United States Patent 9,441,224 (LONG NONCODING RNAS AND CELL REPROGRAMMING AND DIFFERENTIATION) - sequence listing, part 4

SEQ ID NO: 332 - DNA, 259920 bp, Homo sapiens
accatgccagcttctttccccagtgtggctccaagaatgctgacaaccaaactcataatttcaagacaggaacttagaaaaatcctctctgaaatagcaccatcataaaataagagacttcgtaatactgacatttggagatccctaataaaatgactagtcattctgtctaacattgatttcaacagataacaatccacatttatgcacaagaagatttcaattgtctttttagaacctcaccctcaaatatgaatggaaagtcaaggaccagatatctaaacaaagttcctctctccatacactaaaaagctgaataaggaaaaaaaaaaattgacgaaaagagaacaggaagcagaaaataatctcataagacccataatcaatattgttaaataagaaaatattttgattgcattcatgagacaagaacgagagggcataaaaaaggaacattctatgtgcaaaagtattatccaaattttaaaattatgatgccgttacacttttggcaatggtagattgacttgtattatgttaaccttccaatagacagcaatacattctggggaaaaatataaaaacaactatttgaaggcactgggacaacttaaagcaggtagaaactgaaaggggaactgcattgattctgcatctggcttttcacttaaaggctctttccagtcagtctacaccacatgaaacggctggaacgcaagcagaaagctatagtcttacctgatttgaggattcaaaggaaaaaattttgggctgatggaattgctagaaaatcatgggaagacctcagacaggagaaagctgagggcctggaggtataaaatcttcatataaaccccctcaaatccttggctggtcttgattaatgcatgtgcagaggacctggcaaaaaacaacagctggaaggctaaaaaaaatgagtgaagagtttagctcagggaggagtttcatttttgagctcagtcccttgaattgcttgctagaacaaaatcagcagtatttaaagatagccatagcctccacaatagcacaattaaaaactactaaacacatgaagaaacagtggatggaaaaaaagtaagttggagaaagccaaagaaaggaagccgtgaacttgaaaatacatcaatagaaaatattcaatctgaagatgagacagaaacaatattgaaaaaaacctacaaagactcactattctgtgggactatatttaagtggttttaagttatatttaaatgtattctcagagctgtgaaaatgcagtataataaaagatttgaggaaataatgaccaaatttttcctaaattatgaaagacataaatttatagatacaagatctgaactccaattaagataaatacaaagaaaccacacttaggcacattttcaccgaacagttgaaaacataaataaagagaaaagcagccagaggaaaaacagctccattataaacaggggaacaattatacaaattattactgatttctcatcagaaacaatggaggtgaggaaataatggaacatcttaaagtgctgagggaagcaggaactgccaatcttacaatctctacctaggaaaacaatcatcttaaaaaatgaaagcaaaataaataaattttcagaaaaaattgagagagcctgttatcagcagaatggttctaaaagaaatataaattcttcagggtgagaaaaatcagatgaaaatttatagagaaagaatgaagaaatatgaaatggtaaatacttgggtaactataaaggactatactttttcttatctttaaaagaaaatgactaatgaaatataataacaccttctcggttaatgtatatattacctataagataatatcacaaaggatgagatggtaaatagaaacagactgttacatggctctaattttttttttttttttttttgagacagagtctcattctgtcggccaggctggagtgcagtggcacaatcttggctcactgcaacctccacctcccaggctcaagcaattctcctgcctcattctcctgagtagctgggattacaggtgtgtgccaccacacctggctaatttttgtatttttagtagagatggggtttcaccatgttggccaggctggtcttgaactcctgacctcaagtaatcgacccgccttagcctcccaaagtgctgggatcacaggtgtgagccactgcacctggtcacatggctctaatttttaaaaaatgccttcattgaaatacaattcataatacaacctacccattccaagtatacaatgtaatggctttaattatattcatagtagggtaagaatggaaatggcagccgggtgcagtagctcatgcctgtaatcccagcaccttgggaggccaagttgggtggatcactggaggtcgggagttcgagaccagcctggccaacatggtgaaaccctgtctctactaaaaatacaaaatagtcaggtgtggtggcacgcatctgtaatcccagctactcgggaggctgaggcaggagaatcacttgaacccaggaggcggaggttgcagtgagccgagcttgtgccactgcactctagcctgggtgaaagagcgaaactctgtctcaaaaaacgaaaaaaaaaaaaaaaaaaaaaaaaaaaaaaaaagaatgggaatggctaatattgaatttaaaattgttttcaatgccatgatgtaaacacatgctccaattcacatccacaaatcttccccagaattgacctgggaaacacagattagtcattgcatataagttgtggttactaagttaagtctacttcaatcaagtcttttaataatctagattcaagaattcaggaatttggaattataaaaatgttaacataaaaatagggcaaaggatagaataattaaagtttctgtaataagaacctatatgggaaaattaatatgtataaaaatttcccaataaaaataaaatttttgtaatgacaatatagtttgaggctgatcaacaacttgaataaccactacttgttgataggatcacaagtgaggactggatagatgtagattatatttctatagaagtcgttaccctaccaaattgcaacttggcattaaacaagaaaagttacagcttttcattaaaggtactcaaataaattcattgtttatcaaataaatttctacttagaggaagacaatgctgcatagtaaattgtttctcaaacgtaagaactatacagaccctttaaaatgaaattctgcataatcttaatgttatattacttaaatacatggaaacataaaatcataaagttaggtttaatgcattttcttaagctcttataactataaaactaaaataaattttaaaaaattgtaaaatcagtatttaaataaaaatagtatgataaattattttgttttactaaaattgctaatgttaggtttaatgtaaggtggtatttcttcaggcatgtgtctatagttaaatttattatttggtgttctatatttctaaatttaatatttttaaattttcatgttactactgtggacactgcctctttacagaagtatgttttataaaatggcactaatgttcattgagttgtacactcaagatttctgtactttaataagttaaacctttatttaaaaaatagttttcacaatgtaaaggctttgtttgatagtacagtatgatcagacttaacaaagtcctgctcagaaacaatctttgaatgcctattttaataaggtgtctgtattagtccattttcacgctgctgataaagacatgcccgagactgagcaacttacaaaagaaagaggtttaattggacttaaacagttccaagtggctgggggagcctcacaatcatactggaaggcaaggtggagcaagtcacatcttatgtggatgatgacaggcaaaaaatgagagaatgaggaagacgcaaaagtggaaacccctgataaaaccatcagatcttgttcactaccaagagaacagtatgggggaaaccgccccccatgattcaattatctcccactgggtccctcccacaacatgtgggaattcaagatgagatttgagtggggacacagccaaactgtatcagtgtcattgttaacattatagaacttttatttaaaggtaagtttaaatattcctattatttcaatttgcattaaataatctgatgggatttggaacagggtatttggcaccacagaattgtttcaaataggcacatacaaaaatatggtctccgcaatacaatgactatttcaaattcaagatggtaacaaagacagcagtgttcatttgggttcatgttgcctttactaccacatgctatgttacagatcaatcctctttaaaccactatgggaccttcagttttacattgtacgatgacattttttgcattctcttatctagccaaacacaaccaaataattgtgtttctagagaaaataccaaataattgttctggaatgcagggccatcaacactgctcgctgcagccttgacctcctggggctcaaacaatccttctaggtcagcctcctgagtagttgggactataggcccgtgccactatgctcagctaatttttcatagagacagagtctcactttgttgcccaggttggagtattttgttataagaggttactaagattatttgcattatcattgttaaatataattaaaaagataaaagcacaattttaaactgttgaatttttttttatagcacttgtcaccttctaacatattatatattttacttctttatttgtttattgtctatctcctctattcccacaagaatgtaagctcatttaagctcagggcagcaacatttttcttttttcataatgtatctcaagtgcccagaacagtgtccaacacataataagcactcagtcaatatttgttgaaagaataaaaaactttgttataagatgacatctggggacatcccagcctttcaggattcctagattgagaaatgctggaatgaaggaaaaagctttggcttagaggcttatgtcttagctttctagttttactcagctgcttactacctacataacatggggcaagttattatacttaaactcagggagtctgattttgccaggaagatcagtaaaatgtgaagtcagtttaaaattgggataatggttaatatgtaaaatatataaaataccagcagatatggtgatcatctttattatattagagatatcatagaaaaatatataatcaagcaaaaataaacttttccatattatcacaatttttccctcccttatttcatcttattcataaaaacagaaaataagaaacaggttcaggataaacaaaaaagcaaaaaagaacagaatccaaaactttcaccaaagcagctggatgaaaacactggaaaatgttttcctaacaatcctttgtcagatgttgaaagagctgtgttataatagagttataagataagctgaaaacaaagcatcaacaagaaaatagaaacgcataaaacatgtaaaatagaatagagatcactgtgtgacctcagctgcatgggagtggtttttctcccccatcattcatgtacactttatccgcccactttcttcctacttgtaagctcaacttggctcatcaggaaccttaaccctcaggccaaccctgaaggaagaattaacctgcttattgaacccttaggcagtgtgcatggccaggaagcagggtatttggagaacacagagaggtgatctcagcattttactgcaatatcccataaccgctgaaggaagaggttaaaaatgacttatattaagaaaaagcagtgtaaatgtgtttattggtttaaattttgctgtcaaatggaattctcaaaatactttggaaatacaagtagatttaagatctgttttaggtaagccttattttaaaaagagagaataaaatattacttacttattagcaagggacatatcattagtattcacagttaagcacacactaaaaagcaattttggatggctaaattcagtcttaacccaagccatgttccaacaatgcaaacaggtattggtagataaaaatggattttcccttcaacatcctaataacaataaaaaatagttaaatatgatatacactcctgaaaacaacccaggtgttaacagccaagaaaactacgtgactacttgtcacctagttctgccagtgtgcagtttgctgatctcctttaatcttaatgtacagtaaaaattatcttaaacagtctccacataggtgattcattctatcacccagcactatttgctcttttttttttttttgagatggagtctcgctctgtcacccaggctggagtgcagtggcgtgatatcaggtcactgcaacctccgcctcctgggttcaagcaattcttctgtctcagcctcgccagtaactgggactacaggcacctgtcaccacgtctggctaattttggtatttttagtagagacagggttcaccctattggtctggctggtcttgaacttatgacctcaggtgatccaccagcctcggactcccaaagtgctgggattacaggcatgagccactgtgcccggcccatttgctctttaaaaacatgacatatccaccttgctgaaggttcatggctaataatctattctctagtatggccagatactctttcctctagttaagtagaagcttactaaagataaattgtgtttgtttccaatactgtttatgcctgttttatttgttacttttattacacaatctaattaactacatataaactgataaaatatgagtgcagcaaaagaactgtagcctataaaaacagcaacaaactaagctgaatgcttcaaaaggactcaataaagaggtcactaaaaattaacttgtggatgagacattgaaaaagattggaacaactgtcaatatttaaaagtattctacatttaaattgtttcaaaatgtcttcagtttctttctccaaagaaatcaaaatgggaaatcatacatcatgcatcaagggtgtgatttttgtgagagctctgagaacaccattcaacaatctaaactcgaagaaaagatcttggcagctttacatctaaggattggtgaataaatgcagttttacgttttaaagaaagtaaaatgcttaagtcttaacattttattagtcccagctataaccgactttttcagttaactgcccaattacaagtcccaatggtattatttaagagggttctactctgttaatcttgattattcctcctcagtctcagaatgttggaagcttcaaatgccaggttttcccaccaccctcaaattctactgaaaggcacctactacaaacattagccattagttggaacttaaagacttctagctaaatttaatttaaaatttcaaagtgtttgtaacaacaagaattacaactgagaatattaagcaggaagaaaaggaagaataaatgggtgtaccaaaaacacagctttcaaagaaagggcagaaggaaggatgaacatactaagaacagggacagcaaatcaaaagcaaacaaaataacactaaaagatggatgactgattgaatgaaagctgaagatactcttataattattgttatagtgaaacaggttcatcaaatggaaaatggttaaagtacaatgcatttattgtgtggaattctatgtacagtcatgcattgctttatgatggggatatgttctgaaaaatgcattgttaggcgattctgtcattgggcaaacatcatagagcaggggtccccaacatccaggccacagatgggtactggtcccatcagaaccaggccgcacagcaggaggtgagcggcagccaaggcattactgcctgagctccgcctcctgtcagatcagccacagcattagagtctcacaggagcatgaaccccattgtgaacagcacatgctaaggatctaggttgcgtgctccttatgaggatctaatgccctatgatctgagtggagattgtgccactgcactgcagcctaggtgatgcagtgagactctgtctcaaaacaaaaaaacaaaatagaacaaaaaaaccccataaaccagtaacatagtcatttattatcaagtattatgtactgtacataattgtatgcactatacttttatacaactggcagcacagtaggtttacactagcatcaccataaacatttgagtaatcattatactatgacgttatcactaggtgagaggaatttttcagctccataatatgcaagaatcattgttgtatatgtggtctgtctgtcattgattgaaatgtcattatatggcgcatgactctggctgttaaaaatgagacagaggctgggcccagtggctcacacctgtaattccagcactttgaggggctcagttgggcagatggcttgagcccaggagttccagatcaaccaggcatgatggcatgtgcctgtaagtcccagctacttgggaggctgaggaaggaagatcgcatgagcctgggagatcaaggtggcagtaaaccgtgatgatgccactgcactccagcctggtcaacagagtgaaaccctgtctcaagaaaaaccaaccaaccaaccaaacaaaaaaaccccagaagacagatatgtagacataggtatgaaaagattctcatgttttattattgagtaaaaaaaaccccaagatgctgaaaaataaatacgatcccatttttgttcaacattttgcatatgtagttgtcaatgcatagaaaagaatacaaagaaagctgtcagcagtggctactttggagacttgcaatgggcatagtagggaggggtatactttttatagggttcattttcacacaatattttatttcctaattaagtaacagacattcagctttggaaaaggcaatagtaaatgttgtatgaaaatgtaagaacagaattgatggctatagaaaaactactttatatctcagtttaaatactttggatattgttaatgtttctaggtctatgaattctggatagtagaaaaatagcgtgaaacacctttttcaaactggaatggctaagaaagcctaagggaatgctctaaaataaacagaataatgaaataaatgttggtaactacatctcaactcctatgtggtatttctagagcactataggggatttcctttcatattattcagtcagagatgtgtcattttatcaattctattacattttctgttttaactgtcatgcctttgaacctttcctgctctgatttctgctttgcatggaaatctgttatctttctagttgactttggtggatatcaatcctcttgagtctctctaagccttcagactaaagtttttaaagttgtcttttggctgggcgcagtggctcacatctataatcccaacactttgggaggccagcacaggtggatcacttgagctcaggagtttgagactaccctggggaacatggcaaaaccttgtctctacaaaacacacacaaaaaaattagtcggttgtgctggcggatgcctgtagtcccatctactcgggaggctgaggtgggaggattgcttgaacccaggaggcagaggttgcagtaagccaaaattgcaccactgcactccagcctgggtgacagagcaaggctccatctaaaaaaaaaaaaaaaaaaaaaaaaaaagttgctgtttccttcttgcatcatctacattttctctggaatcaataattcatttttctattttcattttcattttactgatcttcctcatatatctggtgatctttacgtgtatgttcatgtttataaatgaaggactaagttgttcatgacaggtgatcatcatggatttcttgtacctctgttgtagtcgtgtcgtttctccagcaggatacccctcggtgaactggcttactaccacctttgattaagtggaaatggcatgctgacatacttaaggtccatgacaagcagccataaaggagtctttgccacagcgctgtaaggcacttgtatatgtgagaagcccttagtatatttatagaggatctcctactagatttaaaaaacagttattgtagtcttaatacagctacaaaccttgtactgagatgtctgtataggaagaaggggttgcctttagtcatcatgtctttttagtctctaccaatcaatgacagtttctcaatctctccttgttttctcatgaccttgacactcctgaagaatactgatcagttaatttgtagaatgtccctcaatttggttttgtctgaaattcgctcatgtttagactgagattattcatttttgccaaggtgaaaggttaaaaggcataacagctaatttgtagaatgtccctcaatttgattttgtctgaaattctctcatgtttggactgaaattactcatttttgccaaggtgatgttaagcccaagttatgtacataacatgatgttaagtacataacatcaggagatacctgatgtcaagatactggttaatattaactctgaacatgtaattaaggtggcatctacctgtttttccacagtaaagttattattttttcctttgtaattaatacatatcattcatggatatatttgagataagattttttaaaggaaataaataaaaaataatctttctcatcataaataacaattttagcacccatagatgattattgcctgtaaaaatgatttctgtatttaccaaatggtgattttctatttccattatttttctgctgttatttattagaatttactataaggacaagctgtgtccttttgccttaatttatttattcaaattttttaatcagtatagactcaatgatatttaatactataggttttaattcattacttgtattatataatctactcacatggggttttaaaaattactttttatgtttgattttgaatataattgtgtattactcagaaaatacaatttgagtgatatcaattttaggacatttattgaaatttctttgtgcaaagtatgtggttaattttgtaaatattctttgtatgcatgacataataaaattctttgtttgctttagtcttcattgtgaagtataaaacacacagaaggtacaccaaataaaattaaatacttagtgaattattataaagcagactcctgtgttactaccacctaggtgaaaaaacagaacctagtgacagaaaagcctcccaaataccagtgccaaccttcctcctgaagaaaaccaatgccttgatttttttgttttgtttttaagagatggtgttttgctatgctgcccaggatggagtccagcagcaattcacaggtgcaatcatagtgcactatagcctccaactcctgagctcaaacaatcttgcctcagctttctgagtagctacgactataggtacacgccagcacacccagctaatgctttgatttttaggttaactagttccctggttcttctaataagtttaccacctaagtattcattactaaaaactatagaggtggctgggtgtggtggctcacgcctgtaatcccagctcttagggaggccgaagtgggtggattacctgaggtcaggagtttgagaccagcctggcaaacatcatgaaaccccgcctctactaaaaatacaaaaattagctgggcgtggtggtgcacccctgtagtcccagctactcaggaggctgagacaggagaattgcttgaacccaggaagtggagatcttagtgagccaagatcgtgccactgcactccagtctgggtggcagagtgagactccatctcaaaaaccaaaaccaaaaccgaaaccaaaaacactacagagatacaagatgtattatgaaaacatgattaatcaattaataccaaagtaaacttcacaagaaatactacgagtcaaagaaaaagatttcataatgataaaaggttcaattcactaagaatgcattacattcctaaatgtgtttgcatctaataatagaactttaaagtacatgaaacaaatatgacaaaaatgaagacaaataaaaagtacctgctcataactgaaaattttaagtcattcctcagtaattgatagaatagacagcaaatcagaaaagatacagacgtgaacaaccatcaactagaatcctatgcctaacaatcgcaaaatacatgcttttttcaaatgtatatagaaaagatggtatctcatcgagttttaatttctattttcataacgaatgagcataaacatacctttatatgattattaactacctggctattgtagatgctattgttgctctgccccagatcttgttaaccaggacattgcaactatacttcaactgccgatagcagcttacatttgcctcttataagattgtcgttggctgatgggagcaccacctcagccttcagaagccactttgcttggaatggctaggatatgccaccccaccagaggtagcccagagccaatgaatgactgatgtgggggtacaacaggctagctagctaccttatgtctggtaaggacaagctttgggatacaatgcatgctccagagctccctattggatgaagctgaggctagacatcttctgaaaccctatctttgcttaacttcttccctgtcctatcctgtttcatttcctccctcacaagaatctcctgaaagagactggtatcttaatatatcactcatacaaaaattgctgtttagggctctgccttttgacaatcctaactaggatagttgctaccagtagtgatcactggaaaaatagtatggaaaaggttgtggagtccctggcaggttgttgcagtgtaaattataagactttcacctacagtaaatggggatgtgatacaatgcagaaagatggtattagcctgtgtaagagagtaggtattaggacggtgaagctgggtaattattgctgagcaccaatgatttaatgaagaaagagaatgacaagttaggtcaattaaacaccaacttacagtaaagaataaaaattaaaaggcaaacacggtttaagaatagaaatgtgagttaatggtaagaggtggcagaatttaagagaaggctactttctcatcccagccaagttttctatgccaaagttaagttcctgatagaaaatattactttgaatcttgtgggcctgtggaaggaaccctttgttcctcgttagcatataggagctccatcttccctatgaccatgcagagacttcaaagtaccctacagaataatgctttcctttcttagagcctaacctcaaaaccttggccattagaggaataacttgtgtcaaatctcgacgtagccccatgggaaaatcttggatctgctaagggagaaaggacatttaatgtcaatagagcggcagcacctggctaataagtactgcagaaactggtggagtatgcctgggagtaaatcctaagggtgctggaccaggggaagtataatgtaatgcggcttaatgaagaaacttttccataactctgacttaacactctgacagaggccctcggaatcaggtttttacttttatttatttattttagacagagtcttgctctgtcgccaggctggagtccagtggcgtgatcttggctcactgcaaactctgcttcatgggttcaagccattctcctgcctcagcctcctgagtagctagcactacaggtgtgcatcaccacgcccagctaatttttgtatttttagtaaagacggagtttcaccatgttggccaggatggtctcgatctcttgatctcgtgatccacttgcctcagcctcccaaagtgctgggactacaggcgtgagccattgagcccagcaggaatcagtttttaatacactgatgcggtggttcttgtgtacttcaaacaagtgaaagctctcattaaatagatatgttaactgatgttgtaaactcttcagagcataataaaaacctcagaaaagtggggatgcagaagtggacatgttatatgaagctaaaaaccagcttatgatgttccctggaaggatctgcaagttgcttcatttaccagcatcaatgaagagcttagtaatgactgttctgtagatggggactttgaaggtgatggtgttacaggactggaatctcttctaccaatgtggatgacacgatccaggaatagcagagattgggtgccagcacttaattatcaggtgcatgatggaaatgtataccacaaacataattatataatattttacatatacataaaacttatattcaaaagagactgagattagatgagcaggaagatgaagtcagccactatgaaaagtcataatcctgtgctcagtttccacatctaacttagttctgactcagaattcatcaactaaaagagaaactagggtccacttgttgccacaagacagcaaaccaatatattagtggctaatttcatctttctgggatctggttctgcgaggtctgaataatactgtcatattaatatactgactccagctttcatttcattagtgttaatatggtaatatctatcctccccgctttgatttttaaactatttatattttaggtggtttggtggtaggcagcctatatatcagtcttgctattttttaatgcaatctgagaatatctgtcactaaataagggaatttaggccatttacatttaacgtgattattgaagattaagtttaaatctattattttgctattcgttttggattaattgaacatttttggtaatttcattttctcttctttgttagcttattaaccataactgccatttaacttagtttttaaaaaatcagactttaatttttagtctaccttcaagtgatattattgacattatgccactccatgtatagtataagaccttataatagaatcttccatttgttttctttaataccttttatgctattgttgtcatgagttttacttgtacatgttataaaactaatacattattattattattattttgagacagagtcttgctctgtcacccaggctggagtgcagtggcgtgatctcggctcactgcaagctccacgtcccaggttcacgccattctcctgccaagcctgtagttgggactacaagtgcccgccaccatgcccagctaattttttgtatttttagtagagactgggtttcaccgtgttaaccaggatggtcttgatctcctgacctcgtgatccgcccgcctcgggctcccaaagtgctgggattacaggtgtgagccactgtgcccggcccattattattatttttgctttaagctataaattatttttaaatgtttgtaataataaaaaaagttttctaaattcaccaacataattaccatttccaaggacttttattgatgtggtataatttctcttttgcctgcagggcttcttcaatatttcttgtagagcaggtctgctaatgatgcactctttcagcttttgtacatctgaaaaagtttgtttcactttttttttttttttttgagacagagtctcactctattgctcaggctggggtgcagtggcatgatcttggctcactgcaaattccgcctctcaggttcaagtcattctcctgcctcaccctcctgagtagctgggattacaggcacgtagcacattcttgcctaatttttgtattttttttttttttttttttttttttttagtagagatggggtttcaccatgttggtcaggctggtctccaactcctgacctcgtgatccacctgcctcggcctcccaaagtgctgggattacaggcgtgagccaccgcacctggcctcacctttgcttttaaaagatatttttgctgtgtataaaattttaattgaacttttttcttttgatactttataggtgtttctccattgtcttctagcttacattgattccaatgttttctgggtgttatggtggatcatttctatgtcttcactaatctcttctgaaatatccaatctcctgtcaatcccctctagtggtattcttaatctcagacatggtagctttttactctctacaagttaaattacaatctttatctttcatgtctctacttaacatgtttctgctttactcagttatgacagctgtttaaatgtcctcatccactaattctatcttctgtgtcatttttagtcttgtttaattttcctccttgttattggtagaaaatattttatctcagtatgtagcttattttttcatttactttttgccattcaagtagtagaagttttcaattttgctgaagtccaacttatctaattcattcgtggtataagttctttccctgccatctacagggaaatcttttgcctagcccaacgtcacaaaacttatgttttcttgaagaactattttagtgttacgtttttattttattctaatacccctttaagattagtatttgtataaataataaggagtgggtcaagtctctcattcacatggttccagcactgtgtattaaaatgactattctctctacatcagattgcctttgaatctttgccaaaaaattgcatgtcaatttctgggctctctaatcttttccagagttctttacctctatcattatgtaattatcacactgtttgattactgtggctttaagcaacattacgaagctaatgtgagtcctctaatgttctttttacaaaattatcttagctattctattgcttttctttatacattttagatcagcttgtcaatttctagaaaaagattgttgggtttttgatgaagattgaattaaatttcactatatatcaatttaaagagaaattacattaataatattgagtcttgcaatccatgagcatggtatttctaatttgtttcttcagtttattatagttttcagtatgtaaaccttgaacttattttcttaggcttatccctaaaatttcatgctttttaatattattatgatgtacttcttttaaaaatttctaactatttattgctagtgcatttttgaattttgattttgtatcccatgacattgcaaaacacatctattagttctagaaactttctcataaatttggaattttgatgcagacaatgataccatctgaaaataaagataattttatctattcctttctaatctgtaatcctcttgtatagatacctttaattaggcaagggaagttacctattattccttgttagcaaagatattttatcaggaatggatgttaatttctatcatttttaccctgcatccattgaaatgattattaaaataataacctggtgatatgatgaatttcattgattttagtatattgaaccaaccttgcattcttggaataaacttggtttggttgttatttctcattcttttgacatattagcaaatttgattcaatttgctaatattttgtgctttttgtgtctgtgtttatgagagttattggtttgtaattttctattcttatactgtctttgttttttggcatcgggtaatgctgacctcatcaaatgagttgggggagtgttcttcccttttctatttcctgagattgtttagaattggtatgatttcttccttaaaggttggtaaaatttgtcagtgaagccactgggcatggtattttctttacaggaaagtttttaaaccacaaagtcaatttatttaaagacataaaactattcaggtttagtttacttgaatgagttttggtagtttgtgtcttttgagggattcgtctatttcatctaggttatcaaatgtattaatgaagttgttatttatttttattatccacttaatatatgtcagccttagtgattgatatccaaactctttcattcttagtcttggtaatttgtgtcttctcacttttttttcatttagtctggctagatgtttactgatttttataatctttgcaaagaacaagcttttgagtattctgactttactctttttctattttcaacttcattggtttacgttcttattatttctttccttcttcttgctttgagtttaatttgttttcttaagacacatattattgactcaaaactttctaggtttctaaaacaagacactaaaacttattttcctagatgcacatctttagctgcatctcagaaattttattctcacttgcatttaactaaaaacatttaaaaaaaatttccctgtgactgcctctttgacccatgtcatttagaaatgtgtttaatttacaaaaatttggtatttttctatatatcattctgttattgatttctagtttaatttgtttgtggtcaagagatgatattttgacttgaatacatttaaatttattgattttttaaaaatggaacacaatgtgctctattttagcaaatgttttgtgtgcacttaaaaataatttgtattctgctctcgtcagatgggtcatttttcctgttttcttaaatggctattatttgaaaatgaaactttgcaaaaagaaggaacgtcacataaggttggattcggaaatctgaagtagttatccatataaacttaatgaagtacctgtacacataaattaataataacataagagactaggcaccatcaaacgaaagcagataatgaataagttacctcttcacatgcttacctctcaatctgttcccaattgagccaataacccattctctatactgtagtcacactgggcttatttttgttcttccaagtagacatgttctttttctgcatcaggatttactgaatataatcgctatctgaaaaatactccctctttttgttaagttctcttcaactttcagacttgaccttgaattcactttctttagaaagtctttttgacgttccctccaaggattatgtcctctttgttaaggatcagtggtttgcactttcctgatggtctgtacctctctttcacagaacttatgattataatgaaaactataaggacagattagaccacattatcaaagatgttatgacttctcaaaaggttcagaatcccctactcaaaaaagtcagcacaatgagacacgtagtggccaattaaactcacttaactagaatctgatttttactggatataatttctcctgtgaagactattctgaaagtagaattataacttcagaagaatattgattgtatgagtattccatatcaatatttaatacatccatgagactattatttataaaatgttacagggcaaacataaaaccaaccaaaatgagaaatcccattcttctgccttctataggtccaggcaaatattaatagataaggtgtctgcttctctaagacattccttgcttaaaaaaagaaaaccctcatacaaagagcaagtttggctcaaataacttttcttttccaaattaaatccaaaatttaaggctttagagtccaagtttcttgcaaattttaggaaaaaaaatcaatgggtgaaggaagtgagaggaaaatctttgcctttcatgtacatttgaaatcttcatttcttttaaatagcacttgatgatattatgagggatcacttacagaaaaatatatagcgctttcctggcaatggaatcggaagagctgccttcctcatgcctctcaggctcactttgtaaattatgtgaaacactcttagacagacactggcactcataaattatacagttcatttgcatattctagtcatgagacgttatgcaaagtgacatgatttgcataatggattcctcttgtcgcttcacttgctgcgtgcttttaaaaaacaaaatgaaataaaatgaaagcatgaaaaggtgaaagcatcaagtccccagccttgcctgtcttcttcccaactacagtatcagtcgctttcattttctagaggattggggggaaagggacaaaaagccaagatatacagacatataaacaaagagctttcatacgaattttgttgttaattacaatgtacccactttctcattgaaatccttcaccataaataacccttttgagccaagagacatcaaaacaaaacaaaacactgaaacagaaaaactttacggaactttttcttaaaaaaaaaaaccaccaaacttctatgtctgtaatttttagggaaggggtaagcctttctttttgtacctaaaaaaaaaaaaaaaaaaaaaaaaaaaaaaaatttaaggtaccagctatttatcattgggaaaaaaaagcatatcatggatgaaagagaggtttggtggaaagattttatccctttctaggtgaacttctgaatggtcttcctgttttgaaagaggaacggagaagaagaaaaacagggtggtgttttgattatttaacaaaatatataatggatacatatattgtaaaggatgaggcaatgccacgtcgacttctatcggctctactccaataagcaggcaacgctccctcagcagttgctagctttgctgcgggctttccctgttcccctgcaccagtgcgaaaagcagagtgtgccaagcggctggcgtctgtaccctgtgggaaaagttaactgtaattcttcggcttttaaaatcaattaacccgagtgttaattaacgtcaagtcgacgggaggaggagaagaagaaggggagggagggagaaaagaaaaaagctgcaagggcggatggcagaagagttggcaccgtgccatccattcaggggcaacgccacagtttcgtgtgatagcagcagcgggtatatgatacggggccctgtatgcgggccagacagtgcggtaaagccaagggagattatccagacccccaggagcgaacagcaagcagcaaccgaaggcgcaagtgccaggattacagcctaggctgctccaactatgagcccttcctcggaccctgggactcggctacttggggtttgggggtcttccacaccacagaggcacaaagctgactttaatcactttttttcctttaaacttgattctgccgcagtggagccagcacagcggatgttttcacacccagcaagacaaaggccgtcgtctccgccatgacactgttccgttccaagcagaggccgggattctggactcctcgaaaaatcaaaaagaaacaaggaaaacaaacaacaaatacagcaacaaacagaaaaaactgaaaaccaccaaaatcgtttgcccgtttgcccgtgccaggggtgatctgggcatctgttgcagcagaaggcgcttgtgtggggctaatttttcttttggtgggggggacaagctgttggcttgtttgctatttcaacttcgtttataattaacttaaaaaaaaccccaccattcagcctagtcaacaacaaacaaagaaaaagcagacatcggaagagaaatgccataggaagcggcatgaatacatgccacagccggtgccacttgccactcggaaaacctcagggaaagatgccaattctacagctgcgaagaaggcagagaaaggaggataaaggtctacaactagaaatcataaggaaagaatactgcttgtataatcctggattgcaattgcacacagcctctgctgggagaagagagggaatatttaaatggagatatagatgggtataaattaaaagataggcacctatcgattgcgtataaacacatgtgtaaggttgtatgtgtatataaatatgcatattttcagacaaacgtttagatatgtatatattttgtgctacaggtatgggtatgtatataggtgtatatgtttatgcatatacacacatatgtaggatgtatgcatgtgtgagaaaaaggagggagagagaggagagagaaggaaatatgtgtatgtgcatgtatgtgtatgcatacatcccactttttgacccaggtatacacagaagacaaaataaaaatcatactccagcagcaagcaggcagccagagatttatctacattcactgctatcaccagggagatgaatggggccgatctgaagcccttttacaagatccactatgggagtgaaggaggaggagggatgccacacagacatgcacaaacttgaaggcagagcgatttggaaggggctactgaggaaacactggtggcataacgcaggggagaagaaggggaaagaggcttgtctctctctctctatgttttaggtggttgtttttaaaaaatctgcaaaagggtttcagggaacggctggtacttacgttgtctgcgttgctgtggatcctgaaaggtgttctgttggcaccgggcgctgagccaggggcaggcgctggaaacaaaagggagagacaaaaaaataaagtgattcaatgggaatattaattgctgctcttgtggattttacaaaacacataaactgttttctttttctttcttaaaaaaaaatgtggattggcgcgtgtcccttttgcatggaatatacaagtagtatgggatttacagcccagttacgggactcaggattagctgcgctggcatcttttgggcatattcttccttttaatgaatgagctttcgctgttaatgaggaataatcgtttggctaatgagctttgaaacattaagagaaaagaggttttttccgttaatcgctctggtgcgactgcatggatggattacaaaagacagcaataggaacgcagtacaaagggggggacctctcctgcagtgggagaagcaccgagatgggtgatgtgtccctgcgtctttccttccttctctctttcgctctctctgccaactgctatgggtttccataactctgcaatcaaagtggatggtcgggaaggattattacacagagtgaagcctccgctgttaatgtctccagtgtttaatcatcatacagtagaatggttttatgcatatttcatttgcatatcattaaactgtgttagtgaggggcattcagaaccaggagaagtacaaagttggggagagagggaagaaaaaaaggtccctatgatgcttatcttcaaacggggacttgttccatgatctgtcttctacttttgctaaaatcattatgacttggaaacctttgaagttggatacaaccttggattcttctaattcctgcagagcagtgtattttacaaaacagcagaaatgttcctgcactagacaattaaaggaatataaactccagtgggctgaaactagtagctctttggggaatgcagtagcagaggcttctacaaataccaacacttaaaaatatataataaacagcatcatattagaaacaaagaaaacgaagacaagaaatattaacacgtggattatatttgtttcttttggggggtaatgaactaaagagaatgaagaagccatcggtaatttatcccttcattaatgaacagtcacctttttgtatgtgtttgtttttgtcctttctttttgaagagggatgttgttacttttgaagcaattagtcaattattttgtagctctgatcttttccccctgcacccgacaggacagaaaggtggtggttagggaatatgtgagtacttggggagggggggacttggtggggagagaaagaatacagtgagttctttgtagatcttatacatgcacaacatattaattgggggcttttaaagctccctcaatgggctatttcattcctggtaaaacagcagctggttagccactactggtgactcttcaaatattacttcatttttattctgtcgccgttgttgttgtcttgctttgtttttcctcagttaagaatgaaaatgtagtatcaccccctctttagtgagtctcttctccatcttcttcactccaatttccaaactgtaaaacaatgttggcttaatactgagtcctggtgcacagtctaactggcacaacttgatttggaaatgagatgctgctttatatttaaattaccccggctccccccttatcctccaaagctttgtctctgttatgaatatgcagatgaggcctgatgtgattacactgtacaattactcctatccatggtggtgtcaggggctgctagggagacagagagtcagacagcctccaagccaatacagagttttgttttcggtatttttcctatctccttggcactgcggcacatgcagatgtcgctgttgttctttataaagccctaatgtatgcaaaagcataacgatttggtttggacgcaaagcatcaacgaaatattatggatgtcttcaagaaagggggagagaaaatcctgactgaaggaatgtccacataaattatttttatttaaatgaattcaaaggatgggatgagggcaagtcagacggagtcgcgtggaaaacatgaataatattaatatgcataaagaattctcaccaacgaggagaagctcctcactacagctcttgggacaaacaggttcattaggaaacagctcagagcgactacagcattttgctatttcaattttttcccttattttaaatgaagagtcagacagatgtgttttctttgcatggcagcattgagatggatccaatctgcgaaatttgctgcccaaatagcatttctaatggaaactggaactaaacaagggcacggatatgggagggaggggagaagagagaatacacgaagaagagtatattcagagccactgcatggcattttgagtacaggaggttttcaggaacgatctttgcttcattagtctcccctgtgggctcctgatgtagggagctatcagggtataccaagatgagcactgagacaggcctttctaggtctgaggctgaggaaagcagcggcaacttggtgcctgtcccccagagctgtctacagttcagaagccaaaagcacagctacttctaatttggggatgcagtagagtgcctactgatccaggtatttgtgaaagatggaattcttggtgctatcatagtatacattgctaaagagcagatgaaatcggctgcttaaggaggcctgataatatttatgttggttaattctcatgataatgataactgcacttgtctagtattttcagaatgttaaaattaccagtgtggcttaatgcatgtttacaataaatagagagggacaaagagtgaatgagcctattgggtggattcaaaactgataaaatatttggactattactcatggtctccaaggattaacaaagaaagtcaaagaagcagtagtcggaaaaaaagagattttgttacttcccttgggcaggtggacagagttcaaattactttcataattcagctaaaagaattttatacttcagttgaaattacatgaagacatttttgatctgatatacatatctgcataaatttctattatgacatcataacgttgacctggaactggtctgattataagcatgttctaaatactgttgctcttcacctataatctctaaaacttccatttataagtttcttttaagactccccctccaataatttccaactgttacacgattctcaactgttggtacagtgtacaaaactacagagtacagtgaattgatgattatttggagaatggctatttaatctgaattattcatatttaacctcttatactttccatctctgttgccagaattacggatatagaattttgaaagaatacatgtaaagaattaagcacagtatctgcacataacaagctctaaataagtgttagattttattactgctatcattactattattacttcagtgtgttggttaccatttgagagaaataaggaaaagaaaataaaattcaatttaaaattcaacctttactttcactattaaatagcaatgcaggtaaaaggctgagtggaaaagcattaaatagatattcatggtgaatagactgtgaatgatctgtaatcagaagtcaaactacagcttatgtcaatgcacactagacccatgaaagagttccattaaaaatgtatgtataattctgaaattttcatgttgcatgacatgaatagtctgataagagagttctatcgtggttggtatggagggttttgggaactgaaaggtgctcattatttaactacaatgatgaagcaatgccaactttcagtctttttttttacaaaaataagttatatttttgaataagtaatacattacaatgaagtatcaataatttaaataatgtagaaaggaaaaggtctctgtcttttccctcttctacccatgagttcctcacccaacccccaaataagtaatcactgttactgttttcttgttcattctaccagctattaatatattaagaagatattaatatagtctctctcctatatcttacacaaatgatactttttaccaatattccttagaattttctgtcaacacaataagttcatttgtgactagacagcttcatttccagtaatcgtgccaattattcctttttccttatttcattggtgaggacatctagtacgatgttgaatagaagtagtgataggtgagtgtaaacatccttaccttgtttgcaatcttaggggatgtcactgtcttgttcatggtcttaggggaagaagaattcagcctttcattactaagaattatgccctttatcatgtgaaagaggtttccttccatccttagctaacaatttttcaaaaaatcatgaatggttattaaattttgtcaaatcattttcagcctctattgaaacaaataacagcttaaagctgtgagtatagtgaattacaatgactgattttcatatgctaaaccaacctggcaatcctgggacaatgccccattgatcatgatatattaatctttttgtatattgcaataattgacctgctaacattttgttaagaatttttgaatccatgtgcatgagagacattagtctataattttttgggggatgtaataactttgacattgttatcagggtcttgctaatagcatagaatgagttggagagtgtctccctcctctatactctgaaaaagtttgtataagattattattttgtccttaaatgctaaattcaattaatcagtaaagctatgaggcctggggatttctttgtggacagttttcatataacaaattcaattttttttttttttttttttttgagacagagtcttactctgtcacccaggctagagtgcagtggcatgatcacagttcactgcagcatcaacttcctgggcttaagtgatcctcccacctcagcctcctgagtagttgggactacaagtgtatgccaccacacctggctaatttgtttttatttttattttttgtacagacagggtctcactttgttgcccaggctggtcttgaagtccttgcctcaagcgatcctcctgcgtcagcctcccaaagtgctggtattacaggcatgaggcattgtgtctggcctacagattcaattttagaaaaatgatcttggattattcagatttctaatttatgttaattttggtaagctggggttttcaaagaatttgtctatttcaccttagttatcaaactgattggaatacatttgttaataatatcctattatcctttttcttatctgtcagaattttggtgatgtccttatttcatttgtgatattggtgatttgtttttttccttcagctttttaaaatcaattttattaatcttttcagagaatcaatctgattgttaatttttttatttcaactcccaattttataatatcctttcttctatttactttgagtttaatttgcttctctttttctagattcataaggcagaatcttagataattttacactttacttcctataacagatgtgtaaagtgatatattttcctctaacaactgctttagctgcatcacacacattttcataggatgtgtattcattctcatttagttgagattaaaaaaaaattcccttgtcattttttaaacatgttaagtatattatttaatttctaaatatttgttttttttctaggtatcttattactataaatttccaacttaataccactgtttcagggaaaatattctatgtaattccaactcaagacttgtatgccccaacataaagtccatctttctgaaattccatgtgcatttgagaagaatccactgttgttctgctgttgttgattttctcagttaaacatttgatttccattcagttaatttttgttcttattattttttgccttctactttctttgggcttcattttacattttgtttctagcttcttgatgagatatttatatcatgatttttcagctttttttccttttaaacatgtatttaaaggttatacattttcctctaggaacagctttagatagaaccccaggttttcacgtcatgttttgattatcatttggttcaaaatactttctaatttataccatagtttcctcttttgcctataggctattggattcgtcttttatccagtctaacaacttgtctttcaactgcaaaattgagtcaatttacatttaacataattactgatatattttgcattatatacatatcatcttattgtttcctatatgttctgcctgatttacgttcttcaaaatcttttttgcatcatttataattaatcaagtccttttcttattacattttttctcttttagtttggtagtaacacattattttactattaagtggtaccctaaatattgcaacatacatctcggactcactatagtctattataaattggtacttttgtcacttcccagacaatgctagaactgaaattggtattgttttgtttacttcctcccaccttttgttattattgacatgcatctcatcattcatatattttaagtctcgcaagatattttcatttttctattttgcagtcaagattcattcagactcactcacatatacaccttacgcactgctctgtgtttcttcttccattttgacatttccttctgaggtcatgtttcttctacctaaataactccctttggtgtttcttttaggttgggtatgctgctgataagttctctcagtttttgttttcttacagttattttcatcttcaattttcaagtatattttcatggagcacagaattctagattggcagttattttctttctgcttttaaaagatgtcattccattgtcttttgaacgccatcatttcgttgagaagtcagctgtcagtcttattgctgcttccttcaagtagcatgccttctttttttgtcttcacttaagattttctctttcaacttcagaagttttactaatgtgcctaggtgtgattttctttgtatttatcctgcctgggatatctatggcttaatatctttcctctttttggaaattgttagtccttagcagtttgaaaattacctactgcaatctttttttaccttgtaggattccaattacacatacattaaatattttcaatgtatctcctatgggctttatgctgtttattttccagccttttatcccttcatgttttggtttcagcattttttaactgatctagcatactcaacaattctctctttatttctaatctgctattaagcctatttataaatgtcttaatttaagttgctgtatttttcagttcttgaatatacatttaattcttcttttgtaagctgcagttcttttgttctccaacatattatcattttagagctatttaagagccatatctgataagtatatctgatccacttcactgtggatctgtttctgctgtctgcttttttcccccgttttggtcctgtgttttgctattcctagaaagtactgaatggatgccagatattgtgtgtgaaaaattttagaagttctggaagatatcttcttttgaagaaaaattaccatatcacctgggaggtagcaggatagaacaagggcagattacctcaatccaataaaagagtaaattggctttgaagctaggttatagtctttttaagacttacgttgcatctggttcatctcatctcttaggtcccatttccttgacagaccctgacccctgatttttgtcttcccagcactatgagattactgaaagctctactgggctttcagtagatttcgccttaggatcttattctggaaaagacaaaccgaaactctgagctatactcttattaaaaaatctctctgaaataataccatcaaaaaagtgatgacatttgttctttgtgaacctgtatttattcctagtaatgaaactgagaataatttctcctctgattcagacttttggcatccctcccaaactgcattttttttaaatctgcaattccttaagcttaactgcagatgtaattcttcaggatcaatggcaaattatcacagtacctatgaaaataataagcgtgggacaggagacttgaattccagtaatgagttgttctctttcaatctatgtgactgatcctgtgctgcaatcctcactaatcaatgctagttttgtcctttcctaccctagaggctattcttcttgacagagaaagagaatctgaataataattctctctctctccccttccttctctcacttttagtaatctctctctctctctttatttactttttgagacagagtctcactctgtcacccaggctacagtgcagtggtgcaatctcagctcactgcaacctccaccttcaggattcaagtgattcttgtgccttggcctcccaagtagctgggattataggcacacaaaaattgccacgcctggctaatttttgtatttttaggagagatggggtttcaccatattggccaggctggtctcaaactcctgacctcaagcgatccacccgtgttggcctcccaaagtgttgggattacaggtatgagccactgtgcccaggcctcatttagtaatctcttaacaggacatgaaaatcctgcagcgcaagtctctttctttcacttttccctagaagcaacccacaaattcttgcccttatatgctcctccttatattttaaatataatcatttatacctaaatttaatatgaaatcacattggtcttctttacatttccctctcccccatttcctgaaaaggggggtattattttattcatcaattacagacaaacacactgctactttaaagactggttgcaatataagcaataagtcaataactatacaatgtgatatgtgttaggtgcaattttagtgttattttgttatttccatttttttttagctttcttcttcttcttctttttttttagagattatgtctatgaagttatatttacccgttgtctgaaggttttcaaaatctgccttataacgtctatggtaacactgtccaaaagaactttcggaaactatggaaatgtgatttctaatagggtaaccaatagctagtacaatggaccaaatctttcatttaattttaatttattaaatttaaatagtcacatgtggctaggggtgactattgttctatttgtttttaacctataagttcttaggtgttgatcaaaattaggttcatatagtttccctataatttctttcatctattgaggatgcagattattagcaaggcaaggcaaaaatatgcccaaaattcaacttttagtaaaatggattttgagaatgtatttgaatagctgatacacatgattattatatcctgagtctatactttttaaaaggatctgaatcaggatttctagaaatatactacttatttgaccaagcaaattatagcatatccttttgaagcaattacttctgatctctacttttatgcttacccaggtgctttctatcatgtttcttctcaaattcagctcccaactgccattgtatagtcatttatgaatgccgtgtctagtcaagaatgcaatctcatgaaagagaatgcaactaaatggccaactttgagattaacacaaaacttgtaactaattattacaatgcttatgtgtgcttctatatatgtgcagatagatacatacataatgcatgtattttatagatttgcatgaagtagaaacaacattttccagaaggatgaaataaatgattaaatttaaagaattcagtgtaaagaatttagttttatgaagtgagggatgtcctgtattaagaattaattacaggctgggtatggtggctcacacccacaatcctaatactttgggaggccaaggcaggtggatcacctgaggtcagtagtttaagaccaggcctggccaacatgataaaaccccgccactgctaaaaatacaaaaattagccgggtgtggtggcacatgcctgtaatctcagctactcaggaagctgtggcaggagaatcgcttgaacctaggaggcagaggctgcagtgagccaagatcacgtcactgcactccagtctgagcaacagagcaagactctgtgacaaaaaaaaaaaaaaaaaaaaaaaaaagggccgggcacggtggctcacacctgtaatcccagcactttaggaggctgaggcaggcagatcatgaggtgaggatatcaagaccatcctggctaacatggtgaaaccccatctctactaaaaatacaaaaaattagctgggtgtggtggcacacacctgtagtcccagctacttgggatgctgaggcaggagaatcgcttgaaccaaggaggcagaggttacagtgagcagagatcgcgccactgcactccagcctgggtgacagagcaagactccatctcaaaaaataaataaataaatacataaaaataagaattacagaagaatatttaaaagtttccattggtcttaaaaaaataaagaatagcatttaatagaatcagatgttatctgaaagtaaatgaaactagagaaataacatgtggactctcataatatctcccaaatttgagtattgtgcaatatgtgtgttcaatgcatatatgaaatatatgaactgatttctagataagcatttaaatatttttctaatgaaatatgtttgtccatattttagtggatctcaatgtgaagggatgatagttcaggttttggaataatacagacctaggaattctgtaatatatagctctaattatgatgtttcctggcctcaaaaataagttagcagctttcccatgatgtctttttgatagtatttcaagagattaaaggtgccagtcaacattatttaagaatgtcctcctttaaaaactttaattgtaaaaaatttaagatttgaaacagataattagagaattagtcacgttacaaatggattctttacttgttacaggcttcacccagaattaacaagcctctatgggcattaaaaatagtattatgtttttacattttttttgtaaaattacttacaaattttcaggaattttttttttatcacacagaataagatatacctgtctttgggataaaaatacataactatcaacacagttataataaaagtgcttcatattaattcccattataattataccttatatttgtctaggactttacaatgtacaaagcactttcacatacactgtttcttttaaaagaaaggcatcacaagaaagtgaactgatacaatttttgttttcaatgaatagtggcactcttaaaatggagatagaaaccatgcctatcacgttataacaacaacaaaacacattttgctgagcttctcaaaaggaggtatggcaaagcataggttctggaatcaacaggacatataatgggatcctaattttacttacttactagctgtgtgactttgagcaagctacttaacttgtctgtacttcattttcctcatctgtgaatccagaatttggacctcatagagtcagattaaatgaaaaacattttacatatcctaaagcaacgcacagaattgctatgatactaggtatatagtaggaactcaataaataaagatgataatgaaaataatgttacttttattattaagatgatctattttcactgatcttcataatctttcaacaaaacatactacacaaagtaaataattagatatgacaatgactgatcttagatcatagatcaggtgaggaagaaaggtgaaagtctattttggaagcagatgagacactacaccatgggaaatggaactcactagaaaaaaatcgaggttacacctaaactagtttaaatttatgatatttaaacagggtagaaacttatactaaaggcatcacaggcaattttgctttaaggagagtaaaatggaagcccgtttgtgatgtgcatgttaaatgaaagaaaacagaatcatatctgtaaaataagaagtaatatcatataaagtgaagaggggtacagggaacataaggctagaatagtttaatttgtataagcatattagctcacttagattgatcatacaaggataaaagattgacctgaagtttggcataaaaaaactctctgctcctaagcaaaagaccctaatgagtctccttacaaacgtgtgctgtcagttaaacaaggagcctcaacttaaagtgtttactgcttaaagtagcccatcactattattatataaacaattgaaattataggccctatttacataaagttaatatcatctttgcattaacaacatttgctgattgttgaatttgtcttgaagttcttctttcagagtggaacatttactcagaaaattaacattatttagggtctactgcaggcatatctcagagatattgcaggtttggttccataccaccacaacaaagttaatattgcaatatagtgagtagcacgaattttttttgtttcccagtgcatataaaaattatgtttacactatactgtatagtctagtaagtgtacaatagcatgtctgaaaagtgtgcataccttaatttaaaagaccttattgctaaaaattgctaccaatcatctgaggcttcagtgagtcataatctttttgctggagaagggtctcgtctcgatgttgatggctgctgactgatcagggtggtggctgctgaaggttggggtggctgtggcagttccttttttcttttcttttcttttttttttttttttttagacagagtcttgctccatctcccaggctggagtgcagtggcacgatctcggctccctgcaacctccacacccagggttcaagcaattcttgtgactggactgtggcagtttcttaaaatgacacaacaatgaagtctgctgtgtcaattgactcttcttttcatgaaagatttctttgtagcatgtgtgctgtttgacaacattttccctacagtacgatgtctttcaaaattggactcaatcctctcaaatcctgttgctgctttgttaacaaaatttatatattattctaaaacctttgttgtcaatgtcaacaatgttcacagcagactccatctcaagatggagtagattccatgttaagaaaccactctctttgtttattcataagaagcaactccttatccactcaagttttatcatgagataaaacttgggaatattttgaaaggaatctttttttctgagcagtaggtctcaaaagtcggcttaaaatattcagtaaaccatgctgaaagcagatatgctgtcatgtaggttttgttattccatttgtagagaacaggcaaagtagatttagcataattcttaagggccccaggatttttggcacggtaagtgagcactggcttcaactcaaaattaccagctgaccctaacaagagaatcagcctgtactttgaagctctgaagcaaagcattaacttctcctttctggctattaaagtcgcagatggcatcttcttccaatagaaggctgtttcctctacattcaaaatctgttgtttagcgtagtcactttcatcaattatcttagctagatattctgggtaacttgctgcagctttaccatcaacacttgctgcttcaccttgcacttttatgttatgtagatggcttctttccttaaacctcatgaactaaccgctgtaagctttaaatttttcttctccaacttccttgcctctcttggccttcacagaattgaagagttagggctttgccctggattaggctttggtttaagggaatgttgtggctaatttgatctattcagaccaccaaaactgtctccattatcagcaatgaggctgtttcactttcactacttcactggagtagcatttttaatttccttcaagaatttttcctttgcactcccacttgactaagtgtttagtgcaagaggtctagcttttgacctatcttcactttttacatgccttcctcactaagcttaatcatttctagttttttatttacagcgagagatatgtgactctttttttcacttgaacactttttagaggctattgttgggttataaattggtctaacttcgatattgttgtgtctaacatccatatggtcttagggaacagggaggcctgaagagagcaacagagatgggggaatgcccacttgctcaagcagtcagaatacacacaacattgataatttaagttagccatcttatatgagcatagttcatagcatcccaaaacaattacaatagtaacatcaaagatcactgaccacagaacaccgtaatagactgaaaagtttaaaatattgagagaattaacaaaatgtgacacaaagtgagcaccacagacttgctcacccagggttgccacaaaccatcaatttgttaaaaaaaaaaaaaaaccaacacaatatctgtgaagtgcagaggagggtaataaaacaaagtaaacctgtatatgtcaggtgttcatataaactgcataatttttatgcccatattacaggtaaaaaagcgtaggtgaaaagcttaaagtaatagctaatacatcacggaagtagcatataaatcaagattttcaaacttggaaacaaatgttctatccccactctccccacgaattttccaagatcaaatgtacctgattaatggtagcactgaagaaatgttatttgttctggtttctccaatttttcctccctgccttagcacaagggagttcacaatttgtagggttttataaattatattgaaataccatagacaaataatagtagcttgcttgaaaacacactaacagctgtgcagggcacacaacaagcactcaataagcatctgacttatccaacttaaaaaatgagacattaaatattgaaaaattatttcatggcacagaaagcacatcagccaacattaaaaaatcaagtacacagttataaagatgggcacactaaggtgttggtatattatccctgactattttttatgattcccctagacaaaggatgtcgagcaaagagggaaccatatttgtccattgtaaacatttagtctagagatttaaaggctgttttgcacactgagtctatagagagacaggcgattgctctctgtcacaatttcaaagtccatcttctttacctcatcaatttgcagcttagtaggggtgaggatgagggaagagttatattgtactcccagaagtaaggggctgttttcctgcctgtcattctaccaacctcccagaataaattgctacttagaaaaagggaagtcaaacatttgtgaaacatattgctatttagaaaaaaagagaattgttttgcaaatagtagcactattaaaagagcagagagagaatagcatcagtcattttatattacatataagcagtttattaaagaattaaatatttatagactataaagcaagcaggcgatgagtcacaaacagcttgctgagaagtacattataaaacaatgagtctgtcagtgattgataaagaacggagaacgcaaatgctttataaattccctaagttagctatgaatttccagaccagaagaaaaggacacagtagccagcaatgtcacaccaactctagctgatgtatatgccaaaagctttcagtgaacaaaaagtacacttctctttgattcgtccacctccatctaatgtagaggaaagagctgcaaagcacagagaactgcaagggctttatggatgctcacttccaagttaatagatgttagatttagatatccatataactcattttattttcttctgacttttttcttattagataataaagtccatataatttcaaagaaagatatcccccttcttttcagaatcatatgcattagagaccagatcgcctaatctaattctatcaagttagagtgaaagcaactaggacttaaaggtgtaaagttactgatccaagttcacatagctggttaataccagaattaggtttaaaacttgggtctcctatctccttgatcaatattcttcccatagtatcaccttctttcccccaatccctttttaaaatgaaaattctgagcttttgctattcacaaccattcatcggttagaaattgtgaattctttctctcataaaattatatttcaattcagtttagatgatgattttaggagaaaaaaagctttaagtggataaaactttatatcttctctgagagaaacaaaatataatctgcctctccatagtcgttctagagtttgagataataggatgctattaagaaaatgttggctctttcttgaggaaaggctttcttttatgcattaactacttgggaggatgaattttcattctttatgagaatgactggtcaagacctaaaggtgttgctaatcttaaatgccaaaagaagtcatctctccttgactttgtgagtcatagcttctatgtgttctggatacagtactttggaattccatccttttctattctctgtcttcaaatttaaacagtcatctggtttccatatagttgagcttgaagttccacttgcaaactcgacagagacacattgtgagtcaaataaaattatgaatcaaatcctttgtaccttgtacagatgctaaagcactgagtagtagaaatcaaaccactgatgcccctgcccataaccctaccattatttttttggtaatacttgaatttctatgaaactatatccaaccagaaaatctatttgattacattagatgcttctttttaactttattgaggcatggttggcatataaaaagctgcacatatttaatgtatatatctcaatgagtttgaggagaagtatacacccaagaaaccactaccattatcaaggtcataagcatatccatcacttcctcaagttttctcacgcctgctttaccattattattgttattgtttttggtgtgtgtatggtaagaacacttaacataagatctactctcctagcaaatttgcctacgggcatcatgttatatggtagatcaccagaacttaacttattttgtataagtgaaactttgtacccattaaccataacctccctcttttgccctctcgacggcctgtggcaaccaccattctactctctgtttctgtaacttctacttctaaagattctacatttaagtgagattacacagtatttgtctttctgtgcctgcattacttagcataatgcactccaggtcaacccatgttgttactgacaggattttcttcttcttcttcttttttttttttttttgttaaggctgaaaaatactacattgtatttatatgtcataatttatctatgcatctgttggacatttaaattgtttccacatcttgactattgtgaatcatgctgcaatgaagacggaagtgcaaatatctcttggacactggtttcatttcctttagatatactcagaagtgagatggctgggtcatatggcagttctattttttaattttttcagaaaattccatattttccataatagctgtaccaatatacattctcactaacagtatacaaggattcccttttccccatatccttgccaatacttgtcatctgttgtcttttttgtaatagccatcttttttttaaaattatacttcaagttctgggatacatgtgcagaatgtgcaggtttgttacataggtatacacgtgccatggtggtttgctgcacgcatcaacccatcatctacattaggtatttctcctaatgctatccctcccctagccccccagcacccaacaggccccagtgtatatccccttccctgtgtccatgtgttcaactccaacttacgagtgagaacctgcagtgtttggttttctgttcttgtgttagtttgctgagaatgatggtttccagcttcatccatgtccctgcaaaggacatgaactcatccttttttatggctgtacagtattccatggtatatatgtgccacattttctttatctattataatagccatcttaacaggtgttaggtgatagctcattacagttttgatttgcatttcccttataattagtggtgttgagcattttttcatatacctgaaaagttatttgtatgttatctttggagaaatgtttatgcaggtcctttgcctattttaaaatcaggctatttcatttttgctatcaattgtgtaatttccttttacattttagatattagcccccccttttttgagaaagggtttcactctgttgcccaggctggagtgcagtagtgtgatcttgccttactgcagcctctaccttcccaggctcaggtgatcctaccacagcctcccgagtagctgagattacaggcatgcaccaccatgccgggataatttttgtttttgttatagagacaaggtttcaccacattgcccaggctggtctcaaactcctggactcaagtgatctgcttgccttggcctccaaaagtgctggaattacaggtgagccactgcacccagctaccctttatcagatacatggtttgcaaatcttttctcccaatccgtaggtggccttttcattttgttgattgtttcttttgctgtgcagatgctttttagtttgatgcagtcctacttatttttgctttgttgcctgtgcttttggtgtcatattcaaaagataattgccaataccaatgtcaaggagcttttgtcttatgttttattctaggagttttataatttcaggtcttatgtttatgtcttaaatccattttgagttgatttttgtgtatagtgtaatataaaggtctaatttcattctttttcatgtggatatcccattttcccaacaccatttattgaagagactaattttttttcctgtggtgtattctcagcactcttgtgaaaagttagtttactgcatatatgtgggtttatttttgggctcttgattctgttcctctggtctatgggtctgtttttatgccagtactaaatgctgttttgattactatagctttgtaacataatttgaaattaggaagggtgatatctccagctttgttcttgctcaagattgctttgactatttggggccttttgtgcttccaagtgaattttcagattgggtttttatttctgtgaaaaatgtcattgaaattctgatagggatcacactgaattttacattttaacaacataaattcttccaatccacaaacatgatatatctttcattttctttgagatatcttttcatttctttcatctacctcaatttctttaatcagtattttattgtactacattgtacaatacaatgtagtataataaatacaggtgaacacatctttcacctccttggttacatttatacctaagtattttattcttttttgatgttattgtaaatggaattgtttccttaatttcttttccagaaaacttgttgttagtgatataaatacaactctattaattccagcaactttattacttttattagttctaacaactctttggtggattctttagggttttttttttttttttttttttgaaataaggtaaagttatctacacacagagacaattttgctcttctctttctgatttggatggattttcccccctaactgctttagctaggacctctaggcactgtgttgaaaaaagtggcaagagtgggcatccttgtcttgttcctgatcttgcaggaagcctttcagtttttcatcactgagtaggatgctagctggggcttgtcatacatggcttttattatgttgtggtacattcattctatacgtagtctattgagaggtgtttttttttttttaaatcaggaaatcatgttgaatgttatcaaatgctttctctgcatctattgagatgatcatatgatttttatatttcattctgttaatgtggtatattacttttactgatttgtgtaggttgaaccatgactggatcccaaggatgaatcccacttgacaatggtatataatcttttaaatgtgctgtaaaatttagtttactagttttgtttttagtattttcacatctatgttcgttacaaatattggctagtaattttcttttcttgcagtgtccttgtctggctttggtatcagggtaatgccggccttgtagcatgagtttggaagtgttccctccttttcacatttttggaggagtttgagcaggactggcgttacttcttctttaaatacttggtagaattcaccagtgaaaccatcttgtcccgagatactctttgttgaaaggttttggattccttagtcaatcccattacttgctattggtctattcaaatttcctattttgtcaaagctcagccttgttaatttgtatgcttctacaaatttatccatttcttctaggttatccaatttgttagcatatacttttcacagaagattcttatgatccttcgtattcctgtgatatcacctgtaatgtctcttctctcatttataattttattcatttgattcttttctcatttttccttaaagattttcattatcattttcattatcttttcaaaaaacaactctttgttttgttgatttttttctatggtttttctagcctgtttcatttatttcttctagatgtttattcctttcttccttctgctaactttgggcttatttcgttcttcttcttctagttccttgagacataaagttaggctgtttatttgtgatctctctttttttcttaaagtaggcatttactgctataaacttctttgttagaacttctgtggctgcattgcataagttttggtatgttgattttccatttttgtttctctcaagatactttttgatttcccttttgatttcttctttgtgactcttagttgtgaatatttacttttttgatttttgattttaatttttgtgcatacatagtcgcatatgtatttacagggtacatgagatgttttgacacaggcatgcaatgtgtaataatcatatcatgtaaaattggatatcccctcaaacatttacatttgtgttacaaacaatccaattatcttttagttatgttaaaatgtacaataacattatttttgactatagacaccctattgtgctgtcaaatactaggtcttgttcacattctttcctttttttcttttgacccattaaccatcctcaccttccacttatactccaactacccttcccagcctctagtaaccatccttttactctctatctccattagttctattgttttgactttcagatcccacaaataagtaagaacatgtgatatttgtctttctatgcctggcttattgcacttagcatgatgacctccagttccatccacgttgttgaaaatgacaggatctcattccttttatggctgaatagtactccattgtgtatatgtaccacatttttttatccattcatccgttgatggacacttaacttgcttccaaattttagctattgtgaacaatgcagtaacaaacataggagtgcagatatctctctgatatactgatttcctttcttttgtgtatatacctaggagcaggattgctggatcatatggtagctctatttttagttttttcaggaacctccaaattattctccctactggttgcactaacttacagtttcatcaacatgtatgagggtactcttttctccacaaccttgccggcatttgttattgcctgtcttttggatattagccattttaacagaggtgagatgaaatctctttgcagttgtgatttgtatttctctgatgatcaatgatgctgagcaccttcgtatgtcttcttctgaccatttaaaaactggattattagatatttttcttatagagttgtttgagctccttacatactctggctattaattccttgtcaggtgggtagtttgcaaatattttctcccagtctgtgggtttttctacactttgttgactatatccattgctgtatagaagctttttaacttgatatgattccattcgtcaatttttgctttggttgtctgtgcttgtgggctattactcaagaaaggaatttttgcccagactaatgtcctggagattttccccaatgttttcttgtagtagtttcgtatttgaggtcttatatttaattctttaatccatttgcttgatttttgtatatatatagagagacaggggtccagtttcattcttctgcatatggacatccagtcttcccagcaccatttattgaagagactgtcttttccacagtgtacattcttggtacccttctcaaaaatgagttaactctaagtatgtggatttgtttatgggttctatactctgttccattagtctgtgtgtctgtttttatgcctgtaccatgttgtttttgttactacagctctacagtacaatttacagtcaggtaaagtaatttggccagttctgttctttttgcataagatagctttgggtattccgggtcttttgtaattccatattagttttaggactgttttttctatttctgtgaagaatgtcacagaatgcagtctacatattgcatagaatctgtagattgcattgggtagcatggacattttaacaatattgattcttccaattcatgaacatgaaatatctttccattttttgaggtcttcttcaatctcttttatcagtgtttcctaattctgattatagagatctttcacatctttgatcaagttgattcctacgtatttcactttatttgtggctgttgtaaatgggattactttttgcatttctttctcagattgttcagtcagcatacaggaatgatactgatttttgtatgttgattttacatcttgcaactttactaaatttgtttatcagttctaacagttttgatggcgtctctggatttttccaaatataagatcatatatctgcaaacaaggataatttgacttatcttcctgtttggatgccctttatttctttctgttgtctgattgctctagctaggacctccagtactatattgaacaataacagtgaaaaagagtgtccttgtggtgatccaaatcttagaggaagggctttcagtttgttcccattcagtatgatattggcttgaggtcagccatatatggctttcattctcttgaggtatgttctttctatacttagtttttgagggtttttatcatgaagggatattgaattctgtcacatgcttttttgcatcaattgaaatgatcctatggtttttgcccttcattatgttaatatgacctatcatattgattgatttgcacattttgaaccatccttgcatcccagggataaatctcgcttggtcatgatgaatgatctttttattgtattgttgaatttggtttgctagtattttgttgaggatatttgtatcaatattgatcagagatattggcccgtagttttttttttttaatgtgtctttagttttggtattaggatgatattggccatgtagaatgagtttggaagtattgcctcctcctttatttttcaaaatagtttgagcaggattggtattagttcttctttaaatgtttggtagaattcagcagtgaagccataggatcctgggcttttctctactgggagactttttattaaggcttcaatctcattactcattattggtctgttaaagttttggatttcttcaaggttcaatcttggcaggttgtatgtgtcaagaaatttatccatttcttctaacatttcaaatttattggtatgtagttgctcatagtagccactaatgattcattatccatttcttctaaattttccaatttatttgtatatagttgctcatagtagccactaatgatcctttgaatttctgtggtatcagttttaatgtctccttttgcatctctgattttatttatttgggtcttctctctttttttcttagttaatctggctaaaggtttgcctattttgtttaacttctcaaaaaaccaactttttgtttcattgatcttttgtgttgttttcttcatttcaatttctgctctgatctttattatttattttcttctatcaattttggatttggttcgctcttgcttttccagttctttaagatgtatcattaggctgttcatttcaagtttttcgtcttttttgatgtaagcactaagagctataaacttccctcttagtacagttttttgctgtataccataggtttcgaaatgttgtatttccattattgtttgtttcaataaatttttcaatttccttcttaatttcctcactgatccactggtcattcaggagcatactatttaattttcatttgtttgcatagtttccaaaattcttcttgttgttgatctctggttttattccactgtggtcagagaaggtgcttgatattatttcaatattttttgaatattgttttatgagttaacatacggtttatccttgagaatgatccatgtgttgaggaaaaaaatgtatattctgcagccattagatgagacgttctgtaaatatctattaggtccatttggtctatagagcagattaagtccaatgtttctttgttgattttctgtctggaagatctgtccaatgctgaatgcagggtgttgaagtctttaactatgattgcactgaggcctatatctcgctttagctctaatagtatttagtatatatatctgggtgctccagtgtttggtgcacatatattaacaattgttatattctcttgctgtattgacccctttatcattatatagtgacctatttgtctcttcttacagtttttgtcttgaaatctattttgcctgatatataagtatagctactcttgctcttttttggtttcccatggcatggaatatcttttttcattcctttattttcagtctatgtgtgtctttatagttgaagtgtgtttcttgtgggcaacagatcactaggtcttttttaaaaaaatccatttagccactctatgtcttttgattggagggtttagtctatttacattcaatgctattattgataagtaagaactttctcctgccattttgttatttttgtggtcgttttgtggtcctctcgtttctttctttccttcctgttttccttttagtgaagatgattttctttcatgatataatttagtttcttactttttatttttttgtgtatctgttgtatgttttttggtttgaggtcaccatgaagcttgcaaatactattttgcaacccattattttaagctgaacacaactgaacactgtttgcatacacaacaaagaaacaagcaaaaagaaaataagcattctgcactttaacttagtccccccactttttaactttgtgttgcttctatttattaatgtatcttattgaactgtgtcttcaaaagttgtagttattatttctgattggttcatcatttagtctttctgcttaagagtggttcatacatcatagttacagttttacgatattctgggtttttctttgtacttactattaccagtgagttttgtacctttagatgatttcttattgctcattaacatccttttctttttgattgaagtactccctttagcatttcttgcaggacagttctggtgtttatgaagtccctcagctattgtttgtctgggaaagtctttatttctttttcatgtttgaagggtattttcaccagatatactattctaaggtaaattttttttcctttcagcaaatatgtcatgtcaatcacccccaacctctaagatttccactgaaaagtgtgctgccagatgtactggagctccattgtatgttatctgtttcttctctcttgttccttttaggatcctttatccctgacctttgggaatttcattactaaatgctttgaggtagtaatctttgggttaaatctgcttgatgttctacaaccttcttgtatttggatattgatatctttctctaggtttgggaagttctattatccctttgaataaaacttttacccctctttctctacctcctctttaaggccaataactcttacatttgcctttggaggctattttcaagatcctgtaggcatgcttcattgttttttattcttttttcttttatctcctctgagtgtttttttttttttctttttgagatggagtcttgctctgtcgcccaggctggagtgcaatggcgcaatctcggctcactgcaagctccacctcccaggttcatgccattctcctgcctcagcctcctgactagctgggactacaggtgcccaccacgatgcccggctaactttttgtatttttagtagagatggggtttcaccatattaaccaggttggtctcgatctcctgacttcgtgatccgcctgcctcggcctcccaaagtgctaggattacaggcgtgagccaccacacccagctctctgagtatatttttatatagtccgtcttcaagctcactcattctttcttctgcttgatcaattctgcaatcaaaggactctgatgtattcttcagtacgccaatagcattttccaggtccagaatttctgcttctttttatttcaatctcttagttaaatctgtgtgatagaattctgagttccttctctgtgttatattgaatttctttgagttttctcaaaacagctattctgaattctttgtctaaaaggtcataaatctctgtttctccaagaatagtccatggtgccttatttagttcatttggtgaggtcatattttccagatggtctcgatacttgcagatgttcgtctgtatttgggcattgaacacttaggtatttactgctgtcttctcagtctggacacatttgtacccatccatcttgggaaggctttctcaatatttgaaaggacttggatgttattatcaaagcttagtctgctttagagggcactccaagaccagtaatgctgtggttcttggacactcatagagatactgccttgatggccctgaacaagatcagggagaattctccggattacaagggagagactctagttctcttctcttactttctctgaaacaaacagagtctctctctgtgtctgttttgggccacctagagctgggggtggagtgacattagcacccctgtggccaccatgaccctgtgactatgctgggtcacactggaagccaacacagcactgggtctcacccacggccttctgtaaccaccccctggctactccctatgttcactcaagactctgaggctctgcaatcagcagatggcaaagctagccaggcctgtgtccttcccttcagagtagtgagttttcccaggacccaggcaggtccacagctgccatcctgaaaccaaaactagaataaaaaaccttcaaagtctacctagtgtgctactgtactatagctgagttggcactcaaaccacaagacacagtctttcccattcttcctttctctttcccaaggcctcatcccatagccactgccatcacaggcccatggggtatactgccagactactgctgatgttccctaaggcccaaaggctcttcaccaagcttggggtgaatgctgcctggtctgaaactgacctttaagtgcagtaggctcctctctggccctgggtaggtccggaaataccattcaagatccaagtcctggaatcagagactccaagagcctgcttggtgctctacctacctgtggctgagctggtacctaaggtccaagacaaagtcccattcacttttccttctgcttttctcaagcagaggagtcttgtcccatagccaccacagctggaagtgtgctgagtctcacatgaagtcagcaggtctcagagtctcacccaaggccctcaatgtagtagcttgttattgctgctggttatttagggcccaagggctcttcaattagcaggtaaggaatcctgccaggactgggtccttcactgcaaggtagcaggttcccttctgacccagggtgtgtctagaaatgttgttcaggagctagggcctggaaaaagggcctcatgactctgactggtgccctatactgttgtggctgagctagtatccaagatgcaagacaaagtcctccccactctttgctctcctttcctcaagtggagggaaggggtctctttaggagttgtaagctgtgtagcctgggattagggaagggatgatgtctgtcctcccttagctgctcaggctggtgtctcagtaggctgcataccccactagtccgctggctctgggcccagttcagcactaggacttgcctaaaagtttgcagtccttgtggcctagactgcctttcaactttatttagagtcccagagtgctttggcccacaatggtgagacttgcaggaactcaagttcagactgctgggatcagtcaatccctcctggctagggctggtttaaatgctcactctgtaggtgggcatcagctgaatttggttgtttttttttgttttgtttccttgctataacagggcaacactgagttcagtgcctcacaactgctgtgctgctcttcctcttcccagagcaaagaaacaccttggcaccatgccaacactgtcaggaaggtagagaggtggcgtcagcaattcaatcacccagcaattcagggtgatcagtggagccttttgttctgccatattgctccacctaaaggagtgtgttatttaatttgtgaattttcctcctgtttctagtttcatacctttgtggtcagaagatatttgataccatttcaagcttcttaaatgtgttaagacttggtttgtggcctacacataatctattttggaaaatggtccttgtgcccttgagaagaatgtgtattctactgctgttggatggaatgttttgtatatgtttgttaggtccatttgttcaagtctgacatttccttattgattttctgtctggatgatctatccattgttgaaagcagagtatcaaagtcccctactattatgttgttgtctatttctcccttcaattctgttaatatttgctttgtattttcttgatgaattgatccctttatgattacatagaaatattctttatttctgtgacagatagccactcctgctctcttttggttactttctgaatggaatatctttttctatcccttgactttcagcccatgtgtcttcttaattctaaagtgagtttcttgcaggtagcctacagtcaaatcacatttttttaattcattgggttactctgttttttgattggggaatttaatccatttacatttaaattaattattgataggtcagaacttactgttgccatttgaataaaactgattattttatagttctttggtttctttcttcctctcgcttttttttttttaagtggtatgcttttattcctttttgtcttgtatgtatttattatgagtttggctttgtgagtatcatgaagcttatataaagcatcttatagttataacagtctattttaaatgatagcagcttaattttggtcacatacaaaaactttatacttttactcaccctgccaacattttctgctattgatatcacaatttacatctttttatactgtgtatcaattaaatttttgtagctggctatttttatacatttgtatttttaaccttcatcctaaaagtgatttacataccaccattacagtattagactattctaatttgactacgtatttacctttatttctgagttttatagcttcatatattttcctgatgctaataagcatcctttcatttcaacctgaacaacttcccttagcatttcttataaggcaggtctagcggtgataaactccctcagctttcgtttgcctgtgaaaatctttctctctcccttatttctgaaggacagctttgtcaggtatgctattcttggttagcagctattttctttcatcactttgaatatatcattccactctttcctggcctgtaaagtctctgctgagaaatctgctgatagtcttataatgagtcctttgcatgtgacaaaaaccccttctgttttcaaaattatcttcatctttgacttttgataatttgattttaatgtgtctcagtgatgacctcattatgctcaagttatttggagttttttgggcttcatggaagtgcatgctcatttctctttccagatttgggaagttatctttcatcatatctttaaataaactttcttcctctttctctttctgagctacttctgggactctcataatgcatactttggttcacttgatggtgtcccatcatcccgtatgctttcttcatccttttcattcttttatgtttttgttcttctccctagataatttcaaaagcccgtaattctttagtggtaatatacttccttgaatcttgatgttccttgaagccttcacgtttgaagaaacagccaactcttcctgtctttattgatcaccatgaagagagaaagacctgcaccagtgagcctggttagagatgctgaaggtttctcagacctttactatgaatgcatttgctccactcctcttgtttcctcttatggggaaatcttaatactgtctgccttctcttcatcctacaaagctgggactggtgccaaaagcctctcatttattttccctagagctgcgccctgaagtgtttaaggttgtgtgctttctcacaaaccagtagatcaggcttttaagatacatattggctactgagatccatgcactgtctgagggagcttgcacaggccatgcaccagggactcatggggtaccatccatggcggtggtggtgaatggggtcctaagggtgcacaacagcttgttgggaatgtatatgggtaaattgtattgcaggatttgtgggtggatcacttgatggagtccatgaaccagttaactatatctgtggctggctgttgaaaactgcatgccagttgctgtgagtgttcacttcttctccctactcctagctaccactggattattcagccatgcagatccccttggtgttctgggaggggaaagatgacgtgagactctcaggcagcatcccacaaggctgggtaactcaggctctcactttgctctccctttccctcctgagagaaattgtgggcctcttttggcacaaagatgtggtactttaaggaggggtgacattagtgaagtgaaattgctcttcttactcttttcaatgtttccactctcagattttttgctccaccagtgtgctggaaactctcagctatattttgtggctcccacaaaggtattctcatctgtgggtggttacaccaactggtgtttccttgaggggaatgagagctagattctcctgttctgccatcttgctgatgtcacactccctagatgctttctttgtagaggaaaactctgaggcttctttgtaagaaagaataacttaaccattcttggtgtgtaagttccctcattcctccaattctcatcaatacagaaaaacagctaactgcatctcaaaaccaggcagtgtcagtataataaaaataaattatactgaaaataaagcaaacacttagttcatattgtaattgaacataactagaaacaatgtttggttaatggttgacaataactttatctttcaaatagaagtaaaggtatccacatattaaggcaaatcactctataaaataacaaaagccacagttccctgaaattttctcttccaaacttttccaaagatgggaggtactgaggaaatatattgtgtatattaggtatgaataagtgcatatgtggttataatgctttttttttttttttttttgagacggagtctcgctctgtcactcaggctggagtgcagtggcgtgatcttggctcactgcaagctctgcctcctgggttcacgccattctcctgcctcagcctcccgagtagctgggactacaggcacccgctaccatgcctggctaattttttttgtatttttagtagagacgggtttcactgtgttagccacgatggtctcaatctcctgatcttatgatccatccaccttggcctcccaaagtgctgggattacaggcgtgagccactgcgcccggcctataatgctattgtaaatgcattatctaccagatcaactcattgattagagaaagttaaaatgtaaaaatttgaagctaacttctatctgaattaaagctacatgctcaaaagacaatgaatgtcagaaataaaactgagagaaatattaactaataaaggcaaattcaacttttagaggtcaaaaaataatccattatgttaatgtgtgactttctcagggagttgctaagtgttccctgcagagtttgacttactgtgtcagagcagcaaaagttttaactaaaaaacaaaatcctggcaccattggaaaaacataccatatgagaatgaattcacaaagtaactatgattcactcatgcttgatgtgctatgttcagatcagagattttaaacattaaataaaggtcactacaatcaaagaggtcagggaatggggagacaaactcaaaacaattaagatgtctcagtctggaaagctgagaataaaggagattttttatagaatgaaaactgatttaccaaatcctaaaattaggagcaccttttgttttttgttttgttttgtttgtctgtttttagagacagggtcttgctctgtcacccaggctggagggcagtggcacaatcatagctcactgcagcctgaaattcctaggctcatgtaatcttcccacctcagaatcccgagtagctaggactacagacatgcaccaccacactcagctagtttgtttcaattctagggggcagacggggtctcactacattacctaggctagtctcaaactcttgacctcaagtgatcctcctaccttggcctcccaaagtgctggaattatagacatgaaccaccacacccagccaggggcatcttttgaagcttgaaagtggtaaacacagaacaaatatgatgaaataaaacaagacagaacattacttgacataacaaagtaaagtttcagaaattgctatttcccagcctgggcaacatagtgagacactgtcttaaaaaaaaactaattaatgagatactagctgagcacagtggcacacacatgtattcctgctgaatgagaggctaaggcatgagaatcgcttgaatccaggagtgcaagactagccttggcaacacagcaagatcctgcctttaaaaagaaagaaagaaatcattgcttcaagagaaaaaaataatcaggattaaaaactatcaaaataaataaatgtatgctaaattcatcatatgttattaaagggaaactaggatgttttcttgacccataacattgagcaccaaaacccctctcaatgggagtcagaatactaggatattttcagtagagcaatcgtatattattataaatgttacttggagtcttccttaagtttcagtggagaaaagtaagtatattaagacactttaatagatgtaaaatttaacaaggttttaaatctaacagctttaaagaaaaaacccaactctgaaattgggggttattattttgtaactcaaacagtaaaaaccatgatgttaacatctttacctacagtcttataggtaacaaatctactgcagaaaacaacagctgaaagttgttgctattttgcactattctgaaggaatatactaagactcagtttatgtatttctgcacttccaaaccacaagggcaactaatattcatctgtgtggagtctcaacaaataaacccaaaatgagtaacaggattgaaaaccagttcttttattttttttttttcaatcttggcttagatttaaagtgctattatgaaagaagatgttaagttaatgaagacagtaaactagtaggtttgagaaccaatttcttgtgtcttcagagttttcaactcaatatgacacagataaattcacttcagtgcaaataaaaagcacagactaaaactgtaattctaggagctgtattaggaacctaaaagccaattgttaacaactggataagtcaaatatccatagataactgaagacgatagatttttcttctttggtttttatttgttttctccattttgccctttaaggtaagcctgtacctgcttatttgtccttaggaaaaaaccagatatcaggataaagctattgtttctgaagaatgactgccaatgtcaggtttctctctgtaaactgaaacagaaggagctatcttattcccaatagggtctcagaaaaagatacaggtttaaggttgataattcccatgtacacatggtaagaagggacaagatctgctttatagagttaatcctcaaaaaaagatacggattcttaggccctgttggtaaacaataggttccatggggtgagtgcatcagccaaaatggcatatgtgtaaagtgagcaccagcatgtgataactgtttgtggatgatggtgtaataaaattttttgattgtgtgaccatttattttaaaataaatcagatctgtaaatataaacaaataaagaaataatatctgacacagagaatttcaaagactatcctaattactgatagatgatgtacaataagacaagcataatttaacgaagttaatacaaatgacagcaacagcaaaaatgttgctttcttttgttttttgtttttgagacggagtcttgctctgtcgcccaggctggagtgcagtggcgcgaactccactcactgcaagctgcgcctcccgggttcaagccactctcctgcctcagcctcccgagtagttgggactacaggcgcctgccaccacacccggctaatttttttgtatttttagtagagacggggtttcaccgtgttagccaggatggtctagatctcctgacctcatgatccgcccgcctcagcctcccaaagtgctgggattacaggcgtgagccaccgcacccggcctgttgctttctaatctataaaacaattatatataatttaatgatttctaaggtttcttggctatctaaagatccagaacattgccattattttacgaagtcagatgactttctctttcttatttgacaatatttattatgttccagccagctttgtgagcataggttattcaactgagagaaaaactagatatagatcctatagtttatagacattaatcaagaaactatatattatcaaaaattgtgtgttataaaaacacacggagctctgaatgcacagaaggggactgattcagtttggtggggaaggaatgagagtatgggaagatttccatgaggaactcaattttaagctgagatctgaaggatgagtagggattacctaggaaagggaggaatgggatgaaaatggtatttgtaggtagaaggaaaggcttgtccaaagatccaagttaataggtatgcagctgaaatagtagggggaagaatgtgatgtaatgaagttggagcatcagacaaagttcagatcatgcttagcttagaatgccatattaaagatggcagtcttcattttagggaaataggaagcctttgaaaagtttcaccaacaggagacaaatgaccagatttctaaaacatcaccttggttgtgatatggagaaataattgtcagaggtaagaacggatgttgaaaaaacaggaagtttttgtggtaggccaggtgaaacatcatggtaatttgccctgggacagtgcggtggataatgacataagtggctgaattcaaaagatatttgtaaggtaaaatggacattaggtgatgaagtagacatggggagggaattaccaaaaataattctaatgtctctgcaattagtgaagtcatttacaaaaagtaaggaatggggacaaaagaacagatttttttctttatttttaaagtagggggtggtttgaagatcatgagttcatatttggacatgttaattttgagctatgtttagagatgtcaagtagaacagaataagaacaaggaatgcaaattaaaagaatcacaggcatataattgaaacctgagtataaatgagatctcccaagggagagagtattctataattgttttaaaaaatgtaagaacacattattttaaggccttttggaaaaaagaacatatttactgtatcaaattctcacaagccttccaatgtcaaataataatcagcattttaatgtattatcttaattgaacatcacaatcattttatgggataggtactatcattattctcatggtgcatataaagaggctaaagctttgggaagtaatttaccttattcagaagccagagttcaaacctagggctgagctcttaactattgtactgggctgctttcttagtacttcttatattaaaccagaaacagtaacaactttaacagtcaaagtcttgtaaagacttgtgtgcagagtgcaacactgcatatttaaagtaattatgtaggaagagagtatggcagctttaatttgatagaactatgggagaacaaagattttaggaacataaaataagtctggtttacacaaatgacagaaatctcctgctcagttaccttaaattgcttcatatcataaaaccataaaaaatatcatcatcagcaatatggcatccaacagtaactctgtttaggaactggtttcagttttgactcacagaaagtagtatttcccagaaagttatcatgtcaaaagacttagtttttcttgggctatatgaaaatctaactcagtttacgtattacccaataaggatcatagccatagagggagttgaaagtttactaagtgataagaatttgaaaatcaagaggatctaggaaaggcttgtaagtagatagctttgggtattattatcaaatcaagaaaccttattttatgcttatactttaaaaaaaatgcttgtgcctttatgtttgtaagtattgatatattggggtccccagaaagtataagaataaagtcaaattaggcaaatacataagctttaactgagtttaaatttcaaaatgaaagttactgtcttagtctgcttagatttgctataaagaaatacctaaggctgggtaatttacaaggaaaagaggtttatttggcacacagttctgcaggctgtacaagaggcttggcaccagcatctacttctggtaagggcttcaggctgcttcccctcatgtcagaagttaaagaggagctggcatgcacagagatcacatgacgagagaggaagcagagaaagcaagcggagttggggtttgcaccaggctatttttaacaaccagctctcatgagaactaatagaatgagaactcacttaccccctcacccccagggagaggattattctattcatgaaggatatgcccccatgacccaaacacctccctttaagcctcgtctccaacattagaaatcaaatttcaacatgagatttgaaggggtcaaacaaaccaaactatacagtaatgaagagagcaagtgtttgcattactagcataaggagtgctttggaactgagtggaatgtggacacaatgtctcttaagagcagggatgctggttctctgcgtaggtataaaattttactctggcatgaacacacaaaaaggcgatctttcttcctttatacatgtgtaactcttaatgatgaccagaacaaatactagcattgtcactttactaaattgcagtgtaggtatttacagtctacacttgcatgcaatttcagcttctgaatataacattagtgattctaattttattttatttgcagctgaaatgacttgtgtgcaatatacatgattggtgaccttactagaatgtcctaaaacatgctgtgccagagataagtttagttgccacaaggcaactgaagttgaatttttaggtcataatatgcctgaaaaaaagggttgtatcatctttagtgttaaagatatttaaggcattttattattatgagccatatacccatctgaacaacaaagatgccttgagtgttcaagtcaatccatagtttggaaggccttggataaggttctttaagcttttctgtgcccagcccctgcagactgattaagccatatgcagattatctttctccataagcatttatttcatgaacttaaggaaaaagccaaagtgaaaattaaggtttatatcagggccaagactgggatgaggtaagagaaacgcctatggtgtaaaatttaaggaggctctcaatcccagggtcatgtaagtgctaggttgacaccagaaagtgggtacctccttaaattttgctatataagcaccttcctagcctcaccctagtcctggccttggattttattgtcaaaggtctttcagagtcaaggctgtgctatttcagatgcacatctttttgttgttgttgctcaaaagctaacaaaaatcaagtacataatttttaaactttatatcaaaaaagtactgtaaaaaaatgaaatacgtagaggagcaatattaatagagatctcagctaaatctgaataacaactaatagcatacctgttggtactatttgctgtgtgcaattatatatatatttatatataaacacacagacacacacatacacgcacacatataaaatctccttcagtcctcaactctgagttaaagtataattatcattattattcccatttatacaggtagggaaattaaggcttatagatgtcaaataaaaaattgctcactgtcgcatagcgagtaggaactcaagctgatctaactcaaaaccctaatctctaactgctatgctttgctgccttctaaatattatcattcaatattggtgatctgttgattgtatctctactataggcaggcatgtacatgctaattgcttatgtaaatttagcatttttcttgtcagaaaaactggttaataagccttagagtactctcatttttgcagccttatagcatggtggactaagaaagggaaaatgaatgtaagaaaaagaaaagaaagaaggaaaaaacaaaagattgcaagagaaaatgcatgatttagagatcatatcccttttgtgaaccaggataaaataataagcatgaggatgagattagtatatgcaaagaagcttctttaaagcaaacccaaaagaaaaaggaggtctcatttatagtggagcaaaagaaagaaaaaaaggtttattagaggacaaaaaatgttactttggttttaatttcagctttttcaaattaaaaaaaattaaaatagacttcttttttcagaaacaaagtatcagaacttgttactttttctatctgctgtagaaaatactgatataaaccaaaacatagggtgaacaacgttacagtacttaattttaaaaacaagttaaagtaataagtgttattcaattcatatagcaagaagaaacacttatgtagaagtaactaagattattaatgtctaagaaatacatgtttcacgaacaattttaagaatatgttttaagagacatagtattattggccatgattgtgatgttccagtttttttgggaagagtagatactataaaaggttaaatgccattttttcaccccgtacctgcccgaacctctgagctcctcaaacccttacctccatcactaagccaagctctgataccagtaagaaagtccctatcttgcaacctgctaaagagtgccctcttgtgttgcatgcacatgaaataaccttttttttttcttttttcatgaagtgttctgcttacactgaaccttaggttttctttggcattgcagccaagaaagataaaagataaatgatgctttagaacaattttctggcttttaatgccagctaagtaaaactatacccctatattaaagagttataggttttctttaaaaaacttttataaaataaggtatatccacttcaaaaaataatgtgccttttgttcaaaggctagtttttaaagaaaacagtttgcataaaatgttagtacactgctaacgttagaatgtactaagaattttagtacttagaaaaacaggaatttgttctatcagaaaaaaatagcagtgacaataatttgcttctctcaacctctggaaacttacctaatttctcagaagtgtatttgtgctgaaatttttatttctggtgacagtcaagattttgttcatgcttaataaaatccaaaagggagaacataagaaaaataaattacttgaccataaagtgagtatatctttaaattccaggggaaaaaatgagatatttcaaaagatagcgttacataacatcaatatattcctctaaacagttttgacacaagcacaaagaaatttaaaggaatgaaggaaatcagtgttttcattgtctaatacacaccaagaaattcgaactgtgagactggtaactccataaattaccactctatcctggacatacttttttctcttttaaaagaacttatttacataatgaattacagacatagcatgagaaagattatgaaaagctaaatattaaaaaaggactaaaaagcatgttaatgaatgcaagtgtgtgatatgtccatatatgtatatatgtttatgtatttctatcactttgtttaataattaaagtgaatatcagtcaaacacttggctcagaaacatgggcaaaaataagatccctgaaattgtcttccggtaaataaggagtaaaaacactgaagaaaggattagaattgacgaacccactagatttgcttaacattttcttcttttagtttgtttttaaggtgggggaatgttattctgcattgtgcacattaaataaggttaactgtgtgcaacacaggaaagattaaacaaatctgttaaaaaataccaacccaaaatataagaggtacaaagaaaaagtagcacatatcttaatgtttccagagtggggcaatgtttagaaataaaatattcttgaaacatgtctcttcaggtacttgtattatctaaatcccttgaatggtgtctaaatagaacttagcaaatccaagacaaaaacagagaaatgggtataacaaggccacatacttagagtaaaaaaaaaaaaacaactctaggttctatatctacccctgactcatcattgaccttgaaaaagtcagtgttctccactgctcctctatcaagcaggagcaataactcttgccagaaaccacataggagtgttgataatgggaggattggtgtgataatgcacagagcttatagaaattttactgtgctgtgtacacttttgggaaagatcatgtgtttttttgctaccccacaaaagcttaaagaagataatggatgtataaaacattatgttaaattctgcttaacatcttcattttcatttatcttgatagtttcttcaatctactgttttttataacctcttatgtgttaatatttttatgtctgggaatttctaattccctttctatctcattctttctctttatttgctttcttttcagttttctatttctaaaaaaacaagaatttattcttgtcttgaatttctcccttccctcattctatatatatgcacaaatactattttttcttctactacttatctctgttgttcaagtataataaaagcaatcataacaatgatactaacacttaatatatttgaaagtgctttgtaaacaaacgctaatcttatttcaggtatttattcaagttactcttaatcagaaaaattgttgatagtttatatatcttatttatgacgccctcaaaaggtaaaattttaatagtagtaacattttcaatagtagtaaaattttcatcgtgtcactatggaagaagaaataactactggatgtaataaaccaacaataaactttattatagttttcaatagatttcttagtaaataaaaatagaaaaaactattttctaaatttctttatctcaatttatagaataagatatattttatataaccacaggggagaaaaatagaaatgtttcacatttctattttgaactctattgcttttcagtggataacagtggaaatcacttaatatatatgaaatatggaaacgactacctctcattgtgctcttggaatgattaattgtgcttttacattagaacaaaagctgtgtgaacatatggtattattactttaatacaggtaattcattgtagtatgaaacagctatatatagaccaaataataatcacttccattacacaggataaaataaaactgccactgaaaaaaatggagaaatgcctctttctgcctttaattagtttttaataaatgatacatagtaaatggcaacattctaacttatcacaatttaggcacagtcctttaatgggaggttaaggggggtatggaagtgtatgaactctggtatctgtttgcattgcctgggaaaccttctctgttaaagggcattcattgttttcaacatctgaaaagacgcaagctctcataaagtcctttcaggtatgcgtgacaaatgggaagtagtccttctatagcacaaagttccaactacagataaatagtctatctgttcttggttcacatctctatgaacatccatttcatttactgttggctttaaatcacacactcttctagggagattaatacctagagtatgtcacagccctttttacttcataaatgtgagaaatacacttagattaattgttttgatttttttttcaaagctgctttttggttccctgacattaaattctataaaccagtcctccatatatattttttcatggtatatttcaatagactagaagaccttctggtgtttaagtttgtttctaaggatccagatgggatttatttttcatatatggtttctgcttacatgcaacattgtattttaatgttttttagtcttcaactagaaaggataaagggataaatgatcaccacgaaccgttaataagtatctaaccgtggtattctacttactgtagggggaatatttatgctcttcttgctgtcatctagacctacctgagaagtaaagcaagtgagaaggcagactttatcacttgatacaactgtcaaaatggtgtcaaatgttcactgaatgcactcctccctccatgcttgcattagccctttccgttgctgtaacatcatactgcctgcatgcatgcacttctgcatgtaaagacaggaacttttatgcctagcattgtcttggaataaaagagcctggaaggaaaaccattgtttccttttaaaggggatagaaaaaacatacttgggctacaaaaaactatttccatatgcccacagctaacttactgtaaagaaaatcttgggtagattttccatggagaaatcttttttccttccattggattaccccatgagtgtccctgtcctccaacagtatggttttcctatctgaaaatgttgagtaaatttctgctatgactagtagattcaggagattaaatttacttaatcgtcagtacaaatatacctcttcttatgtgctctttatgaaaataaacacatgaacaaaaactgagttgatcttcctaaaatggacacattcatacaaagctaaatcatcttctatcacatactgaaggcaaatgatcgcatacttagaaaaacagaggtgtatcttgatgtagtgtgtatacttagtattatgcctgacacttcttcacactgctcttcatgtgttcacaagcatataaatgtgcaactccatttctataaagtcaaattcatctaacgttacatagtctggttgatatttctatatcttttcctcctttaaatgtgactagctatttacgccataacaattctggtgtagcgctgatttagcatttttattggaatgtgaaagctcttaaaagaagaaaaaaaatctaatcaggcagaagagatagaaaacttgctgaattttccttcccccttccaagacccccctgaatcctatcaaaagcacatcttccattcattgcttcccggtgtcattatgacaagcggctacaaatcaatagcagagggaaaggcaggaccaacccgcactcaccaagtgataaagattcactctcagccccgatttgctaatagcccataatagcagccattggcgccccgcattaaataatacatttcactccgcgtttattatgggatttttaaaactcctcaccaaattggattttctcgatggtctctaatttccacatttatcatttaaaattaaactgctctgtggaaaggggggatagagaagaagaaggtagagagaggccagacagtactgtatttttccttttgactcccccctttatgaaaacccataaataatatcaggtatcacagctataagcagcaggattttttaaatattaaaatttctagaaatcaggatggaatagtctgtatgtgctggtctgtgaatgaagatgacaattcaacaggacaaaatatatatccataaatgaagttttaagcaaaataaatttggtttaaaaatgctcagtaatgttgcaatgagggtgaatgataagaccgatggaaaatatgtgaatgttacaatatgcaaatactccaaggagctataaagagagttcagccagtaaggtattctagctttaaaaaacaatatttttcttattccaaagctcagtgacaaacagatgaaaagtaaaaattctcttattgtcttctcattacataatagcttactttactctctatactttcttggtttaaaaattaattgtaaaatttcatagagtcctatagccacaggactcacttcttggcagctatggcaaatcccaaataagttcttaaatctcccatagatgccaccgaaacagcggaatcaacccatggaaacataaatcacttcaagtttaagtatatatccttttagataattttttttgtcctttgggtataaaaattaaaattaaatttcagttctatagcataatacgaaaaggctatattttctcaaggctgcacagttgagactcactatggctaacttataactacagcactggcaggatccaaagacatcagaagaaaactaatcagtacatatgtagagatgcttgaaaaggctaaaggtttagtgaaatgtcaaatgatcctctgatttcttccttttgggaacttcctcagcaatatagtcttacctatatcatttcccttaagaaacagaaatgatctttcaaatcagagagtttaaaggagttgaaaagctcagccattttataacaatatttcatttaatcttcattcttttgttttggaattttgttattgacctaattatttttaaacgtttcaatgatcctttaaaaaaaatctgccattagttgctgtgccttttctgtcttttttttttttttcaggtagaaaagtactgttgtacatatacctattctttcctttcctactccatataactaatagcctcccattttaatgaagtctttattcaagtaacatacatattgaaaagtgcacaaataaaaaatgtatgctatgaattctcactagctgcacacacttgtgtaaccagcattgagaccaagcagcagaatgttttattagttacccagaagctcccctttgctcctttttagtcactaccaactccctcaagggtagtctctgtcttgcttctagcatctcagataattctgcctacttctgaactttgtataaatagaatgctctagtatgtactcttttgtgtctagcttctttcacttaaaattatatgacatgaattcacagtgatgtatgtagttatagtttgtccattctcattgctgtagagcagggactgacaaactaagatcagatctggcccactgcctgtttttgtatggcctgtgagccaaagatttttatattttaaaaaaatatataaaaatcaaaagaaagatatttcattacatgtgaaaattatatgaaactctgggtacataataggtgctcagtaaatatcggctttatataggtaatctaaagagttaattttaaatatattcaagaagcagctttactttgttttcatatcaaaagtccttttcaatttgccctatcaacatctcccttctcttcaaccctgaagactgtggtttgtaaaactatttagctcacattcactcttctgttccttgtctactgtgttatgttctgtaccttactcctgaaacaaaacaagtcttctgctctttaaatttatttctaaaagcttacttctattagaaagtctgtatctaagctaacttcattagatttaagtagataaaagctggaactgaagaaatgaagaaaggggatatgttaaaactgatgcattgtcaggattttcccagttttctctttttggctaatttagaattcacagagtaacagcttatatctgttcaattaaagggtcagttaaagagctggcacctcaaaaatgtttatcagtctgtgttacgtaattaaatatggaatctattcagacaaacgttaaaaatcagtccaggggaaaggaagaattttaataaattttgaaatacaaatcctaaacagttctttttgaggatgtgatactttatgtcatcacaagagactggagagattagaatgaactggtttaaagtcttaaaatctaagcctggaggctttctttaatctgcatgcaagactgtttaacactgttgcaactgcaattaagtactagactgtttttgtttatttctttacaaaactgctttgttagtttgtaaaatattcagacacagtcaaggttatgggttctctcaggatgtctatgtaaaaggagatacaatgggatagggaagctttaattatggctgggtccttgctctctgagtgccagctttagacaatcactctttctgtggactctacgtagtggcttttttttcttttagctgtttaagaatctgaagcatcctgtggtttattgactattgtaaccacatactctgccactaatgttcatcactcctgtttctcctgactgctgcctcttgaggagaatgaaaggtggaaaatgtgacacagtagtctcaaattgtatgactcagtttaaataccgaacaagaaaaaaagtgtcttaaaccaccactagaaacattttcctttcaaatggaactgatctttaaaacccagttcaatccagcaaacaggcaaataattgctaatgtagacactttcagaaagtattgtggtataccagaggatcagttttctataggatgatgaaaacacttctagttctttgtgatacttgctgatcttattcaaatttaattttatccagcttcagtcaattcttacccagactaaataatgccacttagattttaatcttttcttactctttaagtttgccttttaatgaactatttttagaaatgttcttccttcaatgcaatattctcttcacacatcttttacaagcaatttttttcccttaaatcaaaaatctaccatgagttctatcccctacccctaaaactacttatggaatttatttctattacaattttattctttccattacttcatcggtttcatatacttggtggattttaacattttaaaggtatacacactcacacccacacccatgcattcttcacaataccaccctgaagtagaagagacagtatggcattttcattaattaaaagtggaaacaatgaagtccgactgcctgggtttgaattcaagctatgaggccttaggctatttacttaacctctttgttttactttcctcattagtaaaataagagataattatagtcctagttcatagtgttgtggtaagaaatgaatacttgaaaaacatagtgtagtgaatattagcataaaaaattaactattactattattattttataaatttccccagattataaaggtagaatggcgagtaggtatcttctcttctctatagccaaagggatctttttaaaacagaagtcaggtcaggtccatcctcgatcaaaatgcttcaatggctttctgcctcattcaaaatcaaagccaatactaggccctacttgatccaaactccctcatccccaaccttctgctcatttcctgctattcatcttctctctcactctattccagccttcattcacctccgtgttgttcctggaatgtgtcaaatatgctgtcactttcaggcccttataagtactgctccctctagctgaaacattcttttcccagagtcaaaaacttttcctgaccactcattataaaagagcaatcaccctaacccctggcaccctataccccctttacctgatttattcgcctctatagtacttattaccacccaacataaataacataaatttaccttttggtgataacagaatatatagggcttaactaaatataacgattgctaattgaaaatttctcctattactttattgtgctggcttagaaaacagtgacgtacattagcaaagcctttcaatttttaagattaatcaggcagaatcttcatagtcagatgaatctatgtaatacattacattaaatgggttagatcctttctcacagaaattaacaaataattttgaagtgtgtttaaggcttatatattatcatattagtagctccttcaaaagacaacaaacacttgacacacatacctgttctagtagtgaacttcaacaaagagagttttctctgtgaggaaggctagagataaaagggaaaagaaaaccggcttctacaggaggatcctgaaaatgttacctcccactttttgaaaaaaccctctttgaggatttttataggcatagagacttggtttaagtctgtcgtgtgtgtgccctttgacttagaaaagggatcaattgaaataaagatatgtgtcctgattctcatcgacagatgaaagagcaaaacattaggctagtatcacatctagggaagagagaagagagaaatattagaacacaggtaaagagaaataaacaacaagagaagaaatagttgtcctgtgaggcttagcctgtgggcttctatatacctagtacctgaaatatagaggtataaatcaaacacttattagctagccccacaggaacaaactgattaagtttacttacactgcctattctttccttcgttgtgatctttgagaaattttactacccctctttcttttgggatttttattgttaaaagaagctgtatgtatggtttctgggtccattagcaaaatatttttgtttttatttttatttttttaattatcacatatttcaagcatacaaagaagtaaaaagaataatgccactaacacctatatagccatctagctttgtcaaatttaacatttctatgtttgcttaattttttaaaaaagaacattacagttgcagtttaagcattatggaaatccttagtttaagcattatggaaatgagggacctcatttccccagcttcctccctctcaggatgtaaactgtaccctgaatttaacgttcattattcccatgaatgctttccacattttagaagtttatattaatgctagcatactgcaaacactctgcaataatattttcatgctcaacattatgttttagagttttattcctaatgatacatgtagttctagttcatttatcttaattgttatatgtattccactgaatgaaaattcccaaatagattcatcccttctctgatggacggacaattaggctttccggatttttcatgattattaacaaagcagcaatgaacattaatcttaacttttagtgtggatatacaagagagtttcatgaagacatataaaagtatgttcaacttttctcgatattatcaaactgttcttcccagtaactgtacctgtatatactatcacctgtagtttttgagttttttccccacatttgtgcttacaaatattttcaattctaatttattttttgttaatctgatgagtacgaaatagtatctataataggcatttatcattcttttaggctgcacagtacttgaatctcattgcaatgattagaactaatttgtggggaaccatcatctttataatttataaacatagtttctctgaccatatattcagatttttcaattttcagtaaggtttatcatgtattctttaaaaattttgtaccttatatagatatattcctttatatttaatgtcttttattgttataaatggcatttttcaaattatatatattttttggttttggtggtagtacacagcatacaataaacttacagtactaactacatacatcagaaaaagagaaaaagtttcaaatcaataatctaagctgtaccttaagaatctagaaagagaagagcaaaataaacccaaaacaagcagaaggaaggaaataataaaagagcagaactcaatacaattgaaaacaggaaaacaacagaaaaaaatgagtgaaatgatgaactggtttttctgaagatatctagacaggtgaaaaaactccagcaattatcaacatcaataataaaacagaacaccactgcataccctaaaaaaaataaaaaaaaaaaacaaagagctacagatacctctacacatataaatttgacaacttagatgaaatggaccaattactcaaaaaatagttgatcataactcaccaatatgaaacagataatttgaatagcctacaagtattaaagaaattgatagctgggcatggtggtacacacccgtaatcccagctacctgggaggcagaagtggaaggatcacctgagcccaaaaggctgaggctgcagtgaggcgggattgggccactatactccagcctgggcaaaagagtgagaccctgtatcagaaaaaaaaaaacaaaacaacaacagcaaagaatttataattttaaaattaccaaagaaaaatctccgggtccagaatatttcactgaagaattctaccaaacgttcagggaacacttaacaccaattctacataatctatttcagaaagcagaagaggagggagcatttcccagttcattttatgaagcgaggattgcactgatgctaaaaccagacaaaaacagggaaaaaaaaaatttaaagaaagcaggataaaaagaaaactacagaccaatatccctttttacatggatgcaaaaaaaatcaattcagcagtatggaaaaagaattatacatcatgaccaagttgggtttataacaacacttgttcaatttttttttttttttttttttgagaaaagtcttgcccttttgcttagctgcagagcagtggcacgatcttggctcactcgaactcctgacctcaggtgatccacccacctcggcctcccaaagtgctgggattacagtcacgagccactgtgcccggcccacttgttcaatattttaaaaatcaatttatacgtacctctatattaacaggctaaatcccatgatcatatcaattgatgcaaataaaggactgacaaatccaatagccatttatgataaaatgctcagaataacagaaatagagggggaatttccttaacttgataaagaacatctgtaaaaaaaccctacagctaatattatacttaatgatcatagactgtatgtttttcctctaagattggggaacaagggcaaagatatctgctttcattgcccttatttaacagtgctggaagttctagccaatggcataagtcaagagaaagaaataaaaggcatacacattggaaaggaagaagtaaaactatccttatttgcagatgacatgattatctaggtagaaaatctgaaagaatctacaaaaaactcacaaaactagtcaaagtgagttcagcaggatacaagataaacatacaagaatcaactgtacttctatatactagtaatgacaccaaattttttaaaaacacaataccattaacaatcctttaaaaagtgaaatacttcaccaggtgtggcagctcatgcctgtaattccagcacttcaggaggctgaggcaggaaaatcacttgaagccaggagttcaagaccagggcaacaaagccagaccctgtctctacaaataaaataaaataaaataaattagctgggtatggtggcatgtgcatgtagtcccagctactcagtacgctgaggcaggaagattgcttaatgaagcccagaagttcaaggctgcagcgagctacgatcaagccactgcgttccagcccaggcaacagagtaagaccctgtatctaaaatattttttttggtaataacaattttaaaaagtgaaatacttagatgtaaatctaagaaaacatataaaggacttgtaggttgaaaactacaaataaatagaaaaacatattgtgtccatggatgggaagactcagcctagcaatggtgtcatttctccccaaatgaatatgcaggtttaactataaaaatctcagaaagatgtttctatatagaaaagattattttaaaattcatatggaaagacaactagaatagctgtaacaattttgcaaaagaacattgtgtgaagaatcagtctaactagtttcaagacttagagataacaatcaagatagtatggtattcatgggataatagaaacatatcaatggaacaaaataggaacccagaaatagagccacataagtatgcccaaatgatttttgacaaagttgcaaaagcaattcaatggaggaaaaaaccagccttatgacaaatgctgctggagaaattgacaatctatagactaaagaacaacctgaacctaagcctcacatttcatataaaaattaactcataataattcacagaattcaatgtgaaatgtaaaactataaacaaattttagaaaaaacactggggaaaaacttccagatctagggctatggaaagggctctgagactcaacaccagaaacatgatccatgaaaggaaaaagtgctaaatatgatctcatcaaaattaaaaacttttgctctgtagaagaccacgctaagaggataaaaaggcaaactacagagtggaagaaaatagtctagttagagaactcttaaaacaacagtaaaaaagcatatactccaattagaacacaggcaacagacatgaagatatttcaccaaagaagatatacagatgcaaataagcacttgaaaaaatattaggcatcattagccacaaaccactggggaaacacaaattataaccacaataagacatccctacacatctatcagaatggctaaaattaaaaatagcgacaccatcaaatgctgctcaggatgcagagaaactggattactcaaacatcactgatagaatgtaaaatggtacagcaactctggaaaatagtttggcattttctcaaaaacactaaacatgcaattaccacacaacccagcaattgcattccaaggcacttatcttaatgaaatgaagatttattttctccttaaacaacaatgggtacaggaatgtttagagcagcgtagtgggttgaagggtggggttcccaaaaagatatgtccacatcctaatttctggaaacaaggaatgttactttagttggaaaaaaaaaaggtctatgcggatataattaagaatcacgagataaagagatcattctagattatccatccaggtgtgccctaaatacaactgtccttatagcacacaggggacatttgacagacagatgacaaggtgatgtgaagacagaggcagagtctagagtcacaacaataacagggaaaaggctattgatacacacaaaaatcctgagaattatacagagttttaaaaaagctaatccccaaagattaatactgtatgatacataacattcttgataggacaacattataaaaacaaacaagagattagtagttgccaggaattaaggagagttggggcaggaaggaagtgggtgtggctgtaaaagacaatacaagagatccttgaaataataaaaatgttctgtatcttgaccatattaatgtctacatcctggttatatgtactatagttttgcaaaatgttatcattggggaaaactagataaaagatacacagtattttctgcaaattatttcttacaattgtgaacctacaattatctcaaaataaaaaatctaatttaaaaaagtgatcagctgagtggaggaataaatagtatgaagtagaaattaacttaaaaaatcaagttagaaggtaactgtcatcttaaacatgccaatgcaccctaagataaaattcaggcaatttaaaattgacagtagttttccttttaaccaagaaccgttttatcatatctcttacaggtgaaacagctttggtgttcaaaaataacatctctttttcttttttttttttttctttgagagggagtcttactctgttgctaggctggagtgcagtggcatgatctcggctcactgcaacctctgcctcccgggttcaagtgattctaccgcctcagcctcctgaacagctgggaatacaggcgcatgccaccatgcccagctaatttttgtatttttagtagagacagggtttcaccatgttgacggggatggtctcaatcccttgacctcgtgatccgcccacctcggcctccccaagtgctgggattacaagcatgagccaccgtgcccagccaacatctctttttcttactcttctctatttgtctgcagtattacaaaatgaaatcaagatggtgctataaaagttccccctgcaaaccactccaaactcccttctataactgacaccaatgccagtttcttttctctcagaaattgtttttaacttttattttcatattgaattagaagaatgcttcacctctttttatctgtatttcactcaaaagtccaggttattttaaacctcaaaatccagttctaatccagtttacatttactcctttatttgcacttaaccagtgaccaagcatctatatacagtctatttaaccttgatagtttttaatatctatatccatcatgccaccaataaacaaattacgtgtcctaatttccaactttagtttcatattaggatccaagtaccttagtaaatgtcctaatgctttcatcaaccatttgcattttcttgaacatcagcagttttgtaacataaagtcagaccacaaacctaaaatgtaggtcacaatgtctcctttcacaatgtgtcatgaaaatttaactacttcaggataaagaccaggtgccacattctttcgtttttgttaaaggttttaacactcctggtaatcaaggctttttttttttctccaaaagtcataaattgactgattattccttcacaattctcgtttcaactgtaaaacttttatgtctagctgaatgtaaccgctccttttcttgtctccctatatccaaaatcttttcattttaaaactgactgcaaactaaggtcagatacattttttaatacattacttttaaaacacagataaacatacacacttgtgtgtgtgcattttcattataacattgctacttgaagacagtcaatttttcatttgcttaaaacagtgtttttcaaaggaagcactatttttggaagcactggttccagtcatgactctaagtcacaatataaatgtatcctgtgaagcatggttaaaaagaaaaaaattgaaaaacaatggcctaaagaatatggtctaatttgctacacctgacattcaagacctatgctaatcttgcctgtagctaccaatatatcctcattgtctacgacttgcttcacaaatccactgcacctctcaaattgattcacttgccctatcttaaaacatattccatgctttcccaaccatgtctttttgcagatatgcaataaagatttcactaaatgtataatgaggggaaaaggacaaaatagaaccctaaaaacaagtctatcagaattttaccccaacaaaatgcctacctctcaacgaaattttttcttaccccaacagagaaggcattgttcctttatctgaaatcttgcaatacttgctctcttttcttttcttatggtgattttgtgataccttttattgttaatgatctgttatcatttacccttattgtaatgtaagtacctcaaaaattgatatcatgccttatatatttttgtttaataaaataatgctattttaaaacttatgataaatttaactagtatctagcttaagaaagaaaaaattaaagctaaaactgaactatcctataacagtcttctccatcccaattccttcccctacagagataaccattattctaaattcccatggatgtttcttatacttttattaaatatataactacctctgcattttaaaacttaattaatgacatcccaatgtaaatattttgttactggcttactttgctctacattgtttatggtatttgttcacgttgatgcaaacaattctagttcattcattaatttggctatgtattactcttttacattaatccatcataggagatttatcaattcttttgatggacagtttgtttccaattattcattcttacaatgatgtaaccaatattcttatacatgtctctgtgcataagtatgagaatttcctttgagtaatacctagatttgctctgctgtagggtatgagcatttttggcttcagtgcatgttaccaaaatgctttcccagtctctggattgtattgtcactttttacaatgtattccaataagcaaaaaaaaaaaaaaaaaaaaaaagttaatttcttaaaaaggtatagttatattaactttttagagttatgattctacttgtgttttctaattactcttgactcagtttggaaaagttttatttttctggaaaattgtccacttcagctaagttttcaaatttattggcatgaaacaatttatgcccaccaggggatgttttctgagctcacctaaaaattagattcatataactattaatggccatgcttcacataaattttttttttttttaaacagtctcactttgtagcccaggctgcagtgcagtggcgtgatctcagctcactgcaacctctgcctcccaggttcaagtgattctcatgcctcagcctcccaagaagctgggattacaggcacctcccaccacatctggctaatttttttttttttttttagtagagacagggtttcaccatgttggcaggctggtctcgaactcctgatctcaagtgatctgcccacctcggcctcaaaaaatgctgggattacaggtgtgagccaccaagcccggccatgaattcttttttagcagaatacaggtcaggatacacagcatattgacaaggcaatgtcagacattcttcttaagtaggagcagtcatcacaacaggccacaccgccaccaaacagcatagcttctagtcactacactaagatttcctaccaggtattactagcttatttacaaccctcccaggccaaagcaatttacccaagaagtgtcatttttaacataagcaacagtgcctggtgaacagctcacattccaaaagtcagctgccattattatttgcaactccaggggaaatgagaaaacaggtttccaggggaacagagctaggtaaattgtattcccttacgtttttaaataattagttttctttatcaattttgcttcgtttgtctattagtcttttcaaagaacaatttttaaattctatcttgttttttaattcttcaatttctgctctatatttgctttttttttactttctttaggtttactctttgagttgagcatttagctatgtattttactctaagtacctccttagcttcatcctacaattttaaaaatagtgcatttttaatactattccattctaaatattctcaaagttctattataatatttatttttgattcatgagtttagaggtgtgtttctaaatttttccaggctaaggggtgcttttgagcatctttctatttttcatttttaattttgttgtattatgtttagagatatcaaactgatttttaaggctttattgagacttgcttagtgccctagtacggttaagttcttacaaatactatacatttatttgaaaagtatattcattaactattggattaactgcactacatctatccctgagatcatattgttatttttttcaaatcttttccagccttactaataatttgtatgcttgagtagttatttagagaatgatattcaatttctcattatggctacagacttgtcattttattcttctaattctgtccatttttggcctcgttaataagtctttcttacatattgtctttggagttttcattttgtaatttgcagtagtgttgttttcctctaataaagctatgttagacccaaataacactgggtctaacaaaatattatattagctttctttttattagtgtttgcctccttttttaacttttaatctctgtgccctaatgtttcgcgcatacctgttataagtaaaatctaggtaaatttttaaaaatctgacaatattagtttttagtttggtaaattagtgtattttacatttttgaaaactgatatttgggtgtttttctatcatcttatttttgcttgttattttactttttcttagaacttccttgtccttttctgccttccattaacttgaggtttttttccaatttaaattttttttatattgagtattgagggaataaaaaagaacatctacaaaatatatgaaagctattcctttctcttgattttaatactgtgattaaatacagtaatcaatttattaatattagatgaatcttgtaaaaattgagagatatgtcaaaccttttccaaataggttggtggtaaacttgtctccttttagttctgtcagtttttactttatttatttttacaccctcttattatgtgcattttcaaatatcttatctttctagtgaaaagaacttttatacttacatgacggtctttatcttaagttttaattccagtcactctataccctcattataggtttctgctctcataaatgttagctctactttttttttttttttttttgagacagagtgtccctttgtcgccctggctggagtgtgcagtggtgctatcccaactcactgcaacctctgcccactgggttcacgccattctcctgcctcaggctcccaagtagctgggactacaggtgcgcaccactacgcccggctaagttttgtatttttagtagagatggggtttcaccatgttggccaggctagtcttgaactcgtgacctcaagtgatctgacttcctcagcctcccaaagttctgggattacaggcgtgagccaacatgcccagcctctacttgtttttaacaacacaatattttactagtatcgtcttgcacaattttctttagatttatacaccattttaccattttgtctatgtctcattcattcttacatttcagatcttccacttgaaattactctcttttgcctaaagtatatattttctgaattttctttagcaaagattggctagtatcaaattgtctccattactaatatctaaaaatgtcttttttctcttcttgttttcataaaatacttttgatgaattctggttgacagttgttttttctcagtacattgaggatataatcccatagtttatcagcttctactgtttgtgtcaagaaattggctgtcagtctaacagctgtttctttgatgataacctgatttttttttccccttggctgtttttaaaatcttctccttgatcttactgttttatagtttcacagtgatgttcctggcagttaatttctttatttctccttcttatgattcgattgagattcttgaatttgtagattagtgcctttcagaaaagttgtcagccattatccctactccattctttgtctcttctcctaaattttgattagtcataatttagattttttcatttcatttcccatgttccttaatcactttgacattttccatatatttgttacaacattccattacacatttcttcagatatatcttttaattcacatagtttcccttagctgtttcttatctcagttaaacctgttcttggagctttaaattttagctatggtagtttaattactagaaactggtttttcttcaaatctatttgctgctgttttcaaacctctcctttattcttaaaacattttaagtaaatttactttaaaattcttggcttgaggattttcagaccacaagtagtatgtatagggatacagacccatgctatatctggtttgtggctatgaattttcaggggctgtatctgctcccccctagtgtctgccacccacatactcacaacctctccatagagcactatatttaaatatagccattttccttccagtctcttgaggacatgggtataggatgggtttatttttagttcactcttacattgatattctatcccttttggttctcagctttaagaagacatttacttgggaagttcctggatttcaactcctgtttcttattctctggaaaatcataaaaaccaaacttacagttaactcactttagcaaatgtcttcaaggtgaaagctgactgcagtgttttgcttgcctgacttaggtcttgctttcatttagttttaggtttgaatttcctttattttctaaccaactcatgaatataattaagtttttttaagtcttattcattatttttaatattttactgggaagttggcgttagtacttagccacattgccagaaataaaattaatctcctaaatattcttaattcttatattttccctttatactggtttgaaaattacacattggaattttaatttttaatagatacacttaagcttttaccattgaaaactgatttaaatcccaatgtcaatcctatatcttccttccaaagaatacaaggaatttcagactcttaaagcaaagtcttcctcctttccacatggtattcttgtccagtattttagtttcactcctattttccctttacattttttattttaaaataattggattcataaaaagtttcaaaattaatacaaggaatttcaaatatccagtttccctaatggttacatcttaaatagctatgtaaaatgccaaaaccaggaaactgacattgatatgacatttttgtataattctacgtcactttatcacatatgtagattcatataaccaccactacaatcaagatacagaatgttctgtcatcataaagtactttctcatgctattcctttatactcacccccctactcctttctgccccacttctacctaccatccttaacactggcaactactaatgctttccttcaattttgtcattttgaagatgctatataaatggaatcatactttaagtagccttttgggattggcttttttgtgtgtgtgctcagtataatgctctttattttctaggctcattctattattttaagtacattctttagtaattctttcacagagtctataagttagtggactctttcacttcttgtttgttctggaaatgtcattattatgcccttattcttgaataataccttaggtggaaatatatatcaactgggaaaagagaaacgattccaggtatttaaaattaaaaggtatcttgctacagaaatttaggtgctacaaactgtaagaaatattctcaatcacttcttcatcaaatattctctctccttcattcttccatggtcttcatctataactcttagtagatgtatgttgaactccatatcatattttctatttctataactctgtactgccttcaggataatttcctcaaatttatcttacagttgttaattctctcttcactggccatatttttcattttttagatattcttcttttttttgcttattcattttgcttaaaaatagcctgtattttaatatttatattatgtgctcaattatcagaagttaatagaggataatactggtatatattggttctactgattcttgttcatactggctgtttccttgcatattttataactttcagaaagtgagcccatgctaagcagtggattttctgagggaatacagcgtagcctgggttgagaacacacccttttaaaatggcttttgtcttaagtttctgtaaggcacctcaggagtattaacattcagtaactatacgttggttgatttcccagtgtatagaactagtcaggagtataaatttaaacctcaaacctaaaaagggtatgcctatgattatgatcagaaattcatggggaagcttttaaaattttccccacttagacactgggcccaggttgagaaaaaaatcttccttgtggtctgtctctgctgaaaagtagatgttttgtttctgtttttaatatcctgttatttgataatgctcctagggttcctgcttaatactggtgtttcatttctaactctgttcaccatgtaggccccagatcttgtctccaaatcttgactggctattaaatctatatccttgggccaagacatcccaccatcccattctcatggtagtccatgtcactactcatgcttcccactctgttttttaaaccctatatattttcaggtcttaagatttttccttactttcttgtaagcacagctatacaaccaaaacgatatttgttgcatattatagtatttctaaatatgtagtagtatgagagttttcaagttaatactaagttgcctgtctaggaattctctattaaatctttttatttgtcacatagcccatggcacagcatctgctaggcagcagtgtatcataaatgtgatgagtgactggttgaatgaatgaattaccattctttatcagcattcatttccttcattaattatttttctccaactctgatttcccaaattcctcataaatttgtgaatgacatattttatggacttcatttagactaacataattttctcacattaactattataccagtcatggtaataatcctgcattcagtttgttcccttctatttgccctacgtggacctgttggtcctctttttaccatgaaactcttgctatgtcattttattgccaagaggtttgcaaaaatcttattttggtcatttttatcgtcttaaactcttttcttctttcaatagttatattcaactgcattttccactaaataaggcactggcaaatgtgggtagcacataagatgattcttaattattgactgctgttatattctgctttattcttataacttattaatttgaggaagatttacataaaaatttgttttagtttccagaaggaaatattagaatattaataaatattatacatataaaaatatatctaaataataaaatagaaattgctccatatatacttctttcatcatatttctaccatcttcacaggcattagaaatataccatatatttactaaaatatatacatgccatctaattatgcaataatttctttcatatttatatatgtataaaacaaaattcacaggtatcttctctcctttacacctcaacactattgtatgtcttcagtaaaatttctgtaaacctgagtatgatgtcaagaactcaatggacatttaataaatattcatttgtgacaatcatgataacctcacacagggctttgaaagtgattttcagaaatcatcagctattctttcacatagattaaaaaaccttcccccagaagagatgattgcctttcaatcatagaagaaaaaaatacagcaaaaacaagtgagatagtgtctttttatttttaagctaaagatccagtgtattatagcattatgtaccatgaagatttcagataaaactatgtaaactcaagttagtgacatacaattgtatcgggtttaaaatttttccatatactgtggtatgcactaataaattccgacctgtggttttaaatacagtagcatctaagcactgatacagacctgcaattatgtcaatggacattctatgaacattagtagtgaagatacaaatccactgcagtaagctgattagcaatgctaatgtgcacactacacagtcatataattaaaaagagttttactcacagtgatgtcgaggttatggggttaggacagtttccacttcaaaagatggaagaatccaggttactatgatagcaaaaagtaaatcacctaatttaagctgttgaaaatatcatggtttatttttaaaaaagaaacttctaccctacctttgaacattatggtaaattatgaattaattctttcccagctaaaagagattttaaaaaagcagaacctcaataggcatgataaagaatctccaccatgtaacactacattagtccaactaagttatcatgtcattgtccacttaacagagaatggagcttaattagagaaaaaaaatcataaaaatgttcacagtttcccccgaaatggaaagatgtacagggagatgtgggggtggagaaaaagaagagagaaggcagtcagtaacaaacacttggttataatgatgataagaatccatttcctttatgcaattttgttggtgttcattttttatatcccttctcagctataatgatctacaaagtatccttaggtttggtggtctgtaatcagctaagataaacagttatctttgctttaaatggagaacaaccattagtcgatcgcttatatttgcagacaattccattctgaaaactaaggtgtaaatactcttaaattttagagacaaactattttgtttctgacaagatttatcacaattggaacatgtcaccctcatcgtgacacttagtggtgggataaagtagtgttgtctttctgctttagaataagaaactggatcatttcttttaagtcttgtgattatatttaaatcttatatacatgccctgaaatgaagaggtgttctcataaatccttgcattatgcaggaaaatgtcaactgcagctttaactaacattctgtgagacaaaaggaagcccaaagtagctgctcttcataaagactagatgctaatacacatgcgcatgcgtgcactcacacacgcacacacgctgtgcctccttagagagctatttctattttcataatatggttaagttaggattatccaaggaaaaaatttcaaaggatttatcatttaacacttcaatggagttactaataggaattatattgaagtaggtcatgccaaatccactctcaaatgacaagagatcacatataagtctgcaaacatttcagacacaatagccacaagacccccataattattaccagggtatatggcctagtataataaagatcaaataattcaaacttcaagccagacttataattactatcttactaagatctcagttaatcactcataaagtaagtagatggttcatactatgaaggttaatacaatcgtattaacaatgaaataaatatttgcctttctctcagtccatgatacatcctattattttagccacaaacatacacacacatacacacacacacacaccctatggctagaaaaatatgaattcaagctgaagacagtaaacaaaaggaatttatctttcctaaaaggaacacagaaataatctcccaaattgtaaattccgagttcatggaacatatttgtcctactctttggaaaatgctttctaactcattcacacagaagtcactgcaaagtgttaattaatactaatgatgaaatctgatgacctgtacatacctgtcctaagttaatttgtatgtggggtgggaggactcatataagcctctactattccacaatgacgaagaagcattatgaggttataccttaaagaacaaaaaaggtgatgctttctgtaaaattgtctgtttataaactaagcataaaatgtcaaaaggttcttgtgtctggtattctaaatttaaaaaaaagttcttagtttatgattcttaaaatatgggaaatgaacaagtactcactgtcgtctctagtcacctattcctatttttggctgacaacatttctggttagagctttatttggaagctttaacatattttaactgttacacattactcagctcaaactatagccaagataacttgcttgtcagtttattaacagcaaattattcaaatatgttccatcgtttgtgattaaagggcctgtggtgagaggggagagatgaagggaggaacaaacaaagatggggagggattgtcacggttaataataaaacagtatttctaaaaattgtttccattgttgaattaaataatttaagttttaagcttagcccgagactcgcttttaagagtctacatattttatctgtgatgaattacattattctcactcttagtcagagatgcaatatcgtctttattttaacagacttctgtggaggtatgtggtttccataaaaaatgagtaacgcgaatgttgtctttttttaaaagagtttcattttattctactactgagatagtaagctctattatccaaaagccaaaatgcaagctaacgtatctaaatgaaatattcaggaaatctctttatagttctttcagcattcttctaaataagattgtttctttcctatgttcctagtctaaaaactttaactccgttctctagaatgaaggaaaactattgaaattcttactttctcctaaaatccatgacttgcccataattgtgggacctgatgaatcctcctattgactgaaaatatatttatatcttcattcaacaaacaattctcaggccaggagcagtggttcacgcctgtaatcccagcactttgggaggatgaggcaggcggatcccttgaggtcaggagttcgagaccagcctgaccaacttggagaaaccccatctctactaaaaatacaaaattagccaggcatggtggcacttgcctgtaatccaagctactcaggaggctgaggcaggagaattgcttgaacctgggaggcagaggtggtggtgagctgagagtgtatcgttgcactccagcttgggcaacaagagtgaaagtccgtctcaaacaaacaaacatacacacaaaaaaacaaacaattctcagcaatggaaaggaaaaatcacaactggatacttctgtgcatttaaaatcataatgaaaaagaatatcataatatgatattttcatgtaacaattatatatgtatatataatatatacactggatactgagggatgactgtatatatacacacacacatacagtcatccttcagtatcccagggggactggttccaggaccccctgaagataccgaaatccatggatgctcaagtcccttatataaaatagtgtagtatttgcatatgatctacacacatcctctcatatactttaaatcatctctagattagtgataatacttaacacaatgtaaatgctatgtaaatgattgttatattgtttagattttaatgacataaaaaaagagctgtacatgtttaatgcagacacaaccatccatttttttctgaatattttaaatctgcagttggttgaatccatgaatgtggaacccatgatatggaaggacgactgtatatatcatatatatttttcatatatgatattttcattatgtgaaaacatcatgtatatgtatacatatggagctatatctatattgatatattactccttatcttaattttatcttcaacttgccttatcttgatttttacaataattatcatttaagcaggggaagaaatactatttccattttataggtgaaatgaaaaaagattcagaaagttaagtgactgattcaaactctcaaacctatcaagtagcatagccaagatttgaactagtcagtcttttcagtatgtttcactgtgataaaattataagcactgttagaaatgttcagaaaatatttaatcaatttccttgataacatatttcaataacaatttttagtactatctgtaccaactaatttttatagtaagttacagctctgtacctgtaggcagaaaaagtataaactttaaaggaaaaaaacactgaccatttacatggattgcaatagaaatcactttgctaatgacaggaaaggtctcattcaactaatgagaataattaaacagcataagagcactaagaccaactatatttaataattggatttctgcccttagcattttttatgacattagaaaatatgttgatttctctgtctgaattaagatacataatgcttgttaaggtcaagagaaaataatactttttatatagggcattatggggtcgccttgaagacattcacatcatccctccttttgttcatgtgcacatcattgcagcggctggctgttttctatcatacgatctccaaaacagagttctattattactgctttttctaacatctctctattagtatctcactctctacctgggcttccctgtcattatctcctacattctgagaagtccccatgttataaagaaattaaataaaaggtgtaagtatagctatagcccaagccaacacaccaaaactcagaggccagattgtcccaaggaaaccaacctaaaagtaataatgctaataatatttatttggataatgttttagagattcttcctatatgtttaaaatttattaaaggtaatttagaccattagcctttagaatactgcattaacacacaatatctatttttattatttaatccattatactatattaagaaactgattatatccttttaaaaataactaccgttaactcgcagatatctactaatgtgtgatcctgtttgtagattaatcaaggccccttgattttcataccccccccacccacttgagctctggacaaaaaaagaaagtggcaaaatattaaatcaagaaaagctgtagaaaggcttttggaaaaagagataaattcacatagataaaacaatctaacaaaaatcttcctgattaggtgaggggcgcctctgcccggccgcccctactgggaagtgaggagcccctctgcctggccagccgccccgtccgggaggatggtgggggggtcagccccccgcccggccagccgccccatctgggaggtgaggggcgcttctgccgggccgcccctactgggaagtgaggagcccctctgcccggccacgaccccgtctgggaggcgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggaggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaattaaaaaaaaaataaataaataaaaaaaataaaaataaaaatcatatttcatgactgtgttggtataaaaaaaaaaaaatcttcctgattacaatactttttttgcctgactttagtaccttctcactgaagtatgaatggtaaagtagaaggggtagaaatactgactacagagatacagataataggggtcaaaagaaatgtgtaatgttatttcctaacacacaacccttctttcaagatcacattttcatgcatttatgtattaaaaaataatttgaatttaaaaaactgttggtatgtaataaataactttgttgttgactttcagtatctcttttaatttattctatagggcttcccatgtctgtgcataaaattcagggcagatttcatgtttttattcatttataggcaatcaaaatactcagcaattaatatgtttagtctagcctagtattaaaaaagttgaagtcctgttataggcacctgccatgagagagggtggttagaatctcacttgcagatcctttgatttaattgaggctctttctcagcttactgctcctgagaagatggcagttcagttgacttttgggatcactggaaccctccaggcagtctatggagttaagacaaccttgtatcatcttttttgtggatatgccctacctctgatccatggcatacacttaagcaacatttgcctaacagtcacctgtcactccaccttcaaagcagctggccaatcaatctcatggctctttagatttcttaggcatgtgtcagctagctggtcttaaatggcaggggtcacttaactaagttctacatctcttaaagccttcctctcttggattcagataaaaggagaccttcctttccttccccttggaggtgtgatgggacacttagcacactaacaattctctccaaacatcctcctttcctcaatttcgaaactcccaatccttttatatccttgacatgattaagtagcttaagaatcacataactgttttttttcccttctgctcatgtaagaactggagggtgtcttcatatctcaccttgaaatcttctgtcttagggccatagctaaaacaaacaaggagagtcccattttaaaattctgttacacatggttgcaaacttgcaccatactcaagaggttaggggaaagaattgttttattttattttaccaaataaagaagagcaaatgctagcaaataattagaaaatttttattgctgaagatcactaaatgaacagtacttacttaccaacatgttttcatttgccatccatatgctatcttcattaacaataaaaatgtaaaattattgatgattttcaggtaccagggatgaatgctcaaatgctaagaaaacattcatactattctgcacccaaaactactaaccttatttccatagaggaatttctatatagaatccagaggtaaacaagagcccagggagagggaattgtctgtcctttcggcaacattatcttattataagctcttaagaaatagttaacctcatagacatcaaacagagattttatatccaagaagatattggctccaggaaagtgtcaaattgattctatgcagaatgaaaattgggagctgattttaagtcaacagttttataacatggagaaatgatgttaaatggattctagtgggtttaaaaatttttctccagaactttcaatagtgcttgatgagaatcaagctttgacttccatagcacttgggtttgaaatgcttctggaacatcagaaatcttactattaatatttcagtatgacccttttccatttttgtgaacatcagaaatacattagttatatcactatggaacattttccttacaatttgccattttaacaagtctttttcttggccctttcaaattttacttgctcttttaccattatctgtttttaaggtagctttaattggcttgaattttaagtattagggcagggtttatattacaaaaaaagaataatttctagaaaaatttaataactaattaaaacactttattacatttcatcaaaattgagaataatataatttagaatgcaatctatccagaaactgatctgtgagcacttgcttgtggttactgattgtcccatagacttagagaaagaactatatgaactatacttgggtacacagtgaacatgttaaaactaagacgtagcattaatgtaaaattcttggcagaagtcaaacctttaaacatcatgtgaatatagattttcatatctaattttatgaaggcttttttttttcttgccagttctatagtctaatattactttctttctgcattctctttcacaggctatggcctttggcaaagacaatgacaggcaaatatttataaaccatagattagttataaatttgatccaatcaaatgatcagtaagcacattcttattgccagttgttattacctcttttggaaaggtattggcaactttcattttgttaatttcaaatcagacaatttcccagaactaactgaggttccagtgcccagcggaaagctaaaataacctaaatttgcttcttttccttcttcactcctgtcttgtgtgtgtatacttatttgtgtatgtgcacaagtataaagaaataattatttttgcagcttttggcctgaatgcttgtcactccattttacataattcaatttaccctcttccaaaaacagatgtttcagttgcaatctttgcctctttagaatctccatacaggcaagcttagctaataatttttgattaatatagccaaataccaactcctacttcaaaccccctttacttggaatactatcatcagattggtttacagagagaaggaaataacaatgaggtcaggaggaatggagatggggtaaaatagcaataaaaagtaattatataaaaatgctaaaggtataacatctgcttttttgcttagctcactgagcttgacagtttcagatttatgctattgtccatgtttaaacagatacagaaaagggaaatgggaaagaatgtttatgtgagactattaaatagtgcagggaaaatacgagttgttattacactggtaaggaaaagagaaactcagtgaaatttctttccagagatttgcctttgtgatctgcaaggtgctgttcccctgcttacattccgttaccctggcaacgcactcctgtaaaataaagattattaaagcgcatatgattattttgctgctgagtgaataagacaagccgcttctgaaatgccttatcagagaaattcaattttaggccaaattgtgtttttgcctccttctagcttttttcctccctccccccacttcaaataaaaccatcatcttcacatttactacatgatattttgttacccattcacacccttagtattttaagtcagttttcttttaatttcatgaaagcattttccccaattttttatagctctagtctattttccagctatctaccatctgtttgcaaatcaaaattacaaagcaatgtgctcttgcttttattttattatatagtaatagtagaaatattgggttctgtaccaaacataaatgtatgtattacacattggctacgcaatatttgaccaaaggatgatgcaaaaggcaaagataaggaatgtggtgccattttaaagtctgcatatccaactgtattggtcatcctcacccttaagttgaatgtcttgtgcttttccatttgacattgccctaaggtgatgttatagagctgggaagttttatagccacgttgacagccagtcacgcctttgttgcttggtgcctctacatttggagaaaagattcttgagagccctaaaattatttaataccaaacttataaagtttggtattttataagtattttaatattagccaatttcttggagatatagtaatggcaactttgctaaaactatctagtgatttcattagaaactacagcttttatcataattagggtccgagcagaggtcaacaaaaaataagtaaattggtaatagtaaatgcatatttactgtttcatgctatctgtgtgaagaagttatcatttaaaatcttttaatacaagaaagagttacatccgctttgaagtagaggtggagggaatgaagtttgttcagaaaaaggcaagtttccaacaaaggccacatagaagactccttacacatctgttaaagctaacacgagacatgaatagataagaacagccctggagaaaccttcatcctgtactctccgacagtggatggatgaggtggatgacattgcttctacagagattgtttatgggacatttttcccactgctacaaaacactggcatataacctaatactgctgtgtcatgaaaaaaaagcagaagtacagtgttgataatctaataacatgaaaacattaatatttgctctgttaacttattttcaggcccaaccaagcaccatactcctacgttgattaagcatacaggcccattggctttttatgtaactaactacaaatcactgcttattactaagaaataacattgatatttcacaagttctagacactctgagcacatgtagaatgaaatatcaattcttctaatgaagcaaatcaaatttagtattgtacacccaatctttggtatgttaacaccaccatggaacttatgactgtaattcactcccagcactgcccagaaggtgtcaccacagcctcattggcttgaaggacttggggacatgtgggggagtagaaagcaaggggagaaaaacagacacaaagaaaaaaaaaatcttcatgcagacaaaggaatataagacaactactagttgtaatatagtgccaaatacagaatcacaaacattcaccccatgctaaaactacaaaattactacaggagaaaagtgggcctctacttgtcagtgagagtagaaagtaggagattcatggaaggtgttacttgaggtagtcattttgtagaaaataaaaagcaggtgataaatagaaaatattcatgtactgagcctggtccaagcttcttacctaaaatggtttgcctccttatcacatctagttggataagctgcactgggccacataaaaggaaagataaaagaacagctgggaagagatgctatgaagaatcaaagaatagaaaacacaaagtcttttattgagaagctgcacaaattaactccaaattaccgccacagtcagacaagaggaggcttcaaggcacaaaacttgttgctgcactccatcttgctttattgtggtgtcttcactcatgtagctaaaagccatcccctttatagtactatatcttttaatctctgctcttcccccctgtagtttaattaaaagacaatgaaccttttaaagtagtcaaatggaaaatataaaattgcaccattctatcaaagcttaagatattcctgttctcagagcatgagaagaattcaaaataacatactttgtattttactacacttcagtccctctgtgccatttcttcttcagggctcttgattggaatagctatctgaaccagaaacgcagctcaccctcagaatgataaacagaggcaaaattaaaaacaagtaaacaaactaaaaaaaaaaaaaaaaaaagtcaagttaaatcaattagatctttgtacctgattttttatttttaaataatattattgtaattctgcattccttctatgtttaactgacataggcctaaagattagtagtgtttcttatgtaagtattatttactcaatatgttgtcagttttagggcatgtgggctaaaataagaaaaatatagtaaaatgttattggatgataagtaggcctgaatgctcagctttccgacaactccacagcctaaatctattagttttggcaaagggcaccaagacaaattcatgccgtttgaaatgttccatgggagtctttaaaaatgaaggtcttgtctactctttatggacattaaaatgcttcatcccaaggacccctttatagcaaattgcaagctgttctgttttatctgctttgacagaatgaagggctgagctggccctagagggatgggatacagagtctgagtagctcaaacttgagatttccaataaaccatctcctacaattagaagaaaggcacagaggagattcatttcaacagatagttccagcccatttagaactactctattctcccctacttatttcatcactaaaaatctaacaaaaatcatgtccctccaatactccactccaaactagcacctaaaactctaataaccagtctagttgagctttggcatatatacatccttcttattagtctcttgattctgatacttattatattaattcccgatttcttataacttcaaatccttttcaacactataattacccaatcattattctttaagttcaattgtccagtataggttgcctatcattctccataaaagaaatacttgcagatttcagttagttaataaatgctgccagggcatgagacttaagtttaattcttcatctatagatgcctaatataggaaacctgctaaaaacttccagacaccactcaattcattaatgccaactctctccctttctcttacccttctgtaattaggacgtctctttttcgagtgtcatcacatatgataatatatggagagtgtgaactgttaacatcaaaaaaatgattcttccctttagaatgtaagattataataactaatcctatttttaaaagtccccaaagccacatactcataagtatacctctatgtaagtcagcttataaaagtaataaaaatgagggccaggcgcggtggctcacgtctgtaattccagcactttgggaggcggaggcgggcggatcacggggtcaggagttcaagaccagcctgaccaacaaggtgaaaccccatctctactaaaaatacaaaaattagccaggcgtggtggcacgtgcctgtggtcccagctactcgggagactgaggcaggagaattgcttaaacccgggaggcagaggttgcggtgagccaaggtcacgccactgcactccaccctgggcaacagagcgagactctgtctcaaaaaaaaaaaaaaaaaaaaaaaaaggaataaaaatgaaaagatagggaaaagaagtctctcatcaccacctccaaaactttaacaatagtaaaattaataatttatcaagaaagatccccctagttcagggaatattcctcaaacatactctgaaagctgaaatcttacagtatcgtatacaatagctgaagctctgacaacgttaaaatcatccagtctgttcctgtctcgggtttcttatttttctataccaaagcatcattaaaattgcacaaatttgccaaaaggaagaagagaatataatgcaaacgtcacaacaattaaaatagaaaagcattaaaaaatgatttaaagcacaggcgttcaaatcagacagactcgaatttgaatattggttctgttgactactgacaagttcttgaacagtctaaaattcaatttattcttctattaaaaaacaataatatcaactttgaagggttattgtgactgaataagataatataggtaaaatgctcagcacactgcttatcatacagcaaataaatattcacatgctagttactatggaaagaattttcccgggggagggggacctctcagagaatgaaaatattcattttatatgacttgttttataataacgaaataacattcaatatggaagaacaagtacaagtttcaccctgttgacaatttaaaattaacctaaagaataaatattgctgggtgcagtggctcacatctgtaatctcagcactttggggcaccaagtgggtagatggcttgaggccaggagttcaagaccagcctaggcaacatggcaagaccccatctctataaaaaacaaaacaaaacagaataaatatttttgggttttcaataatgaagatataatgacttcattatttgatataaaatttgacacatgccctctgctcaaaacagaaaacacgggagataaaatataaaaatggataaccaaaaacaaaatacataaataggctcacaaacacgatacgtacttctatggaccagtatgaagacagaattgcaaaacagtgtgcagggctgaggctactgtgtgctagactctggagggaaacagtggtagccaggattcggctccagtatggtaagggggactaaataggttttggagaaatagggaatagcttgatattggaggctggtgtgtggcttcccctcactggaaagctcagtggctgaatctgtatcactctgagctgaactgtcattataaggcatatgtctggacagaagccttggggagtctgttgtaggtaattgaaagatcatcacaggacggaatgaacaaggacaaaaagagcaaaacactcataaaacctcctactcaaataggacggaaaaccaaaattaacagaaatcaaattctaacaaaggtatcaaacaaaatcaacaaatcaacactcagaaaatgaattcgctctggccaggtgtggtagttcacacctgtaatctcagtaccttgggaagctgaggcaggaggatcacttgaactcagaagttcaagaccaggctgggtaacatggctagattccatctctacaaaaagaaatttaaaaataggctgggtgaggtggcatgagcctatagtcccagctaatcatgaggctgaggtgggaagatagcttcaacccaggaggctgaagttgctgtgagccgagagccgagatctgcactccagctggggcaacagagtgagaccttgtctaaaaaaaaaaaaaaaattagagaaaaagaaaatgaattcactccacatagcattagtttcattgaaaaagcctaacaacgacttccatgactttcagcgaagtatgtttggaatatttgaaggcataaataaaataaatataaaatatttcaggcaaaaggcaataagctataaaatgagtcagatatgaaataacaacggtatatgtggaaaaaaactagaaatgaaaatacagtcaccgaaattaaaaactcaagagcatgaataagctctggactgcatcttgtacattcaaaaccctaaggaataaaccaaaaaagctattagatctattaaacgagcttagcaaagttgaagaacataagactaaaatataaaaatcaattgtatctctatatgctaccaatgtatagactacaatttgaaaataaaacttagtgaacaattgcatttacaatagcatcaacaagaataaaatacttaggaataaatataataacaggacagacatgtatactaaaatctataaaacataattgaaagaaatttaaaaattttcaaggatctaaataaatggaaagacatccagtggtcttccgatggactgaaagacttaatagtattaaatgtccacactccccaaattgtgaactacagattcattaggaattctatcaaaatatcagatgtcttttggcagaaactgacaagctaatcctaaaattcatatggaaatacagaggacccagaatagccagaataatcttgaggaagatgaataaagtgtagaatctttttttgtttgtttgtttgagacagaatcttgctctgttgccaggctggagtgcagtcacgcgatcttggctcactgcaacctctgcctcccaggttcaagtgattctccttcctcagtctcccaagcagctgggactacaggtgcctgccaccacgcccagcaaatttttatatttttagtagagacagggttttacgatgtcggccaggatggtctcgatctcttgatctcgtgatctgcctgcctcggcctcccaaagtgctgggattagaggcgtgagccaccgcactcagccaataaagcgtagaatttatatttcccaatttcaaaacagcctacaaagctatagtaatcaagattgtatggtattgacatagagatatagatcaatgagacagaattaagatatcagaaataacccttatatttctggtcaattgattttcaataaggttggcaagataatttgatgggggaaagaaaaccttttcaacaaatcatgctgtggtaaagggatatccacatgcaaaagaacgaagttgtcccctacctcacaccctatacaaaattaagtcaaaatggatcaaatacctaaatggaggaggtaaaattataaaacgcatagaaaaaaaaaaggagtaaatattcttgaccttgacttaggcagtgatttcttatatatgataccaatagcacaagcaataaaaaaatttgataaaactgaacttcgtcaaaaatttgaaaaaaacttttgttcttcaaaggacactatcaagaaagtgaaaagataactgacaggaaaaaagtatttgcaaatcatatatctgataagaaacttgcattcaaaatatacgaaagatacatataactcaataaaatactaaaaccccaattttaaaaataggcagaggatttgaatagaaatttttccaaaaaagatatagaaatgccaataagcatgtaaaagatgctcattagtgattagtcattaaggagatgcaaatcaaaaccacaatgagataccacttcatacccactaggatatgtaataaaaaagacaataaataacaagtatttgggaggatctggagaaattggaaccctcagacattacttgtgggattgtaagatgatgcagccacttctggcaattcctcaaaatgttaaacatagagccatcgttatgactaagaccaacaattccactcctaggaatatactcaagagaaaagaaaacatattatccacacaaaaatttatacatgaatgttcacaacagcattattcacaatcataaaaaaagtggaaacaattcaaatgtccatcaaatgatgaacagagaaataaaacagggtaatatgatttgacaaaagaaaaaaaagagaaaggaatgaaatactgatacatgctacatctatgaacctcaaaaacattatggtaagtgaaagcagccaattacaaaagaccacagattgtatattgtatagtatcatatatgcaaatgttcagaataggctaatctatagagacaacaagtagattagtgatgacacagggctggagggcatgagcaaatggaagggggagtaatgagaagtgactaccaataggtacaatgtttattttggggatgacgaaatgaaaatgttctgaaattagatttttgtaacattcgtataactataaatatactaaaacccactgagttgtacacgatataccagtgatgcatatttatgacatgtaaattatatctcagaaagtgtttttaaaatggttggggatgcagatgtaaattgctataaccacttagaagaacaatttgccaacatctaatatagtttataatacacgtatacccagcaaattcattcttaggtacacaatggggcaaaaatcttacatacaagcacaagaaggcaaaaaaatattcattataacattgtttataatagttgaaaaaatggaaactacccaaatgttaattaagaagtgaatggataagttgggcgcggtggctcatgtctgtaatcccaacactttgggaggcagatgtgggtagatcgattgactgcaggagtccgagaccagcctggacaacatggcaaaattccatctctacaaaaaatacaaaaattagccatgcgtggtggcgtatggttgtagtcccagctactagggaggctgaggtgggagaattatgtgagcccaggaggcagaggttgtagtgagccgaaattgtgccattgcactccagcctgggtaacagagcaaggtgatgctctatctcaaataaagaaaataaagaatgataaactggtacatatttttaaaatgaaataccataaaatgtatcaatgaaaatgaatttcgaaaatagaatgttgagaaaaaagcaaactgcaaatgacatacacaatgtgatgccatttatagctcaaaaacttgttatacaacaatatacaccatttttggatacataaacatataataataagatttcttaggaataaaaccactatcttcaaggtacagcttacttctgagaagaaacataagcagatttgttaaaacatgatttatatctataatgtaccattattattattaaaaattctgtagcaagcatgacaaaatggcaatttattaaccagtgtaacaggcctaagagtattgcttatattactcttttttcagtttgtttaaaatatattttaacacacacaaaaacggcacgatccaacaaatttaaactttccccaaacagcaaagcttctcagaatggtttttctgttttgcaatcaataaaccaaaggcaaatattattgacctaagccagcattagagtaccactaaaagtcaaaggattcatttagtcaaaatgctaaatttttttaaggtgcaattagtacggatgaattcaagcattttaaaaatcagatgctctctgaccttcccactaaagtgtcacctgacaaggtcaccatttcaagaatatagtaattattcaggaatgagggagaacattcagtggggtagtctccccactgttttctcagtagaaatcacagaaatgacaactgtaattaaatcttttttttaaattacctatgagttttaagtcaggatgaaaattatttctaaccttatgaactttcacactgcactgcactaaaagaaaatccttccagttttcctttatatgagtaaagcatatgacagctaaataaataggaagtcttcacttctgacctttcattgctattcaaaagaagcaattctgtttgccactattccacttaccaaagatacaaatgaaacaagtagaataattaacacaaaatcatctcttattgaaaagagctgaatgctttaagaaaaacattattacaaaagaagggagaaggtaccatttagcccctaagccatggaagttaacagactctttccatcttttggtaatgatgacttaaattttggaaacattcaaaaaaaaaaaaagatttttcaggttgaaagaaagtattatagaagtccaatcattcacaattattatcattatataaaagtctaccttttcagaaaatttaagaccacattttttataattgtaacaaacatagattaccctttactcacctttccccccaaaaatataacaagataaagacagtgaaacgttttggtatatttaatcacaccattacctgcttccctattagggacaacaaacaggtctcatctcctggcccaactctgaatgactataagtgactgctcaggactgtgtcaagaaatgttcctaggccatctgagcttacaagcagagtagtggattgattagggaaaaggaatgatgaaatgtcagccaagtatttgccagcctgattttatatctgttaatgatagaaaagaactaatcatacttactcactcatacatatgtttgagtatatgttataaagtgagttaatacctaaatgatttaaataaaattcaaataattactagcacatgtcgttagagaaaaatataaactgggggaaaaggaagagtttctcaattagaagaaatatacaggacttgacgataggcctgatggggacaatatgagccacagaaggaaaaacctcaatgactcaaaatatttattgttttgtctattctggacattttttataagtggaatcatatgatatgtggcctttgtgactggcttctttcactaagcataatgctttcaaaattaatccatattgtagtatataatgttacttcattcttttttatggtcaaagaatgtttattgtatgaatatacggcattttacttttccattcttcagctgatggacctttgggttattttcattttttctgaataaaatattttatcatatgtgttaatatattctttaaatatttggtgggcagatcatttgaggtcaggacttcgagacccttctggccaacatagtgaaaacacatctctactaaaaatacaaaaattagctggccgtggtggcaggcacctgtaatccaagctacagctgaggcaggagaatcacttgaacctggaggcagaggttgcagtaagccgagatcgtgtcactacacttcagctgggtgacagagcaagactctgtctcaaaaaaagaaaaaacaaaacaaaacaaaacaaaacaactcctcatccattaaagttttaccatgagattgcagcaactcagtcacatcttcaggctctacttctaattctagctcccttgctattttcatcagatttgtagttacttcctctattaagtcttgaacccgtcaaagtcttcctagagggttggaatcaacttcttccaaacttctgttaatactgatattttgacctccttccatgaatcacaaatgttctcaaaggcatctagaatgctggttcctttccagaaggttttcaatttaccttgcccagatccatcaaaggaatggctatctattctgaaataacaagacttgaaagtcaaaatgaccctttgatccatgggttgcagaatggttcctgtgttagcaggcatgaaaacaatattaatctccttgtacacctccgagctcttaggtgatgaggtgcatcatcaatgagcaggaatattttgaaaggattcttcacttctgagcagtaggtcttgagagtgggcttaaaatatttagtaaccatgctgtaaacagttgtgctgtcacccaggctttgttgtttcatttatagagcacaggtagagttgatttaacataattttttttttattattatttttagagatggggtctcactatgttgtccagggtagcctcaaatccccaggctcaagcaatcctctgacctcagcctctcaagtagctggcagtacaggcatgagccaccaaaccccccaaattagcataattcttaagggccctaagattttcagaatggtagatgagcagtggcttccacttaaagactctagctgcattagcccctaacaagagtcaacttgtcccttaattctttgaagccagacattgacttgtctctagcaattaaagtcctagatggcatcttttcccaatagaaggctatttcctcgacattgaaaatgtgttgtttaatgtagccacattcattagttaccttagctggatattctggataacttgctgcaggcctctgcatcagtacttgctgcctcaccttgcactttcatgttacggagatggctgcttcttttgttaaacctcatcaaccaatctctgctagctttatttatttatttatttatttttatttttgagacggagtcttgctctgtggcccaggctggagtgcaatggcgcaatcttggttcactgcaacctctgcctcccagttcaagtgattctcctgcctcagcctcccaagtagccgggattacaggtgtgtgccaccatgcctggctaattttttgtatttttagtagagacgggggtttcagcatgttagccaggatggtctccatctcctgacctcatgatctgccagcctcggcctcccaaagtgctgggattacaggcatgagccaccgtacccggcctattttttttttttttttcctacagcttccttgcctttcatggccttctagaactgaagagaagtaaggccttgtatctggatccagctttggcttaagggaatgttgtgactggtttgatcttctaccactaacactttctccacattggcaataagcctattttgctttcttatcatttgtatgttcactggcgtagcacttttaatttccttcaagaatttttcctttgcactcacaatttggataatcgtttggcacaagaggcctagattttggcctatcttggcttttgacatgccttcctcattaaggttaatcatttctagctttgatttaaagtgagagatgtgcaactcttcctttcaatcgaacactaagaggccaatgcaaggttattaattgacctaatttgaatactgttgtatcttagggaatagggaggcctgaggatagggagagacagggaaatggccagtcagtggagcagtcagaaacacacatcacattcattaagttcaccatctttcatagacagtttgtagtgcctcaaaacaattacaatagtaacatcaaagatcactgatcgtagatgagcataacagatataataatgataaaaaagtttgaaatattgcaagaattaccaaaatgtgacacagagagacaaaatgaggacgtgctgttggaaaaattgtgcctataggcttcatccacacagggttgccacaaaccatccatttgtttaaaaaagaaaaaaaaaaaaaggcagtatctgtgaagcacagtaaaatgaagtatgcttatacaagatcatgcaaacagaaagagttttacatttttttccccaaactggatgccttttattcctttctcttacttaaatgctctggctagaacttctagtacaaggttaaagagaagtactgagagtggacatcatcttgtacctgacctttctgaaaagcatttagtatttcaccaagaagtatgttagctgtgtggtttttgaagatgctttttatcaggttggcagattgtctttctactcctagttggctggatgtttttatcatgaaagaatgttgaattttgccaaaaacttattctgtatctattgaaatgattatgtattcttgtcctttgttgtattaatttgatgcgttacatagattgattttcagatgtcaaagcaaacttccattcctaggataaatcccactcggttatagtgaatatatatactataatatagctggatttgatttgctagtatttggttgaagatttttgcatctatatttacaagagaaattggtcagcattgttttttcatgtttgctttgtctagttttggaatcggggaaatactgacttgacaagagtaagttgggaagtacttcctactcaggtatttttgtaagcatttgtaaaggattggtgttaatgttctttaaacaaatggtacaatttaccaatgaaggtatttgggcctaggcttgtgggaattttaaaaattactaattaaatttctttactttttatacaggtctattcaaatttttattttttcttgagtcagctttggtagtttttgtcttcctaggaattttccatctcaagttgtataatttgttggtgtacagtggtttatagtgttaccttacaatccttttcatttcatttctttaattttatgttgtggaatacatgtgcaggacgtgtaggtttgttacatagataaacgtgtgccgtggtggtttgccacacctatcaactcatcatctatgtattaagtcccgcatgcattagctatttatccttgatgctctccctccctccagctccaccccctacagggcccagtgtgttttgttcccctccttgtgtccatgtgttctcatcattcagctcccacttataagtgagaacatgcggtttaagtgttgtttcctctttcatttctgattttaataatttgaatcttcttttttattggtctgctaaagttttgtccattttgttgatcttttcgaagaaccaaattttggtttcattgattttctctattgtttttctatcttgtattatatttatttttgttcaaattttaattattttcttctgcctcactgtgtttagtttgttctttttattgcttcttaagattgttattgacttcaactttttttaaatataggcattataccaataatttcatgtaagtactgctttaactgtatctcataccttttgctgtgttttatttttattttcattaatctctaagtattttctcacttcatttgttaaatttttcattcattggtcatgtgtgtattgttaattattcatatatttctggatttcccaaatttctttcccttgtttctaatttaattccaatgtggtaggaaaacatgctttgcatgatttcaatcatttaaatttattgaggcttattttatggactatagatggtctattatggagactattctatgtatgcttgagaagaatatatacttttgttgttgctatgaggagtgttttatagatcctgttagttcatgttagttggtggtattgtatgacacttccttgttgatcttcttcctagttgtgctattattggaaatggggtacgaagtctccaactattattattttactgtctacttctcccttcgattctgttggttgttgctttttatgttcttgggtctggtgttagtacatatttgtttgatatttttacatcttctagatggattgacactttaaattgtcctgttatgactctaataacaatttttgccttaaagtctcatattagtacaccaacttcagctctattttgattactgtttctgtggtataagttttcctatctattagtttgaacctttttgtgtctttgaatccaaagtatgtctcttgtgagagcatatggtggcatcttgctcttttattcattctggaaatccttgtttgttgattagaatgtttaatctgtttctttccatttaaaataatgcaatgaaggcttttactatccaaaaccttattattcagtatactttcaggaatagatttgatgcagaaaattaggaagtgcaaggtccacagatgttggcaggtatcagggaaagctctttagtagaggtggtgtgcaacttatcttggaatataagcaaaagttagtcaactaaataagacatggattagaacagtggagctcctgagaatcaggtatttctggtagagcaaacaatacgaagaaagaaaagagcatggtctatttggatcattagttgttgtttcagtattgatgcagtagaaaacggtggcactgggcgcggtggctcacgtctataatcccagcacatttggaggctgaggcaggtggatcacgaggtcaggagttcaagaccagcctggccaacatggtgaaaccctatccctgctaaaaatataaacattagctgggcgtggtggcacgagtctataatcccagctactcgggaggttgaggcaggagaattgcttgaacccgggaggcagaggttgcagtgagccaagatcgcaccactgcactccagcctgggcgacagggcgagactatgtctaaacaaacaagcaaacaaacaaaaaaacaaaaaaaaaaaaagaaaagaaaatggtggtattgaggtgtgctttaagtcaccacatatgtattgtggctaaaactgttagaatgaatgatattatccagggataatgtcaggagtaacaaaacatgaaggtctacatctaaactcttgtttcagattttaaggaataatttcaaggtttccctagggtctgaaaagcaatggaaaatgaaaacctgaacattccatgaacacatctttttgtattgagaattaatggaattaagtttatggtttttacatgcccaagtgaaatagtcattagcaatcattgaaaagtttagagcaatgacacgcccacaccactctgcattgccttctgagaacagctgcacatgctgccacaagtttgtgccatactgtaatactttttacagtactgtaactatttcataatatattttctttattttttgagacagagtctcactctcacccaggctggagtgcagtggtaccaccttggctcactgcaacctccacctcccaagttcaaacgatcctcccacctcagcctcccaagtagctgggactacaagtgcacaccaccacacccagctaatttttgtatttttagtacagtggtggtttcaccatgttggccaggtgggtctcgaactcctgactacaaatgatccacccaccttggcctcccaaagtgttgggattacaggcgtggcccactgtgtctggcagatttcataatatattttaattgtgaaccttaaagatactataaaaagagtaactcaatcctcaccatgtagtgtggaatataagaaaaccttagcttacttatgtcgtttaaaaaaattatcagaatatttataaaatcccattacatagttattacacagttctcacatgatagctatcacagttccttcttttcctttttgtagttctgcctacatgtctgtgatggttagtactgagtgtcaacttgattggattgagggatacaaagtattaatccagggtgtgtctgtgtaggtattgccaaaagagattaacatttgagtccctgggctggggaaggcagatccacccttaatctggtgggcacaatctaatcaactcccagggaatataaagcagccagacaaatgtgaaaagacgagatgggcctagcctcccagcctacatctttcttccatgctggatgcttgctgccctcaaacatcggactccaggttcttcagtttggggccttggactggctctccatgctcctcaacttgcagagagcctattgtggggccttgtgatcatgtaagttaaggaagtctgataataatatatatatctatatctgtcctattagttctatccctttaaaagaaccctgactaatacaatgtctgtagaaggcaacctttcaactatccatcacaacttttacttatgttttctatattcctacagtatttctaaaataaacacacactgcatctctctccatccacgtgaagaacatacattccttcaaggtaatctatataaagagaagtagaagaaacatctaattaatgttggcaaacattttataaattaggataagtcatttttgctggtttgaatagttttgggcaaaggttatgaaatatagagagttatgctgaaggaaatggtccttctccagtccaattttttgctatagtataagtgactaaccaccaccattgctgcactggcttgtcccttttttccccatccaaaacattcagtatggtgcttatttggcagggtaggagtgaatactactgataatgatagcataatagctccatcagtgccatgtgtatattatatcttgaatatatacagttcataattattggggaataagaaactataacagatgcagctgcaaaagcagccaacttgccatcttcctgaagttgataagaacctaaatgaacactttcatattgtatgacatgtatgaaccaactgaaaatccaatttataataacatgctcctgtctattccttcctgtgctaaactacatgagttccactattatgttaaatccaatattctgctgttctccctgctactcactttcatcctataattctagagtgtcaaagtttaaaacactgtaataatatacctgcagaaatttagtaataaggcagatataggtttaatctgaaataaatggtttttataaattatttccgtatatctaacaagtctgatctaggtattgttggctcaagcttctatcaactcagaacatcctggagctgaagagaaattccaggttgctttgtgtccgcatgtctatgaattaataatatggaattagggaatactagaaacagtccactactaatgaatctagaaatgtatctcatagttgagagagctgtaattcaactcaacaaatacttcctgaatataatgtccaatacttgctaagtataaacagttattcataaagccatcgctacatttagatgtaaaatatgagtcactaggtttaaatctcattaaatcttcacaacaacccaatgagggtgtccatcatcatttggcaggtaaataaaatgaaattacaaaactattaactgggggtggtgaacttgaaccctaaactattcaactctaaagcctgcgtcctcagacagtattacatttttcttcttaatggtatattcacttggttttgcaatctatttgagatttcaggtctgttttttttaactataatgttttaataagacaatacatttacatgctttaaaagtcaacactgaggcaagaagaattgaaaattggtaacaataagtatatctggtatacagatgacgatttacatcattaaaagaaaccagggctccctggagaaacggcttaatagaagaactgcggcaaggaatatagaacatgagtctggaacattttgttataccagaaagcaaggaagagatttaaaaaaaaaaatgttaggggccaagtttggaggctcacacttgtaatcccagcactttgggaggccaagacaggaggatcgcttgagctcaggagctcaagaccagcctgggcaacatggtgagaccttgtctctactaacaacaacaacaacatcaaaaaatcaaaaaagttagccagctgtggtggtaaacacctgtagtcccagctacttaggaggctgaagtgggaaaatcacctgaactcaggtctaagcagcagtgagctgtgatggtgccacccgcagtccaacctgggcagcagagtaagaccctgtcaaaaaaaaaaaaaaaaaaaaaaagacagggacatttgagaaacactggagccagcttgaagagatttctactggctgaatttgggacaatataagcactgaaaaaatgtgatatccgtgagtccataatgatccttttttttttcttaatgggagaggaggagaagcttttcttcatagcaacacaccagccagttaatgtgaaaggactatttggtaagaaaatcatttggcaaatattatagtaaaagcagatttagtcaagaatcatcaatatatattacaattcataggtgaaaaccttacgaagaacaagatatctccatcatctcaaattattttaccaacaaaattcttgctaattataagacagaaaagagtaacttcacaatgggaaacctacaagatggcacataaaccaaatgatccaagttaacaccaacattaaacataaacatgtgaataaaaagatatcacatcccttctaatatgatacactgagaaagataccaagtcacttctgtggtgtcctcaccaaaaattctaaccatgcagaaacatcagacaaacccaaattgagtaatatttttcaaaatatctagcctgcactacttaaaaaaggttaaagtcatgaaagacaaacaaggatgatttcagattaaaggaaactaagagatctgacaataaatgcaacgtgagatactagattgcactctgatacagaaaaaaaatttatttatttcctgtaagggcaaagaaatacaagggaaaaaaaggtgtaatatgaatcagatttgtagatttcataatagtattgtatcatgttaatttcccctgtggttatatatcagaatattcttagaaaatacaaatgaacgtattttgggggaaagaggcgttatgtctgcaacttacccttaaatggttcagaaaaacataacacatatataattaaatatataatatcatacatagagacagactgtgaggacgatacaaagcaaatatggtaaatttgggtatctgggggaagagtatacagaaattctttgtaatattcttgaggcttttctctgagattaagattatttccaagagaaaatttattgctaatttgtactaagaagacccacaataaacttagacactataaataaagaaggaagcagggcagctgaaatataaggtaatggtcacaaaaatgtagtctaattagatattatttaaatttccattagacataagaaattacaataatttttagtgtgatatgatttcttaaaaaacagcctttatctgtcagcgatacacagtgaaatatttacggatatatacagatgaaataatatgatgtctgacactgactttaaaataatttagtgaagggaaatgggtgtggaattatggatgaagtaatatagctcatgcattgataattgttgaggctaggtgatgggtatcaaggttagttaacctattctttcttcttttgtgtaaagtacacaacaaaaagtttttaaacagtcaatgttatacaaaaaatgcaacagatgaatctttgtcccactcctgccaccatatttcctgtcaactccttataggtaaccattttattagttgctttttttttatttttccagtttctttacaaaaatacaagaaaatacaaatatatactcttacttttccactcttcctacaaaaggtaacaaacaataaacactgctctatatattgtttcccttcaccccaccagcttcatacattctgtatatctctccataccagtatatacagctctattttgtatatgtgtgtgtgtgtttgcgtgtgttccatggtttattcaaccagtcccttattactagatccttgatttatttccaatcctgtattcatgcaacaatgctataataacaatataacaatataacaatgctataataaatgactgtgtatatttctgtcattttgtaccagtgcaggtttacctacagcagtggtccctgacctttttggtaccagggaccagttttgtggaagacaatttttccacacatgggggcggtggtttcaggatgaaactgttccacctcagatcatcaggcattagattctcataagtagtgcataacctagatcccttgtgtttggagttcacaatagggtttctgctcctatgaaaatctcatgtcactactgatctgacaggaggtggagcttaggcagtagtgctcgctaggctgctactcacctcctgctaccggttcctaacaggtcacagactggtattgatccatggcccaggggtaggagacccttgacctacaggatagataaccacaggggaagtcctaggtcaaagatatgttttttaccatattcttgttcctcccacccaccactgatatatgagaatgttgtttccccacaggcttgccaacagaatgtattatctaacttttgggtttctgtccatctgacaggtgagaaattacactttggtattttttcacttgcactatttttcttgttatgggcaatataactgctatttccgccacctctcatgtcagaggataaggaatctctattggttataagcctctaactatgcctttgaatcagtttttttcttaatgcatctaagaaatttacttcttcaagtattccctattccttcagtatctttcatatctctaatattctccctactttttcctttccttctaaggtcaaatatttttttttcttgctagatattacactcaaacaatatggtataaagaacagaacatgagaagtctccttcttatgttgaacctgaataccatccatcccaagagtgaaacaccattctcagtttgtgtattccctctctcacactgtacatacagatgcacacatgtattacatttaatagatacattcaaatgacaacatactgcttaggtgaggtaatgctagctgctgtaataactaaaccctaaaatctcagtggtttaacacaatgaaagcttagtttggactcacgtggtagtccaatgttcagttggcatatttccacgtgtacttcaggcgcccaacttctgccatagcctaaggcttcagtcttcactttagcagcaaatggaggaaaaagagagagagattaagacataattgcttcttaatcaccctgcccagaagtcctatcagatcactttgcacatattccacaagaagtaacagtgattttaaatgcagaagctgggaagtttagtccctgagttggtacttattcaactttactctatggaagggtaacataaatccctggagaatagatagctacctcttaaacatagattcttcatgctgttttattccatagtgtgtgtatttccttaatttatcttagagatgtttccaatagttcatattgggctgacccactgtaaaaccttttttttgttaaaagaaaaggtgaaatctgatgtcaatttatcacttctattcaacacagtattgaaagtcttagccaaacgaattaggcaagagaaagaaagaaaggacatgtaaattgaaaagaagtcaaattatccttcttagcagatgatgtgatctcacatttagaaaaacttaaagattccaccaaaaattattagaactgataaattcagtaaagttgcagagtacaaaaccaacatgtacaaatcagtagcatttctatacactaacaataatcaatcaaaaaaagaaagcaatcccatttacaatggctatgaaaaataaaataaaataatacctaggaataaatttaaccaaaacagtgagacagctctacaaggaaaactataaaacacccatgaaagatactgaagaggacacaaaaaatggaaaaatatcccatgctcatggattggaagaattaatattgttacaatttctatgctgaccaaagtgatatgcatattcaatgcaatctctatcgaaatacaaaataccaatgacattcttcacagaaatagaaaaaataatcctaaaatttgtatggaaccacaaaataccttgaagaactaaagcaatcctgagcaaaaggacaaagctagaggcatcacatatactacagagctatagtatccaaaacagcatggcactggcacaagagcagacacacagagcaatggtacagaatagagaaactagaaataaattcacacagttacaaccaacttatttcacaatgtgtgaggttgcttttcctccacagaactaatcaaaatttttacctttgcctatctgatggatttaaaaaatggtccatcagtgtagtcttaattcacttgtctcttctaaaaatatgacaatctcatcaagattttaggagttactagatttattacccttttcatcacttgtctgttttttattttatgaaatagttggtatttctcattgatttctagaggctcctaatacactaaggtatcttatttgcaatacagaattttaaatgtttcccacagtttatagttagtctttttgctctgcttatgatatttgactgtgaaatttttatatttttacttaatcaaattaattaatcttttccattgtgacttttgaggtttgtgtccaacttaggagttctcacctctggtataaagaaataattctcccagggcttaatctaatacttttttgtttttatttttcaagataaaacctttgtttcatctgaaatttttattgtaaggtgtgaggtaagaatccagcattctgtgtgtgtacagatgcccagcccattgtcacactatctcttattgttgtataatacaccttttctatgccaactggaaacatcacctttaacatgtactaaatttccataagtatttgagtctacttctgtactttctattcaaccaattgatccgcctattaatgtattcttacacacaatttaaattaacatagctttgtaatatgttttagtatcttagtgggagagtctttcctgattatgttactttttttttattatgaagttctagggtacatgtgcacaacatgcaggtttgttaaatatttatacatgtgccatgttggtgtgctgcacccattaactcgtcatttacattaggtatatctcctaatgctatccctcgcccccgccccaccccaccccacgataggccccggtaggtgatgttccccttcctgtgtccaagggctcccactggtcaactcccacctatgagtgagaacatgaggtgtttgctttttgtccttgtgatagattgctgagaatgatggtttccagcttcatccatgtccctacaaaggacatgaactcatcatttttatggctgcatagtattccatagtgtatatgtgccacattttcttaatccagtctatcattgttggacatttgggttggttccaagtctttgctattgtgaatagtgccacaataaacatatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccaatctaactggtgtgagatggtatctctttgtggttttgatttgcatttctctgatggccagtgatgatgagcattttttcatgtgtctgttggctgcataaatgtcttctttggagaagtgtctgttcatatccttcacccacttgttgatggggttgtttttttcttgtaaatttgtttgacttcattgtagattctggatattagccctttgtcagatgaatagattgcaaaaattttttcccattctgtaggttgcctgttcactctgatggtagtctcttttgctgtgcagaagctctttagtttaattagatcccatttgtcaattttggcttttgttgccattgctttgggtgttttagatatgaagtccttgcccatgcctatgtcctgaatggtattgcctaggttttcttctagggtttttatggttttagggctaacatttaagtctttaatccatcttgaattaatttttgtatacggtgtaaggaagggatccagttcagctttctacatatggctagccagttttcccagcaccatttattaaatagggaatcctttccccattgcttgtttttatccggtttgtcaaagatcagatagttatagatatgtggtattatttctgagggctctgttctgttccattggtctatatctctgttttggtaccagtatcatgctgttttggttatcgtaggcttgtagtaaagtttgaagtcaggtagcgtgatgcctccagctttgttcttttggcttagggttcacttggcaatgcgggcccttttctggttccatatgaactttaaagtagttttttccaattctgtgaagaaagtcattggtagcttgatggggatggcatgaatctataaattaccttgggcagtatggccattttcatgatattgattcttcctatccatgagcatggaatgttcttccattttttgtgtcctcttttatttcattgagcagtggtttgtagttctccttgaagaggtccttcacatcccttgtaagttggattcctaggtattttattctctttgaagcaattgtgaatgggagttcactcatgatttggctatctgtctgttattggtgtataagaatgcttgtgatttttgcacattgattttgtatcctgagactttgctaagttgcttatcagcttaaggagattttgggctgagacgatggggttttcgagatatacaatcatgtcatctgcaaacagggacaattcgacttcctcttttcctaattgaataccctttatttctttctcctgcctgatagccctggccagaacttccaacactatgttgaataggagtggtgaggagggcatccctgtcttgtgccagttttcaaggggaatgcttccagtttttgcccattcagtatgatactggctatgggtttgtcataaatagctcttattattttgagatacgtcccatcaatacctaatttattgagagtttttagcatgaagggttgttgaattttgtcaaaggccttttctgcatctattgagataatcatgtggtttttgtcattggttctgtttatatgctggattacgtttattgatttgcatatgttgaaccagccttgcatcccagggataaagcccacttgatcgtggtggataagctttttgatgtgctgctggattcagtttgccagtattttattgaggatttttgcagcaatattcatcacggatattggtctaaaattctcttttttttgttgtgtctctgccaggctttggtatcaggatgatgctggcctcataaaatgagttagggaggattccctcttcatctactgattggaatagtttcagaaggaatggtaccagttcctccttgtacctctggtagaattcggctgtgaatccatctggtcctggacttttttctggttggtaagctattaattattgcctcaatttcagagcctattattggtctattcagagattcaacttcttcctggtttagtcttgggagggtgtatgtgttgaggaatttacccatttcttctagattttctagtttatttgcgtagaggtgtttatagtattctctgatggtagtttgtatctctgtggcatcgggggtgatatcccctgtcattttttattgtgtctatttgattcttctctcttttcttctttattaatcttgctagtggtctatcaattttgttggtcttttcaaaaaaccagctcctggattcattgattttttgaagggttttttgtgtctctaattccttcagttctgctctgatcttagttatttcttgccttctgctagcttttgaatgtgtttgctcttgcttctctagttcttttcattgtgatgttagggtgtcaattttagatctttcctgctttctcttgtgggcatttagtgctgtaaatttccctctacacactgctttaaatgtgtcccagagattctggtatgttgtgtctttgttctcgttggtttcaaagaaatgtttatttctgccttcatttcgttatgtaccctgtagtcattcaggagcaggttgttcagttttcatgtagttgtgcggttttgagtgagtttcttaatcctgagttctagtttgattgcactgtggtctgagagacagtttgttataatttctgttcttttacatttgctgaggagtgctttacttccaactatgtggtcaatttcagaataagtgaggtgttttgctgagaagaatgtatactctgttgatttggggtggagagttctgtagatgtctattaggtctgcttggtgcagagctgagttcaattcctggatatccttgttaactttctgtctcgttgatctgtccaatgttgacagtggggtgttaaagtctcccattattattgtgtgggagtctaagtctctttgtaggtctctaaggacttgctttatgaatctgggtgttcctgtattgggtgcatatatatcgaggatagttagctcttgttgaattgatccctttactattatgtaatggccttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgagacggagtttcgctcttgttgcccaggctggagtacaatggcgcgaccttggctcaccacaacctctgcctcccgggttcaagcaattctcctgcctcagcctcccgtgtagctgggattacaggcatgcgccaccacgcctggctacttttgtatttttagcagagaaggggtttctccatgttggtcaggctggtcttgaactcctgacctcaggtgatccgcccaccttggcctcccaaagtgctgcaattacaggcgtgagccaccgcacccagcccattatgttactttttaagaattttcctggttattatttttttttcacgtaaacaactgagttccttgactaattccaaacttcacccagaaaaacagctatacacgtgtcctactatcctctttagcctatgctttctgttcataagagttctactttcttccttttcacactaaaactttgatctcttaaaagcttgattccatctcattaaacaaaaaagtaatcaagaatttcttccttttttttttttcaagacagagtctcactctgtcactcaggctggagtgcagtggcctgatcttggctcactgcatcctatgcctcccaagttcaaatgattgtcatgcctcaacctcccaagtagctgggactacaggtgggcgccaccacacctggctaatttttgtatttttggtggagacagggttttgccatgttggccaggctgttcttgaactcctggcctcaagtgatccacccacctcagcctccgaaagtgctggaattacaggcgtgagccaccacgcccggccaatcaagaatttcataattgctaaatccagtagcctttcttggaactccttggcttctttgaagttccagaccctgttaactctttgcctctctcgaaattctctcctttctttgcttttatgtctgcttcatttagatacttcacatccgttttcccgagctcctcctccgcagagaaagtcactcaaaaacattgtgtccaaatatctgtcttcggtacactattttatgtgtgtgtgtgtgtgtgtgtgtgtgtgtgtgtgtgtgtgtgtgtatttcctcttcaggtcaactactatgaaatatctatctgtaattctgagtacagcttatggtaggtataaataaaaataaatactaaatgaatgggcaccagttctaatttcccaaattcctgcttataatttctccagggattccccttagtcatcaacacatcaacacataaaatgcctgtacagtagaggaaacagtttctctgaatcctagactggtcaaaccatatctggaacactgagattcattcggcaccacattttcagaggccatgacaaatctgagtgaatctaaagaagggaaacaggatggtaaatgatacaaaactcagggtataagaggaaatgttgaagtaacttaggatgttgagtcatcagatgattaagaaaagacatagcagtactcaagtatgtaaagagtactttccggtagggggcaatgttgggtggaaggaggaggttatgaggttatggcactgttcagtattttttttttttttttgagatggagttttgctcttgttgcctagcctggagtgcaatggcgcgatctcaactcactgcaacatccgcctcccaggttcaagcgattctcctgcctcagcctcctgagtagctggggttacaggcatgcaccactatgcccggctaattttgtagttttagttgagatgggtttctccatgttggtcaggctggactcgaactcctgacctcaggttatccgcccacctcggcctcccaaagtgctgggattacaggcatgagccactgcgcctagtctaaacgtttcaatactcacagatatctgtgcaaggtaggcacacagttttatctacctaccttatgtttgtgtgacactatcacaaattcaggctgttaatggcccaacctgatctgtagcaacatcctgtgaataagtcttatagcctctgatccatcctatccattgtaaccattttgtcagatcaaacttcctgacataaaatttcccttatcaaaagttaatgacagcagggcacggtggctcacgtctggaatcccagctctttgggaggctgaggaaggaggactgcttgagcccatgagttcaagaccaatgtgggcaacacaaagacagtgagaccttgtaaaaaaaaaaaaaaaaaaaaaaaaaagactttcactgttaacaaaaaacaaaacaacaaaatcctctagaattctttcctaagtccctagttttatttttaccactatgtcccataaatccttttcttcttaagtgccttgtacttttggtatgtatatattgcacctaatattgctaaatgatcccttctttttgtggagtatctgttcttcaaagtttagctcaagtagcatctcctccctgggctttgatcattacagaaggaagagatcccaacccattctgaacatatgtgatgctatctaaatcactaccttaaaattctcttccctgtttggtagtcatatgtagtatgtaatactgcaaatataactttctacaacgatgaaaccgttctctatctgtgcgtccaatataacagccagtaaccacaagtgactactgagcatgtaaaatgtgaccagtgcctacatattagacagtgtggtcttggagggcaatacattaggtttctgatgcatagaatatttactgagaaataattatgttctaggccctgtttaaacattttatacctatcatttcactaatgcttttctattatcattctgtttctaagataaataaactgagtccaagaaagtttaaataacttgcatcaagtcctaattctttgggattaacaacgatgacaatccacagattattgcagtaagaatattagaaaatatgacaaggagctcagtaaatcattaaacagtattcctaagatagttattttatcttcttttggtgtctcttacaacgtctagcacatcactttgtacgtagtaactataactgaatcaaatgataattttacatggcttatagtcttctacacttgtacataatgttttctaaaatcagagtataaattgaatgtataaaaatgaagtcataaaaataaaatgtgttatagccacatgatggaatattattcagccataaaaaagaatgaaatattgattcatgctacaacatggatgaaactaaaaaaaatgctaagttaaagaagccagtcacaaaagaccatacattataattcctcttacatgaaatattcagaatagacaaattcatatagacagaaagtagattagaggttacctaggatttgtaggattggggtaaaacagagagtgatcactagagggtaaggagtgttttcctggggtcatgaaaatgttctaaaattgactgtggtgatggttgcaaaactacgtaaaaacaatgtaaaaatttaactgtatattttaaatgggtgaattgtatggcctgtgaattaaatctcaataatactgtttttaaaaggggggaatcaaagttttatgtttacaaagggttctactcctaagagctaaatataaattatggactatctaggatacatctttacttttagatataatctctgacaaaaatatttcgaatacacttaacggtaaagtgaaataaaattgtggttttcaaaattgttttctcataggtggacaaaacaaatcttttttggaaaccaacgaaacaaaaataatctggagctgtcttggttgaagcagcgtgcgggattcagacacctcccactcagacccctgcccttccttcaacattggcatctaaagaatctctccagcgtttggaggaaatcaagttggaagttaagcaagaagcaacacaaaaaactgagtaactacaaagaagtaaaaagtaaaaactctgcaagttgaattgttagctggcaggctaccatgtgatattggctcagaattgtcttgtgttagtaaagatacaaacatttgaattctatttatgaactttgaattctgcttctgtaattagacttttttttttttttttggacagagtctcactctgtcgcttaggctggactgcagcggaatgatctcagctcactgcaaactccgtctcccgggttcaaatgattctcctgcctcagcctccccagtagctgtagctgggattacaggtgtggatcaccacgcgcagctgaatttttttttgtattttcagtacagacggggtttcaccatgttggccaggctggtctcaaacttctgacctcaaatcatccacttgccttcgcttcccaatgtgctgggattacaggcatgagccagtgtgcccagcctgcatgttttttgtttgtttgtttgtttgtttgttttttgagatggagtattgctctgttgctcaggctggagcgcgcgatctcagctcaccgcaacctccgccttccagattcaagcaattctcctgcctcagcttcccaagtagctgggactgttacaggtgcatgctgccacgcccagctaatttttttgtattttagtagagaaggggtttcaccatgttgcccaggctggtcgggaactcctgagctcaggcaatccgcctgcctcggcctccgaaagtgctgggattacaggtgtgagtcactgcgccaccgcatgttttttttttttttttttttaaagagaattattctaaattcaagatctacctctaatttatgtggtctttttttattatgtacttggattaggaatttttgtatttttgtttgtacaacaaaaaatatgtaaacatccccaaataaaaaaataggtgccctagatctgtgacactggaagtgctgttttcctggctcaatatcccttatttggctaagaaaaaaagggcagtttccaactcatttgtacttacatagccacagactcttctacttgtatggcttattaacatcaaaaatttatattctattattatatgtgatatattacactatactacattataattatccccaaaacaaaactgatcatttatttctctcaaacatatttttaatatatttaagggtaaagtagaataaaactgtggttttcagaattattttttcagaggcagacaaaataaatcttttttagaaatccaaaaaagcaaaactttcccaacttccctatttcaacttaactttgaatccccaggctgatatctctttaaactcaaattagtagcctctctttatagtcgtagctgataatgaaggcataatctttcccctttagacatgaattctggagctcctcctcctccctgctagctctttccacagctaccaacttttcttgagtcaagtctatttctcacactttttctatgtactgctattagaatagtcctcaagtgctctatgatgttatttccttactcaaaaacttagaattgttctctatagttcaacttcctctccatctctgtgtgatggttaattttgcgtcaacctgattgggccacagggtgcccagatacttggtcaaacattattctgtttttgtgaaggtgttttttggatgagattaacatttaaattggtagactagacaaagcagataatctaggattggcatccaatcatttcaaggcctgaatagaacaaaaggctgatcttcctcagaataagtgaaaattatcctgcctgatgggcctcaaactataccatttgctcttcctggttctatagcagcttccagcctttggacttgaaagcggatacaagctctacagattttggactagccagtgtccataatcccatgataggtatctcctattagttctgtttttctgaagatcactgactaatatactgtttacccaactctgtagtaccatttcataagatttttttttttttttttgacagtgtcttgctctatcacccaggctggagtggaatggtgcaaacaaagttcactgcaccctcaacctcctgggctcaagtgatcctcctacctcagcctcctgagtagctggaaccacaagtatgcgccaccatgccttgctagttttttaaatgtttgtagagaaaaagtctaaccatgttgcccaggctcccagatcgtttattagacctcaaaatattctctactacaatgaaataaatccatttgtcaacttctacccaatttgcataattccactgaaatgcttttattaaataactgatatgcatttgtaccacctacatttgcctctcacatatatctctccagctaggatgttaactactttgacaacaggagcctctattttctttacttctttccacagtgataacagagattaacaatgtgaagtatagtttaaagactattaaatatatatatatacttaaatcataaaaagtcaggaaacaacaaatgctggagaggatgcagagaaataggaatgtttttacactgttggtggggctgtaaactagttcaaccattgtggaagacagtgtggtgattcctcaaggatctagaactagaaataccatttgacccagccatcccattactgagtatatacccaaaggattataaatcatgctgctataaagacacatgcacttgtgtgtttattgcagcactattcacaattgcaaagacttggaaccaacccaaatgtccaacaatggtagactggattaagaaaatgtggctcatatacaccatggaatactatgcagccataaaaatgatgagttcatgtcctttgtagggacatggatgaagctggaaaccatcattctcagcaaactatcacaaggacaaaaaaccaaacaccgcatgttctcactcacaggtgggaattgaacaatgagaacacttggacacaggaagggaaacatcacataccggggcctgtcgtgggtgggggaagtggggagggatagcattaggagacatatctaatgtaaatgacgagttaattggtgcagcacaccaacatggcgcatgtatatatatgtaacaaacctgcacgttgtgcacatgtaccctagaacttaaagtgtaataaaaaataaaaaaataaaaagactattaaatatatatatacatactttatacctatctataccttaaatagatatataatgtatgtaaatttatatatctaatttacctcttgcctacagtctggtacatgttttaatgttaatttttatttggttggttttggttttgcttaaaagaataacattttgggttaaaatttatttgccattttaaagtattctccttccactttcattttgctgttaggacacagaacaaagttatagacaaactttagactatataatttaaaagtacaattgaaagaatgttttaatgttgggatgaagtgcatactttactgtatatttttcaaactcagttatattgctttgctaaaagtaaataatatcaccaggataccatctggtaaaaatctctctgtggattaacccacaaaaggaggtgaatgaatttttatatattgcatagttgtggttgcaaaactgcagtaaaaatatgttttcaatgcactggtgtaagtgagacttcagaattcagctacctcttctgatttgatccaaaaggcttggaatatttaagaccatatctcatcaacatggaaaaggaggagtgttttattttctagcattcctatgacttggaagaaaaaaaatctaggaaattgaagtccatgaactggaaaatatgaatttggtcttttagaaagcattcatttaaaaaataatgggcagttacttaataataggacatagcatgtcagagaagtctgaggccatataagacagttggataagatttgacaatgtcattgtgtgcagcccatccaatgcaaaatggtcaaatcagtttttaccttttttttttttttttacttcaaataatacgctatccaagtcttgatctagtccaatgactagaggaatagaaattctccccacctctctcgagattccattccagagactaatagatttcactgtcagaaaacatttcccagattcagtcttaaatttctgttacttaatttcatcccaatacttgactataaactctcttatcctacctttaaaaatatcttgacttccataatgtttgtatcttacaaatatttgtaaaatgttatcataactatactcagagatgagcaaaaaatatacattttgttattttaatattttaaggattaaagtctgaagatcattatacatttattttctagtctgaacactacttgatttgcttatttggggcatgtacatgccccaaacttgtattctctttgtgatctcagcagtaccatttaaataacttttatctttcagccacatgatgtgaagcttttgcatatacagactaaaatctcattgactgattttactgccacattgcattacaagaccttatataatttgctaccactatcatctcaaagtctcttggtaatactgctttccaagtactgtatatcctgccagttgaatggctgtgtttctgatcatttttccccagatgtattagctacatttttccaggttgaatcacatttcatttcctgcccatatttctaaccactttaggtcccttttatctgccctcactggttttgccaacaccatccaatttagcatcatctgtaaatttaattaacatgatgtgtatcctctcttataaatcactaatgaagtttctctacaatgatttgtttattttaaaaactctaatgctgcttaatgtttataatcttgcttataatgtttataatcttaagaaggcaccacttttttgccactaaatatttgttttattattttaggagtggttcatgatagactaacaacagaatcatgttcagggtcactgctatccttttttgaatattagtgctaaattacttttatgattgcttctgtacataacaaagctttaactgacaattttctacccttctgtgttttttcattctattaataacatcacagaagaacaacattatgatgttattctcatgtgttattctcacgtccatgaggtaaaatggtcaaagatctcatattccaaattctgttgtgcagtgagttttttaaattttagattccaatttactgtgacaacagtttgttatattaaatgagtaaagattaatttagaatgtttgtattttaagtattttggaattggcaagttgaaccaagatcaatatggttcatatgaactgaacaagagctattttgttcctcttttataactgtgatttcttttgaatttattggttatttaaaattcttctggggtattaaaacctacttttaatttcatttttataaggaaatacattagacctccaaaagtatgttttgaaacataatactagaaacaacatatatgtatccaccacctaggttaggaaaacaccaccaccaccaccaccaccaccaccaccacaccaccactaccagtaccttatcagctatgggatacatttttccaattgcttacctcttctctcccttaggagcatctgctgctattaactttataaaaataatttactttgttttgtttacatatctatatatgtatccctatagttaagatgcatttttaaaaaattgaatatctcagacatttcagtcatcaatttccatcttatactaatttactttttgtaagtatttgtcttttcctacaggaatatcttgccatatgtcttcaataatcttggaagaaagcatacattcttttttcttcaattttttatttacctaaatcctagtgttagctttacataccacaaacttttctttttcctattaatccatcctcttaacttacatattttgggacagtttcttgtactcatttactagtgtatacatatttattaattgcttattatggcccaattatggcatatagatctgattttacatacttagtagaagtaacttcttttttcagccaattcttatatctcattatatttgttaagaaattagaaaattcttgtgggtgtctatgatgtatatatgcatgcatacatacatacatacatatatatacatacctatgatgtatgtatatatatgtcataggtactcatggtttttatccatggttcctgtctcataactctcatatatatgtatatacatatatatctcatatacatatatgagagttatgagtacgtatatatacatacctatgatgtatatatgtatacttcaagaatagcaaggagtaacttgctttttcagctaattcttatatctcattatttcaaattttatataataataatttctaattttatctaataataatttctattattagaaattatttctaagaaattagaaaattcttgtgggtacctatgacgtatatatacatacatacatacgtatatatacatacctatgacatgtgtatatatacgtcataggtacccatggttttcatccatggttcctggctcataacttgcatagctcttgttagtctttcattataatgttggggcactttaggcttcaggagcaggcttcaggagcaagcctcaggaaagagaatctctctctctgacctcctgaactcctttacctgctcaaggcagaactctgatctgactgtgggtcaaaagaccctcattccagagaaggttctgccccatactctggaggaagaaatgctgcacagagaggccaagaagaatccaaacaggcattgctgggtttccccattcagcctattaatatgagattgtaccctttttgttcaaccacatttcatgcctatgattctccataaaaacccaagaagtactatcacatttgggattaaggaaaacaaaactaaaccaagaagactgggttcaaagagcttccagataactaaacacgtggagtttcctagattatggcatgcccagagagtgcatggaagttccgagcactttcccccatatcctgccctgcacatcgcttcatgtgtgttgtaatatctgttacaataaacaataaactaaaataagcatttccctgggttctgtgagttgctcagccagaagctccagaggcttggacttgccactggtgtgaggagagggctcagttttggggactgaaccctcaatccatggggtctgatgctatctgtaggtagatcatgctggaatttaattagcagacattcaggtggtgtctgccacttggtgtgtgggaaaaaattctcttacctttggttgcagaaagcttctctgttgatgattgctgtggtggtatgaaagcagaggaaaaacatgcttagagagttttccccaaacagtacctaaatataagacctatatttattctctcataaatttaaacttctattattatttatttatttatttattgagatagagtctctctctgtcacccggctggatgcagtggcatgatctcggctcactgcaacctccacctcctgggttcaagcaattcttctgcctcagcctcccatgtagctggggctacaggcacgcaccaccgcacccagctaatttttgtatttttggtagagacggggcttcaccatgttggccaggatggtctcgatctcttgaccatgtgatctgccccccttcgccttccaaagtgctgggattacaggtgtgagccaacatgcccagtctaaacttctatttttaaatatcaaattattcctatcataattttttattccattttaatttccacttctcatgtccatatccataacaactttaacatatttccatttattaaaaaaaactcaactttcatccttatatagcactgatatcacacagtaaaaagctggtaaatcgagggctttttcatattttaccagttatcttgttcttactttaaaaattacactcaattatttagagaaagatgttcatctccatgtggtttatgatagaaacaaagggaaacaatcaaaatatctaataactggagatctagctaaataaaatacagtacaatcctacaatagaatattaggaacctaattaaaattggcgattaccaattttagcctattaatgagaatctcttcacctagtaatatctgaggtataaaagcaagtgtcccagggtggcccacgacacttgagggaaaaatatggggttacaaaagccaagtcattacatctcaagagggataattctgcggcaccattcactcctcagagctccctgggggatcaagctgaggttaggcttttgaaacttcatctttgcctagcttctatccttgctctttttccttcttttctcattttcttttgagagcactcaataaatcactgcacaagaatctctttcttgagttctgcttctaaggggacccactgacccaaagaatcagtgcacagaagtgatcctagaaagcaggctccaaggctgagattctggatcactcactgactggctggctgtcaatgaggaccccagaattagtggtgtttttggcattctgtagcagtaatgcaactgctaaaacttgaaaaaggatggaatagatgtagaaaatgcactggcttgtgccatacttccagatttaagaggaatgaggaaagtggtaagtatgtaagtattgacataagagttgaaaataaattacttaggcagatagtgagggtatattagtcctcggtaaggttttccttttaatgaaaagcaaccccaaaataattttcttttctaacaaagagcaacctgtaaaattaagctgcagacataaacaagcaagcagagtgaacgcaagctgttgtgcctacaggaatatactacctgggacgagacatgttcaatatggtggctccatcttctctttttgccagccatgtgtatagtaagaagcaggcaagatggagctggccaagtgaaaagtccatttgcataagattagggtggggcaaccagccttccccactgctatgtaaacatcatacctagtcaaacccatttgtgagccctacctaaatgagacactgcctcctcaagcctgcctataaaatctgctgcagtcctccactttacctttttcagatgcctctctcttgcaagagagagtgagctgctatcctccctcctttcttctgcctatttaactttctattccttaacccacccacgtgtccttgtccttaatcctcttggtgtgagacaacgaaccccaggtatttaccccagacaacaatgccatttcagtatcacagaattgaatggctgttattaagcactcgtgatactatgaagaaaggaaaggatgattaatcatcaattcaaaacaatgtgtgaaattcttttttttttttttttttgagatggagtcttactctgttgcccaggctggagtgcagtggcacgatctcagctcactgaaagctctgcttcccgggttcacaccattctcttgcctcagactcccgagtagctgggactacaggcgcccactaccatgcccagctaattttttgtatttttagtagagactgggtttcactatgttagtcaggatggtcttgatctcctgacctcatgatctacctgtagagctgggattacaggcgtgagccactgcgcccagccaatgatgtgtgaaattctgagatcttcatctctaagttgtttcatagtaaattataataaaaaataaaataaaatgcctcaaaagagacataggaggatgtgataataaagagtcttaacccaagcctgtctcacagcaagttcactgtgtttagagactaacccagagattattttccctgttcctaaacaaaaactcagaatatttctgtggagtattaaaaaaaaaaaagcggggggtggccggcaagatggctgaacaggaatagctccggtctgcagctcccagggagatcaatgtagaaggcgggtgatgtctgcatttccaactgaggtacctggctcatctcactgggactggttagacagtgggtgcagcccatggagggcgagcggaagcagggtggggtgtcgcctcacttgggaagtgcaaggggttggggaactccctcccctagccaagggaagctgtgagggactgtgctgtgaggaagagtgcactctggcccagatactatgcttttcccacagtcttcgcaactcgcagagcaggagattcccttgggtacctacacaaccagggccctgggtttcaagcacaaaactggtcgaccatttgggcagacaccgagctagctgcaggagttttttttcacgccccagtggtgactggaacgcccgtgagacagaactgttcactcccatggaaagggggctgaagccagggagccaagtggtctagctcagtggatccgaccccgatggagcccagcaagctaagatccactggcttgaaattctcactggcagtacagcagtctgaagtcaacctgggacactcaagcttggtggggggaggggcgaccaccatttctgaggcttgagtagccggttttcccttcacactgtaaacaatgccccgggaagtttggactgggcagagcccaccagcaccacaaagccaccgtagccagactgcatctctagattcctcctctctgggcagggcatctctgaaagaaaggcagcagccccagtcaggggcttatagataaaactcccatatccctgggacagagcacctgggggaaggggtggttgtgggcacagcttcagcagacttaaacattcctgcctgccactgaagagagcagcagacctcccaggacaatgctcgagttctgctaagggacagactgtctcctaaagtgggtccctgacccctgtgcctcctgactgagagacacctcctagcaggggtcaacggacacttcatacaggagacctctggctagcatctagcgggtgcccctctgggaggaaacttccagaggaacgaacaggcagcaatctttgctgttctgcagcctccactggtgatacccacgcaaaaagggtctagagtggacctccagtaaacaccagcagacctgcagcagaggggcctgactgttagaaggaaaactaacaaacagaaaggaacagcatcaacattgacaaaaaggacatccacacagacacctcacctgaaggtcaccaacatcaaagatcaaaggtagataaatccaggaagatgaggaaaaaccagcataaaaaagccaaaaattcccaaaaccagaacacctcctctcctccaaaagatcacagctcctcgccagcaagggaacaaaactggacggagaacgagtttgaggaattgacagaagatggagaacgagtctgaggaattgacagaagtaggtttcaggaggtgggtaataacaaactcctctgagctaaaggagcgtgttctaacccaaagcaaggaatctaagaaccttgaaaaaaggttagaggaattgttaactagaataaccagtttagagaagaacataaatgacctgatggagctgaaaaacacagcacaagaacttcatgaggcatatacaagtatcaatagctgaatcaatcaactggaagaaagaatatcagagattgaagatcaacttaatgaaatgaagtgtgaagacaagattagagaaaaaaaaaagaaacggaacgaacaaagcctccaagaaatatgggactatgtgaaaaaaccaaacctacgtttgattggtgtacctgaaagtgacagggagaatggaaccaagttgaaaaacactcttcaggatattatccaggaaaacttccccaatctaaaaagacaggccaatattcaaattcaggaaaaatacagaacaccataaagatacttctcgagaagagcaatcccaagacacataatcatcagatttaccaaggttgaaatgaaggaaaaaatgttaagggcagccagagagaaagattgggttacccacaaagggaagcccatcagactaacagtgggtctcttggaagaaaccctacaaaccagaggagagtgggggccaatattcaacattcttaaagaaaagaattttcaacctagaatttcatatccagccaaactaagcttcataagtgaaggagaaataagattgtttacagacaagcaaatgctgagaggttttgtcaccaccaggcctgccttataagagctcctgaaggaagcactaaatatgtaaaggaaaaatcggtaccagccactgcaaaaacataccaaattgtaaagaccatagacactatgaagaaactgtatcaactaacgggttaaataatcagctagcatcatcatgataggatcaaattcacacataacaatattaaacttaagtataagtgggctacatgccccaattaaaaaacacagactggcaaattggaaaaagagtcaagaccaatcggtgtgccgtattcagaggacccgttgcacatgcaaagatacacataggctcaaaataaaggaatggaggaatatttaccaagcaaatggaaagcaaaaaaaagcaggggttgcaatcctagtctctgataaaacagactttaaaccaacaaagataaaaaatgacaaacaaggcattacataatggtaaaggaatcaatgcaacaagaagagctaactatcctaaatatatatgcatccaatataggagtactcagattcatcaagcaagttcttagagacctgcaaagagacttagactcccacacaataatattgggagactttaacaccccactgtcaatattagacagatcaatgagagagaaaattaacaaggacattcaggactttaactcagctctggaccaagcagacctaacagacatctacagaactctccaccctaaaacaacagaatatacattcttctcagcatcacatcacacttattctaaaattgaccacataattggaaataaaacactcctcagcaaatgcaaaagaatggaaatcataaaaaacaatctctcagaccacagtgcaatcaaattagaactcaggattaagaaagtcactcaaaaccgcacaactacatggaaactgaacaaactgctcctgaatgactactgggtaaataatgaaatgaaggcaaaaataaataagttctttgaaagcaatgagaacaaagacacaatgtaccagaatctctaggatacagcgaaagcagtgttaagagggaaatttatagcactaaatttgtccacaggagaaagcagcaaagatctaaaatcaacaccctaacattaaagttaaaagaactagagaagcaagagcaaacaaattcaaaagctagcagaggacaagaaataactaagatcagagcagaactgaaggagatagagacacaaaaacctcttcaaaaaaaaatcagtgaatccagagcctggttttttgaaaagattaacaaaatagaccgctagccagactaataaagaaaagagagaagaatcaaatagacacaataaaaaatgataaagggatatcactactgatcccacagaaatacaaactaccatcagagaatactataaacacctctacgcaaataaactagaaaatctacaagaaatggataaattcttggacacatacaccttcccaagtctaaaccaggaagaaattgaatcccacaacagaccaataacaagttctgaaattgaagcagtaattaatagcctaccaacgaaaaaatgcccaggaccagacggattcacagccaaattctaccagaggtacaaagaggagccggtaccattccttctgaaactattccaaacaatagaaaaagagggactcctaactcattttatgaggccagcatcatcctggttctaaaacctggcagagacacaataaaaaaagaatttcaagccaatatccctgatgaacatcgatgcgaaaatcctgaataaaatactggcaaaccaactccagcagcacatcaaaaagcttatccaccacaatcaagtcggcttcatccttgggatgcagggccagttcaacatacgcaaatcaataaacgtaacccatcacatgaacggaaccaatgacaaaaaccacatgattatctcaatgaatacagaaaaggcctttgacaaaatccaacagcccttcatgctaaaaactctcaataaactaggtattgatggaacatatctcaaagtaataagtgctatttatgacaaacccatggccaatatcatactgaatgggcaaaaactggaagcgttccctttgaaaactggcacaagacagggatgccctctctcaccactcctattcaatatagtattggaagttctgaccagggtaatcaggcaagagaaagaagtaaaggtattcaaacaggaagacagcaaggcaaattctctctgtttgcagaagacatgattgtctttttagaaaaccccatcgtctcagccccaaatctccttaagctgataagcaacttcagcaaagtctcaggatacaaaatcaatgtgcaaaagtcacaagcattcctatacaccaataatagacaaacagagagccaaatcatgagtgaactcccattcacaattgctacaaagagaataaaatacctaggaatccaacttacaagggatgtgaaggacctcttcaaggagaactacaaacctctgctcaaggaaatgagaggacacaaacaaatggaaaaacattccatgatcatggatacgaagaatcaatattgtgaaaatggccatactgcccaaagtaatttatagattcagtggtatccccatcaagctaccattgactttcttcacagaattagaaaaaaactacattaaatttcatatgaaccaaaaaagagcccatatagccaagacaatcctaagcaagaagaacaaagctggaggcatcatgctacctgacttcaaactatactacaaggctacagtaaccaaaacagcatggtactggtaccaaaacagatatataagaccaatggagcagaacagcggcctcagaaatgccacacatctacaaccatctgatctttgacaaacctgataaaaaccagcaatggggaaatgattccctatttaataaatggtgggaaaactggatagccacatgcagaaaacagaaactggatcccttcctacttacaccttatacaaaaaattaactcaagatggattaaagacttaaatgtaagacctaaaaccataaaaccctagaagcaaacctaggcaataccgttcaggacacaggcatgggcaaagacttcatgactaaaacaccaaaagcaatggcaacaaaagccaaaactgacaaatgggatctaattaaactaaagagcttttgcacagcaaaagaaactatcaacagagtgaataggcaacctaaagaatgggagaaaattgttggaatctatccatctgacaaagggctaatatccagaatctacaaagaacttaaacaaatttacaagaaaaaaaacaaacaaccccatcaaaaagtgggcgaaggatatgaacagacacttctcaaaagaggacatttatgtggccaacaaacatatgaaaaaaagctcatcatcactgatcattagagaaatgtaaatcaaaaccacaatgagataccatctcatgccagttagaatggcgatcattaaaaagtcaggaaacaacagatgctggagaggatgtagagaaataggaatgtttttacactgctggtgggactgtaaattagttaaaccattgtggaagacagtgtggcgattcctcaaggatctagaaccagaaataccatttgatccagcaatcccattactgggtatatactcaaaggattacatatcattctactataaagacacatgcacacgtatgtttattgcagccctgttcacgatagcaaagacttggaaccaacccaaatgcccatcagtgatagactggataaagaaaatgtggcacatatacaccatggaatactatgcagccgtaagaaaggatgagttcatgtcctttgcagggacatggatgaagctagaaaccatcattctcagcaaactaacacaggcacagaaaaccaaacaccgcatgttctcactcataagtgggagttgaacaatgagaacacatggacacagcaaggggaacatcacacactggggcctgtcaccgggtggggggctaggagagggctagcattaggagaaatacctaatgtagatgacgagttgatgggtgcagcaaaccaccatggcacgtgtatacctatgtaacaaacctgcacgttctgcacatgtataccaaaacttaaagtataataaaaacaaacaacaaaactagaatggacatattagcggttggtagaacccttaccttggtgccctgacatgtggagtcaaagcaaatataattcattagtaaagttcctaaaaatgtcccatccattcccaagatagtaagtaaaaaatagcattgtatccctaaaggatatgcagagatcagacataccttcagaaatgtaaaggatataggattaatggttaattttatatgtcaacttgtctgggccatgatgcctagacatttcatcaaacactattcaggatgtttctgagagagttactgaatgagatttacattcaaatttgtgagctctgagtaatgtaggttgccctccataatgtgggtgggtcttgtccaatcaggagaaggcctgaatagaacaaaaacttgatttccctgaagcaagaggaattctctctcctacggctttcagacctcatttgcacatcaattcttcctgaatctacagtagactcccgttacaactctttcttgtatctccagcctattgggctcctcaatcagattttagactggccaagtctccacaatcacaggagctaattccttaaaataaatctctttatagatgcacatcttattggttttgtttctctggagaattgtgaataatataggcaggtagtcctcatctcatccccatttaattcacaagtcagatttctacaaaaactggatgaattatggcagaaaacaatgaactaccgtaattttagccaaacagtaatactgaatgtagctgttgtgccagatgtggtatttagtaaagaaatcataattagcaaattaacacggcctttggtacatggtgtgtatctattgatttggagattgcattcttttcaatatctattcacaagaaaggtgaatcagaggaagtatgcattgaaaaaacaatataatctaatatatatagaaaaataatatatagcgggattgtcaaagctttatctgtacaggccagatagtaaatattttaagcttagtgagtcaagcggcaaaatggaggatatgataaaggcacttatttgcattatccaaaaaatgcacatttcccaaactttttattgatgaagttcaaaacatattattttagtataatttttttgaaaatacaagtctcctaataagaagagaatcctttttgtgtggagataacattttgctaaaatgggggtacaaagttagtgttcccaattactaaaattaattgtaaggtacacctgttaaagctaatctgtaatgagattttacacatttaatctttgaaaatgtccttaacaaagatgatacatattaccaaatactgacatcagtcatgagcatatgatattaattgagcatattcatcaattggaaggcattcatagaattatattagattcttttcttgataattgcagtttaacatttcattacattgtatattaatcactttcaattgacggttaggtggaagctcctcaaccacaaagttaaatggattttaaaacatggaaatttcctttgcacttgaatcaagttccaaaaactcttgctggaactgtaggttgagcttggaaaatatactcactccaaattcatatgaaaattatagatcccacttcttgttctgattcaaacaatgtgagttaacattgaaatgactctactgcagcacataactgtgatttgctattgaattaattaaaaaaattattaagtctgcagcaaaaaataaatttcaaagtcattaattttctaacatattggttgagagagattcttcttacttagaaaagtttcagtcttggccctgagctcaaaaattcaaaataaaactttacaattgcaaagtcattgaacttttgtgtggtaaataaattcaggatagccggcatctcttttggacaaaaattcacagaacaaatgatatttaacttgcaaaagcagtgaagttcactgttaacactactggttcaataacacaaaaaaagagtttcaaatattttccacaaaatacctgctgataaataatacaatgaaaaactatggctttaactatggcttttataactttgtccaactaagtctttttctgttccacataaatctttaccactgacagttttaatacatcttagcagattccacttcaggttatactaagttaatgttttttatacattttgcctgtagttgtctcaaagagactattcaagagtcaagaaaatcgactgcctttttcttttttgccttgttttataattgaccactggtggtgttcccagtgtcctcagttttccttatggaaaggcaaacaatcttttaaatgttaattttcttaggatacatatcttcagccactacaaccaaacacaatttaattaactcactatcagtaaatgattttccttgcctggctaacaaaagtaccacttagaaacttactttggtgtagcctcatttacattttttcgttttgttttgttttgagacacggtctcactctgtcacccaggctggagagcagtggctcaatcttgcctcactgcaacctccacctcctgggttcaagtgatcctcccacctcagtctctcaagtagctgggattacaggcacatgccactatgcctggctaacttatttttctgtattttttatagagatgggcttttgccgtgttgcccaggctggtctcaaactcctggattcaagtgatccacctgtctcagtctctcaaagtgttgggattacaggtgtgagccaccacacccggcccatttttgtgtctgtgtacgtgactaaattatgtttcatgagatatcccatcttacgttttctaccttttctgaccattactttctatgagttgaaaacattgtgctgagagcttagtctgataaaattgacatatattattttagcatagctataatgtcaccacataataaatacaatactttgtcatctaactcaataaaaaattatccacagtccattgtgtcttaaaagtgtaacactcaaatccactttctcttttcttgatttaacataatgcatattcactggtgattttttaaaacatcacatgacaatggtatgtgtgactcttgatatgttattaagttatgactacatcactgagacttgtagtgtgctgtggaagagtgcaaattgagaagaatgtcaacatagtctccatcacaactactttgcccattgtagcaaaaaaccaccatagacaatatataaacaaatgggcatgaatgtgttctaataaaattttatttatggacatttaaactttacaaaattttcacataccagaaaatactattctgatttttttcaaacatttagaaggtttttaaaaaaattcttagctcatgagctgcataaaaagaggtcacaggccagatttggcatgtgaagcatagtttgcctacttgacatatactgtcatggtcctgctccccagactatgttaattctgccatcacaatatagtcaaaagggacctgaactatctgaacatttcatgtaacatgatattggtccactatgttgatggcatcatattcatcaagccttattcaccaaaagtaccaaatatactggataacttagcagaaaaaaatgtactccaagcagcaagagacaaaacacaaagatagagaatcctgccccaatgataagggtttcaggggtccagtagcatagaacatgctggatctcttctccaaattagaaaaatgtattgcactttgtacttccaacactaatgaaaatgtataaaatgtggtaaacttcttcagaacagatgcagtatttgagaatactgctctgacccactatcagtagatgtggaaggttgcctcttttgagtggggcagagagcataaagagctctacaacaggttgaggctcttagataacagtcgtgttacttaggcaatatgactcggcagatcccatacactggaggtgccaaaaccagtcaaagtcattaaaataaaagaaaactgcagaccaatacctctcataaacatacacagaaaaatcctcagccaggcgcggtggctcacgcctgtaatcccagcactttgggaggctgaggtgggcggatcatgaggtcaggagatcgagaccatcctggctaacacggtgaaaccccgtctctactaaaaatacaaaaaattagccaggtgtggtggcaggcacctgtagtcccagccatgtgggaggctgaggcaggagaatggcgtgaacccgggagatggagcttgcagtgccactgcactccagcccaggtgacagagcaagactccatctcaaaaaaaaaaaaaaaaaagaaaaagaaatcctcaacaaaatattgcaagtcatatccagaaatatataaaaggaataataaacatgaccaagtggggtttattagggaatgcaaggctagtttatttaaaaatcaatcaatataatcatcagtctaccaacagtctaaagaaaaaaatccacatgatcataccaattgatgcagaaaagcatttgacaaaacacaggttatttccataataaaaagtcagtaaactaagaatagaaggaacttaccaaactcagtaaagggaatttagagatgatctatagctaacaatacctatagttaaggactaattgtcttcctcctaataatggagacttggccaggcatggtggttgacgcctgtaatcccactttgggaggcagaggcagggagatcacccaaggccaggagttcaagaccagcctggccaacatgtcaaaacaccatctctacaaaaaatataaaaattagctggacgtggttgtaatcccagctactcaggtggctagggtatgagaatcacttgaaccggggaggtggaggctgcagtgagccaagactgcgccactgcattccagcctgggtgacagagcaaaaccctgtcttggaaaaaaaaaaaaaaaaaaaaggtaattagataaagatgtacaaaatgcagcctgggcaacatagtgagatgctgttgctatcaaaagaaaaaaaaaaaaaaaaaggccgggcgcggtggctcacgtctgtaatcctagcactttgggaggccaaggcgggcggatcacgaggtcagaagatcgagaccatcctggctaacgcggtgaaaccccgtctctactaaaaatacaaaaaaattagccgggcctggtggcgggcgcctgtagtcccagctactcgggaagctgaggtaggagaatggtgtgaacctgggaggcggagcttgcggtgagccgagatcgcgccactgcactcctgcctgggtgtcagagcaagactccatctcaaacaaacaaacaaacaaaaatgctgggcatggtgactgacatctgtagtcccagataatcaggtcagggaattgcttgagcccaggaagctgaggctgcagtgactcatgattgcaccactgcactccagcctgggcaacagactgaggactgagaccctgtctcaaaacaacaacaacaacaacaacaacaaaagtactaaccagtttaagctcttcttgtttctttgccattcttgtaagttttagaatcagcttatctgtatctacaagaaaaaaaaaaacctgttgggatttccttttcaatctagatgccttttatttcgttttttcatgaacactctgaccaccagtcctaaggaagtcttacccaaatcaataaagagaaaaaaacccccaaaaaccaaaaccataaggattggagcagaagaaataaaactgtacattcagagaggacatgattgtctatgtagaaaatgcgaagaaatctataaaaacaaaggacaaaaaagcaagaaaacactagaactaatacgtgagcaaacatgatcactggatacaggtcaacacaaaataaaatttattttatgtctgtacactggcaatgtacaattggaaactgaaattaaaaacataataccatttagaagctaaggcgggagggtcacttaaggccagtagctcaagacaagtctgggcaatacagcaagaccctatctctacaaaaaaattaaaaaattagccaggcatggtggcctgcatctgtagtcctagcttacttggaaggctgaggtggggaggtcacttgaacccagagtttgaggctgcagtaggctatgatctcatcattgtacttcagcctgggtgacagagtgagaacttgtctctaaaatgatgatgacaataataaaaataataatgccatttaaatagttattttaaaatatacaggtattagtgtagccaaacaggtactaatatgtatgctgaaaactaaaaagcactgatgaaaaaaatcaaagaagacctaaatagagacataccatgttcataaaatggaagactcaacttagtaaagatgacaattctaaaagtgatctgtaagtttcaacaaacaaataacaacatattatataatttcatttatatgaaatgtccagaataagcaaatccatggagatacaaagtaacttagtaattgcctatggatagagggtggcagggggttgaggtgaatatgggtagggtgtttctttttggaggtaatgaaaatgttctaaaattgattgtagttatggctgcacaactctgtgaatacactaaataccattacattttatactttaaatgggtgaactgaatggtttgtgaattatatctcaatagttacaaaaaaactccatcaaccactatccattatgtagtttaaaaaaccagaaaagcacattttaaaactatataatactatttgactcaatactgtcacttttagaaaactaataaaatcagagatatgtaagtaatgcttatctatagaaaaatgtttactaaattatctcaggaaaaattagaaataatctataattccaattatatgactgttccaataaaacatgatacatttgcatgatgagtgttttaatttttaagagctgtatagttcagaaaaatgtcatgtgaaataaactttagtgaaaaacaatccaggtatgaaagtatgaaatgcataacttatttttaaatttttatttatccatttgttacttagtctcactctgttgcacaggctggagtgcagtggtgtgatcttggctcactgcaacctccaccttctgggtccagacgaatctcccacctcagcctctcaagtagttgggattacaggtgtgttccaccacgcctggctaatttttgtatttttagtacagatggagtttcaccacgttagccaggctggtctcttaactcctgacctcaaatgatccgtctgccttggccttccaaagtgctgggattacaggagtgaaccactgtggctagccaaaatgcatgattttttttttttttttttttgagacagagtttcactcttgttgtccacgctggagggcaatggtgcgatcttggctcactgtaacctccgcctcccgggttcaagtgattctcctgcctcagcctcccaagtagctgggattataggcacctgctaccatgcccagctaatttttgtatttttagtagagatgcagttttaccgtgttggccttgaactcctgacatcaggtgatctgcccacctcggcctcccaaagtgttgggattacaggcgtgagccaccaagctcggccaaaatgcaagatttttaaatgtctttatgtgaaatacttagtaaaaccatgggtcatttagacagaaggttcatagttgtcatctctgaatggtagcactacgagtgatttttttctttattctcttatgtttttaagatttgtattaacagaaattaaattacttcaataatatgaaataagtaacatattatttggttttctgttttaaaatagaagattaaaaactaagaagaacagcaagaggaagaaataaaagcagcataatgcgttatcaatttaaaagtaggtgggaatgattaacagtgtcacatgtaccagagaggtagactagacaaaacttgaaaaggtccattagatttcaaacaaggaggttatcgttaacattctggcagatctgagagtgtcataagccacactataaaagagtagaatacaatgaaaggtaagaaagcagagataatgattaaataaattgtctttttatttttttttaaagcagatttcactcaggatgtacagagctaggaaaaaaacatctctcccaaactaacaagaaaagaccaaacaatgtacaaatcgtaactttccttacacttactagagctaaattcacagggaaacaaaccaacctggaacctaaggagaaacaaatgcctctaaggagatacatgatctgagcactgacttactttggataggacactaaaagaacatagaagaaatgagtaagaggaaaccagctaaagtttttaacaaactactaaagtccaaatgtgggctactgtaaaaatataaaaaccctgtgaactatagattcatggggaatttatacatatgaacctttactgagtgctcacaagatagactgggggcagcgggggagactggagaaagcttccttctatggtataggctcggaagaggcgagtggtcactgctgcaggaacacgctgatccttctcttgacagaacataagccttaagccactcagagaaaggcaacaaactatcccagatctataacattagagatctcctaagggctaccaagtagcagaatcaccgagaaattcccacccccaagtctcaggtacacaagggcctacctaaggctgaagtcaaaccaggacaataccatatctaccttggtacccactaccagactagcaagcatcaagtaacaagaaaaaaaagtctactactgagagaaggacatgaaagaaacattctccgtggtacaagtacacaaggaagacttaaacccaagggtgcagtagtagcattgataaaaattactctggcttgcagggtgtggtggctcacgcctataattacagcactttgggacgctgaggcaggtagatcacttgaggtcaggagtttgagaccagctaacatggtaagactcctgactctactaaaaatacaaaagttatccgggtgtgtggcatgtggtatatgcctgtaaacccagctactcgggaggctgaggcacaagaaccccttgaacctgggaggcagaggttgcagtgagccaagatcccagcactgcactccagcctgggtgacggagtgagactcggtctcaaaaagaaaagaaaagaaaagaaaaactctggcaaggcagccccaaccaggagcccatctccattagacccagtgatggcatctattatagaaaaataccatgatatgagattagggggaaagactatccagtatgaagctttatatttaacacaaaggagtaacttggagattggtataaggtgaccccatgaaaaaatagtcatattgttgaaagatagttgtgtctttggaaattatttttagtaaagaatagaggagtgatggcttataaacaacagaaaggaatctgtagaatccactcatccttcaggatctgctgggttccaggaccctcaaggataccaaaatccatggatgtccaagttccttatataaaatagtttactatttgcatgtaacttttttacatcctctcatacactttatctctacatttaatatctaatacaatgtaaatgctatgtaatttgttatgctatattgtttatttgtattattacaattaagctttctaatgttgtattttgtggttgtactgttattttttattgtgtggggggcttgaccagcagatggggatctctgaacagactgaactggtaccaccaaaggaatactaatactagtgcagatatattgggaaaagagaagttcattttgtggcctcttctgtcttggtggaaatcatgagagcacccaagtggtggagaaactttcttaatgaaagagcatatggcataggctggtggcttggaacattaatcccaaagagaagtcaaaagtcattttttctcaagacgctcatttaccttctagtggcagcaacctaattctgaagatagagaaaatatgtgttttaacttttagttaattttagttaactgaaaaactggaaagttaacatttcactttgaagattatcaagactagttgttattgtctgttttagtgtttcatttgtacctccataagaaggtggcaagggcttagaagagcagataaaaatcaaatatgcggccgggcatggtggctcacgcctgtaatcctagcactttggaaggctgaagccagcagatcacttgaggtcaggagttcgagaccagcctggccaacatggtgaaaccctgtctctactaaaaatacaaaaattagccacgcgtggtggcaggcgcctgtaatcccagctatgcaggaggctgaggcaggagaattgcttgaacccaggaggcagaggttgcagtgagctgagattgcgccactgcactccagcctgggcgacaagagtgagaccctgtcttaaaaaaaaaaaaaaaaaaaactggtcagttttcctgcatctagaatctttgtttgaagaaattgagactggtagaaatgaggtctagtgatcacctgttatgtttaattgaataatctctctcctatataaaaccattaaatattattgtacatagattatgtatacaaaaaaacaaaattcaaaaatgcatctagccaaagtaccattaagagcaaataatttcttcttaataccactgcctttttaaagaacaagatagagctgagaaagtattctggcttctcttcatctggtcaatggcaaaagggcaaaaaccagaacactgttatgctgtattaatttttaaagtccaattaaaggtaacatctacaacctttcttctgttgtgtttgccaaagatttttaaacattaaacacaaagtgctgattgcaagagaagaggaaagctctggctgctacactctgccagtgataaaagctttgtccctagagacttagctaacatttagtcacatgatacaatgtacgctgcacacaactttgttctattccaagggcttcctttcatctaaatgaccaaatagagcctggcattattatctctgattttattacctcctataaaagcttaggcaccggattgaaatgagaatattaaacaacagaaaaacctgaaacattctaaggttggagaaaatggctttaataaaaattgttacatattcttaactactcatcaacttgcatatcttcataatttagttcaagaaataaaagctttctatatttgagcagcctcccaggtttaggcagcttaggatagcatatggattccttacccacatgtacttcctactaccaaccttacccataaataactgttagtaaggactcttctggtgaccgaaactcttgaactggcttagcaaaaagaggaatttactaaaacaacactggagtaccttatttaaaagaattatacaaagacaagaaggtggacaaagatacagttgggactagggcaggttttattctaaaatcacatctgtttccatgggctagcctaatctttcctcactgtagaatggctttttccacataaagaaaaacatagctgcctagagctagagagctgcacatattatagctttaaccataatctttcagtcgcaaatgcaaaattatcagggaaggttctcattggcccaaataaattatatgtccacccttggacaaattaactctgattaggtggatggggaactgtatccagcttgaatagctaggtagtccggaagtacacacatgggacaaagaagtatgttaaacatatgaatggggaatgaaagttccagaaaaagtgtgttaaacacacagaagttcactaccctaaaaagtcaagttatcttcaataactttttacattaaaacttactaatgtcactatggtttttttctattgaataatgactattgtccaggcgcagtggctcacaattgtaatcctagcactttgggaggctgaggtgggaggatcccttgagctcaggagttcaagaccagcctaggcaaaatagtgagaccctgtctcaataacaataaaaaaatttaaaataaataaataaataatataaaaaataaaaaataaaaaataaggcatagttgcacgtacttgtagtctcagctacttgggtggctgaggctggaagattccttgcgcccaggaggtcgaggctgcagtgagctgtgattacaccactacactgctaggtgacaaagcgagaccctgtccaaaaaaaaaaaaaaaaaaaaaagactatggaaaaaagaactgaccttgttttgtttgccagttacacttctgtaggtaatgctacaaccttcaagtttacacatttatatgctaaattgtttcagaaagaatttaagacagaatgaaataatatgttaaataacaacagaacataaatgtgaaacaaaggagggaaaaacaaaggtggaaacagagtgaaataacaaataatgtattcttgtttttttttttttttttgagatggagtcttgctctgtcaccaggctggaaggcagtagtgtgatctcggctcactgcaacctctgtcttctgggttcaagtgattctcctgcctcagcctcccaagtagctgggactacaggcacgcaccaccatgcccaactaatttttgtatttttagtaaagatgggccaggatggtctcgatctcttgagctcgtgacctgcctgcctttgcctcccaaagtgctgggattacaggcatgggccaccaagtctggccaaataatatattcttaatgcaggtaaacgtgttgttaaattaaacttataggtggccattgttttggacagagctccttcactaggctcaacatatcaaaccaaaatggattcactcatgttgaagttccatgccactaagccaaaactaagttgtttatctgaccttccaagaaatcaggagagagataacagccaaatccccaataggctagtgttagccggcatgataaaaaagtactgtctactttaacccttgcaaagaaagtaattttgaaacgaccaatccacttttttttttttctttcagataaggtactgctctgtcaaccaggcttaagtgcagtggcatggtcatagctcatcgcaacatctaattcctgagcttaagcaatccttccacctcacttcagcttcccaagtagctgggcctacaagcatgcaccaccatgcctggctaattatttttcagtttttgttagagatgaggtcttgctgtgttggccaggctggtcttgaactcctggcctcaagctatcctcccaccttggcctccccaaagtgctgggattataggaatgagccactgtgtccagtcccaatctgctttttgttatttctgctttcctcagtccttttctgtctataaagtcaacctcctctgctcagctcattggaacacagaatgaggtgttgcctgattctgcaattgataataaaagccaattaagatctttaaaattggctgagcacagtggctcatgcctgtaatctcaaccctttgggaggctggatgcaggaagatcacttgacgccaggagttcaagaccagcctgggcaacacggtgagacccgcctggggaacacaatgagacccacctaggcaatacagtgagactctgtctccacaaaaaaaaataaaaaataacacaccctctcaaaaaaaccataaaaaattaattatttttaaaagacctttaaaataaaattgttataatattgtcttttgacaacatacttttggggaaggttacaaatctaagttttccagtaactttgtcagttacaaacttcataatgtactttaggtagtgaaccaattgcttaagaagcataaaatgtagggtgggcacagtggctcatacttgtaatcccactcctttgaaagactgaggtgagaggatggcttgaggccaggagtttgagacctcttaggtagctagaactacaagcgtgtatgtatcatcatgcctgggaaacatagcaagatgctgtctctacaaaaaataaaaaataaggccaggcgtggtggctcaaatcccagcactttgggaggctgaggcaggcggatcacgaggtcaggagttcgagaccagcctggccaatatagtgaaaccccatctctactaaaaatacaaaaattagccaggcatggtggcgtgtgcctgtaatcccagctactcaggaggctgaggcaggagaatcacttgaactcaggaggcggaggttgcagtgagctgagattgcaccactgcattccagcatgggtgacagagcgagactctgtctcaaaaacaaacaaacaaacaaaaaacacataagccaggcacgatggtatatgcctgtagtcctacctactcaagaagctgaagcagaaggattatttgggccaggagttcaaggttacagtaagctatgaccctgctactgcactccagcctgggagacagagtgagaccctgtctcaaaataaaaaacaacaacaagacaaccataaaatgcactaacaaatgtatatatatatacttcatacatagtaagaaagggacttctgctagaaatccccacttagcctccataatattcctgatatctctcttcatttattagggataaagaaatagagagtgactatgttagcaaggagacaaagggggagagctgctaattgaaaagtgctctgtgatatgactttgagcagagacttgaataaacagatgatgtgagctttgagaatatctgggagaacattccaggcaaaggaaacagtaagaataaacctcagcaggctgggcacggtggctcactcctgtaatcccagcactttgggaggccgaggcgggcggatcatgaggtcaggagatcgagaccatcctggctaacacgatgaaaccccgtctctactaaaaatacaaaaaattagctgggcgcggtggcgggcacctgtagtcccagctactcgggaggctgaggcaggagaatggcctgaacccaggaggtggagtttgcagtgagacgagattctgctacagcactccagcctgggtgacagagtgagcttccgtctcaaaaaaaaaaaaaaaaaaaaaaagaaaagaataaaccccagcaaacaagcatgcttaacatgttcaaggaaaagcaatgaggccagtgtgtctggtacagaatgagtaagagataaaatggtaggtcatttgagaggtagaaccagactgtgtaggatactgtaagccatggtgaaaactggttgctattctaaacataaagggaaaacactggagggttttcagcagagaattaacataatatgactttgattataaaaggctgaccctagctgctatgtgaagaatagacttttaggaggtaaaagtggaagcagggagacaggttgagaggctattagggaagtctagataagagaccaagagagaccttaggactctcagcccggccaacataatgagatcctgtttctacaaaaaataaaaaattagccaggtatgctggtacacgcctatagtcccagctactaagaagactgaagcaggaggttcacttaagcctaggagttcgaagctacagtgcgccactgcactccagtctgggtgacaaagcaagaccttaacactaaaataaataaataaattgaattgaattaaaattttaaaaaatagtggccggacacagcggctcacgcttgtaatcccaggactttgggaggctgaggcaggcggatcacctgagatcaggagttcgagaccagcctggccagcatggtgaaaacccctctctactaaaaatacaaaaattagccaggcatggtggcaggtgcctgtaatcccagctacttgggaggctgaggcaggagaattgcttgaacctgggaggtggagattgcagtgagctgatattacaccgttgcactccagcctgggtggcaagagcgagattccatctcaaaaaagaaagaaagaaagaaaaaataccttaggactacgtggaagcattgaaggtgaggagaagtagtcaagtttgggctctattttggagataaatctgagaggttttgctgatggacctctccgtggagacagagaagactggtaattgaaaagcagtcctctaaggacaatggagataagactggtctgtatatgctcctgctaaagttatttatcttgatactgagagagaaaagatcttaagttataaaatagggaaatgaatattgtataactttaaaacccttcactttccttttctttatggcctcaattgctcatgaaaaaaaaaacacagaacttttaatcactgcagacaatgtttcaagaagttaaaaaatacccttctattagacttgcagtgtcttaacaacactctagtgttatttcttcttaaaaaggcctctagtgcaatgagttagctgagactaccataccaaatcttcatagctaataaaactagaggttttgtaaacagaacacctacataaaatgtcacataaactggtattccttaacaactggcacaatgaaaagaggagacaggcagtgaaaggaagtcatctggaaagagttactgaaaccctcagtttccaaactggtttcaactaattaatgttgaaaagtcgtcttgtactttggaaatgaagcatttgacttcaaggaaagtcaggagaaaaaggggttaaaaaaaaaacaaccaaggaaactggttattttatgtagaaatatcaataatgtcacctaaaatctgtagtttgatcaagatttttttaaggaatttcaaatcccagacaaactaaagttcagagaatttgctgttagacctgcactacagaaaatgttaaaggaagtttttcaagctgaactaaaacaccagatgtaaactcgcatgtatacaaggaatgaagagcattggaagtgaaaaatgtgtgggtaaatacagaatatatttttttcatatcttaatttttttaaacattgtaaagttgttttatggtagaaatcaaagcaaaatatatgataacaaaaacacaaagaatgacaggagcttaaagacatatgtgatgtagtttaatttaatttgaaggatacccgaaggaaatgaaatcatcaccttataaagatatctgcactcctacacttactacagctttatgcacaacaggcaagatatggaaacagctggagtgtcaactgacgagtgaatggataaagaaattgtggtatacatatatacatacacaatgaaatattattcagtcttaaaaaatgagatcctgccatttacgacaacatggggatgaacccagaggacattatattaagtgaaataagccagacatagaaagaaaaatactgcatgatctcattcatatgtagaatctggaaaaaatacatataatacatagaaacaaaaagtaaactggtgattaccaagggaaggggtagggcagggaagaggaaattagaataaataagagtatgtagatcaaagggtacaaagttgcagttatgtaagatgaataagtaaaaacaaaaaaaggatggatggatggatggaagggtggaaggaaggaagtgagggagggagggaatagaaacttgaacaatcaacttgacctaattaagttctagaagagtaaatcgagaaactgcagaacatacattcaagtgcagaaaaaacattcaccaattcttctaatgcatctcaataatttttttaaagtctcaataaactttaaaagctgatctaatacggtgtttgtattgtgaccaaaacagaatcaaattggaaatcaattacaaaaagatatttagaaaagccccaagtatttgtaattacagtaatatgcttcttaataacatataggacaaataagaaaccacaattataaaatgctttgaactgaataataaacatacaacgtatcaaaaattaagggtgcagctaaaacagtgtttgaaggaaaatctatagctcttaatgtttacattagggggaaaagtttaaaatcatctaagttttaaaaagtacaaatttaaatctaagaaagcagaggaaagaatatgtgagtgaaaattattgaaatagaaaaacagacattacagagaaaaccaataaaatgtacatacattttaacctgcagttcctagatacacctatacaggtataaaatcactatttgacagtaacatccatcagatatgaatttataactaagaaaatgaaaaaaacttagatgacaaaaatgaagaaacttgttagatagacatctatataatagaatgcaacgcttcattttttaaaaaaacggcagctttacaggtactaatgtggcatgatctgtgatcaagcaaacaacagcaagatgcagaacagtttgtaaagaatactaccgtacatgtaggtgtgtgctttttatttatttatttttctggtgtatgttttttaaagcatatgtgcatgcatttatttttatatattcacatatgcataaaacatatctagaaatacacagcagaaacgggtaatagtggctgcttctggaaagaagacctatgtgtcttctatatatgggtggtattatagttcagtgggtaccattttgccctgtagaatttaataatgtgtaaacattctacattttaaaaaatatttcaagtttaaaaaagggtaataaatatcataagaaaaggggagaaatgggaaaaacaaaagccagaaggactggggtcagaaggactagactagttatttacacagtttggctttctgaataagcagcctcctttgaggcagcaggtcattgtttatctagataagatagctgagaaacaaaagcttcggtggcctttttctattcaccttacagtgtgtctaaaacaaccatggcaagagtccttagctagatatacacctaaggggattaaagaggtacagatggacaagctcataggatttcccatttactgctatagaggcccacattcaggaatctttctttgagcctgcagatcctacctacccaagctaccgtgtatcctttgctctctatctatgatggagaaaaaagggattgtgcagtaattgctgcatgaccacatatacataggggtgtcacaaaagccagcagtcagaatttgctgttatgctattttcagtatcaagaacccagataaaagcaatcttcaggaagtaaaatcaaaatatttacctttcctttggataaaatgtttaaattctccaaatttaaaaattaaagttaccctctatattcagagctatggagagtgtgatgttgtttatagctctccaaacagccagatttgatatatgatattagaatattttctcctctctggttttgttaccttcttctgaaacaataacttttgttttatgtggtttaagtatcttttctattttaattaataaaaatttaaatattatcaatcctcaggcagcatattttataaaaggctatcaaaagtcacttcttatttcaattcttcttggtataatgtacctggtcttattaaaattacccacaaaataaataatcctttctgattaaattattcaaacagtaccactaatactgaaaagtgatgtgacagaagtcttagtatttggaatttatctttagaattcttaagttttccatgaagtactccatttaaatctccattgttttctttaacccatggggaaattattacactcttttcaggcaaggtagtaataggttcctttaaccatgtcaataagcattacagtagtaggtaacaaaagcaaatatgcatacatgtgtcacctctttctttttctttcttttttcttttttgagagagggtctttcttgctctgtcacctaggctggagtgcagtggcatgtgccacctaggactacaggcgtgtgccaccacggctggttaagagatagggtttcactgtcgtgtaggctggggtgtagtggcgcaatcacggctcactgcagactcaaactattgggctcaagcaatcttctcacctcagccttgcaacatgctgggattataggtatgagccaccatgcctgtggcccacgtgtcatttcttgaaacacagacatggtctgatatatagcttacgtaggcaaaaaccacttcaacatgtttaaactttagaagaaaatgaatgcacaaccagggaaaagccaaatcagacttgtaaatccatcaagaaaattcttcgaatttacttccagtcatcaccaactatccaacaaaaaaagtaactatttttttctactctatattcagtgtgaaagctaaacagaaatgttatatataaaaatagaaggatctcggtttgggggatttgaaatatatataatttagattaccttttatttgtttgctgtttatcatttacttattttgcctaggtgcataagaaatagcattgtgggtcaatgaagcaaaagctaaaaatgcctaatatcaatggtagcaaaattttatctcattaacatacagttaaaatacttacctcacatattacttacataaaatcacatccatgattaggttcaggtatactcctccatttgaaaattttataccttcccctctgtagggaaaaagaaaatctattttctttctcgaaaataaaaatagcatgagtaatgggatctaattaaactaaagagcttctgcacagcaaaagaaactaccatcagagtgaacaggcaacctacaaaattggagaaaattttcgcaacctactcatctgacaaagggctaatatccagaatctacaatgaactcaaacaaatttacaagaaaaaaacaaacaaccccatcaaaaagtgggagaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagaattggaaccaacccaaatgtccaacaatgatagactggattaagaaaatgtggcacatatacaccatggaacactatgcagccataaaaaatgatgagttcatgtcctttgtagggacatggatgaaattggaaatcatcactctcagtaaactactgcaagaacaaaaaaccaaacactgcatattctcacttataggtgggaactgaacaatgagaacacatggacacagaaaggggaacatcacactctggggactgttgtggggttgggggagcgggtagggatagctttaggagatataactaacactaaatgatgaattaatgggtgcagcacaccagcatggcacatgtatacatatgtaactaacctgcacattgtgcacatgtaccctaaaacttaaagtataataattaaaaaaaaaatcaatttgcagagacaaatttacatataaataaaagtatgcctgcagcttgtaagttcaatcaataaagccacaagcatttgttaaatgcttcctatatgcctaaaaaaaaaataaataaaaattaaaaaaaaaatagcatgagttccaaattccaaaggtggaatatttcagtgataaacccggagaaaaataagtcaccaatagtgtaggtaaaaagattttcccgaaagactactttctcctgatacaaaaaagctactgctttaataaaggacatcattcgattcatgttataaaacatacaagttagtaacttatactgcttgcagataaatacacttatagtagaaatataaaaacatgtgtaagaatgaaaattctgggcaggcaaggtggctcatgccagtaatctcaggactttgggaggccaaggcaggaggatcacttgagcccaggagttcgagatcagcctgggcaatatgttgagaccctacctctacaaaaaaatatacaaaaattagctgggtatggtagtgcacacctctagtctcagctactcaggaggctaaggtgggaggactgcttgagaccaggaggtggtggtggcagtgagcagagatcacactactgcactccagtcgatgtgaccaagtgagaacctgtctcaaaaaaaaaaaaaaaaaaagaaaaaggaaatctgtcatgaaacactactagggaaggagggagagaggacaatgaaataggagaggtaaacaatgggaacaataattgtatttctaacatgtaattggaggagaaggaacagcaacagggaataatgcacagtgctaacattttacaaagcttggactaggcacataggtgtttactatactattctctatttttatctgtatatttaaaatatttcaaaaaataccatttatgtaacaaaaaagcatatgcagcaataaatatacaaaagattaaaaattctaaaactttattaaaagacaatagaaaagatataaataaatggaaagatataaatgcatatttatgataaaaaggctttttctttttttttttttttgagaacaagtttcgctcgtgttgccgaggctggagttcaatagcacaaccttggctcaccgcaaccttcgcctcttaggttcaagcgattctcctgcctcagcctcctgagtagctggcattacaggcatgcgccaccacactggctgattttgtatttttagtagagatggggtttttccatgttggtcaggatgatcttgagctcccaacctctggtgatcagcgcccctcggcctcccaaagtgctgggattacaggtgtgagccactgcgcctggcctaaaggctctacgttttaaggagagcaattctacctgaaatcaaccaataaatttaaaaatttcaatagcctttgtcttgaacatgacaagtgaccataaaatgtacatgaaaaagccaagaggagggaatggccaatatactcacgaagaaggacaaattgaaggtatgtgccctatcaaaactcctcttccaaacaccaacacttttttttttttttttgagacgagtcttgctctgtcgccaggctggagtgaagtggcaccatcttggctcactgcaacctccggctcctgggttcaagcaattcccctgcctcagtctcctgagtagctgggaatacaggcatgtgccaccatgcccggctaatttttcgtattttagtagagatggggtttcaccatgttggccaggatggtctcgatctcctgaccttgtgatccgcctgccttggcctcccagtgttgggattacaggggtgagccactgcgcccagtccaccaacacttattgagccaagataaagacatagtggtagtagtacagcaactgagaaccaagagaactctttcacaccaaatcactgccaggtggagcacattcctaaatgtaagagacatactgtactatttttcttctgtaaaaacagtaaaacacaatttataacagaatttttataatacgacagcaggaaaggatttcttacacaaaagactgaaagcattaactatttaaaaagattaataaattggactacattaaaatcaagagcttttactcatcacaaagtacaataaaaaacgtttaaagtcacaaattaagagatgttttatacacacacacacacacacacacacactcaacaaaagattctcatccagaatatttaaatgactaccataatttaataacaaatgaaaaatgaatagaaaaactggcaaaaaagctgttcagagaaaagaaaacacaagtggccataaacatttgaaaagacattcaatacagccgatgctgtggctcacgcctgtaatcccagcactttgggaggcccaggtggggggatcacaaggtcaggagttcgagatcagcctagccaacatggtgaaacactgtctctactaaaaatacaaaaattactgggacatgacggcatgcgcctgtaatcccagctactcaggaggctgaggcaagagaattgtttgaactcaggagtcgacagagcaagactccatcaaaaaaaaaaaaaaaaaaaaaaagacattcaatcttattattaatgaggtaactgcaaattgaaataaaaagataccatttcagaaccacaaggccaacaaatatttttaaatcccaacaaatatagatgttgtcagaatgagaggaattcatgcatatcattagtgaaagcaaaaatcagtataagcactttggagaaaataattggcatttctaataaagctaaagatccacacagtccctggcccagcaagtccactcccagataaagatggaatatagactagatgtgtgtgtgcatcagatatacatacaaaaaacattttatcagcattatttgtagcaagaaaaaacaatttgtagcaaaagcctaatttttcattaacagtagaataaatacatcatatagcagtggaaaggaaaattaaactatagctacattggtcaacttgactaaaacttaaacgtaactgtgcactaaaagaggtagggatttgaaataggacaataccaatgattcaagggaactgaatgaaagaactaagttggcaaaaggagagcagagaagcagaagcaaatggaaagaagaggtcttaaagaaccagtttggggaaatttgaagtttcccaaagaagacagtgaagttccacaagaaggaagtggacagagtagagttggtggagcacatacttagcaggggtttgagaagacagttttcagtcgacttagatggtcccatgggagaagcaggatccagtttagaaagaacagagaggaccttaaaaattatctgtagcctgagtaacaacttccaactaagccaacttctgatcatagtgctctaaaagtaaatcctttcgaatatattgtcatcaggttttaactgggacaaagagtaaatattcctggcagtatgaaactcttttttcttcttcttttcttgtttttgagatggagtactgttctgtcacccaggatggagtgcaatggtgcaatctcagctcactgcaacctcagcctccagggttcaagcaattctcctgtcttagcttcccaagtagctgggataacaggcacccgccactatgcctgtctaatttttctttctttctttttttttttttttttgagacagagtcttgctctgtcacccaggctggagtacagtggcatgatctcggctcactgcaatctccacctcccgggttcaagtgattctcctgtctcagcatcccgagtagctgggattacaggcatgcaccaccatgcctggctaattttttgtattttgagtagagacagggttttaccatgttagtcaggctggtctcgaactcttgacctcaggtgatctgcccatctcagcctccctaagtgctgggaatataggcgtgagccaccgcacccggccaagcctagctaattttttgtatttttagtagagacagggtttcaccatgttggccaggctgttctcttaactcctgacctcagatgatctgcccacctcagcctcccaaggtgctgggattacaggtatgaatgagccatcgcgcccagcctcttctttttaactaatggtttctatccgggaactcagaaccaaaactaatgacccttttatgacataaacatctccaaaaaacgatgtgtttgctgtaatctctgcctggaccactctgtccctctgtcgccagatatccagatgattctctccttcacctctcctttacctcccactttactcaaatgacaataaggactcccctgaccttacaatggattacattatcagtctctatgcttcactctatactacagagtgtagtactatcacatatctacatttctggtgtcatggtggccaaatgtatgtcctagcccctagactttagccttgaccatacaatttgtttggttgctaggaagttagcagacatgattcaagcagagacttaaaatggtttgcactgctagccttggtctcttgcactcctgcttttggccatgcaaaaataacataattcggtattccactggtgccagaagaatgggagacatgtggagaacacctgaacctgagccataccctggagtcctatctagcctggtatacatatatagaaccctaggagatcaaccaacatacatgtctggtgtttgtaagccattgacttttaggcagtttgttatacagcactattgtaaaaacagcaaatagaaactgaaaaccaccaacatccagacagtcctcaccctctttcctggcttatttgtcttcacagcacttaagatactatgtattttacatctttattttctgtccctctacatacacgcatccacacacaaataaaagctccacgaaataatttttgcttcttttgtttattgttatcactcctgcaccaagactagcatttggcacataacaagtgttcaataaacatttgttgaataatttaaagaaaaacagccaaagtcctcatactcatggaacttatgttttagtggggaaaaacagaaattaacaagtatacaaataattatcattagatagttatgagtgttataaggaaacaacaatgatgaaatagaaaatgataaagtataagcaggaagggttgtataggtgatttttcttaaagttgccatgcgggggtatcaaataaactgaattctgaatacagggccttatatgcatatgggatgccattctaggcaaagagaactgaaaatgtaatgacactagggcaggaacaagcttgctgttcaaaaacagaaagagcacctatagtagtaagagacgaagtagacaaacatctgatgtaccaagggcctcatgggccacagtagggtctttgggttttattctgattacagttgggagcctttggagggtcttatgtagggaaatgatttatttttaaggtcattttgtttgttagattgactgtagggggcaagaagggaagtacggagataagtaaaggagctactgcaacagtatgggcaagtgagtatgacaaccaggcccaggactgaggtagtggtggagcgggtgagctgttgaggacatcttttgaaagtagagccaaaaggacttgctgattgaagagatgtgttgtatgagagaaggagaggcatctggaggctgaagtgattggaatcaagaatagcctcttaatttctgtctgaataacttatcaaagagtagtttcattaactgagttgaagatgagcagttaagggggaagcgacaccatgggctccattttgtacacttattgatctgcttctccatacaaggcactgtgttacacagaagtcataggtatctgttttaaagaacattaagcttttgtcaattgctaagtagaatcaatggtttcactgctgtctggatactactggactaaagtcaaaccaaaacaaaagcaaaaacaaaacagtccatgacagacagatattattagttgtcttcccaatacccagcctcctttcctccttattaaaaatctcttaccaggtgtggtggctcacacctataatctcagcactttgggaggccaaggttggaggattgcttgagcccagaagttcgagaaaagcctgggcaacatagtgagacatcgtctctacaaaaaaagtaaaaaactagcctggtgtggtggtgcggcctgtggtatcagctactcaggaggattgcttgagaccaggaggcagaggttgcagtgaactgagatcctgccacttcactcaagcctgggcaacagagtgagaccctgtttaaaaaggaaaaaaaggctgggcgtggtggctcatgcctgtaatcccagcactttgggaggctacagggggcggatgacctaaggtcgggagttcgagtccagtctgaccaacatggtgaaaccctgtctctactgaaaatacaaaattagccgggcgtggtggtgcatgcctgtaataccagctactcaggaggctgaggcaggagaatcgcttgaacctaggaggcagaggttgcagtgagcccagattgcgccattgtacttcagcctgggcaacaagggcgaaactccatctccaaagcaacaacaacaacaacaacaaacacagaaaacaagctcttgctcggtttgttttggtcgagactgctctgtgcccggttaaagatactcactgtgtataccatttatgttaaaaaaaaaaaaaaaaaagtaggggggaagaatacatatttgatgtgcttgcatatacatttttaaatctctagaaggattaaaaaagagattaataccagtggtaatttgttgtgaggagggtaggtaaggcaagatacagaatgacagggatgtggatacaaaagtgagattttcaccataaactctttcacactctgatattttaagcttaagaatgtcttggctactaaaaaaacatgtaaaaatatatatatatttttaatttcaccatctcatattccctcacaaaggtaaccaggtaacagtattagctaatgagaaataaatgaaagcccttgaggagggtttctctttcctagtaaacatatagcttagcaagaagatttctgccttttgcctttgttatttttccctccttattacctgagatgtggatgtaatgtctgcagtcggaacaaccattttttgactagaagaacaaaagttacccattaaagatagaaaaacaggaagctgtcagagagaaactgggtccttgatgactctctcaaatagctaattagtgcttaactacttctgaactacttgtttaataagaaaatataacattaatccacagcagttaagatgaagttgtaattgatatagtcttagaacccacaataaaatcctgcaccataatgcaaaagaggctaatgggtggtcataatgacagaaaaaggtgacataagaaacataatgccctcaaggcacttctaagttaacttctaagaatagatggtattacataatttcaaagtcccataatttacccatcctagtatgtgtttggatggctgggtttctcaacaatgtgaacatttccattgatctcttgtcttacatgagtataagaagatactgtgaggagcaaagggaagatttaaagagaataattctgagtcttggctatgcctaatcatatgacttttaggtattagcttgggagttggcataaaatcattcctgttgttgcaatttcataatgagaattacagaatagacttctaaaactaacgaggcttaaatcttgttattttaactgaaaggaatattttaagatgatggtcaagaattaagtttgcaaaggaattgttcttttgggtttctgtttttttgagacagggtctcattttattgcccaggctggagtgcagtggcacaatcacaattcactgcaggctcaaccttccaggcttaagccatcctcccacctcagccacttccaagtagctgggactacaggcatgtgccatcacgcccaggtaatttgttgttgttttcagatggagtttcgctcttgtcgcccagcctggagtgcagtggcgggatctcagctcactgcaacctcagtctcctgggttcaagccattctcttgcctcaacctcctgagtagctgggattacaggcagccaccaccacacctggctaatttttgcagttttagtagagacagggttttaccatgttggccaggctggtcttgaattcctgacctcatgtgatccacacgcctaggccatccaaattgctgggattacaagtgtgagtcactgcgcctggccaatatttttttttttttttgagatgagtctccctctgtcgcccaggctggagtgcagtggtgcgatctcagctcactgtaagctccaccttcgggttcaggccattctcctgccctagcctctcgagtagctgggactataggtgccagccaccacaccaggctcattttttgtatttttagtagagaaggggtttcaccacgttagccaggatggtctagatctcctgacctcgtgatccacctgcctcagcctcccaaagtgctgggattacaggagtgagccactgcgcctggctgtgcccagccaatattttaattttttgtagagacagggccttgctacgttgtcagggctagactggaactcctgtgctcaagcgatcctcctgcctcggcctcgccgagtgctgggataacaggcataagcctcttcacccggtaagaattgttcttatattcatgtttgattgctttttgtttatttattaagagacaaggtttcaccctgtcaccctcacccaggttgatgtacagtggctcaatcatagctcactgtagccttaaacacctaggctcaagtgatcttcctgcccagcatgcagaatagccaggactggcaaggctaattttttttttttttttgtagaaatgggtttttgcaacaagcgcggtggctcatgcctgtaatcccagcattttgggaggctgaggcgggtggatcaccaggtcaggagttcgagaccagcctgaccaacatggtgtaaatctcatctctactaaaaatacaaaaattaggggagggtggagccaagatggctgaataggaacagctccagtctacatttcccagcatcagagcagaagacgggtgatttctgcatttccaactgaggtaccggattaatctcactggggagtgtcggacagtgggtacaggacagtgggtgcagcgcaccaagagggagcagaagcaaggcgaggcatcacctcacccgggaagcacaaggggtcagggaattccctttcctagtcaaagaaaggggtgacagacggcacctggaaaatcgggtcattcccaccctaatactgcacttttccaacggtcttagcaaacggcacaccaagagattatatcccgtgcctggctcggagggtcctatgcccatggagcctcgctcattggtagcacagcagtctgagatcaaactgcaaggcggcagtgaggctggtgtaggggtgcccgtcattgtcattgccaaggcttgagtaggtaaacaaagcggccgggaagctcaaactgggcggagcccaccaaagctcaaggaggcctgcctgcttctgtacactccacctctgggggcaggacacagccaaacaaaaggcagcagaaacctctgcagacttaaatgtccctgtctgacagctttgaagagagcagtggttctcccagcacgcaggtggagatatgagaacggacagactgcctcctcaagtgggtccctgacccctgactagcctaactaggaggcagcccccagtaggggcagactgacacctcacatggccgggtactcctctgagacaaaacttccagaggaatgatcaggcagcaacatttgctgttcaccaatatccgctgttctgcaggctctgctactgatacccaggcaaacagggtctggagtggacctccagaaaactccaacagacgtgcagctgaggatcctgactgtcagaaggaaaactaacaaacagaaaggacatccacaccaaaatcccatctgtatgtcaccatcaaagaccaaaggtagataaaaccacaaacatggggaaaaaacagagcagaaaaactggaaactctaaaaaccagagcgcctctcctcctccaaaggaacgcagctcctcaccagcaatggaacaaagttggatggagaatgactttgacgagttgagagaagaaggcttcagacgatcaaactactctgagctaaaggaagaagtctgaacccatggaaaagaagttaaaaaccttggaaaaaaattagacgaatggctaactagaataaccgatgcagagaagtccttaaaggacctgatggagctgaaacccatggcacgagaactatatgacgaatgcacaagcctcagtagctgattggatcaactggaagaacgggtatcagtaatggaagatcaaatgaatgaaatgaagcatgaagagaagtttagagaaaaaagaataaaaagaaaccaacaaagcctgcaggaaatatgggactatgtgaaaagaccaaatctacgtctgattggtgtacctgaaagtgacagggagaatgcaaccaagttggaaaacactctgcaggatattatccagcagaacttccccaatctagcaaggcaggccaacatgcaaattcagtaaatacagagaatgccacaaagatactcctcaagaagagcaactccaagacacctaattgtcagattcaccaaagttgaaatgaaggaaaaaatgttaagggcagccagagagaaaggtcgggttacccacaaagggaagcccatcagactaacagcggatctctcgacagaaactctacaagccagaagagagtggggaccaatattcaacattcttaaagaaaagaattttcaacccagaatttcatatccagccaaactaagcttcataaatgaaggagaaataaaatcctttacagacaagcaaatgcggacagattttgtcaccaccaggcctgccctaaaagagctcctgaaggaagcactacacatggaaaggaacaaccggtaccagccactgcaaaaacatgccaaattgtaaagaccatcgaggctaggaagaaactgcatcaactaacgagcaaaacaaccagctaacatcataatgacaggatcaaattcacacataacaatattaaccttaaatgtaaatgggctacatgctccagttaaaagacacagactggcaaactggataaagagtcaagacccatccatcagtgtgctgtattcaggaaacccatctcatgtgcagagacatacataggctcaaaataaagggatggaggaacatctaccaagcaaatggaaaacaaaaaaagtcaggggttgctatcctagtctctgataaaacagactttaaaccaacaaagatcaaaagagacaaagaaggccattacataatggtaaagggatcaattcaacaagaagagctaactatcctaaatatatatgcacccaatacagaagcacccagattcataaagcaagtccttagagacctacagagagacttagactcccacacaataataatgggagactttaacaccccactgtcaacattagacagatcaacgagacagaacgttaacaaggatacccaggaattgaactcagctctgcaccaagcggacctaacagacatctacagaactctccaccccaagtcgacagaatatacattcttttcagcaccacaccacacctattccaaaattgaccacatagttggaagtaaagcactcctcagcaaatgtaaaagaacagaaattataacaaactgtctctcagaccacagtgcaatcaaactagaacccaggattaagaaactcactaaaaaccgcacaactacatggaaactgaacaacctgctcctgaatgactattgggtacataacgaaatgaaggcagaaataaacatgttctttgaaaccaacgagaacaaagacgcaacataccagaatctctgggacacattcaaagcagtgtgtagagggaaatttatagcactaaatgcccacaagagaaagcaggaaagatctaaaattgacaccctaacatcacaattaaaagaactagagaagcaagggcaaacacattcaaaagctagcagaaggcaagaaataactaagatcagaggagaactgaaggaattagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaaaaaatggatacattcctcgacacatacaccctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgccaaaatcctcaataaaatactggcaaaccgaatccagcagcacatcaaaaagcttatccaccatgatcaagtgggcttcatccctgggatgcaaggctggctcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatggtctcagcccaaaatctccttaagctgataagcaacttcagtaaagtctcaggatacaaaatcaatgtacaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaaggtggattaaagacttaaatgttagacctaaaaccataaaaaccctagaagaaaacctaggcaatactattcaggacaaaggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatgggagaaaatttttgcaatctactcatctgacaaagggctaatatccggaatctacaatgaactcaaacaaatttacaagaaaaaaacaaacaaccccatcaaaaagtgggcgaaggatatgaacagacacttctcaaaagaagacatttatgcagccaacagacacatgaaaacatgctcgtcatcactggctatcagagaaatgcaaatcaaaaccacaaagagataccatctcacaccagttagaatggcaatcatgaaaaaagtcaggaaacaacaggtgctgagaggatgtggagaaataggaacacttttacactgttggtgggactgtaaactagttcaaccattgtggaagtcagtgtggcgattcctcagggatctagaactagaagtaccatttgacccagccatcccattactgggtatatacccaaaggattataaatcatcctgctataaagacacatgcacacatatgtttattgtggcactattcacaatagcaagacttggaaccaacccaaatgtccaacaacgatagactggattaagaaaatgtggcacatatacactatggaatactatgcagccataaaaaatgatgagttcatgtcctttgtagggacatggatgaagctggaaaccatcattttcagcaaactttcgcaaggcgaaaaaaccaaacactgcatgctctcactcataggtgggaattaaccaatgagaacacatggacacaggaaggggaacatcacacaccgaggcctgttgtggggtggggagaggggggagggatagcattaggagatataactaatgtaaatgatgagttcatgggtgcagcacaccaacatggcacatgtatacatatgtaactaatctacacgttgttcacatgtaccctagaacttaaagtatgataaaaaaaaatacaaaaattagccaggcgtggtggtatgtgcctgtaaccccagctactcaggaggctgaggcaggagaatcacttaaacccaggaggcagaggttgcagtgagccaagattgtgccactgcactccagcctaggtgacagagtgagactttgcctgaaaaaaaaaaaaaaatagaaaaagaaatgggtttttgctatgttgcccaggcttattgcttttaatttctttcataggatgttatcttcctaaagcactcataaaaaatggaaaatgtttgtgttagaaatatcctttcaactcaaccctgccctgaatgtcattcagtgtaacacatattttggtccttctatttattacactacagatattttaaaaaacattttttagacatagagacaggatggactggatacggtggctcatgcctgtaatctcagcacttcgggaggctaagatcagtgaaggtcaggagccggagaccagcctgggcaacgtggtgaaaccccgtttctactaaaaatacaaaaacgtgcgcctgtaatcccagctatctgatgcaggacagttgcttgaatcgaggaggtggaggttgcagtgagtcgagatcacatccctgcactccagcataggcaacagaacgagactctgtctcaaaaaaaaaaaaaaaaaaaaaaaaagaaacaagaaacagataggatgaaatcaaatattatagtgataattgcagcacacctcctaactaattttatgataaagattttgtgtcatttttctaaagtaactatcacatgaccaggatattatagaaactaaaaaaaaaaaaaaaaaaacaaaactaaactgatatagaaaaatcagtttgggtaagaaaaaaaatagaagactacttggtttatcctgaggatcaataattacttacaatatattgatcttatcaattaagactcgtctatggaattaactttcatgaaattgatcagataatggcaaataaaaaacaaaaacctcttgcttattcagaagtatatattatttctgtacttcaaaaagccatgtaaaatgattgccaaatgacttaggcaattctggtgaatattttgatgataaaacttagattattacatatccttgggctgggcatagtggctcatacccgttatcccagcaacatgggaggctgaggcaggaggattgcttgagtctaggagattgaggttgcactgagctatgattgcaccactgtactccagccagggcaacacagcaagaccttgtgtcttggaaaaaaattacatatccttggaataaaaataggtagttaaatccagggaagactgtaatacaaggactaatttcatcagatttatagatttttttaaaaagtcaactcatcaacacaaattttattaatagcagggtaaaaacaaaaaaaagactaaattcaatttaaaaaacactttaaaatcttgattgaaaatcccagaaagtagtgaaagcttaatatgtaagaaatgagtgttctctgaaggttttgggggaagaggcagcttttcctattcagtcattttgagaaatgcagtacaaaatgctctaagagcattcagttgccatttgatgaagccatttataagagaatcaaagtataagcttcagttcagtaaagtgaatagctatcagaaacaaatgtgcatgtctataattatcacatctatgctggctgacaaatcctgaaagcgactatataaatggtaatgcaatgaatatactctacattcctaaggaattctgcgtgagtatgaattcctgaattcattcccttaaatgaattatagattctcaaacctggtagtcaaaagaaatatgcaacaacactgaagaaaaataaacaataccaaagaatcctaataaccctttccctttacccttccataaaaattccaacccataaccttcaaagcaaaaacccctacttactatcagactcaacttctagacttcagcattttacttttccacaattgaagtccagataattgtcaatatccttaagatttgttgggaaagatacaatcagataaggtactttgaattccaatttcaggcacctcatgataatatatacagagatgccacatattccctgttattactgtttcactctccctagtgtttaagtcattcccaggtagtaagtgaaaggacacagaaaggtgcattaactctctcaggcaacttggcaactatttggtgcacagctactatgcactaagtgtgcctctaagtacatggcttaggatctcgaagtcactcaagcactagggagaaaacactccattgttgtttaatgttgggattttgctgctctataaactagtgttatgcggaagttttaggagatgatactcaaatggaaatatatatcctttcctaagtcgcagaaaggcaaccataaagctcaaaactgtattaccttgataatgtaatttttaaaatgttacgtgtgaaataagaccatttattttttacttttttatttttttgagacagagtctcgctctgtcgcccaggctggagtgcagtggtgcaatctcggctcactgcaacatctgcctcccgggttcaagcaattctcatgtctcaacctcccaagtagctgggattacaggtatgtgccaccacgcctggctaatattttgtatttttagtagagacggtgtttcatcgtgttggccaggctggtcttgaactcctgacctcaggtgatccgctggccttggcttcccaaagtacggggatcacaggcgtgagccactgtacccgtcctattgagaccgttttaaaaatgattgtgacattattctaaaaacttcagtatctatccatctctatatacatatatatgaatgagagatacagcctaatagaggagaaatggaataagtaaatatctctggaaacactgagtacaagtacaaatgtgattaaaagacacagagtatgagatgaaatatccatcttaaaatttcagtgctttggtggttaaaacagtaagagaaaaacaacattgttttgcgctaggaaacctgtttctaatcaactgagctattcctatggggtcaaataaaaatgattagcttattaaaagcatagctttgctatttaataggcaaaatgattgaaatttctgctgcagatcctgataattttagtgtttctagttaagcctgcaaaattgcattcattattagtgtccagattcattaacaattcaatttatagatattaatgcttataatgcatgcttcgcttgccaaaacttgaagagaaattgtttcaattagctttcatggatcatgaatcctgccggctgggtatttttagacaaaagatacaaacacatccccaagcaatgctaatgcacagctgggacttgtgtgtaaggtcacttgagctaacagtttaaaaggaaaaacagtaaatgagttttacccagatgagtaagagagaagtcttctgtttccaaccaaatatttgaaaggcatttaagaaaaatggcagcagaattatttgcttttgagatctctggaagataaaaccattaggccaaaattggcaatctaaactcaaggagcagtattcagcatataagacaatatgggagaccttaaattttccctttgtaaaaaaggggatttcttagaagtcacaagttaacaaaaatgcaaatcctgtcacctgcacaagggtcatgccccagtggtaggagaataaaaaatagactgataccacaaatgatccagatgacaatccagatttacagataattactaactctctgtttcatgttaggccacacacaactaggtcaaagttgctatttactgtcaatggcaaacagtattcttaggtagaagacacattctttggaggatgtccatctcctccagatacatttctgtcacataaatcttcatgtaaattaaagacaatagcccatctttgaacttttctcatagtgtagtacaatgtctacatttccttgtggtgtctggttgtttgtagcttggtatttactggaatatcaagagaatggtcgactttttaccttgaagctaagagatatttcatttgtcctcaccgaaatgccggaccatgttgcatacttaagcacagactgaatgatgtctcatgattttcccatgaactacaatttcacctccctgaaggatcccatttagtgaacttgggaaaaatctaaagctaacagtatggaatcaaaataagttttaaaaagaccatgagattctggaaaactagtccaacactacaactctaaggacattaatgtcataaaagtacagttgagaggcagaggacatgaaaagcatagaaactcttcagaatgtttggataaggaagtatgagaacatgtgaaatatttctaaaatcaaactgagctttgcattgaagcttagatattggtctggaggaacaacaaatacatctgtaaaaatattcattactatgctttttaatcttaatagtggtataacatttcccattgacaagtaaggcatagaaatctctaatttataataggtaggcattaaacaaaactaaaaaatatcaagattaaaatctaatttctgaaaaaatataaattagaacaaaaagaaatcgactgcctttacaaagtaataaaaactaatatatgaaaatgaactataagaggctggaagaaaaatggaaaaacaagtttggagagaaaagtgaaaaaaaatcagtgttttcagtcaggtgcggtggtgcaggcctgtagttccagctacttgagaggcttaggtgggaggacaccaggctgggcgacatagagagactgactcttagaaacaaaacgaaacaaaaaaacttaaaaccaaatgtggaataaagtaagcaactttttataaataccatcattacttagcatttaaaaaaattctatttttttaatataataatttgagtaaaggtctaaaagattgatggaaaaggaccaaactaagagtgatagtacatgggatgactgcaaaaattaatgatgtaacctatttgtttattcaattactacgactgcagaaatatatatatataaagtgcatttctcatactgccaaattcatcatgagtatttttgaaaaaacacaatttatgttttaaaacaaataagttatttaatacattggcacacccaaatacacacatacatctaaaaagcaatgacaaggaccgtggtcactgatgaaatcactagccctatcacattactattcaggtctataattcattctttagtattagagtccatagggccctggtttgcttgcccacactgaaaacagagaacaggaaggatccctggaacgagaagctcacttttttccccattctttcataagcttcctctagcttctaagtgctctgattattcttttgtctctgtgtggcaaacctattacttttaaggtatttctcccaccttgctcctcccatacctctacaatggatgcaaaggtcagtgactccctcaggaatagtagcattttcagcaaggggtatggtgaggtagtcatggaactcccattactgttaacaggagttacaggctacttcactgaaaattccaacccagagttcttttgatgctgaaaactatattttcatataacctgtactatgtacagagcccatatagcataggttataagattacaaatgatgtttagaggatgacatataaacagcaataaatataactgggcatacagataatcagaaatgcaaattggcactgttaacattacaaagcattttgtacaggtctctaagtgtagagatatggagttaactagatctcaaaattttgaggaagcacgtcttgtgggggcaggggtgatggtgaggacaggggatattcaatattactttacacatgagataaaacatttcagcatttttcctataatgactacctagagaaacaaaaaggaaattagttcaatgaagtattacacagaataaattatataaatattacaacgccgtgaaagcaggcataccatcttacttaccagtgtattcccatggccaccctaaaatcatgcctgccacataatatgcacattcaactcaaatatttgttgaaagaacagataaattattcctcacaacgtggcttaagtttcttcttgtgaaaaagaagttcgtgaccaatctgggaaacacagtgaaaccccatttctagaaagtgagtaacttctttcaagtgttgtttgtgaggattaaaagcaaccaagcagtactgtatagtataatactgtacagtgataatgggggggggaatgaaatggggtaaggggtgcatgaggacgctttatattatctttgcaacttttctgtaactctaaacttattccaaaatttacaagtttttttttttttttaaactaagccagccaggcatagtggctcatgcctgtaatctcagcgctttgggaggctgaggcgggtggattgcttgagctctgaggtttcagaccggcctgggcaacacgacaaagccctgtcattacaaaaaatacaaaaattagccgggtgtggtggtgcatgcctgcagttccagctacttgggaggctaaggtggggggattgcttgagcccaggaggtcaaggctgcagtgagccgagattgtgccactgcactccagtctgggtaacagagcaagaccctgtctcaaaaaagttaagcaaagcactcaaaccagcgtctgatatggctggtatgatcaacaaatattctctcactctcttctcaacactacccaatagcattctggtgatgctgcctgaagggactaaccagctaactaacaaatcacagtagagatctgctggccttatttgctggccttgttaattagctcctaaagcctatactggccctaaattattttaaatattctcactgcatgttactaaaagactctaccatcactactcctcactttttctttttcttttatacgctcttatactttccctccactctgttcttctcccaactagtactcattgacactggcatttttttgtggtgactcccattttcacaaataggaaaaatgttaagttactgattctggaagagaagagtggctttattcaaaagctaactccagtttccagatgttctgatgccctaaacttaatgttcatgaataaaatggcagcttagctaaaatataaaatattcatcttggccaggtgccgtgcctcccgcctacaatcccagcgctttgggaggccaaggcaggaggatcatttgaggcttggagtttgagaccagcctgggcaacatagtgagatcctatctctacagaaaattttaaaaattagacaagtttggtggggtgcacctgtagttctagctacttgggaggctgaagcaggagatcatttgaacacagaagtttgaggctgcagtgagctataactgagccactgtgctccagtctgggtgacagagcaagactcagtctctaaaaacaaaacaaaacaaacaaaactcataaccttgaaatgcaaagaaatgtatccacagacaatttcccaattaatggtggaataaatgccaagtgtccacatggaatcatgagaggtttactgagatatttattcttgcaactagcaatgatattttttaagttctttcagaaaaaatgaaatgggtattcattctcaaaagcaatctttcttcttttatcatatcagaaagtctgaatagaagttttaatatcatcggattacttatctcactttaaaatatatatatagggccaggcacagtggctcatgcctgtaatcccagcactttgggaagccaaggcaggggaatcacttgaggccaggaatctgagaccagcctgagcaacatagcaggactgtctctaccctccaaaaaataataaatatatttaaatatatatatgtatgtatgtatttatatacaaaataccatccctgaagggttagaagcaaagtaaatataagcaaaataatttccctatgacttataagcaaaataatttccccatgacttctattaaaaacaggaaatgcattagcattaaaaaaagaaaggaaaaaaatttttttaaaaagtaggctgggcatggtggctcacatctgtaatctcagcaatttggtagcttgaggtgagagtattgcttgagaccaggagttcaagaccagcctgagcaacatagtgagactcccatctctacaaaatctaaattagccaggcgtggtggtgaacgcctgtagtctcagccactcaggaggctgaggcaggaggatcacttgaacccaggaggttgaggctgcagtgagccatgactgtaccactgcactccaacctgggtaacgaagtgagactctgtctcaaacaaacaagcaaacaaacaaaaaaaggccgggagtggtggctcacacctgctgtaatcccaacactcagatggatcacctgaggtcaggagttcaagaccagcctggccaacatagtgaaacctcgtctctactaaaaatacaaaaattagccaggcgtggtggcacatgcctgtaatcccagttactcaggaggctgaggcaggagaatcatttgaacccggcaggcgaaggttgcagtgagccaagatcacaccactgtactccagcctgggcaacagagtgaaaatccaactagaaaaaaaaaaagaaaatgttttcaaagaaaaacaatgttcaacatatactaagcttaacatcttacttcttttgtttgtttgtttgtttgagacggagtcttgctctgttgcccaggctggagtgcagtggtgcaatctcggctcactgcaagctctgcctcccgggttcacaccattctcctgcctcagcctcctgagtagctgggactacaggcgcctgccaccatgccttactaattttttcttttttttgtatttttagtagagatggagtttcactgttagccaggatggtcttgacctcctgacctcatgatctgaccgcctcggcctctcaaagtgctgggattacaggcgtgagccaccgtgcccagccaaaatcctacttctttaagtcagaatcatagaaacaaaagacattctctgagttttcctaatactttccattaaccccttataatggaagtatgctcatctgtctccttattttccattcccaatccaggtctttgttttatctgaactctgtgcagaactgaaagaaaataaaaagtgaaaatcagtaagatttttcttctgttttggagacaggatctcactctgtcacccagcctggagcacagtggcacaatcttggctcactacaacctctacctcttgggctcgagcaatcctcctgccttagcctcctgagtagctgggaccacaggcacatgccaccatgcacggctaatttttgtattttttgtagagatgggggtttcaccatgttgctcaggctggtcttgagctcctagactcaagacatccacccacctaggcctcccaaagtgctaggatgataggcatgagctactgcgtccagctgtaaaaatcaaactgaaacaagaagttacagatattgtccatgaacaaggttgtaagaatttttttaaatgccagtttagttggtagggagtagtctttttctagtagttgtcaaactttatgatttcagtacctctttatgcttttagaaagtattcaggactccaaagagcttgcttgtgtggttataacaattaatagtataataataaaaattaaaacaaaaatttaaaaaatttactagattattttaaaacaatagaaaatcattgcatattaacagcatatttttatgtaagaatatttttttctactacaagatatatgcatttttgtttccagatgaaaataaagttttacattgtaagtatcaagggaaagtgatgctcttaggaagtggaatgtttatcctcagttaagaagaatgaagtgtggtaatgatatctagatgccagtttgagaagcacagggcctgtgctttcagttttctcacatttgaatattatgttgtatgggttttgtttcttctggtaaaattttatacacaggaagacaaaactgtttaattgtaatcagaataagcagagcagggaaaatgttctccatggattctaccaagattaactggccctcacctagaactccaaatcatcaatggtttcataattaaaacatagtttgccttcccctcagagttatccaactacattgaccctttggtaggaactatttggtatggtatctgttaataaaaagctggactggagtttccttcaaattagccaaacctgaagttaatccatagtatctgtgaaggctctggagaaaaagcatgtcttatagatgaaagaaaagagtctttgatcttttattaccaatagcctcagaccagaattcagtctattagctactaagaattactagaatttttgccttataagatatacctagcaactggacttccaactaattttttttttttttttaccttgtagaatacaactagcataggcctctacctaaaaaggcaaaatttagtggaaaaacaaaaactgattttagacaggagtggtggctcacacctgtagtcccagtattttgggaggttgaagtgggaggatcccaaggccaaaagtttgagaccagcctggccaacatggcgaaaccccatttctacaaaaaaatacaaaaattagccagatgtggtggtatgtgcctgtagccccagctgcttgggaggctcaggcagaaggactgcttgagcccaggaggtggacgctgcattgagctgtgatcacgacactgcactccagcctaagtgatagagcaagacaagcaaccaaacaataaataaaaataaaaataaaaacctgattttgccttgttttatttttagtcagataaaaactttatgtctacaagtaaaggggcatgtaccaatcttacatgtactacctatgcatagcatatgcagactaattgtcctgaaccgttactcctgtgtgctttacctgaaactaaatgctactgcttgtacgacattagttcaaccactgtggaaagcagtgtggtggttccttaaagagctaaaaacagaactaccatttgactcagcaatcccactactggggatatacccagaggaatataaattgttctattataagacacatataagcatatgttccctgcagcactattcacaatagcaaagacatggcgtcaacctaaatgcccaccaacagtagactgaataaagaaaatgtggtgcatatacaccatgaaatattatgctgccataaaaacaacaagatcatgtcctttgcaggaacactgatggaactaaaggccgttatcgtcagcaaactaatgcaagcacagaaaaccaaataccctatgttctcacttataagtgagagctaaataatgagaaccactgggcacaaagatgtaaacaacagccactggggcctggaaaaagggagagagacagacactggacagtgggaggaaggagagggacagactctggagagtgggaggagggagagggacagacactgagtgggaggagggatagggacagacactgagtggaaggagggagagggacagacaatggagtgggagaagggagagggatggatactggagaatgggaggagggagggggacagacactggagagtgggaggagggagagggacagacactgagtgggaggagggagggggacagacactggagagtgggaggagggagatggagagacactgagtgggaggaggaagagggacagacactgagtgggaggaaggagagggacagacactgagtgggaggaaggagagggacagacactggagagtgggaggagggagatggacagacactggagagtgggaggagggagagggactgacactggagagtgggaggagggagagggaccaacactagatagtgggaggagggagaggatcagaaaaacaactattgggtactatgcttagtacctgggtgacgaactaatatgtatagcaaaccctcatgacactagtttacctatataacaaacctgaacatgtatccctaaacctcaaacttaaaaagtaaaaataaaatgagaacccttttttgaaaaaaacctttttttaagtctttcatatcaccaggtctgatccaaaactttatgggcttggcagagttgcggctatgggctttcatccctctcaaggaggttaggaaaacaagtggcttccattttcagcctctatagtcctagttgagcttggcctcatatagaggatttcccatacagaataagatccagcaactaagtggccacaatacaagataaatggctctatttatataagctctcaaatatttttcaatgaataaatcctaaaatatattgaatattattagagcaagtttaaaataaatacatgtaattataaattttctagtatttacctatcaatgactatttattccaattcttgtttcctcttttcagacttaaatacctgtgcttctaagcaacttgaatttccttaaccatgatgtgggcgacaatgtgaagaactttccagattccccttagatgaaggatttgtttcccagatgttgagagagtggtcagtttatacctatcatatgataggcccttctacaatggcctcaggtcccatttctgggtaccctacatccaatgactgataaatatgggaatataaaggcttgaccccttgccccaactccagacaattctatgaagccaatcaagccccagagttccctgtagggtgagtccaggccggcatttggccttcatgcagcttgatttctccctttgcccacccttgctttcctcccttgccttccataggtgttgatcctaagggcattctttaatactctgcaagctaaactccctttcggagtccacattcttggggacccagcatggggcagttattaccagcagtgatacaagaaagtaggcattcagatcaggtttgtaactaaagcacttacttccttgctgactgacaagtggcaaaaggcatcttcccgatgtgatggaaatattctatactaaaagtggggatagtatttacatttgggtatacatttgtcaaaactcattgtatgtatacttaaaatttatgcttttaactatttgtaaattatacctccaagataaatatatagatggccaggtgtggtggctaatgcctataatgccagcgctttgggaggctgaggtaagacgatcacttgaggccaggcgttcaagaccagcctggacaacgcagcaaaatctcatctccacaagatgagagaaacttaaaaattagccaagtgtggtggcacatgtctgtattcctagctactttggaggctgaagtgggaggatcacttgagtccaagtctgaggccgcagtgggctatgatcacaccaccacactctacccaaggcaaaagagtgagaccatgtctctaaataagtaaaaatttcaaaaaaatgttttttaggccaggtatagtggctcacacctataatcccagcactttgggaagccaaggtgggaggatcccttgaggtcacgaatccaagaccagcctgggcaacataaggagacatggtctctacaaaaaggaaaataaaaagtagctgaacatgttcctacagtcccagctacttgggaagctgaggtaggaagatcccttgagtccaggagggagaggctgcagtaagccctgatcataccattgcactccagcccaggcaaaagagcgaggatattattggtaaggtggcttccagttcctttcacggtggacaccaacatatgatttcaaaaagatggcagataaggaacaaacatcagctaatgaatggacagtgagtgatgccttctagtatcaaatgaaatgtgttagtaatttggaatgtggaatgaaaacttttatgaggcattctcattttgaaaatataattgacataaaaccattaaagatgattaggttcaaccaacaaaaattgttaaaatgagataatgtggaagttgccatattctatgtgaaaaagataaaatgattaccaagacaggacagatagaacgaaataattgccatgagattttattttctcccttaagctaaacagtttttcaacataaataaaaagggcagaaactgtttaagaaacaatttaatgtttgatgctctttttttttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggagcccgccaccgcgcccggctaattttttgtatttttagtagagacggggtttcaccttgttagccaggatggtctcgatctcctgacctcatgatccacccgcctcggcctcccaaagtgctgggattacaggcgtgagccaacgcgcccggccgtttgatgctcttttaattttgctttaaaattcttgtgaacctacaccaagtaagtacatttgagagtaatatataactaagttacaaacactctcaagggtcacagtttgaactctttgtcccatttatttaaggaaagcaaggaaacggatggaacactgaatatttccaaccaaaaactaagtagaaacctagaaatattactcaaaaccccttttctagttttatttataaatgtcactacaaagaagtctgggctacaaaattcttttaattacattttactcgtcttttccagtatcttctccttgccaaaattcccaattttaaacaagcagggtataaacttaaacaagcaggatataagcagggtataacattgaggttacctcatagctatgtgtccataataatgatattcagagtatagggaagaaaacagatatgagaactagcatgcctcaatgagcagtttagattgaaaaacactggatctacaaaagcagacactgtgcactttgtctttctaccaacaaattctagattgtagtctgaagaaaagtaagtatctaaacatcctgtgctaaaaaattatttagcttagaaataagttaaaccctcttcaggaagaagcaggtttcttggtgtgacttgaagttagtgagaggaagccattcccttattaagacatatacaacaatagaaataatgtggaactccaaaaatggtaactattattaccacagtgtgaaaataaactttttttttttgctctgttactcaatctggttaattagctatgcaaagcaaagttattcttgtcaaccctaaatctaaaactataactttaacattgctgggagtagaagaaagagatttctactacagaaaaaacgttcttttaaattctaatatatacggctagactttactgactcaaaagattatgatccaacaaccactaacactaaactctctggtttcaaagctaattagataacttacttttgtgttgatcagtcaacctacctaatatgaggcatactggctttgttctgtaacaatggcagcattcaaaatgaggaatagagaaaaggaaaagaaattcagtaagtactcaatatgaagcttccatgaatatcactgtacttagaaggtttgcttaggcaatgaagtgcaaccaacaatttataacacaattgtattataaaccatgacaatgcacagattgtcaaactagatttttttaaagattcaattatatgctgtctataggagacatattttaaatagactgaaagtaaaacaatgaaaaaagatatatcattcacacagcaaccataagaaagctggagtggctatattaataccaggcaaaacagactttaaaacaaaaaaaaattcctagagatgaaggagaacattttataatagtaagaaagtaaatccactaaaaagctttaacaattttaaacatatatgctcttaacaacagagccacaaaatatgtgaagaaaaaactgacaaaatggaagggaaaaatagatagtttaaaaataatagttggagacttccgtatcccactttcagtaatggagaaaacagccaggaagaagatcaacaaggaaatagaacacttgaacaacactatcaattaacaggaactggccaggcacggtggctcacacctgtaatcccagcactttgggaggctgaggcgggcggatcacaaggtcaggagattgagaccattctggctaacacggtgaaaccctgtctctattaaaaatacaaaaaaattagctgggcatggtggcaggcgcctgtagtcccagttactcgagaggctggggcaggaaaatggcctgaacccgggaggtggagcttgcagtgagccgagatcttaccactgcactccagcctgggcgacagagccagatccaatcaccaaaaaaaaaaaaaaaaaaaaaaaatgaactaacagacatagacgtctatacaacactctagccaacaacagcatacacattcttctcaagtgcacataagacattttcctgaataggacatatatcaggccataaaataagtctcaataaatttaaaacgactgaagtcatacagagtaaattgaaattagaaacatgtaacagaagctaatttgggaaatctgcaaatatatgcaaaataacaacatattcttaggcaattaattaaaaataaaataacaaaagaaattagaaaatactttaagataactgaaaaaagagcaaaatttatgggatatagctaaaacatactaagcatatagctatgaagcctatattaaataagaaaaaggatctcaaatcagtaagtcaaacttctgcattaagactcgagaaaaaaaaagaagaaactaaacctaaagaaagcataaaaaagtgaaataaaaaagactaaaaatttatcaaattaatagaaatagaaaaaaatcagacaaaattaacaaaaccaaaagttgcttttttaagaggagcaacaagattggcaaaacttcagctagactgaccaggaaaaaaacaaaacaagagaccaggtgtggtgactcatgcctgtaatcccagcactttgggaggctgaggcaggtggatcgcctgagctcctaagttcgagaccagactgggcaacatggcgaaatcctgtctctattaagaaaaaacacaagaaattagccagatgtggtggcgtatgtctgtggtcccagctacttgggaggttgacatggcaggatcccttgagcctgggagatagaggttgcagtgagccatgattgtgccactacactccagcctaggagacagagtgagagctcatcgcaaaaaaaaaaaaaaaaaaaaaaaacccacaaaacaaaaacagaacccaccaccaggacaacaacaaaaaacaaaaatgacacgagacttaagttactaaaatcaggaatgaaagatgacgcatcactattgaccatacagaaatagaaaggattagaaggaaatactatgaataattatataccaactaactagataatttgaatgaaatggaaaaatccctagaaagacacaaattattccttccagaaactggctcaagaaaaaaatagaacatcaaatagctatgcataacaagaaacttaattagtaacttaaaaacttcctacaagcccaggttcagatgacttaactaggaaattctaccacacatttgaaaaaaaaaaagtaatactaagtcttcacaaactcttccaaaattcatgagcagagaacatttcccaactcattctaagaggccaatattaccatgataacaacatcagacaaagacatcacaaaaaagaaactacaccctaatacctcttactaatatagatgcaaaaatcaatactagaaagtctaatccagaagcacacaaaaaggactatacgtgatgaccaagtgagagatatcccaggaatataggaatggctcaacatctgaaaatcaattcatgtaatacaccatctcaatagaataaagggcaaactccacatgatcatctaaatagaaatagaaaaagcatttctcaaaatccaggaccctttcatgataaaatacatttgacaaactagtagtagagaatttaatctgaaaaaaagactcagaaaaacactcagctaacattttacatattgatgaaagactgaatgaattccccctaagaaaagtaaaaaaggcaaggaagaccactctcaccatttgcatttaacattgtaccggaagctctagccagggaaattatgcaagaaaatgaagtaatatacatctaggttggagagaaaaatataaaactatccctccatggagatgatatgatcctgttggatatcaaaaaagcctaaagaatacactgaaaacctattagatctaataagccagttcagaaaggttgcattatacaagatcaatatacaaaaatcaattgtatttctataaacttgaagagtccaaaaatgaaattgtattgtaattccatttacaataccatcaaaaagaataaaatactttgaaataaatttaacaaaagattgtaaaacttatacaatgaaaactacaggccaggcacggtggctcaggcctgtaatatgagcactttgggaggccaaggtggcaggatcgcttcagtccaggagtttaagaccagcctgggcaacatactgggatcctatctctacaattaaatttttttttttttaattagctggatgtggtggcatgggcctgtatttccagctatttggaaggacaaggcgggagaatcgctggagcctgggagttcaaggttgcaatgaaccatgatcatgtcactgaactccagcctaagtgacagagtaagaccttgtctcaaaaccaaaaagaaaaatactagaaaactacaaaatattgttggaaaaaaaaaacaaagaaaaactaaataaatgaaaaggcatctcatgtttgtggattagatcacttaagatgaaaatgctcttcaaatttatctatgaatttaactcaatctgtataaaaatcccagctattctgccaggcgcgatggctcacacctgtaatcccagcactttggggggctgaggtgggtggatcacgaggtcaggagaacgagaccatcctggctaacatggtgaaaccccatatctactaaaaatacagaaaatcagccaggcgtggtggcgggcgcctgtagtcccagctactcaggaggctgaggcaggagaatggcgtgaacccaggaggcggagcttgcagtgagccgagatcgtgccactgcactccagcctgggcaacagagcaagactcgtctcaaaaaaaaaaaaaaaaaaaaaaaaaatcccagctaccattttcctagaaatttagaaacttttcctaaaattcatacgggaaatgaaagcaacccagaaaagccaaaactatcctgagaaacaacaaaatcgaaggattcacaccttccaatttcaaaacttacaaggatatagtaataaagtggtactagtgtaaggacagacatatagatcaagtgaataaaattgagagactgtaaataatcctttacatttatggtcaatttatatatatatatatatatataaaaacaaaagtgccaagataattcaatggggggaaaatcatcttcaacaagtagccctggagcagctgggttatctacctacggaagaatgaagttagatttcttcctcacaccgcacacaaaagttaactccaaatagattgtagacctaaatataaggaactaaaactataaaactcttagtagaaaacataggtgtaaaatttgtaaccatcagttgggcaatggtttcttagctgtgagaccaaaagcacatagtacaaaagaaatgaatactattatgggattcatcaaaattaaaaaccttcattcctcaaaggatactatcaagaaaaagaaaagacaccctcacagatggagaaaaaatatttgcaaattatatacctgataagaaacctgtatatagaatatataaagaactgctgtaacttgacagcttttttttcaaaaactgaatttttggccaggcacagtggctcacacctgtaatcccagcactttgggaggctgacgccggtggattacttgagaccaggagttcgagacaagcctggtcaacatggtgaaaccccttctctactagaaaactacaaaaattagccaggcgtggtggtgggtgtctgtaatcccagctactcgggaggctgaggcaggagaatcacttggacccgggagaggaaggttatagtgagccgagagtgtgccactacactccagcctgggtgacagagcgaaactcttttcttcgaagaggatatacaaatgcccaacacgcacattaaaaaaaaaatgctcaggccgggcacggtggctcacgcctgcaatcccagcactttgtaggggcggggggcggggtggggggggttgcggatcacctgcggtcaggaattcgagaccagcctggccaacacggcaaaacctcgtctctactaaaaatacaaaaattagccggatggggctggcgggtgcctgtaattccagctactccggagactgaggcaggagaattgcttgaactggagaggtggaggttgcagtgagctgagattgcaccactgcactccagcctgggcaacagagactccgtctcaaaaaaaaaaaaaaaagaaaaaaagctccatatgcttagtcatcagggaaaatcaaatcaaaatcatcacgatatactacttcacggtcattagtatggcctatattaaaaaaaggttaaagaaaaagaagtgttgtcaaggatgtggggtaagtggaaccattataaattgctggtgaggaagtcaaatggtacacctgctttggaaaaaagtctggcagttcttcaagaagttaaacatagagttaccacataacctggcaattctactcctatgtctatacccaagagaaaaaaaaaaccatacatgtacacaaaaactttcagatgaatttcacagtagcattattcataatagccaaaaggtagaaaccattcaaatgcactgaatggataaataaaatgtaatatatccatagaatgaaatattatgcagcaattaaaaggaagtactaacacgtgctacaacatggatgaatcttgaaaactttatgctaagtgaagactacatgttgtatgattctattcatatgaaatgcccagaataggcaaatctatagaaataaaaagtagattattagttgcctagtggtgaggtggggtgacatggggagtgactgctaatggatatggttggtgaggcttctttctgtgatgatgaaagtattctaaagtagattctggtgatggctagacaattctgtgaatatattaaaaaaccattgaattgtgcactttaaaaaattttttgagacagagtcttgctctgttacccaggctagagtgcagtagcacaatcttggctcactgtagcctcgaccaccttggctcaagcgatcctcctatctcagcctcctaagtagctggaactataggcgcacatcaccacacctggctaatttttgtattttttgtagagataagattttgccatgttgcccaggctggtcttaaactcctgggctcaagtgatccacccaccacagcctcccaaagtgctgggattataggtgtgggccactgcgccagccatgagttgtgccctttaaatgaatggtgtatggcataggaattttatctcaataaagcccttaaaacaacaacactaacaacgagatgaggcaagaggcagggccagcacccaaagggaccagtcagaaatggttgcttcagttagaaatgtaactgaagagtaatatttctaaaacaattgaaagctgctagagatttaacctgtgaaggacacgatcagacaattttgtataaaataaagattactgtaatatcaatgtggataatagattaggggtaaaatcatgagaatggagaaaggaaaggcattaggaaattgcttaagtaatcccaggatgcctgaactaaagcagtaacagatgtgatggaaaagacaggacaaacttggaagatattaagagtcaagaattaatgggatgcagcaaatagtggaggaaaaaagaaggggaaagggaggaatcatggatcctatttctgaggactccacttgggcatcaccttctcctaaacttttcttcaatccacaatttgagtttaatgtccttttttgtgttacaaatacacacagtgcatacctttatcattgtatttactacattctaatgtagtgtaattgtctgttcatgtgtctgtctcccccattagtctctacgattgagggtaaggactttatttcataatgtctttgtagctctgtaccccctccagagtttagtgcctggcaaagaaggtgtcaccaaccaggacagagaatacaagggaaacagattagttttggaaaagggacatgctgaggaaagataatgatgtcagtttttcctatatgcctacaacacatctaaacacaaaattgtcagatgaaagctggttctatgaagttggagatcaaaagggagtttcagaatagagttagtaagcatcgtgatataggaggaacaggcagtaactaaaaccttgtgtatgtggaccagattgcttacaagaagcataagatagaagtaaagccagagaaagacaaaattctggaaaattcctacatataagagataggcaaagtaattggaactcacaaaacaattctgaggattgcaaaggaagaaagaaaaatcacaggaataatatcaaggaggaagttaggaaggacaaaaaagtatatactggatttgggaaaagtcacgtgatttttgcaaaagcagtttcagtggagaaaggttgggggtggggggaattcgacctatagctgagcaagagccagtgagagatgaggaagtgaaaatagtgagagttaggaagcttgactttgaggtgaagaagaatgctggggatagtaatggtggctcagagtcaaaggcaaattttgtattattttgtttttattttttaactgagaagtctcaatcacgcatatatcctgagaagaataaatcaatacagaggctaatggggaaaagtgatcaacagataatgtcagtcactgagaagacagaaggggatgaaagcgaagctttaacaggagacaggaaaagaaggatagttatgggtaacatttctaaatattgaggagcgataagggtgcctagcaggagcaaagggagttccctccagattgcccctactttcttggtgaagtaagaggtaagccatcttgtaaaagctaacaggaaaatagtaagaagcactggaggctgggtgtggtggcacatatctgtaatcccatgcaatcccagcattttgggaggctgaggcaggtggactgtttgaatccaggagttcaatatcagcctaggcaatatggcgaaacactatctctaaaaaaaaaaaaaaaaaaaaaaggctgggcacagtggctcacacccgtaatcccagcactttggaaggccaaggtgggtgggtcacctgaggttgggagttcaagaccagcctgaccaacatggagaaacccatctctactaaaaatacaaaagtagtcgggtatgggtgtggtggtgcaggcctgtaatcccatctactcgggcagctaaggcaggagaatcgcttgaacccgggaggcagaatttgtggtgagctgagatcacgccattgcactccagcttagacaacaagagcaaaactctgtctcaaaaaaaaaaaaaaaaaaaagaaaagaaagaaagaaagaaagaaaaattagccaggcattgtggcatacacctgtagtcccagctacttgggaagctgagggtaggaaaatcacctgagccaggaaggttgaggcagcagtgagccatgatcaagccactgcactccagcctgggtgaaaagtgagaccttgtctcaaaaaaaaaaaaaataaataaaaataaaaagaatgaatgaaagaaagaagtcctggagctagtgaaaaaggtttgaaataactgccacacagtattggggtccaaatgaggttgaaatccaaaagtataaactaagtagcagtcatcaccataatgtaatatttctctccagcaacaggggttaaaagagtaaaagttggggccgggcacggtggctaatgcctgtaatcccagcactttgggaggccaaggtgggcggatcacaaggtcaggagatcaagaccatcctggctaacgtggtctctactaaaaatacaaaaaattagccaggcgtggtggcaagcacctgtagtcccagctactcaggaggctgaggcagaaggatggcatgaacccaggaggcgaagcttgcaatgagctgagatcacgccactgcactccagtctgggcgacagagagagaccctgtctccaaaaaaaaaaaaaaaaaaaaagagtaaaagttaatcaaaacggaagtgaagaagaaagaactgaattacatatatgccaaaattcattgagttacattcttgagatttgtttgcttgtttataagttatatcataacataaatgttagtattttaaagaactttactatatgtctcatttccagtactcaaccttaaacctcccaaatcaaaaggcaaaaaaacacctctagaacaacttctatttaaaaacaggtttttaaaaagtcacaaaaagcctaaaactgaagccaaataaacaaaaacctaggaaaagaccctctctcccctcaaatgcatattttcattctagagtaaattatagaccaccaactatagcctgacttggatatcaagcacgggttcccacatgaaaattgttattgttggctttagtgcttcaatctaaagaggacacaaattctgctcatgtttgaataacgcttgccaacaaattgatgccacagcaccagggctgcaaaaagtacatttaaagattgaagagaaacataaaggggaaaaactcggtaaatgtatttcctcctactcagaatctaagatagatccctttaaagagaaaaaaggtttttctctttcctctttttccaaaagcagtccaaaagggcattagagaacatctgtaatttacacaaaagggagcaatgccaaagaaactcagattccacagctgttaacccaagggacaactcaaaccaggcaaatctctaaataaggtctgaaaggcagacgctctgctagagggcagctaacttccaaaaccaggagtttggagtgggcacttgaaatactaatgtgtgcctttctagaaagctgccttttgcctttatatgggcaagtgagaacaattcataattcctttactaattaagatatactcaaagaagcctaggcattttgcctggtcaccacctactattaatatatgaacataaagaaatttccttgttattttaatgtttatcttcttcatctacccaatattaacatgttggttaacaataccaccagagagtaaaagctcccaactatacagcaccaaaagttaacaaactttcagaaactgtctaatagaataggttacagaaccaggttccctggattcaagtcctacttctccactttttgggttgccttggacaaactcctttacatttataggcctcagttttctcatctgtaaaatggagataatcttatctactcatagggttgtgaggattagacaatcaatgaatatagacatgtacaaacactccaaatacattgtaaatgcccttaaagtcttagtgtctattattaagtctctgccttatcaatctgcagcaagctcatctctttactatgagttctaaaatttgcatggcacgcagtgctaaattatgtggtttataccctgtgaacgccttatagtcaaaaaagggtctcaaactgtggcatgttgaatttgttggcctatttaccaacaaacagctaacatatgttaatgactcattgtaaaaatagatacattcagacttatgatttgaagattaaaggctcaatataccaactccatttcccttgactagtagtcctcttctgcatgatatatgtgtttactgtaataactgactaactgcctttgcggaaactgtcaatactctgcatgcacagcatctggaaggattaagcaaaacactagggaattaaaagacataatgaagtgaaaattaagaaggaatggagagaaggatgtgttctaaatccataggaaatagtcttagtaagctttcatatttttctctgttttttgttagattaatattagagagttctgtccctttaactgtcaaatggttttccatcttgcaagtaatctttctccaccaaggagtcttttaaaagttataaataaaataccccaaatattttctttttcccacagatgagaacattagaacactgacatttttatctgttctttacaagagtgagttgtgtcaacacagtgctcccagctacaacactgaaaaaaataagtttaattaaagacagagaagaaactgcatgtggagcctaagccactgagatacaaccaagagttgtcaccttcagagtcagttctctatgaacaaatctctttgtcagtgtcagaagaagaagagagagaaagcaaagcaaaagtgtgatgctataaagataaaacatggtgaggtcaaatgtcagtgttcagactaggaactaaaaaatagttatttatgtagtacttccagagtccaaacactatgcctaacatcataaaacatctttggctataaatagatgcctattaaccacatatatgttgtagaagatacagttgaagcacaaagagaaggccatgatcaccaggtaatgtttagcaacaatgaacattgcttttaccgggtttatttcagaatactggctatgctccctcctcaaacactaatttgaagggcaaattaacattgtcacaaaactattttcccaaattaagcacagctctaactacattctagcaatagcttgctttacttgccctgcccttttgtaaggacatcctattgtcagagaggcagtacagcacaatgaatagaaaacaggagagacatgacaaagttctaactttggctctgccatttcctagcttagtaactcttgggcaagttacttaatctatttgagataatttttgctcatgtataaaatagaaataaaagtaactactcaagagtgttattgcaaggcttcgatgagataatgcatgtgaaatacccagttcacttcttggctcatatagtagatgatccacaaataatattctcactatcttttgttttttataatactgaccatttgttgattgtgtattatcatgccctctagatcgtatgtttcttaggactacaacttctttcactcctataaaatagcctatctcagcttagagggaatgtatagtattaagtattaatacctcctggtctgctcacccatatataaattattttgtcacagcacagtgtaacagaatggttatcagcatgagctgatatatcaagattgcttgtactaactgattacatttcaatcatggcactgatacttaatagctatgtaacttttggcaagttacttatctatgcctcagtttgtgagatggaaatataataatactttagactcacagggctattatgaagattatatacacaaaacatatgtaaagctatttaaataatacctggtccaagtatgagttcaaaagacatttgttattacctgataatatatctgcacaatgaatactattttatatttattgtataagtattaaatatttctcagaatttatgtgataaagttgttaggagaagaagcagggtaaatactttggtaagtagtaataaacatgataggaacaacaggtacataagggaaaaaatgataaattcaagatagaaagtaatgaaataagaacaagaaacaatgctttatagagggcaataaactaaatgttagtggtataatgaaatgaaaaagaatacaacatataaaactaccgtattttaactgtagcagatgatgatgaaggaagtgcaggttattcagaacaaagacaggagcaaaggtaggagaggagtacagaaggcctatttggaggccattatacatctgtctgcctggaagtgagggttcctatagaacctcttaattccttagtcctcttaattccctccccctagaacttataaggcacacaataggtgctcattaaatatctatgtaaaagacagaatgaattcccatcacaattagttttaaatgctaaacagaccttcccaatgggcataccaaggcatattagtgtgcctaaattgggtgacaggtgtactgagatagtgatctcgtcagcccttgaggtccaaacctctagccataaggttgttgtcctgctaccccagtgtgccacacaaatatcatcattgtctaagtgtatcatgccataaaaagttgggaagcaatgggttaaacaataaggctattatgcaatatgcaatggaacagatacaaagaggagtaaataggagaggatataatgtacagtagtctttgcctatgtgggtggcactgtggaagatcaatcaaagagtttattagtccatttgcacactgccaatgaagacatacccgagaatgagcaatttacaaaagaaaggtttaatggacttacatttccacatgactgggaaggccttacaaccatggcggaaggtaaaaggcatgtctcacatggtggcagacaagagaagagagattgttcggggaaactattttttaaaactatcagatcttgtgagactcatttgccatcacgagaacagcacaagaaaggccagtccccatgattcaaccacctcccactgggtccctcccacaacccatgggaattcaaaatgagatctgggtggggacacagctaaaccatatcaaagaaggaaaagacaaggtacagaaagaacagcagttcaaaagctgctgcaataagctaggcaagaaaactaagagtaacaaaagagatgaattcaaaacaggttgtgaaagaataactgcttagaacttagtttagttcagttccataaacattcattgttgcctattatgtgtctgctgtttgctgggcattaaggattttaaaaattgaagaaaaattccagttattaggaattttttaattgtagaaacagaattacaggttttccttaatgtattctcttgcacattagctcttagaagaaagggagtattaaaaggtgttacatattgcaccataaaccaaacgtagttttaacctactcattaaagcttcaaaaaataagcctttgggtaagaaggctcaatgtcagcagccagagggttatgaagagaattctgtagaatattcccctaaacacaatagctgcaccaatatttcttaatatatttatatctgatcaagagttagaatgcatgccattggcaaactccacttttagcctttaagggataacaacaattatcatttattaggtgctcattatacataaggcattgtgctactttacatatataatctcactttatcctcaaagaaaccttgaaatgtaggtatcagtcccattttgcccatgaaaaaaaacaaggcttagaatattaagtcacctgtctaaagatatccagctagtaaaatggcagagccagaattcaaacctagatccatccaactcttaagtctgtgtttttattaaatgtgttttaacagataagttacttaagaaagggctttgggaaaggcacctgagacatagagaaaagacagccaccgaagcaaacataggaaaggctcactcacgcactgttctaagaggctgtgcttgcctgagactcaccaactggattcacgcaggaagaaatctaggtgtattcatctgttttctactgctgctgtaacaaatttacacaaatttagtgacttaaaacaatatacatttattatcttacagtgttttgtctcagaagtctgaaaggagtcagtcttactgaactgagatcaaggtgtcacagtgctgcattcctttctgaaggggctagaggacaatctacttccttcccttttccagcttccagaggtcaccagcattccctggctcatggctccttcctgtcttcaaagccagcaataatcagttgagtccttctcaggctgatgcttctctggttcttccatagtttcatctcgttttcatcacaaaaaggttctctaattgtaaggacccatgtgattagattaggcctacccagataacccatcataatctccccatctaaagatccctgactaaatcacatctacaaaattcttcttgctatataatcagattatggggattaggacacgaaggttgttagaggggtcattattctgcctatcacggtctgattgtaagagagtagaacctttcactgtttgaaccacataactagccccctgttctggttccacatgtacaggacaatttactgataatattttggcttaccctatggcttacttaaaagaagggaatgtgctgtttagaggatatagtgtttaatcccctgggcaaatacattttatattatattgaataatttgttttctgagttatacattagtgtcttgtgagtgctgtcagaatgagtcagaatcttttagtccaaaaactataagactcagacaatcaatattcagaatcttttttttttttttttttttttttgagacggagtctcgctctgtcgcccgggctggagtgcagtggcgggatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctcagaatctttaagttaaggatcggagtcagggatgagggagggggcatatttaacaagtctgtatctatgataaaaaacaaccttttgaagagcatgtttaagaagctatatataattatatatatctaagaatgcagctatgtgtcactccctttgatttacaagactgctctcaacaaagagagtagtcagttttctgattgtgcctgtgtaatcaatcaaatggtttgaagtagaatgtccttggaagacagcagggaatttcaaatcaacaacttttaaaacttggatcacatggattagtggtcgcctagagctggagctttttagggagaataaagagtgactgctaatgagtttagggtttctttttggggtaatacatttttaaaaaaattgactgtggtgatgattgcacaactctgtgaacagacaaaaaaaatcactgcattatatgtttttaatgggtgaattgtatggtatgtgaattacatctcaatgaaaatttgtaaaagaaattgcgtcacggccaggcacagtggttcacacctgtaatcccagcactttggcaggcagaggcaggtggatcatgaggtcagtagatcgagatcatcctggctaacacggtgaaaccccatctctaataaaaatacaaaaaattagctgggcgtggtggcacgcgcctgtaatcccagatactcggaggctgaggcaggagaataacttgaacctgggaggcggaggttgcagtgagctgagatcgcgccactgcactccagtttgggcgacagagcgagactccatctcaaaataaaaaaaaaaagaagaaattgggtcacaaagatgacaatgagaagaggtacctgagaaaaacaagggggtttatgcaatttatgatcttagtgaagatcccttaatgtctactactgtcctccttgtttttctatctaccttaactttttacacattctgttcttggaaaagtcacagttttccaccccttttgtttcttactttactcatcaactaatatacaacaaacatattccaattataaatatagaatgtcattctgatgttaacttccaaggtccttactagagaaaaagtataaataaggaaaacattcccatcctgatcctgttttagagcctaattttttttacccttgttctgcattgtttgcagattctctatatgtcctaaatcaatccacgcaccacaagagctgtatcagattcatgccttcttgaatctagattctcacattaaagtcaaagaactggtatctacttgcaatgaggaaacttcacatgttagtagacaagctccatttgctctattttatagcaataactattagaatgctcaatagtgaattcactaatctgtgcaatgctattgaatgacttctgtttgtacttctttgtacctacatcttctttcccaagggcaatgacagcccccctttttcataggaaagcaaaaaccggctttcaaaggtaggcagttttgcttacaaatgtcaggaaatgttttgcttgagccattcttatagttgatataaaaataatcacctatataacccccaaatgtctccctgaataatcaagccatttcaagagaaaactttcttaaaactgatatagtaaagcagtttaattagattaataagataccataaacagggtttccttcgactttgagatggaacacttacctcacacgaattcagacaaaatagtctagttacttttctacatgagaattataaatataagagatcactctccatattggaataacagaaataagtgaagttgcaaccctgatccttgggtaaaactgtgcttatacactagatggtctactgaaccacaaatctagcatactctgttatatactttcatgcataacaatttattcccatttcatggtatgcctagttgtataggcagaaagaagggtgacggccccagaaaagattagtgtacataatcgacactgtagaaagcagttttatataatttagttactcttaaatatgaatatacaactgactttgtagaacaaacatatcataaattcattgtctgatgcaaaactagttttgtcaaatagttcataatattcattttaccaggtttctgcaaaaaccaattattgcagttgaaactaaaaacctttgaatgttaggttacaaaatagcttacaaagcaatttatagtgtatttataagtttgtgttgttactgttgtcgttgttgttttaatgcatgcaggcactaaagcccatattccagggatcctttcagaccactgaacgctgaattttccaagcaagcaggtgtaactcattagatctgccatggaccgtgaaagccacttgccaatagtgtcgaaagcatatcactcatttcaatctcaccaaaaaggacagacctttctctgacaaaacattactgaaaaacactgagtttggggctgtgacttgaacagctcagcacacatggatggaaactcaacagagaagctaaagccaagtggaagtgtcagattgacgttctagctttacaccttcagagagcacagcttccacctggatttcaagaagaaggggtgaaaagaagaaaaccaaacacctagcaataacaatgatcttggcagcatgcacgataattgcaccatctgacctggcagaactgtcagtatgaatggcaaactatctgcatatgattgagttttgtaatcccagaagctcaaaacagagaaacttaaggagccagtcaaatcagctttgaatgtcagtcactgtacaagcaatgtagttaatcagaaaaatcaggatagcactcagaaaacagtctaggtcttttttcagcaatcacaaagccaattaatgaaatactagacatttaaaattctgtagaattaaattgaatagtagtatgccatagttagtatgccaaagatgaaaataatataactacctggatattttgcataaatactaagtagtcttgctcttcacatagtttttaaatctaaattacataatactcaactaaaatttagctaggtggatagagcccgatgtttagtttagatgcaaggactaagagaaagagtagcagttatgttttgtttcttgatcaaggtgctagttacataggtatctttaggttataaaaattcatcaaactgtacacttacaatatgtgaatctttgtcatcaaaaaagctttgtgatcaagaaacatcatgtcctctagtcaactgccccaagaacttagtctccaagaaaagctatacttcagattcccatttgatcaagtttcacacttgtttttcagctttccaagctaaactgtttaaggatagattccagttagacatactagagcaatggaacatgtttcactacatttaggtctattatttcgtaatggagtttctaataatattccaatgacttaggagaggttttttgggtttgtgtatgtgcgtgtgtgtgtgtgtttagagacaaggtcttattctgtcacccagctggaatgcaattgtaaaatcgtagctcactgcagcctcaaatccctggactcaagcaatcctcctgcctgaagagcaaggactacaggtgtgtgctaccatgcctggctaatttttttgaatattctttgcagaaacaggatatggctggtcttgaattcctgggctcaatcaatcctcctgccttggactcccaaagtgctgcgattacaagtgtgagccaccaggcccagccaagaaagtagtttttaaatagccctgataatgatttgttcctgaaaagatctaccaaaccacaactcatgcatatcatagtcacaaagtagtttgtgaaaaatacataagactgagtataatacttcaataataaagaacagtcaaaatgtttgatactgatgacagaggcagaacaagagacatatacacttgccaaaagtatataagaaagatcatgatagaaaaaagaatcaactccaatttttcaatgcactgttaaaatatacatctttctccaaggtcacttttagagtttaagagatacaaaagtcttaaagctacagttagttacccaaaattctttttttttttgggcggggggcggtgggggcggtgcagaatctcgctctgtcgcccaggctggagtgcagtggcgctatctcggctcactgcaacttccgcctcccgggttcaagcgattttcctgccttagcttcccaagtagctgggattacaggcgtgtgccaccacacgcagccaattttttatttttaatagagatggggtttcacatgttggccaggccggtctaaaactcctcaagtgatccgcctgcctcagccacccaaagtgctgggattacaggcgtgagtcaccacgcccagcaactacccaaaattccatgataggttactatttctataaggttgagtcgttgtattaagtcaaaattctcagcatctgcttagtctactgcatacacaactaggggccataaagaaatcctttcatttttataggccaagtgttgtactacatggaattaatggcgcaagagaaaaaaaaaaagtatttttattatcacatattcacatgtgcaattttttacataccacaagaatctcaaaattatgatagcatataaggctgaaacaaatagtagctggctacatttctttttctttttcttttttttttttttttgagatggagttttgctcttgttgcccaggctggagtgcaatggtgcgatctcagctcaccgcaatccctgcctcctgggttcaaatgattctcccgcctcagcctcctggaaagctgggattataggcatgcatcaccacgcccggctaattttgtatttttagtagagatgggtttctccatgttggtcaggctggtctcgaactcccgacctcaggtgatctgtctgcctcagcctcccaaagtgctgggattacaggcctgagccaccgtatacagcggctacatttctttaaaaaaaaaaaatcatagtcactccttgtagtcactcatttaactactttaggttctaggagcctaaattatccaaaaaggcaaaccctgactccaactgaacatccaaaagacacgaagttatcttgttggttggtatttgtttttattagcaatacggcaacaattttacttctgattccatgaaaggagcattcacaaacatgaatcaaaaatgaacatatatataacctactctagcttaaaattaacatagtaggtcaaaattctaagaaaaatgattaaatttagtcttaacatttgactaagataaattttaagtgactaatattaatgactgtgcaatgctcagtgttcccacaagctataccttttaaaaaatattttttagcaaataggcagcatggagttattagcccaaagttcaccttagttctcctctaacattaaccagggtttcaatggaatactccacacataaatttaaattagtagactaatatttctaaataaccgaaagttgaattaactattagttgaatcatataaaattccatttctatgggtcaaaaacagtcaaatcttgataatttcatgtggcttagcctaaaaatagtttttaaacagttccaattctatggtagaaagaagcaaatagcaaaaaaataaaaaaaataaataaaaacatgatgtgaaaatacatgttagaaaatgcttccaactaaatgctaaggtataaagagaaatagaaatagtgggcttcagaagaaggggtaaaaatcaggtagttcaacaggttcctagtagtaatcaataaaatgacttctgcttcaccttttaggaggaggctatacttagcaaatcactgtgtaagctgcctcaataacagcattcctgctatcaagtttacttgcaatgattccaacaaagaaattaatttcttagatgacaagaaaaggttatctgaaatggggaaaacacaggagactaaagctgtctgttaataaaacagacaagcatcagtctaggcaatgaattcagagcagttttactctctgcaagatctgacttcccatagcccactattatacatacatacacacgcccacatatatacatgtatcagtgtatatatgcatacatacttgtgctggtttactcagaactttcctagttttagcactgaaagttccatgatccagaaattcaagcctgggcaaactgagacagtcaccctaatctacagctaccaacagatgcatgaacatgtgtatgtgcacacacacacaaacacacacacacacactctctcccttacccattcacatccccaactctaaagaatgtttttctaggccgggcgcagtggctcacgcctgtaatccctgcactttgggaggctgaggcaggcggatcacgaggtcagaagatcgagaccatcctggctaacatggtgaaacgccatcgccactaaacatacaaaaaattagctgggcatggtggcaggcgcctgcagtcccagctactcgggaggctgagacaggagaatagcgtgaacccaggaggcggagcttgcagtgagccaagatggcaccactgcactccagcccgggcgacagagccagactcagtctcaaaaaaataaaataaaataaaaaaggaatgcttctctaaaacttaaaatgcatttactcactcttcagaaaacatgtggtgttgtaaaattttccaaaagctattatttatgaccatatcattaatatatgtaactggcagtgatcaaatctgagaacttacaaactgccattttggacaagtcatcagatgcactccttcctaaagtctcatgtttaaatcatattcacctcactaagtgttatcagaggaacctgtgacaattattctatttgtaaatatgaggaaaatctctgaggtattctcagcttaccacttatcaagaatgtaaccttgagataaattacttagcctcattaattttctatttaccagtatgtaaaatggggataatagtacctacctcagtgttttcatgagtattgaatgacacaatgtacataaaatgcttagtacaatacagtagcacaaaattaattcccaataaatattattactattgctaatagtattgctgtacagataaaaacttacaagtactttgaaggtggcagttgcctattcctgtattctttggtggaaatgttttcttttaaaaatggttttctccttttataatttttagacttccagagttattctgactgtaaaaactatgagacttttgagtagtttaaaagacagagtgttggctgggcacggtggctcatgtctgtaatcctagcaggcaggctgggaagctgaggcgggaggatcgcttgaggccaggagttaaagaccagtatgagcaacacagcaagaccacctctctacaaaaaactgtaaaatgaaccaggcatggtggtgcacacctgtagtcctagctacttgagaggctgaggtagttggatcaaactggtaagccatgatcttgccactgcaccctagcctgagtgacagggtgagactctcagaaagaagaaaggaaggaaggaaggaaggaaggaaggaaggaaggaaagggaaggagggaagaaggggaagagccgggggaggggtacggggagagggagggaaagagcatccttgtaataaaattacttcttgatgtggaatttcttcccattattgaatttcaacgttagatgtaatagtgcaagtagagagcttcttgtcccctaacattaataaaaaatagcatttaatggcctgaattacaggtgataaaattttatccatactaaaataataggtgtaaacattaaatcaaaatatagtcaaattggattttagagtttgcagaaacctttaaaatcacctagtccaaaaccctcattttataaataagacctctcagaggtgatttgtccaatgtcatatggccagaatcagagacagtaaaagtatccaactctcctgacacctagtccaattatcttttcagtatgctactcttcaaatcattaaacaaaaatcatgaggcaaattcttattctaatattcctaataaaagccatgtttgaatacaacaaaaaataattaagagaagggcgtgtaacgagaaggctgaaggaaaaatgagtacaacatagtagaagataccctttgaagtcaaacaggcttgtttcaaatgccagctctgccattcctttactgtgtatcaatgggcaaagtatgaactctgagcttcaggtcccttatttgttaaaaaggggataatactacctagaacaattacataagattaaaaaaagagttagaagagcacaactgttgagagtcagactatctgtttgaatcccaactccacaacttactcattgtttgatcaagttttatgatttctctgagccataggaagtattttagcagagaacatggcacataactgtaacatgttttagtgttatcaacatatataaatcatctgacacttaatgataataaaaacacaaccaccatcaccagcaacacaaaaaatacctgcttcataagtaaaagtagaccagactgataaagccaacatgctaaataaaatcaatgctaatctatcctaaaatatgtccataccctgaaatgtgtgaaaagttcattagagtgggattaaaatcagattcaaaaagtacaatattatctatctagtaaataatcactttgtagtgacacatgtaagaaatggttttcaagatattgaattttaaaatgctcagtttcacaaaagataaaaagtcagaagttaggtaacagtagaaggcttacaaagtatgaaaaaagctaaaacagggggaggagccaagatggccgaataggaacagctccggtctacagctcccagcgtgagcgacgcagaagacgggtgattgctgcatttccatctgaggtaccgggttcatctcactagggagtgccagacagtgggcgcaggccagtgggtgcgcgcaccgtgcgcaagccgaagcagggcgaggcattgcctcacctgggaagcgcaaggggtcagggagttccctttccgagtcaaagaaaggggtgacggacgtacctggaaaagcgggtcactcccacccgaatattgcgcttttcagaccggcttaaaaaacggtgcaccacgagactatatcccacacctggcttggagggtcctacgcccacagaatctcgctgattgctagcacagcagtctgagatcaaactgcaagtcggcagcgaggctgggggaggggcgcccgccattgcccaggcttgcttaggtaaacaaagcagctgggaagctcaaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcagggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaagccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaggaaggcttcagacgatcaaattactctgagctacgggaggacattcaaaccaaaggcaaagaagttgaaaactttgaaaagaatttagaagaatgtataactagaataaccaatacagagaagtgcttaaaggagctgatggagctgaaaaccaaggctcaagaactacgtgaagaatgcagaagcctcaggagccaatgcgatcaactggaagaaagggtatcagcgatggaagatgaaatgaatgaaatgaagcaagaagggaagtttagagaaaaaagaataaaaagaaatgagcaaagcctccaagaaatatgggactatgtgaaaagaccaaatctacctctgatgggtgtacctgaaagtgatgcggagaatggaaccaagttggaaaacactctgcaggatattatccaggagaacttccccaatctagcaagggaggccaatgctcacattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgagcaaaatcaccagctaacatcataatgacaggatcaaattcacacataacaatattaactttaaatgtaaatggactaaattctgcaattaaaagacacagactggcaagttggataaagagtcaagacccatcagtgtgctgtattcaggaaacccatctcacgtgtagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacacaatacaggagcacccagattcataaagcaagtactgagtgacctacaaagagacttagactcccacacattaataatgggagaccttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatccctgggacacattcaaagcagtgtgtagagggaaatttatagcactaaatgcccacaagagaaagcaggaaagatccaaaattgacaccctaacatcacaattaaaagaactagaaaagtaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaaaaaatggatacattcctcgacacatacaccctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgccaaaatcctcaataaaatactggcaaaccgaatccaacagcacatcaaaaagcttatccaccatgatcaagtgggcttcatcactgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatggtctcagcccaaaatctccttaagctgataagcaacttcagtaaagtctcaggatacaaaatcaatgtacaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgcatacctacaactatctgatctttgacaaacctgaaaaaaacaagcaatggggaaaggattccctatttaataaatggtgctgggaaaactggctagccatatgtagaaagctgaaactggatcccttccttacaccttatacaaaaattaattcaaggtggattaaagacttaaatgttagacctaaaaccataaaaaccctagaagaaaacctgggcattaccattcaggacataggcgtgggcaaggacttcacgtccaaaacaccaaaagcaatggcaaccaaagccaaaattgacaaatgggatctaattaaactaaagagcttctgcacagcaaaagaaactaccatcagagtgaacaggtgacctacaacatgggagaaaattttcacaacctactcatctgacaaagggctaatatccagaatctacaatgaactcaaacaaatttacaagagaaaaacaaacaaccccatcaaaaagtgggcgagggacatgaacagacacttctcaaaagaagacatttatgcagccaaaaaacacatgaaaaaatgctcatcatcactggccatcagagaaatgtaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgcaagaacaaaaaaccaaacaccgcatattctcactcataggtgggaattgaacaatgagatcacatggacacaggaaggggaatatcacactctggggactgtcgtggggagggaggagggtggagggatagcattgggagatatacctaatgctagatgacgagttagtgggtgcagcgcaccagcatggcacatgtatacatatgtaactaacctgcatattgtgcacatgtaccctaaaacttaaagtataattaaaaaataataataatactaataataaataaataaataaataaatatgtaaaaaaaaaaagaaaaaagctaaaacaacagcaatgatagataagaaaatttgtaaaagaccagctgcgtatagaagaaacatgaaagaatgtgtctattatgacgtggttttcatcaactcctaatcaaaaatataataaaagaaaaagaaacagtaccacatccagcatgtcaccatttaagacaaccaattcccagatgactagaaaaaatgtatctctgaactgggtggaaaggcataattcttaaatccagagggaaattaaaccacaaagtttaaacaaaacagcacgaaaaaatcaataactcacaaaataaaaaataataatttagttttcagctttctctttttaaaaaattctattttcagatcaccaacagtggtttaagatgctaccaagtctttaagctctatttggtagggaaatacctctgctatttctaaaggtaaatagggggttttgcatttaatttacaatatggaatactgcagaataacctcatgccaaaatggcacatttctgagggatgcaaaggtattcaataaaaagcttttaaaggcatatttttaaacttgcagcaggaaagcttttctgtgtcaagacagtaattcttttaacagcattgatcaaaatgtcattcttttatgagtgtacaataccttttaatggcatacaacaagccattagggttatacacctctgtatagcagacagcttactggaaaaaagcgaacactggccaagacagagtcagtaggttttatgcttctaataaggaacatttttccccctagctgattcattctaaagtccacaactgaaattatccaaagattaagtgtaagctctcttcacttcggtaatttagaagcactttcacagaggcttaaactgcaaggtctaaactctacctttgtggataccataagatggccttgaaaacagcctctcacccagggccagtaagaaattattcatgaagattaggaaagaaatgacggttttagtaccttttctactttctgaggaaagaagaaagtgaattgaaaaacatattacaagatgatcacttttcgtattcatttacaaaactaaatactaaaggaacattaaagttctatattattctaacataaaacatctctgtcacctaatattgattaggtaatctttcataaaaggaaactattttaaagtaatctcaaaacaagtccttgtctttgaggtactcacaccttaaaagatataaagtaaattctgaaattatttagaagaagtaatccaatgaatatacaaactgacaaaaaaattccaccaatttaccaaattctaatcactcaggaaatgggaaactaagcagtgcaataaaaaatagaaggtgagtacccctgcttttcttgttacacctttacttattgttcactactaaaagaaatgcgacttaaatacaaataaattattctaattacagaaatatcccaaataaattgattgtagcctaaatctctgccttctgaaaatgatttcagggttcgtagaactgaaaaatgttacaaatagtagagaattctgaatcaaaagtaaaactcaactttagggaaaacactagatgcatttcaaaaccttttctctaaaagcaaagtttaaaaagtagaatttgtctccttttaaaggtaggtatgcgtgtgtagtagaaagaaaatgataagtttaaaagaaaggtgttatgaatggctctccaaattatgtaataaaacagaaagttctgtttcaggcaatgtagaaaaccaaagcatttgtaccaatttcataactaacaacaactaaaaatgcaaggcaaaatacaaaaacatcttgacaggatccaagagttgagaagaaactaccaatccaaaattgaagtgaaagtgcaaactcagagatggtaaggagtgctgaatctgtctttgccctgaggatatttggtcagccattctgacaagatctttagacttacagatcttatttcaaatgaagaacagaaaacaaaaatagggccaggcatggtggctcacgcctgtaatcctagcactttcggaagctgaggtgggcggatcatctgaggtcaggagttcaagaccagcctggccaacatggtgaaacctcgtctctactaaaaatacaaaaattagccaagtgtggtggtgggtgcctgtaatcccagctaattgggaggctgagacaggagaattgcttgaacatgggaggcagaagctgcagtgagccgagatggcagcactgcactccagcctgggtgacacagtgagacttcatctcaaaaaattaaataaataaataaataaaataaaaattaaaaaataaacgccacctaaaagtctaacaggacactctcctcccccaaaaattaaataaataaataaaataaaaatttaaaaataaccaccacctaagagtctaacaggagactctcctcccaggaagctgagacatcaaagagttatcccctcaacgtaaaggtgatgagaagtctggacctaggggactaaaagaaaagttgctttgatgataagcaaagcaggggaaaacaaaaaaccacaagaactcgtaaccgcaaatgggctctcagagatacaatctaaattcacatcacaaaaataagtaccgccccccaaataaataaacacagagtggtgcccaagtggtagtgttcctgggtgccagactgtagcagacatgaatgtcatctggtagaacaaactattaaatacagtaaacaagaaaacatggcaccatgaaaaagaaccagccaaaataaacctgcaaggatttcatttattaggattatcaaatgtagattataaaataaccatgctaatacatttaaaattattttttacactgggaaaatacctccacagaaagaaaattaaaaataaatgatctagaaggttggaaagacatttgaacaaattaaatatacactaattgaaaataaaaactcactggagaggttatggaagattagtttacaacagactgacccttccaataagaataactagaaaaactaggtaaaatacagaaaacatctatatgcaggcatgagagagctactaatgcagccaagactcaagggtccaaaatcttgaacaaaagagaagtacagggaagtaacctcaactttcagcatgaattttcccaagtcatttgccaattctcaagaggctgggaagctaagtagagctgttagcagtatcacagactagggggaaaaaaacttgaagtttgggaactgcttgcaataaaccagaagtgtatctgtagaatgaaacccaactatatatcatctcaatctctgactatattgttaaactgtctctattctacctacctgccagaaacaaaaacaaaccctctttggaaaaaattagtatctgacattcaactgacaattactaggcataccaggagacaaatctataagaaggaaaaaataaaagaaacagacctataggaaacacaggtgttaaagttatcagatccagactttaaaatatctttgactaatatgctcaagaaaacagaagagaactatagcttcccctaaaaaacatggtaaccacctaaatccaaatgcctccacataacctccataaaactttaaaaataatgaagagatgaggctacatgggtattgctaaaagaaaaaaaaattaactgaaaaaaccctcataatccatgtctatggcataactaagaggcacagaatagtacaaacttcaaatggattgtcaactaaaggaaaaaaatcaggcttttaaaaaagaaaatttagttttattcagtcttactgaagactgtaacccaggagaatctttcagagagattcccaagcagtatttcagcccctgtatcagggggtggcagttctgcatctgctcataagttacattaaacatgctcacaagttacgttagagcaaagtgccatcaaagtttgggtgtgagagtacatcttgttactgattacagaggcatagtcactaatccctcagaatttatcttatatacaggaagagccaagggctaggctaggatcactgacctcatcttaaaaaaaaaaaatgcaatgattccatcaagagatgtgataacctgggcatcctgcttacagtctccagggcattcttccagagggctgccctccatcactgagtcagagcctttgtgaaattcttctggcaagcagaatgagcaaacatggttccttacatttgctactgtgtctcacaacatgtaagtagaaaattggacactaaaatccaggagctgtctctagagcccatgccagaaaaaaacaagatagacactatgtggaaaacatagaaggaagcagggaagcaaaatacagataaaataaccccagaaagtatagaaatcctaaaattaggtgtgagacctgttaggacagagcactgattactatagaatctaaaggaagggacttccaattataagaaggagaagtaacactcttggggaaaaaaccacttctccgggagaggactgtgacttagacatgggattcctgagatatatgatggtaaagagaaagaagaaaataagagataagagatattaaaaaaaaaaaaaagaaaaaaaaaaaggtcctgggcagtggctctcagttgtaatcctagcactatgggagggtgaggcaggactgcctgaggccaggagtttgaggccatcctgggcaacatggcaagaccctgtctctacaaaaattaaaaaaaaaaaaaaaaaaaaaaaaaaaaaaaaaaaaaagcccagcacagggtcatgcactgttggtctcagatacttgggaggctaaggtgggaagatcacttgagcccaggaggttgaggctgcagtgagccatgttcacactaccacactttagcctgagtaacagagagaccctgtctcaaaaaaagaaaaaaaaaagaaaaaaaaagaataaaagaataaaagataatcataaaatcagagaaacaccaaacccacctccccttccaagaaaatcaaaaacaataaacacaaaaaacacaccaggtaggttaaagaaactgcacttcactataataaaagaataggatgtttttgaactaagaaaccttgtaatttctctttttacataaactattattgctggttaagaaaaataaaattttcaaacctgatcagaaaacaggcaacaactataaaatgttataaaagaataaaaataaagaaaatgaaaacaagaatgcttcagctgataaatagcatcctcaaaaaaaaaaaaaaaaaaacaataaggcagagaaaactataatacatcttaacctgaattctatgttgttaaataagtatttacagatttttttaaaaaaatcctcttaaatcaaacattcaacaattcagttcaaaaatgtcaaaagtctggccaggtgtggtgcctctcacctgtaatggcagcactttgggaggctgaggcaggtggatcacttgaggtcaggagttcgagatcagcctgaccaacatggtgaaacccaatctctactaaaaatacaaaaattagctggctgtggtggcatgcacttgtaaccccagctacttgagaggctgaggcacgagaatcacttgaacctgggaggcggaggttgcggtgagctgacgtcatgccattgtactacaacctgggtgacagagcaggactgtctcaaaaaaaaaaaaaaaaaaggcaaaagtcagaaagttttaaaatgagatgtaattggtttcatgcccaaaaaattaaaattaaaaaagacaaaaatggccaagcacagtggctcacgcctgtggtcctaactactcaggaggctgagacaggaagatcacttgagcccagaaggtcaaggctgcagtgagtcgtgatcatgccactgtactccagcctgggtgaaaaagtgagactctgtctcaaaaaaattaaaaaaaaaaaaagagagagacaaaaattattttagaaattaaaaataaatataaagtacccaagagaaggaaagactgactgaaaataaaatatgtatcattgaacaaagccataaaaacagccaagagaacaaaacaaaatgaagtagagtagtaagcatcaggaaaatggccaggaatggtggtttatgcctgtacacccagaactttgggaggctgaggcaggaggattgctggagaataggagtttaagaccagcctgggaaacataatgagaccccatctctgccaaaaaaaaaaaagaagaagaagaagaagaagaaccaggagaagaagaagaaccaccaggggaaaagagagagaaagagggtccaacatacataaaattgtaagacccaaataagaaaataaaataatggaataaaactaatatttaaagttataatatgggttgggcgtagtggctcatgcctataatcccaacagtttgggaagctgtggcaggaaaattgcttgagctcaggcattcaaggccagcctgggcaatatagcaagactccatctgtataaaaaaaactttttaattaaaaataaagttgtaggtggctgggtgtggtggctcatgcctgtaatcccagcactttgggaggccaaggcaggtggatcatgaggtcaggagttcaagaccagcctggccaacatggtgaaacctcgtctctactaaagatacaaaaacaattagctggccatggtggcacatacctgtaatcccagctactcaggaggctgacgcagaagaattgcttgaacctgggaggtggaggttgcagtgagccaagatcacgccactgcactccagcctgggtgacagggtgagactctgtctcaaaaaataaataaaataaataaataaataaataaataaataaataaataaagttgtaggctgagtgccgtggctcatgcttgtaatcccagcaatttgggaggctgaggcaggaggatcgtttgagcccgctaattcgagaccagcctgggtaacaaagtgggaccccatccctacaaaaaatgaaataattagccgggcatggtggtgtgcacctgtagtcccaactgctcaggaggctgaggtgagaggatcacttgagcctgggagatcagggcctcagtaagctatgattgtgccactgcactctagcctgggtgacagactgaaaacctgtctgaaaagtaaataaataaataaataaataaagttgtaatatacaaagaaaaatcagaaataaaacaagatataaatgtatacattaaaaaggcctacaaagaacttggaaaaactgatacaaatacttaaactgagatgtactgcaatatacaactaggctttaaagatttttaaaaaatccatccaagggtagggaaaataagcacaaatcttctgagattatttgtaaaggaagcaaaatcgaaccagtgtcagacttcttggtagcaacatagaaaagacaataatgagtagttaggaattaaagtatgtcatttaaactgacaatccaaacagctgaaacctaagtaagtaaaaggcaaatgaaggaaattaagagcattataaataataatataaaagtaaccaccagaatgaaaatacaaacctcccaaaatacaagacaaaaacaaaaacaaaaaataaaaaaggagtggggaaaggaacatactattaatagattatgaaagaaacaaaggaaatataatacacccaataaatgtatataaaataatgtgacagagaccacataaaccatatcaatgaatgtaaatagatttaacttacctattttttaaattgtaaatgttaaatttcaaatggactcaaagtaaaactctacactgtattttacagaaacacaaagtgaatcagaaaggctaaaaatacaagggataaaaaaggtattcaaggcaaatgaaaacaataagtaggtattgtaatactgatattaaacatgagagaactgagacctaaaagcatgacataaagaacactttatgatataaagactacaatttccaataaagatgcaatagttatgaatatctatccaccaactaacacaactgctttaataaaacagaatcaaagagaaataaaggtgcaagaaagaaagaaaccaaacagaaaacatcaaaatctcatacttagtacaaaacaagtgtacagaaaatacaaaaggatgtggaagacataaacaaaacaagctttatcagtatctatacatttaaacaccaataacagaaaaacaatctttttcaagtgcacatgaatattcacagctgctttacccttgatagccaaaaattggaaataatctcagcgtctatgaataagagaatacatgaagaaattgtggtatattcagtgagggatgtaggtaccaaaatggcatatttgacttatgtcaaactaactaaatggagtcaggaggccaggaagaaggagccttcacatatgaatgcctgtaacaggttttattacaagaaattcctgcatgtcttacatgtacccttgtaacagaccttatcatgggaaatttctccaaccagataagctacttgcacaaggacacttgccttgcagtggctgtctccaccactgaactgatgtcagcttctgcaacaagcccctctagccaatggtcttgtttagcttatgtggacttgttttttgtctttaaaagtttcccgttttcccctaaccctcttggatgtacctatagtctgcttatggcaggtttatcctggacttcagtcctctgctattcctgaataaactctttgctttggagggctggtctctggatcactcattttaggatgacggttcatgcagtggaatactgcatagcaatgaaaaagagcaaaagattgctataaacacataaatgacacagcatattattttaagtaaaagaaactagacacaaagtagcaaactttttttttttttttttttttgagatggagtttcgctcttgttgcccaggctggagagcagggttgccatcttggctgactgcaacctccgcctcctgggttcaagcgattctcttgcctcagcctcccgagcaactgggattacaggtgcccgccaccatgcctggctaatattttgtaattttagtagagacagcctgtccatgttggacaggcaggttttgaactcccgacctcaaacaatccacccgtctcaagctctctaagtgtttggattacaggcgtgagccaccacgcccagcctcaaacttttaaacgaagttcaaaatcaagcaaaactaattgatattgataacaatgagaactgtggtaacctctgggaagacaaagggtggtctgggaatgaacacagggacttttatgggctgctggaaatgttctctatcttaatctggatctatccacagatgtaaagaaataaatttttttgaactatacacttaaagtcactacaattagtacagtttattgcatgtcagacaaccaaaacaacaaatgcaagtcatgaacagacacatcatacacacacacacacaaaatacaaatgatcagaaaacatgttcaacttcattggacatcaaggaaatgttaattaaaagactggtacaacccaaacaagattgactaaaatttaaaaacctgatacactatttgtgagagtgtaaattggtgcaaccattttggaaaactgtgatgtatctacttagctaaaatatgcatttctctcacaaacttaataaacaggcttctcatctactctattttagtcagagcctcagtccaacagctacatccacagttcttttctagacattcttaggtctgctacatcttttttttcccttttgctttcacttctcttcttaattatgggaattttgggcccatcaaggatttgaggcagggactcttttccatgaaatattctgttcaattcaaagaactttcaaatatacccataggtgaaattcattctgagacaggatcagttttaaggttttatcaatggacgtgaaggtcaggcccttgatttgatccttactaaaagactgagttttaattggccgttgtcacttaaagcctttataaattttatctttgtgaagtcaggattaagaagcaattgtgcctctcccaacaccatagttccttttaattccctttcattcctgttttcaaaaatgacaattcttttctgatctgtgctttcttgtaatgccttctaaatgcatccaccagcaatgaacacacaacaacactgacacaaagcattctgttttcctaccttttgtagtagaactacaaatttactaagtacatgatctgtatcaaagatagatggttaaaaaaaaggtaggtcttcatataacatttcatcctttggaaaacttgaatggtctacagtttatgaagtcccacctattaatgtggttactaaaataacaccagatggaaggaaactattcaaatatcaatccatcgctcattccttcatttcagatcacaagaaaaatgagaagatcacctaagtctatgagatttaactataactatgaaatgcattttaaactgggcgcagtggctcacgcctgtaatcccagtactttgggaggcagaggtgtgcaatcacttgaggccaggagtttgaggctagccttagcaacatggtgaaaccctgtctctacaaaaaatagccaggtgtggtggcgtgcacctgtactcctagctactggaaggctgaggcaggagaactgcttgagcctgggaggtcgaagcttcaatgagccgagattgaagtgcaggtcattgcactccagcctgggtgatgaagcaagagcttgtctcagaaaaaataataaataataaatatataaatatgcttaattttttttaaaaagaaacatattttaaatgccataatatatcctcaggcaacagtaaactggcatcctaatttttagactgcaaatataactgaaccagatcagatagagcaaaataggtaagaatttcaaatatgattagctacattgcacttttatgtaaaattcatagatgataaaagacatttaaaacctttctccccagtattttcagcgtaggcacttaatatataaaatgaccatcacattgaatggaacaccacaaaaccaagtgcatttacaccttccatttgctctgcatgtataattaaactcaataaaatgaaagtacaataaaatctttccacaatgttagcaggtcaccctcaagcagcttgacctatacatggctggtctagccagattaacctattatttacaaatcaatcttcctctcttttctacctacaatactccatacacagcaacaactggagagaaaaataaaatctagtaataaagattcaaaaatccttgctgtatattcaggaaattcaaataaaaagctaacactagtcttaaatattacactgcttataaaacattcagggaaaacaaacaaataaacatagccattctatcaagagacattccagatagcaaaatagttttaggtgaaatagtgtattattagattaactattatttaaataatattttttcattgaaacttaaaaggatataaaccattctatgttatatgctaatgagatttaatcagtcattatttacagagcaaagtttggctcatccagttctggcattgatacaatttatcaactgacatgttatgcttacagcatattactttccttgatcaaataattgagatcttgttgttctgttccacaggaaaggaatatctttcagatctcagaccattagcttataaattctatggctttgttaacaaaaaaaagatagtggacatcactaaaaaactgaaagtaaagacctctggcagggaacagtggctcacatctgtaatcccagtactttaggaggccaaggcaggcagatcacttgagctgaggagtttgagaccagcctggccaacatggcgaaaacccgtctctactaaaaatacaaaaattagccaggtgtggtggcgggtgcctataatcccagctacttgggaggctcaggcagcagaattgcttgaaccagggaggcggaggttgcagtgagcagagatggcatcactgcactccagcctgggttgacagagccagacttcatgtcaaaaaaaaaacctctgaaaatcctccataaaatcaatgagactacaagaaaaaacaaacaaacaaagaaaaaaaaccccaactttttcagaacactagaaactaaccaaagacttccagcaatccagaaaatgactgttacaaaaacaatgacaacaaaaccacagctaaatcttggttaagaacgctgagatttgtggcatttaaatttgctctatgcgcatctgcccaacctcggcaacacaggagtcttgaaaaacaatagccacaatcaacaatgactgtccaagaagttgaaactctttcaaagccctattctcagagtattgtcattattggacctggaagactccacatatactgtctttatttgaaatgatccagagcttaccagtgtgaaaagcattttccttagagcattaatcaaaaacaacctgagacaacagttgaatctaactcttaaaccaaattctcaaaagtcaacaacagcaaaatgaactacccaatttaaaaatgggcagaacattccgaacagataactcatcaaagaagatacattgacggcaaataagcatatcagaagatgttcaccaaaatatgtcattaaggaactgtaaattaaaagaacaatgagatactaccacacatactttcaccatctgatccagcaatcttcctcgttggtatttatccaaatgagttaactttatattcacgcgaaaacctgcacacatatgttcgcagtagctttgttcataattgtcaaaacttagaagcaaccaaaatgcccttcggcaggtaaatggataaactatggtaaatcaatacaatagaatattattcagcactaaaaagaaataagctgccaaatcaagagagacacaaaggaactttacatgtatattactaagtggaagaagccaatctgaaaaggctacatagtgtatgattctaactatatggcattctggaatgggcagaactatgaagatcgtgaaaagatcagagatttccagggcttagagggagagaaggataaataggtaaagcatagaaaatttttagggcaatgaaactattccttatttttttttatgttttagagtctcgctctttctcccaggttagagtgcagtggcaagatctgagctcactgcagccttgacttctcaggctcaggagatccctccaccatagcctctcgaacagctgggcccacagttgctaatctaccacgtctggctaatttttgcattttttgtagagacaaggttttggcatgttgccaaggctggcaatacaactattctgtatgatactaaaatgatagatacatgtaaattataacaaacataccactcaaatgcaggatgttgataggggaagaaactgtgtggttgtgggagcaaagggtgaagaagaactctatactttatgctcaattttcctgtgaacaatctaaaactgttctaaatctgtttaaaaacaaataaaagagaaaactttaaaaaatatatgaatatattacagaaggatataaattaccaaaggtcacctatacttcccatatccattgtttatattttgttatatttccttttagtagttgttatatttcatttatattcatggagatgatatcatagatattttgtattgtacttgttcgtgatctgacaaaacactcatttttgtcttcacaagcattgcttaagaacagtaagatattctatgaaactgatacaatttacttcacaattcacttcacaattcattttattgaatatacactcctatggcacttaacatatgctaggcagtttgaataactttaaaaatattaactctcaaacttttaaatttttattttcttacttcaacattcaggggaacaaacatattaagtcttttaaactcaaaacaaccttacaaagttggaaactgaggcactaaacaagtaagtaccaaaggaactcaactattaagtgatagagcttaacctttttgactacaaagctcatactgttcataaccactatcaatgctgcccctaagtatgtctcttactattgaatattttaggttgcttctactttatctaacactataataaatgctactatgaacatcttcactgataaaatgcttaatttcaacaataccagaaatatacaacacaacaatagccaataaagtgaagactgcttatttcagttacttacctgtcatattaccttttgtcctgctattgccaaagacacctttacttttgtctcctttctcttctttctgagctcttaccacattcataacttcaaatatctcttttatatgggcaatgccctaatacatttctcaagacaagaactcttgccacttatagtctttattcctgatggctagacaactttacctgattgtggtggtggggggggtctctcaaattgctatgtcctaagctatctccatcaattcacccctcaaacatgcctttgctctacattttcaccattctcccaatcaccaagcttagaaatctcaatattttatttttctttctcccttttgttcctctgatctccaaaaagttggcttgtccatttgtgtgccccattaaaaacatcgataatgctccactactttaaaaaatacatttcaaacttgaagacctggaattaatgatctgaaaagtccaaccttattccccatactcctttactgaagcaaaaaagtaaagtacctgctacttttcatgtaagttttattctttgttcatatatttcctgcctatcgttaataggtacaggaaggagatataacaatccaaaatgtgtatccacctttaaaaaagcataacaaatatgaccccagaaagtttttttttttttaaaaagcccacaaaaaagaaattatgtcaaagaaacacaagagacaaatgaaagctttcaagagccaaagctggaaaaatctgtgcaacaaaattaagtagtaatggattataacccaaagtattaaatgaatatacatgagtccatactaacataaataagtgattgagtaagcaaataaatgggagagaatagacaaatctctcatgcggaaaaattccaaataatttatgtagatactctgctcttaaaaaagtagagcataactcccttctccctaagtgtgcactgtgcatagtgactttcttccaaagagtccaatatacaaaggagggaaaagggagtaactttacagcagaaaaacctgacaaacactacctcagccaggtgaccgcccagtctaatcacaaaaaaacaaaacaaaaatacccaggtaaatcccaattgacggacattgtataaaatacttgatcattattcctcaaaactttcaaggtcatcaaaaacaaagtttgagaaagtgttacagccaagaagaaggaagctaaggagacacgagtactggaagtaatatgggataccagatgcaatcttggaatagaaaaaggacatgaagtaaaaactaaggaaatctgaataaaatacggaccttagttaataataatgaaccaatgaaggttcattaattgtaacaaatataccatacttacataagatgttaatagtaggtgaaactgctgtgggtatatgagaactgtcgaactcttggcagtttttttttttaatctgaaacttctaaaattaaaagtttattggaaaaaacatatggtcccaaaacactcctcttattgagagatgaagtctatggcccctcatcttaaaactgggcagctttgtgactgttgagttacagtgacagaagtgatgcaatgaaactagataataaatgccatgcagcttccaactggtgctcatatggctctcacctgtggaatgctctctcttgccactgaatcaacaggcaaagaaagggttattctactaagttggatgactcttcttgactaccaggagaaactgagctacttaaacaggatgggaataaggaaaggtacgccaggaatacagtggatccaggaagaacctatgagcactgctatgtcctaagttaacatacccctccccctacaaacagctcaatatagacaggactactaccagaccaaatcctgtaggaaggtctaagtcatcccaccaaaaaagaaaccacagtgcacacaggtacttgctgagggcaaagggaaactgagactggcagtagaaagtagttataaatactggctacaaccacatgataagttaagtaagtgagggctgtaatagctatgagcataatttttttgatatgaacacatttgcgcatgtatctgactttatttttgttctctctctcatcccaaaaccgtctaaaataagactaaacatttttttttccccaaaatcagaaataaggcaaagatgtagcctctcatctctatgaaacattacactggcagttcgagacagtgccacaaaacaaaaaataaattaaaggcatacatatctgaaagagagaagtaaaacatcacagaagttattgttaacacagaaaattctaaaaataaaaagttaatagtgcattcaggaaagtcataaaattttagattaatatacaaaaattttaaaaattagcaaaagaaaaagaataaaatttacagtgttatcaagaaatataaactacttatatatattttgaatttacaaataaatttaacaaaatatgtacaagacctgtaaatggaaaactataaaacatttctgagagaatttaaaaatgatacaaatagggctgggcgaggtggctcacgcctgtaatcccagcactttaggaggctgaggcaggtgggtcacaaggtcaggagatcgaaaccatcctggctaacatggtaaaaccccatctctactaaaaatacaaaaaattagccgggcgtggtggcgggcacctgtagtcccagctactcaggaagctgaggcaggagaatggcatgaacctgggaggtggtggtttcagtgagccaagatcgtgccactgcactccagcctgggcaacagagcgagactccacctcaaaaaaaaaaaaaaaaaaaaaaaagagacaaatgaaaagagataccatgttcatagattggaagaatcatatttcttactgggaaaagcaacaatttattggtctaatacagattcagtaaaatctcaaagaggtttccagcaagccttttgtaaaaaatgaccagctgactctaatatttaaaaaggccaacaactgcagattttttttttttttatacaggatctcactctgttgcccaggttggagtgcagtggcataatcatagctcattgcagcctcaacctccagggctcaagcggtcctcctgcctcagcctcccaagtagctgggaacacaggtacaagccactgtgccctgctaatttttgtattttttgtagagacagggttttgccatgttgcccaggctggtctcaaactcctgggctcaagagatccaccctcctcagcctcctcaagttttaggattataggtgtgagccaccacacctggccaagatgtcttttaaaggtagcaaaagctagaggtgtgacactaccagatattaagacttagacttattatacctaattgcaaaacagtatattataagcataaaggacatataaatcagcagaacagattaatcagtccagaaataaaacaacatacataagattgattttcaacaaaggtgtcaaaataattcagaacctcctttagcattgtttatattgaagacctgcaggcagaaaattcttagcttttatttatctaaaaactctttttacttgaccttcattttcaaaagatatttttgctgaatagagaattcaggtatattgggatttttttattatttatttatttatttatttattttgagacagagtcttactctgttgcccaggctggagtgaagtggcgccatctgggctcactacaagctccgcctcctgggttcaggccattctcctgcctcagcctctcaagtagctgggactacaggagtgcaccaccacacctggctaattttgtatttttagtttcttaatctgtaaatttatgcctttcacctaatttggtacttttttttttttttttgagatggagtttcgctcttgttgcccaggatggagtgcaatggtgcgatctcggctcaccacgacctccgcttcccgggttcaagcgattctcctgcctcagcctcctgagtagctgggattacaggcacgcaccaccatgcctggctaattttgtatttttagtagagaaggggtttctccatgttggtcagggtgatctctaactcccaacctcaggtgatcagcccgccttggcctcccaaagtgctgagattactggcatgagccaacgcgcccagcaatttagtaagttttcattcatatgtcttcaatttatttatttatttatttttgctccctttctctacctctatttctgggactccaactagatgtatattagacatcttgctactgtcccacatgtaaatgagtctcttcatttttcattctttatctctcttgtcttcagattgtataatttctattagtctgtctccaagttcactaactcttctgttattccaatctgtttttaagcccatctatttttttattttctatttgaggtaccctatttttatttgagtaccatatttttcaattctagaattcttttaacagtttctacttctctggtgagattcctcatttttaatttattacaagaatatttcccctttacattgttgaacatatttatgacatttgctttaaaattcttgcctactaaatcaatatctcttagggtcagcttccattgattgccttttctcttgtgtatagatcacattttactgtttctttaggtgtctcattatttttgacagtattatggacatgttgatgtgctgtggagattctgaattatgttgtgttcctgtgaagaatgttgacatttttgttttaacaaggagttaatttggctgaagtagaaaacccagttgtctttcctatgatggatttcagttgaaagctctgttcacatattttagctttaggtgaattgcttgaaaactgtctaatggaaatctatttcaggggtcaggtgaagagaagggagagactataaacagaatccctctctgtgaatctgtcattttcctactcactttctagctgtgggggttagcccaaatcctgccctctgtatgttcaggttagtaagtctgttaatattctatttaagttacagctgtctaatgtagtgtctactggggtaaaaaaaaaaaaagttaccataagaatgggaaattcacccatttccaagaggatattcttccagtttctgcttgcttttggttgttctccattgtattcaagtagttaagtttatattttgttgacagattacagttgttagcacagaagagttgttcaaataggtgatactctcttgttatcagaagcaataataatctcattaggaaaggtaaaaatagtgccgggagacctagatatccacatggaaaaaattaatcttcccacacatgaaactcaacacaaaatggatcataaactaacataaaatctgaatctggctgggtgcggtggcacacacctgtaatcccagcactttggggggccgaggcaggtggatcacctgaggtcaggagttcgagaccagcctggccaacatggtgaaacctcgtctctactaaaaatataaaaattaaccgggcatggtggtgggcacctgtaatcccagctactcgggaggctgaggcaggagaatttattgaacctgggaggtggaggttgcggtgagccgagatcgcgccactgcactccagcctgggtgacagagtgagactccatctcaatgaaaaaaaaaaaagctaaatctacaaaacagaggaagaaaatctttgtgaccttgtggtaggcaaagtttcttagataggagacaacacataaaaataaacagcacattatcaaaattaaaacttttgctcttgaaaagatatcattaagaaaatgaaaaggtaagcttcagattgggagaagataatctgaacatacataattggcaaagaacttttatacagaacacaaaaagaacttttatacctcaataaaaagacaaacccatctaaaaattggaaaaatatgaaaacagacatatcatgaaagaagatacctgaatacacaataagcttataaaaagatattcaacatcattagccatcagtaaagtgcaaattaaaatcacagtgagatagcaacgaacgccctttacagtggctaaaattaaaacgattgacagttccaacgatgtggagaaattgcaactttcatacattcctgaaaatgatataaaatactacaactacgttggaaaacagtttggcagtttcttacaaagttgaacataaaatgattgtatgattcagcaattccatctcctaagtattttcccaaagactgtaaacaagtgttcacagcagttttattcataattgctccaaactggaaataactcaaatgtcaaacaataaatgaatagataaacaaactgtaatctatagatagacctaggtataaagaaatatcataatactgatacacagaaaaatattagtaaatatcaaaaacaatactatgaaaaagaagctggatgcaaaatagtacacactgtttagtttcatttacattacattagagaaaggtccaaattaatctataaaatcaaaaagcacattaatgattgcctagggttgagggataagggatagaaaatgactgaagataggacaagagaacttactgggataaagagtgagaaggggaaaacaagctgtatctaaaaagatactgaccaagaattttaacaaagctggtaaaagataaaaaaccatggattcaactcactaaaggataaacaatatatatatattggaaaaaaatatatgtataggcctatcattaaaactactgaaaatcaaagacaaagggaaaactttcaaagaagccaaggaggcaagttctctttattattttatcagacaaaaataagtctgatagctaacttctcaacagaaatgatagaagccaaatgacaatggaattacatcctcaaagggatatgccaatccataaacagcaaaaatacccttcatcaatgacagtgaaataaagacttttcttcaggcataaaaaagaatttgtcatcaacaaatccacattaaaataaatattaaagtgcattattcaggcagaagggaaataatcccaccaagggaagctagaagacacagaaaggaatgaagagccacaaaaacggtaaatctaagcaattattggctgtataaaataataatattaatgtctaaaggcaccaaaaatagagaattaaaatgcacagtagcaaaaaacaagtgtgaataaatgaacataaaatattataaggtgtgtactttttttttttttttttgagacagagtcttgctctctggctcaggatggagtgcaatgacacgatcttggctcactgcaacctctgcctccgaggttcaagcaattctcctgccttagccgcctgagtagctaggattacagatgcacgccaccacgctcagctaattttttgtattttagtagagatagtgtttcactgtgttgcccaggctggtcttgaactcctaagctcaggcaaaccacccacctcagcctcctgaagtgctaggattacaggcatgagccactgcaccctgcctacattttttttttttttttgagagggagtcttgctctgtcgcccagactggaatgcagtggcacgatcttggctcactacaacctccacctcccgggttcaagcagtttctcatgcctctgcctcccaagttgctgggattacaggtgcacgccaccacaaacagctaattttgtatttttagtagagatggggtttcaccacgttggccaggctggtcttgaactcctgacctcaggtgatccacccgcctcggcctcccaaagtgctgggattaaacacaaatatatccgtgatgatgttaagaggtctaactgcaggcatctcatttctaaccactggactcttaaggaccccaagaccttatctcttgaggctatatgactttaaaacccaagcctcttgaacagtgagacctataactctttcctatcagcagttttatgagcctacagctccctgattgtttctagaccctagggatttcccttatttttttaatgcctcatatgctatatataggtgtttgtaaggaatagcatttttggttgtctttttctccatattgcaggaacaagaaaacttatctttatttcctgaaaaaataaaactgtgggtttaaaacatttgaggatatactttttaagttaaaaaaactatttccaatccatctttttttttttttttttttttttttgagacggagtctctttttgtcacccaggttagagtgcattggcacgatctgggctcactgcaaccctgcctcagttcaagcaattctcttgcctcagccttctgagtagctgcgactacaggcatgccccaccatgcctggctaattttttttgtttttggtagagacggagtttcaccatgttggccaggctggtctctaactcctgacctcaagtgatccacccgcctcggcctccctaagtgctaggatgacaggcatgagccactgcgtccagcctctaatccattttttaagtgagaacaaaactaataaaatgtagtaaatgagttattatcttcatagaataactgagaaatcacatttttatttctatagcagctacaagatacttgttgcataagttcaacttcagaacatgtaattaaaatatctacactgactcttccattatccaacaggtctaaattcggaatctcatatgcttgttaatcagtactatttgatgcctgaattcttgttttccttattctcttgagacagggtgatttttttttctttgaggtgttaaattttgaggtaggggggttgggggatagataagtcaagtttctagcaacctcaattcctcatctctaaaagggagataatagtacctagcacagagtgtggcaaaagaatcaaatgaggtaacagtaagttccaataagtgttagctgttgctattattcctatttattatcttttcccagcaatgatcattacttttgagagtatgtcttagcaatggtaactgtttttgagagtaaggtcaaatgcttggcatgagccactctgaggaatgggtaagtcgtaccttgaggatcacacatagtaacaaaggaaactcctatagggtatgtctgccatatgctggctctactctaccagagaaacaggtaggcagacaataacggatgctggcaaggatgtagagaaaggggaaccctcacacactgttggtaggaaagtaaattagcatagctgctatggaaaacagtatggaggttgccaaaaaacttaaaatagaattaccatatgatttagcaattccgttactgggtatacatccaaaagaaaggaaatcaatatatcagagagatatgcagttccatgtttactgcagcactattcacaatagacaaggtatggaatcaacctaactgtccatcaatggatgaatggataaagaaaatgtgatatatatacacaatggaatattattcagccatcaaaaggaatgaaatcctgtcatttgcagcaacatagatgaaactggaggccattatgttaagtgaaataagcaaaacaccaaaagacaagtatctcatgttctcactcatatgtgggagcttaaaaagtgaatctcatgaaaatagtgaatacattgctggttaccagaggccaggaagggaaggagggaggggcaaatgaagaggaaaaagaaaatataaacatatatattacccctgggctgtacacttaaaaatggtaaagatggtaaattatatatgtgtattttacttcaataacaaatgatttttaaaaatcatgttgtataccttaaaaaaataaataaataaaaacaagtcttattcctttcttccccaaagctgtcaccaactactcttggtacttctatttcttgagtactgactacagaatagggacacacatcccccaatgttgtattttgttctttatgccccaccaagcaagcctagcagtcattttcattttaagtgttttattactaattgctacagggaactaggtagtgcctagtgaagaaggtatgtttcctggggttgtggtaacaaattgaaacaaaataggtggtttgaaacagaaacttaactctcagggttctggagactagaaatctgaaattaaggtgcagatagatttcagcacagctgtgctccctctgatgtgtctggggctccctctgatgtgtctggggaagaatccttcctaccctctccctagcttctggtgcagaattgcaggtgattctttgttccttggcttgcagctgcacaactacaacttctgcctctgtcatcacatgacctctttccctgtgtgtgtgtatgtctaggtctctgtatccaaatttccctctcccttctcttttctggtttttttttttttttttggtgttgttgttgtttgttttgttttgttttgttttgttttttgacagagtgtaactcttttgcccaggctggagtgcagtggcacaatcacaactcattgcagcctcaaactcctgggctcaagctaccctcccacttcagcctccagagtagctgggacacctggttatttttttgttgttgttatttatttttagtagagatgatgatgtcccgctatgttgcccaggttaatctcaaactcttcagctcaagcaatcctcctgcctcaacttcccaaagtgctgggattacaggtgtgagccactgtgactggcctcctttctcttataaagaaaccagtcactgaattagggtcacattcacaaatactaggggttaggacttgaatatacctttttgagggacacaattcaacccaccagagagaatgtctttaaatttaagaagctattaaaagttcttataatccctgtccatgttctgtaggtctgggtttttggaaatcccttgagcttcctttgtccctcatagatctctgggtaatgctttttaaatgatcctagactcccgaactcacagctcctaaaaagccctctgtacagaagtttctcttcccgggaaacaggcttgatggtatagttagaataaatttctgtcctccttgaggacatggatcaaagcttcataattccttgatactagaatggggtctgatatcaataacattttttatgaactagaaatcattcaagtacctccttgtttcagctgtgtaatctgtttcttgggggatttcctgactaggtgattaccttaaaacagagctcccatgccatgtaagaatgatctccttaaggtttttcctcacactccacatccttactgtttcctccctctgagactattttatatcgttcaaaaatctcctagaaggcattgatttgacttctgagagtaataacactttgcaaaatatgcattagtgaaattgcttccaggtcatcatactttacatttttgcttggtgtaatatacccaaaggaaaccacaactactttaaaagaagttacatgattatgacttcatgtatgcaaatcaggcctcccctaacatcctttcttcagttggttcttgtctgcccttggttctacttgttttttttcttttcttctgttactatggcagaacagataaagagtcttactctgtcgcccaggctggagtgcagtggcgcaatcatagctcattgcagcatcaacctcctaggctcaaaccatcctcccatctcagcctccagagtagctgggaccacaggcatccgccactgcacctggctgattttttaaattgtttgtagacatggtctcctaatgttgcccagactggtctcaaactcctgggctcaaaggatcctctgctttggccttaggaagtgctgggattacaggcatgagacaccacgctcagcctcagttctacatttgatgttgctactcttgtaagtgaaaaatctttatcttgatggtttatcccttccatgggataaatcatctactatcattttgctgtgtcctgcaaatattcttataaaattatttgaaatattctaaaaataaaaataacttctgtatatctatcacgcagtttaataaaacactaccagtatagttgaaacattctatgaacacttccttaataacattccccctctctttcccccaccgacaccaggtacatgtaccataaattatcaccacagctaattaccacctggaagctgatgtttatgatccccatgcatttttgatacctttactaaactatatactattctacatatttctaaatgctaattctgtattatatctgttacagattcttctgcaatgtttttcccctctaactatgattgtgagatatatcatattgatacatactgtttggcttcattattttaatagcatcactttcattttaagaatatacaaccatttttatcattcttctactgatggacatttagtttccatgtttctactattacaaacattgctttttgaacagccccttagatcacaactagagttatttttctctttttcacaacagctttattgagatataacttatatatcataaaattcaccctttaaagtgtacgattcatagttttgagagtattcataaagctgtgcaaccaccacaactatctaattccagactatttgcatcatctcaaaaagaaactctatactcattagcagtaattttccattctcccctgccctggcccctatcaaccattaatctactttctatctctatggatttgcctattttggaaattttttataaataaaatcatacaatatatgaccttttgtgactggcttctttcacttaacatgtttccaaggttcagccatgttgtagatgtacattaatttgattgtggtgatggtttcatgggtacatgtcaaaacttatcaaagtatacactttaaaaatatgaaatttgttgtacgtaaattgtacctcaataaaactaccaaataaaataggcaaaacaggtcaggcatggtaactcaaacgcctgtaatcccagcactttgagaggccaaagcaggtggatccccaaggtcaggagttcgagaccagcctggccaatgtggtgaaaccatgtctctactaaaaatacaaaaattagctgggcatggtggcgtgcgcctgtaatcctagctactcgtgagacttaggtgggagaactgcttgaacccaggaggaggaggctgcagtgagctgagatcgcaccactgcactccagcctgggcaacagagtgagactgcatctcaaaaaaaaaaaaaaaaaaaaaagggcaaaacatttttatagatgcttcacaaaagacgttcagataacaagtggatgaatgactgactactctatttcattaagcatcagagaaatataacttaaaattacaatgagacatcagtacagacccagagcaatagtttaaaaaatttaaactactaactactataaaccccaagggctgatatgactgttgaataactggaactgccatatgcagctgatgggaatgcaaaatgggacagccacttttgaaaaaggttttaaagtattttatgaaattaaggctgagcatggtgcctcacacctataatcccaacattttgggaggctgaggtggaaggattgcttgaggcaggaggttaagaccaggaggttaagtccagcctggacaacatagcaagaccttttttctaccaaacattacaaattagctaggcctggtgacatgctcctgtagtcccagttacttgaaaaggctgaggcccaggaattcgaggttatggtgagccatatcctacctcaaaaacaaaacaaaacaaaacaaaacaaaaatagagaggaaaaaaaaaagcaaagagcaagcaagcaagcaagaaattaaaatctttggccacacaaacacctgtagccaaatgtttatagcagctttattactaacagccaaaacctggaaacaactcaaagcccattaactgctgaatggataaacaaactggtaatacatataatggaatactactcacacattaaaagaaaaaattagtgatacatgcaagaacatagatgaatcttgaaagtattatatcaagtgaaagaagccagacactaccagctcatactatgtgattccactaacatgatgcctccaaacacaaacctatagcagtagatatcagatcaagggttgctagggaccaatggtgaggatagaaaatcgataataagtgcatgagactttacagacttacagatatactaaaaatgattgtgatagttcacaactcttcacatttgtccaaactcatagaacagtattccttaaaagagtcaactttaccatatgcaaattatgactaaatatgcccgactttgttttttcaaaagtgagggtgaggtgggatggggttgggggagacattatatacaggagaacaaagataagaatgacaccaaatatctaaaaacaacagccagaggacaatagaatattaaagtgctaaaaaaagtcaacctacaattatatatccagtttaaaaataaatctttcaaaaatgaaagttaaataaaaacattttctaagaaacaaacactgacagaatccttcacctacatgcagtattaaataaatgaagttattcaaactgaaggaaaattatgaaaatatggatctacatagatggatgtattctatcaaacacttaacaatgcaatgccaatcttatacaaactttttcaagaagtaaagaatacaacacatcccagatcacttaaagatgtcagacaccattaccctaattctaaaaccagacaatcaaaataaagcaaaactgaagaccaatctccccaaaatggcaaccgaacagtgaaaaaaaatttagttaaagccattcctcacatcatatataaaagcaaatttcaggtaagctaatgttctcatgtgaaagataatgcctgagatggttaggaagaagattatgagattatattcaggtatatgctggtagaattcaccataaaattattttaatataaaacatccaaaaaattaaggcacacaaactattttcactcttcatgttgatcaagaattttcctatttcttgttaattcaaaaagactctggatgcaataccttgtgaacttattttttggtatgcccctgtgctcatatactaccttactacctttatctctctgttttttgtttgtttgttttggagataggcacgatcattggccactgcagcctggaattccccggcccaagtgatcctcccacctcagcctcctgagtagctgggagcaaggcgaacaccaccacggctggctaattttaaaatttttttgtagagatggggtccgactatcgtcttgaactcctgggttggtctcgaactcctgggctgaagcagtctttccacctcagcctcccaaagtgttggttgggattacaggcgtggaccgccacacttagaaatgacttttctaatatccttaaatcagagctcatgtaaaattttcagccttctcattccacctccctccgaactacaagtcttaaaactaagaaatgacagccattcggtagaagttaaaacactgtttcgctgcttatttctacttaaaaaaattatatacatagatatatattatgtaaatatatataattatatatatagacatacgtgtgtgtatatatataaataaacgtgtagaattggactggggtcccactaatatccacatttcaaaacagaatctaaaactccctaaaacagggttgggctcggcggctcacgcttgtaatcccaaccctttgggaggctgacactggagatcagtctgagcaacaaagtcagatctcttttctactaaaacaaaatacaactctctaaaactaatacaaaattttgtgtgtatgtgtcatattctggagaaaagctccaaggttttcctctgggtcttaaacaggactaagaccccccacccccaaaagaatctctgttctagaggctaagcatatagaagctcatactgcattatcaaactggaaagttaatagaggattttcatggtcatatacaggagaggtggggaaagctgtctatttagactgtaaactcctaaaatgttcataaatctcaatggaaattaaatccaccggggtgggagaagtatcacaatagacaaagaagctaaaggttaatgaagagaaggttttaatcagtggttacttttgtgcttgggatcaatcctcagtttgtcctccaacgtaacttttggcattattcatttcaaagtctgaacagtatccataaacccaatacgaaacctatggatccagagggtccgaccgaaaacaaaacaattatgtttccgatgtgaacgcatcaatagcttacttttgtagcgctttataaaacgctgtcacttgctgctttccacgtcatgatattcccggtcgggaagagtaggacagcagcatcttttatgaataaggaattttttggattcaatttgtgaggtgtgggacgctcaccaggttgcgcgaaaaccatttttctacatcgtcaagtgcacgcaccccgtgtctcatagtattagtgatgaagacgaggatgaaactaccaaagacatcagtggggagtgaattatacttgggggaggtgtaagcacgtcgaaataaggaagctgagagacattttgtgaaagagggaaggtagcgttaagaggagccttccatcaggggcaacagaacgggggcaggcgtggcgtctctgggactgccggaaaacgacgtgagggaaaaactcagaggctacgaaaaggcgaacagacggagggcctgcctcaggggagctaagcagctcgcctgaagccccccatctggaaatgacgtgtttaactcggcgcccctgcagctccggccgcccttttttgtttaactccgcgcccctccagctccggccgcccttttcgtcgctctcccctcgcggtcgctcacccctgagatccctggttccactgagacgctcagcttcattcggcaactcgcggacaccaagcgccacaaattcaaatacgagatctagagacgctgggtctcaaacgtctcc

SEQ ID NO: 333 - DNA, 3038 bp, Homo sapiens
tttactccattcacaaaggtttattgggtccctgcctggtgctggtttgggttagtcactgtagaggatccatctgggccagcctgggaggggcaggtctggagtccgaggcagacacgaaaccgggggtgacacccaggggctgtggaggctgccatgctgaggacagctctgggaggaccgctgaagaggatgactagcgggtggggagtggggttcagccatctcccgggagctgggagggcccaggtggaggtgagggcagcagaggaggaggaggaatgggggtctccaggtagaaaaagggagcagggaatagcatgagtggaagcccagaggaaggaaagtacccggagggtctctgtgcttcaagaggccagtggaggggacagagacaaacggccagtggtgaagcagggctgacaccctggcagcaaggacactgaggcacacacctgccattcaccagcactctcctccaggtgtgcaccagctcctgcccgaagcctcaggaggtcctcctgcaggggaacacagggccaccagaacccaccccaccccagagggaagtctcagtgacagcctctctgggccctgggagctgctctactggaatggagagagaggctgtacccattgcaaacccgcctaccacgccccgcactggggcagtgaggtccggcgggggggtccgcaccagggttcaccaaaccctccctttcaagggaagactgccccaggaggatgggcttgggatcagaaggccatccaaaggccagccctcccctggctctgccagggccctgctgcctgtcccctccccgcctctctccaagttgttcctggacaccaaatggaccccatccaacttgtccctccttttctttcccctgcccgccccctgctggagttgtaagagggcaggcagaaagggaggtgggggaggcccagccaggctgggggacaggagaagcagccccagttctaactctgcttcccccacagcagagcctgccaggcccccgagggccgggacctctgggtgatgcctggcactcccctaagtcacaggtggagctgggcctttggccagtactctccctcctgaccactgggatgggacaagacagtaggggcaacaggtaggaagggccaggtctaaggtgagctgggggtgcagccctagagagaggtaggaaggagggacaggggttgctctggaggagagagggttgctccagaggcagagggaaaagacaactggagtgggagtcagtgagccaggttctgtgttccaaaggccagcattgcctggaccttgggtctgtcctcacctgcataagaggctgcaggagccaaatgggccttccagccttgtccaatattatggagtcccgaggtgtggagtgtattctgtgggcccaagaaacagcaacagatccccagaacagatgacagccctaaagaaaggctgctttcctgagcatccctggggctagaaagagtgtggatcaggtgcttcctattgggctgggcctgcagaggggacaagaggggccagtcttacagccacccagaccatactttccacacacatgcacatgcgcacacacacttgcacacacacacacacacttgcacacatatgcatgcacatgccaccagatctcagccagcacagaaaggctctcccagccttaggtggcttatgcattttctgaaactaactgtgggaaaagggcttggggaaccatcccatgtgcctgcaccaaatgctgtgtgggtggggcaggacacaagccctacactgacacctcccagaaatcagggaatcagagcttgagagattgtccagtaaaagttggaaccctcaacaccccttgactctgcccaggaggagcaacctcagaagcccccccaaacctcctctcagagacctgccgagtaggaggcttctctctctactctcctccccgcaaaaaagaggccagaaaagaggatgattggctaactcagaggtgccctgatggaggggagcaaacaaggggacttccaaggagaattccctagcccacctgaaagacccctacccagagtggtgaggggcagcttaggagcactgacgcaagggggagagaccaggctggcttccctctacgtagtaagttcctggggtgtgcgcccctgccccagacagcagagaaatcgcctgactgggagatggagaagaggggccaccttctcatgccaccccgccgccaatcctccaggcacactcgggcgcttgacctgctgaagcctgtagcctcaggtccagtgaggagctcacgggacagagggccctaccagagccacgaaaaccggagggggggacctccgcccaaggcaggcgtctctgcgcgcccgctggggccctggtcctgcagttggcttctcccgacacgttccttcgctgccgaaagcgattcgcccgcgctctaccgagcccagccagctcctacctcggcccgggcggcgagcgctgtctccgtcccgagaagaagtttcgcggctggtcccggggcggcaggcgcacgggacgctggcggcggcggcggcttccgacttgggctcagaccccgccgctccagacaagtccccgcgactgcgacagtgtctcgggcagttcagctccccagacgggagacagaccctcgcgacctggttcaggccttgccctgggggacactgcagtccaaggcgaaaggagacttgctcccggcctctgggtccctaggtcaaggcacctccccgccccgccgcccctgagcccaagtcgccaaccccgcgccgcgcgcagcgagggatcagaaggtctcggacgccgcggcagggccggccagggccccacgagttagggagttgccccgcacccctaaacgctcagcacccatttacggttgaaagtacgcacttgacgcgtccgggcgcctccgcggtgagtcgcgccgccgctctcggggtccgcgaaggtggctcagttcgggcgctccagtctc

SEQ ID NO: 334 - DNA, 61015 bp, Homo sapiens
tataggattcaagagaaaacgagaagactcattcatttatttgttccaccaataaatgttgaggacctgttgtatgtcaagctctctgctcagcactctagatgatttattccatttaacaatgctgcaaacttagaagttaagcactactattgcactcagtttaatcaggaaattagggcttagcaaaatagaatagcttaaccaatgtaaaatgtgatgggggacttcaaaaaacttacaatctagaaggggaggtagcaggtagtacacacacacacacacacacacacacacacacacaaactccaacacaaagcagaatgtattcaatagatgatccagtttcagagctcagagaaagaagatattgcattcaggcctcacggaaaagattgcatttaatggggttctagaagatgattaagattactgcaaagagaaataaaagagaagcagatcccagcacagtagaaggaatgacgtaagtagaagggtggtggcagggaaatgtagaacatgcttgtgaatggaggataagccagttgagtaagagcaaagggtacaggaatagagtaaaggtgttaggactggtaacgtaggttgggtacaggtcatgaggtacctagaatgtctatgttaacctggaacttattagaatcacaaagaggagccactgagcagttttaggaacccatgatactgtcccacggcagtaaaaagagtgtgtttaacagtaatacgaagcatggaaaaggaggcaaggctggtgattgccagtccaggcagccagcaaccacatgacaccatggcaaacagtgaaggcctgagccacggtggaagtggtggggatggaaagaagaccacggacacaagacccatggcaaaaagacctggcaatggataagtgggtgaatgaggtgtcaagaaatgatcagatgctgatggtgccactaatgcacatccagacaaagctcagtgtctgggagtaaactgtcaaacaaaaaaatatcagtgtgaagaacttccagtttacaatgacacctggctagcagtccatgactcaacctctctcaatttcccagtaaatatacatacattccccactacatgttttaaagaatgaaattcaaaattagcgtgaatacaaattgccaaaatgtggagaaacattttcaccaactccaagacagcagaaggtggattcagagaaacagtgagtggccaagctacaggtgttctcctgaagcagggaaacccacacatggcaaagaaagtgagatggcctctggtccttcccctgtctgccctgtctcaaaggcctaggtcagtgctgaacagtaagttctattgtgcaagtgcttatttctaaggtaccagagtaaaacaccaatcacctgttctccaccgcatcctctcccactaaccccaccccactcacattttctattgcatctgtgaactgaaagcaacgagcaggaagttgtcggggtctagaatcatgctctacatcctagtggatgtagccctcatattgaagctacataagcaagaaaaaagactctaagatatccaacagcagtgtgtgccgggcttctaaatttccaccaactccctcagttcaaagtgtcaaagaatcaagcaagagagtgagatcttatttctctacagcagagccacaaaatctgtgtgttggcaaacactgaatgcagagggaacttgtctaatctaaggattagtaaacaccaaactaaatagagggcctatgaaaaaagtatgaaacctcaggggaaagggaacaatatcccagagatcaagaagatgaacacacctttgaaaatgatttgctatcaaaaaaaagagaaaatggtatgaaatatttttattattttcagtaggatctaagaagatatggcctctctgaaacaggagcagaaagccaaaaagctgaactgaaagaacgcaatgagatgaaaagacaacgccatggaatgtaaagacaataaacccaggtgaaaaggaagctgggtgagataaggaggctgaaattacaatatgagaaatgaagtcagccctgagggcagtaaaacagaccttgggaaatctaaccagtaatgtgcagaatggagttgaacagaagataaaagggggagggaggtccaaaaaaatgtgttattttttaaggcaaatgggaagatgatatatgtagagcacaaagaaaggaaattcaatctgcaaataataggtgttaccaaagacagaaccaaaacacagtaggaccagagcaatgatcacagatataatttgaatgcagtagacataaacttctataagaaatctacttaatttttctgtctcaggattgttgtctttaaaacgggggtttaaagcataatgcagagagttttatgaacatttgaaggagcatctatatgttatttgcttgccttcaatattggtagatagtaaatgctaagtaacatcagttgtaatttattattactctataatagctcatacaaattagtaagccgaaaaaaaataaaagtaccaaaagcgtgatgagttcattcatgaaataaaactatgaatagcatataagcatatgaaaaatgttcccctcattaggaatcaaagaaatccaaattaaagccatgagttacaacttttccaataacaaattaattacggttctttttctttaatggtgatgctctacattgagaaaagtgtgctgaaatcccactgctttgctggtgggactctaaatttgttcaaccttacagttgatatttatagatcaaaaagattaaagagatttatatttttgttatggactgaaggcttgtgtctcccaaaaattcacatgttaaagccctaacccccaatgtgactgtatttggagagagtctgggaggaggtgataaaggttaaatgaggtcataagggtggggctataactgattaactgataggactggtggtcatataagaagaggaagagataccagagctctccctccaccgtgtgagaatacagcaagaaggctgccatctgcaaaccaggaagagagccctcaccaggactggcaccttgttctgggacttccaacctcaagacctgtgagaaaataaatttctgttgtttaagccaccagatctgcagtattttgttatgacaccccaaacaactaataaaattatttaaccagaatctcttctaggagtctatcctaaggaaataatcagtgaagcaggcaaggattgaggatgtagcctgcagcattagaggagtagttaaaaataacctcaatctctaacaatagatgtttggaaaagtacaaaatatatattgttgagtcttttgaaaccataaaatcaaatgttaaggcttatttaatggtgcagtggaataattgttatctaatattaatacaaaagtagagcaaactctatatcaatatgattcttattttgttaaattatttatcaagtatatccacatagagaaaagaaaaaaaggacgtacatcaaaaaatttttaaaaatcaactggacatggaatattatctctgatggtagtctttttctttttttcttttttttgaggtgtagtaaatcttcaacaatcatcctgtgttatttttacaataataaaatacattttctttttaaacaaaacctatgaatcttgcttccatcattagcttggaatagtctttaaagagagccttgtttcttcatgttatgcttatgtcctgcctgtaaagttttagagacattatctaggtcattcacctgcattcataaaacaatgtcataaagaagttttcactacaggatgctggcattgttattttgttggtaactcctgcatgatcttacctacaatctccaaacaattgggcatgtacctaggagttctataatagagcttagcaaaattcttgcttttgtctttaagacatatcagtccagttgggcgagatggctcatgcctgcaatcccaacactttaggaagctgagttgggaggattgcttgagctcaggagttcaggaccagcccagcccaggcaacatagcaagagctatttgctaactaaaatttttaaaatcaactgggcatggtggcatgctcctgtagtcccaggtactcgggaggctgaggtaggaggatcacttaagtccgggagggcaaggctgcagagagctctgatcacaccactgccctccagcctgggtgacacagcgagaccttgtctcaaaaaaataaaaaataaaataaggtatctcagtccaaaatcagatcagtttccttcgaatttcaaaaaaggaagtgaagtaaacatgattattttcttgaaaaagacaccacaaatataccaaaatggaaaatattttgtggaagagagaagaaatttactctagattgtttcagaagaaggaactagaatcaaagggtgaagccagaggaaggaagattttgatgcagaactgagaactcattaattagagattccttgcaaagtatgagtcccccattactggtggttaatagcaaacagatgaccatgtgtttgaaaggaagagaaaacagaaagattttaataaaaataaataggtttatttaaggtttaaataaaataaaagcttttttttatttttttacatctcccaagtctccatcattcacagaaagataatttctacattaaatttgaaccaaactgaaaggcagactagataatctttaaggcaaagtagctatatcatttttgtcccaactgagcacttttgagagaaaagaagtgataataattacaccgagacaggggctttcaggttaaactgaaatgtatggtcatcctactctagggtctcttccaactctttgacactaactaacctctatgttcctcaaccttaagtgtttaatccttgcttcgggggctaaactgtttcagcacctacctttgactggcttaattaaaatggtcagacattctggtgtataacaatctttctttgaatggctgaagcagagaggaggagaaatgccaaattcccccaataattggtccttggagaaaagagagaagtgagcacaggtaattggaagcctacaaggtacatggcactggcaaccccagaattattttgagctgcagttagcagcatacctaggtgattactacttggatatttcagtgtttcccaagtgtagctggaatgtgtggctctgattggttttccagctggaaatgttacagaaacaggaagatttctgctttcaagtgtcttgttgcatcctgcctctgcttggcagaagctctggtctgacagtcatgtacatctcttccgctgtgctttaggatggacatgagtaatttagggtgagctacagcaacactcacagaatcacccccacaacaaaaaaggccacccccaaatacaccctgtgtggttttactatggacaatcacagggccatcagctggaaacaggtggtagagaagattttaaaggtaggcttttgtagatacccattgatgtgatatgattttttcagggtccctgccttttctgaatatctcttcattggcctctcaaaagtaccatgggctaaggcatcatgctcttatatttcctattggaatgcataagcattttatcctagaagtaagacaggaattgacttgtgatcaatagtgtttatattcctgcacccagattagaaactctcccagggcagagagtctttttatatttttgtgtgttctcagggcttggcaaagagtagggggtaatggtggtggtataatagtgttgatagtaatcatcataatggctatctttttttaaaagagaagttgtttattataaacagaaagggcagggcttccaagagaagttaggagaattttgagagggaaagaaaccttgtaatgacccacagatgccatcaaatgcggacccagttaggactgcacagcaaataattttgagcagctggaaagcaccgggtctatgaatgagacttagtctatttctgctactacaacaaaataccttagacttggtaatttataaaaaacagaaatttgtttcttacagttctggaggctggggagtccaagataaaaacaccagcatttgctgtctggtaagtgcctttttgctgcaaactcacgtggcagaaagagcaaatgctgtgttctcacatgatggaaggacgaaaagggacaaacagattcccttaagcccttgtataagggcacgaatcccattcatgagggcagagtcttcatgatctaatcacctcctaaaggccccacccttaatattattgcagtaggaattcattctcaaattgaagtttggagggagaaagggaaagatctaaagtagattagaagcctctgaaacaaattaaatagagctgaagacaaaccatgcctggttagaagttttacctaaagcttgggaaacaaacagagagaacaaaggtgaccctatacctgaacagagaaccaggtcacattcccagaaaccaagaagatgagctctttctagagaggtttgtgtgtcaattaatgggtgattgatttaaactgcaaggagagatcatgtgttctaaggcatccttattaaactctggcaattgagcagcagggaagaacaaaatgtgcagattatctaaaagctaaatggtgatagcttcaactctttgtaccttcaagaaagccagtactttgaagttgttgtagcatcaatccagcatcaagctcctcaccacagtcaaaatcagagaatgtattctgtttttacagggcagcaaaatagatatttcacagcgactcttgacttgttaaactagcctcatctctaagctttccaaataacagccaataagacggcaacaacaaaagctcctggaatgaaaccaaactattgtttgaggagcaatgtccaggcctggacacctccctgggtactgagctgataaggacagtagtaacgaggcagctttcatattaagtatcagccagggcaggtacattctaggggtccaacgcacttcccaggtgcccagaagcacaccttcaagcaacttgaaataggtaggtaccctggggacctgagtactgctggcagactagcgaagctccagaaatagaacacgtgcaggcttctttctagcaaaggttatgggttgtccagaaaatccagcaggcaaggtaagaataacttggcataacaggtgctgtgggcagttacaaactgaagaataacctacatatgagtgtctactgaagaaagcacaatgtacctccctcctgatggaccagagatgttaccatcttcatgaaggatgccaatagctaataagcatcactaaacactgctttttccaatagaaaacactgtactaggagccaggagactttggctgcagtccccactttgccaccaacttgccctgtgagcctggacaagttacttttctcttaatttccatgcccgagcagtgagttaatgataccttcctttccggctccaattaagtattgatgacagggctgggtgcagtggttcatgcctatgatcccagcactttgggaggccaaggtgggaggaacacctgaggtcaggtgttggagaccagcctggccaacatggcaaaaccctgtctctactaaacatacaaaattagctgggtatggtggtgggatcctgtaatcccagctctcgggaggctgaggcaggagaatcacttgaacccgggaggtggacacacctttgtactccagcttgggcaacaagagtgaaactctgtatcaaaaaaaaaaaaaaaaagtcttgatcacaggagtattgaatgaaataatgtctgtgaaaattagacagtagaattcaaatgtaagtcattgttataattcaactgaagacagttttgtaggataaaagctaaactagtggaccaggtgcagtggctcacacctctaatcctagcactttaggaggccaaggccagtggatcgcttggccccaggagattgagacccgcctgggcaacatgatgaaaccccggctcaaaaaaaaatacacacaaaaaaaattggccaagcatggtggcacatgcctgtggtcccagctactccagagggtgaggtgggaggatcatctgagacagggaggtcaaggctgcagtgagccaggattgtgccactgcactccagcctgggtgacagagtgagaccctgtttaggaaacaaacaaacaactaaactaaataatagtgttatatgttgaaagaggcaaaacagaaaatccttgcaaatgtttctcaactaagaagacaacttcaaatcatttgtcttctaaatagtacctaatgccatgaaaagagcctgccaatgccttccaaacaatcctatttatcacttgaaaactcaggcgatgtggctggaattgatgagactgtttactctatgatttccatccctaccttccctccctaatacggtacacagaagtgggtgagtgtaactcctggcaaatgaatagacaggagtgccaaatcccaggaccagctactatcccctcacctccattcccctgtcccagaatcatacagactctgaaacttgcgtgttttcctataatcttcaacatgtgcactcatttctactcctcctttcataattgagtagtgaagaagataatttataaacactcatgcctccatggctccaaaaagaaatttgaagttccaaagaggcatggaggcagaacgtatttaaacataaccagggggtggtggtagaaagctgcaggcctcagaaggaatttacttgagactatgtgggctctgcctctacaaagtccagctgctgtgaactattcatttgttggcagaatttgcactgagtccatgggacaaacattttctctctagaagtttccctggattatctcttcaggctttatcatccatttataagattaaaaatcatatcacataaaacttgactctagaaatatgaaactaaccaatgttgtttttcaaaagttctctgaaaaataaaatggattatgcaggaaaattttgtaaatggaaaatattgcatattcagagtttgaggcaatccaggacattttaagccagaaagcagatggaataagagcaatataaattactgtaactgtattttgccaattgcaaagtgactctaatgccaaacagaacttcttctccccaacttgttgactgcatacgtatttgtttttaatttacacttggtagagtttggtgagatgtttggagttcgaatgatagaatctacaggtctagggaacaccaaatctagccaaaccacccacagagtatccaattaaggaaacaagcacataatgtacaaaaaggtattttcagtgaaaaataatattcatgcatgttatataagccaattaacaaaaactgtgcctgtagcaatttttaaggaatgtcttacaaataggaagtacgttaaatactgaacagaaggacaaaacttcatcagcagtccttcctggccttggtgctctcaacatgatctccagcctgtctcttagatgtcttggcagcttcccaaaggaagagtcttggcctctggtcgtcagactcagagaatcctgactttaatcctgactcaattcactctagaccatcaattcagggctcagtaagatttgtccaaattaccctgactggagtcaaataacgcagtcctgtgagaatctaaccagctaatttttgaaagaggagggagaggttgacacagatttttcactgcagtgcaaattgtagtaaagggacaatctgatgacttcttggtgaatctgtctctgcttcatattccagtaaggtgctcgggccttgagccatttccttgggctaggtttgagctaggatgtgatttcatcaacaggctatttttaaccaaggcagcctagaaaccagcctcaggggactcgtgctgagataaattcacacaaatcactccccagcccactgaccagcaagactcctgcttggacaagaaatcttgctccatagcctaaattatgacagccttgaattttcaaagcccaaattttcaatgacaagccactttagagtctgaatgataagaatggaatgaagatttcccctgcatctgcagtctctcctcccaaccacataaatacagggtagcacagaactgcatattcatgataaaacaaacaggcactacaaggtgtttgctgcattcttacattttttttaataggcaagacctctttactcttttacctctgccccaaacacatcttcatacccccttgcccagtttcaaatctcatgcactgccactatcgggtagaaagactcaggaatcagcatctggaaatacattaattttgcatgaaaatggaggatgatagcagaaattacaaagagactacacactagaagcatctgttcattacagcattttaacgtgcaattatggaacagcatgaagcagggtggatgaggaggagaaggagggtgcccagggaaggcgccctccaccccaggtgtgaagagggcaggcaactttggagggagctggaagagacaaaccagggaaatgaaactggcttaactcactcagatgtggaagagcatatgccctgataatgcaggtgaggtgagaggaattagaactccccgtccctaggaagcgcagcgtcggccttcattcagatctctacagcagtgagaaaggatgcaaggactattcttctggaatcccaggaaggaagactggaaagacaacacatctgacccagtacccatgtgcaagcactcggtctgtgccaagcaaatgcaaagatgcagactttcatacaatcatacactgtgatcatttatcaatctccttgaggattcatagtcaacacaatggcatagtttaccacaggcctctgcccttcagaactcaaccagtctcttggcagctgcttctagaatgggggttgggggtgcagtccaccacgagagctttgaggcaactgggcagcttcaggcacctcacggcttctccttctgagataattcccaccacaacaaacctgtatgcctacaggagtggcgaaggtagccaccatcccagaaataaatggtgcataccatcggggttaaacccagtgctgaagatttgtaaattccatttcctgcaaagtttctgggggagaaaagtgggtggggctgtagagtgcaaacataacaacattcacgtacctcagaggacggtggaaagaaatggctaataaaaattattacaaatcacttcacacacataaagtgctttataataaatactaatactttaattccacactgctcgtttctagattttaagagtcaagctgaaagagtaaaagtagtaagcttcatattctgtcgttttctagttttaagcaaaggaagaaaggaaggaaagagaaagaaagcccaagaagtcaacttttcagttgctgcttatgtaacaggagcctgtgaactgcaccagaaattaattgaaggaaaagtaactgtaggggaattgcttggagaactgccagaagggttttaacagctggaagttgaaaagtgattaattttgacagcaataaaagcctcatgttcatacataattatgcttagatttgtgggctgctggaattttttctatgcgctattaaccttttgctgtccaaattggaatttagataccttaaatgagtcttgatttttaaattgaataataatttgctttccatggtattgagtcatctcaagacatggaaagtttcaggggaaacacagtagaataacaagcaggtaggaaatagcttcacatatccttctgagtatttttgaaacttaatagaaataaaggcatctcattttgccctatgcaggaacaacaacaacagcaacaacaataaagcatttaggaaaaagcattcagaacaagcaggacaagatactgaagcaacggtatgttgtcaactctacaattcagctgaattcatagcactaggaaatagagataacactgtaagaagatattcattatggtttaaaggtcccctctaaaattcatgttgaaaacttaatcccgaatgtggcagtattgagaggtgacccctttaaaaggtgattggagcatgagggtagagccattcgtgcattaatggattttcaggttaatggattaatgggttattatgggagtaggactggtggttttatagaaagaggaagagagacgtgagccagcatgctcagcgccttcaccatgtgatgccctgtgccaccttggaactctgcagggtctcagcaagaaggctctcaccagatataacccctcaaccttggacttccccatcttcggaactataaaaaattaattgtgtttcttataaattatccagtctcagatattcttttatgagcaaaagaaagtggactaagaaaatataatgctacattcaaaaatattgactagcataggattaaactgagttctagaactccagtacggctaattagctacaaaagcttaaacacatcacttaatttctctgtgacttctctgtttcctgcataggaagagagggctggagtagataatttagaagatcacactcactctaaaatccaattattttaaataatctgttttgggattagccatattctgactttttttctcttagtcacctttactattcttatatcaaccagtttgaccagatagagtgaaatcttggtaatataaaatattttcaaaataattagaaatagctaatatttagtaacaataattgcagtttgcaaagcactattctaagaactttataaatatttgatgtatatacctatatatctataatattatatgtcaatcctcacaaccatcatatcagagaggattgttatcctattattacaagtattactatttttcccactttacagaaactgaaacagtagagtggttacatgacttcccaaagtcgattaataccaagtgggaatgcaaagatttggggagtttcctattattcctaagaaaatatatgttattgtagacacagtaaatttatgtcatgaatggtggaacagaaataagaacaatgaacctgaactcaaaagaactagatttagccttggccctttcattttctgcactgttaccttgaacagttcaactttccattccagtttccttacttgtaaagtacaggagtcatctaaatcagtggctctcaagatgtggtagccaaaccagtgacatcgctattatatgggaactggttagcaatgcaaattcttggatccaacccaattaagttcttaattctcggataggtcccagacctaccaaattatagttcctgggcattagggtccagcagtctctattttgacaagcccaccaggtgatcacaatgcatgctaaagtttggaaaccagtggcctaggtgatcactaaattaccttctgattctcacattctgtgattccatctctgactgtctggtttcaggtcgttgaatttcaaactgatgtggttttgctctatttaaatacctcttccctgattctttgtgccagaggatgggatacctaatgttggctcactggaatgattttttctttagtcatcatctgagcattgcagaagaatgaggttactgtgaatgctttcttacctcaagcaaaagtataagattgaattccaaagccagagcctcaacagaatctgagttcttaatccaatgccatgccccacatgggggcttaataaatccttgttgctgcctgaggcaaacgacatccaagctatgattagcagcctgaaggagctggcatgtgtttgctcccatattcccaaatgtgccaaaatcagacctgcctgtctcctccaagtcaagagggaggcacctatggatagaatgtccaatttacctcttaatttaatgctcccattgccatagtgttacctgacaaatacaactcacttgaaatcagaagcctggacaaacaaacaattccaaaggtattcacatttatttgaggcccgattttaaatgggccttcaccttgttctctttcagtaaccacctgctcttcagcagtggcagaggaacacctccaggtttcagggccaaccatgatatgaatgcccaatgcctcatacttaataaaccctcctgtaaaagcagaacaccaggtgactgcataccatgatatacaatactataaacagcagaagagcaaagactggtgtctctgcttcctttgtatttctcatgacacctcattaacataagccattgtttgctggttttcttaaaaagatacaactagaagaaagaagcagaaatgcaaattccattggatttcaaaattttctgagaaaaaatagaaacttaggaaagaataatatattgaaaggaaagatgggcacataaagaaatataaacttgttaggagttatagttatgaagcaggtggagtttcactctttagagccaaataagtctaagacacatggggaataactctactcttgttttatgtgagtggaaaaccataaatatttattctaggccatcccagagactaacaattttacatttggccataataaatatgagaagggctaaaaaaatttacaaaccatttcccaatccaaggttacttcaaatgatatgttagcaaatgcattacattcttttattaaaaataatctaggtataattttccaatttgatacctgtatattgtgatagctgcaaaaagaagtcaagctgatattttgggatttattctggactatcaggcacaatctattaagtaggtgctattattgtctctatcttacagatggagaaactgaggcacagagaggctaacacagccaaagttacaaaactaactagcaaataaaatagcttagattcaaaaccaggaactctgtctccagagtttatgctccttgatactcatgtcactcttgttttatttattctgtgtatcacttaggaatgctttggtggcaagtaacagaaaactcaactgagagtgactcttaaaaataggaattcatgtggtcagatgtcatagctcacgcctgttatcccagcactttgggaggccgagatgggcagatcacctgaggtcaggagttgggaccagcctgaccaacatggtgaaacccagtctttactaaaaatagaaaaattagccaggcatagtggtgcatgcctgtaatcccagctacttgagaggctgaggcaggagaattgcttgaacccagaaagtggaggttgcagtgagctgagattgcaccactgcactccagcctggatgacagagggagactccatctcaaaaaaaaaaaaaaaaaaaaaaagcaggaattcatttttctcgctaagcagcaagtatggagaaaagcaactgctgggggttcagttgctctctatgccctcagggacccaggtactctcaattccactgatcaatcatcttagaatcctcacgcctacaatgtcatggtccctgctgttctagatggtacctccccattccagggaggtagaaggtgtagtccccccgccttcttgggggactttgtctttttccatttgggaaactacactcacctcactggactgtcctttacatctcactagccaaaacaggatcacacactcattcttcacccaacgaaaggccaagcaaagtgagatgatggttactggttttaactaatcatgctttattttgggggcttggaaaggaagctgaaactaatgagcctctacccagctcctgaataaattagactttttttagtgagaaaggagagtgggcaggaaggggaatgagtgttggatgacaatagacagtgtctgctgcactcccctactttggatatttggttgctctttattgttcaatacctgattcccttgaactgtgggaaggcactgtgctaacaagtgggaataaagacaaaaaccataatctctatatggttataaattgctgaaaggcttcatttgagagaaccaattgcatacccaattttaaacaaagaggtgaaagaacttaagtgacatatggctgagttggcaaatggctgtcaacagaatccaagaggccttaccttggctttgagtacacaataggtgagacaaaacaagccccaaggtactcagactgtaaaatgacagaaaggacaagccttgtgtatgtgcttaaaaatagagtgtacattcagtattctcatagcattaagcatacagagttggtttatacccacaagtaatcacagtataatctaaatttctccaggccttacctgctgctgggtatagatagaatcatgcaaaagtaatgactcaaacttccctggcacatgtctgtgccagcccctgctttgtgtttctgggagtccccatgaagtccacaaaagtacacacaaactgtcccaagcccactggggttgcccctgctctggcttgacccagagctacataatggcttggatcagagctggaggagcaactccctctccttcacgtacccactgtcacaagggtctgaaaacagtgcagctagcacctcctctctccctaggacccaaacatgtggccacagagctgggctgggcacagattcaagtgacagtgactgtgatcaactcagtatctcttctcttcctcaaatatcacagcttgccgttgcatcaaatcatcttgtctggctctttttcccttaggacaactgactaatcacctctgtcctaggaacttattcttaggaagtagccagacacatggccaaaaatatgcattaaagagtcaattacagagctcttaataatggttaagaaaaaaaaataaccttaattttatcagtaggagactggttaaatgaattacagcatattcattttgaaaaataataagcattcatttaaaatgatgaggtacatctacatttactgacgtggaaagatatgatatattgttgaactgggaagaaagtatgatctcatttttataaaaatataagtaaacacatgctcacatgaatgtatgtgcattaatgtgtgcacacacacaaagaaaaatagaagttatctttggacaacaagataagggcatttttgccgttttctttatatctttctgaaaaataggaatgtttttacaagaagtatgaattgctttcataatcataaaaagataaagccatatctattttgaaatataattattttaataaaataggctttagtaattgatccattctttagggtgaaattgtggaggggtataaaatctccatttagcaatatcttttaatagaaggaaggtctaatcatttactggaaattcctgggtaatgtgcaggaaaaccaaccttgacagaaagatgattggtactggacagctcctgaaaaatacagtgaggctggggagaagggcagtgccccaacagcgctattcctggaagcccaagaaatcacaatttctgggaaaaaaaaaaaaaaaaagtatgcagagcaaagcaaacacatgggttgctgtattttgtggttgcctctttttcgccttggctcattttttctattggttatttttttctaactgattagtaaaagctcaaagcttaacaacacctggcatttacatcacattttttccctctatttgtttgcctttcaagatttttgtgaaattttatgacacatagaagttctcattgtttgtgtgataaagtataacagtcatcttttttttttaatgattcttggctttggtatcttgcttggaaacgctttttctaccccccaaaacaccaaaattattcactcatattttatttaacctatacatttttatcttttataattgttaaaaggaaaattacagataaattaaatttaacagagtttaactgagcaaagaacggtttgcaaataggcacctcccccaccaccagaatagactcagagacactccagcgctgcatgtgatcaaagagaatttacagacagaaaaaaaaagtgatgctagaaacagcctgattggttacagctctgtgtttgccttatttgaacctggtttgaactatcagctgcctttggttggctaaagcttggcgatttgtatgagtaggttgcagtctgtttacacatccagctgggtttcagttcactatatatggaggaaactttagaccaaaagtctcatatgtaaggagacagctttgggctaaacttaatttaacataattattaaattgatcgaatttgtgtgtgtgtgtgtcatgtatgaggtagtgatataaatggtttgtaccaattggttgatcattcttcccaacaccatttatagatttatccagtcttttttttactgattagaaataatatttttttttttttttttttttgagacggagtctcgctctttcaacccaggcggggctgcagcggcgctatcactgctcactgcaagctccgcctcccgggttcacgccattctcctgcctcaggctcctgagtagctgggattacaggcgcccgccaccgcgcccagctagttttttgtatttttagtagagacggggtttcaccgtgttagccaagatggtctcgatctcctgacctcgtgatccacccgcctcggccttccaaagtgctgggattacaggcgtaagccaccgcgcccggccttattgtataccaaaacaacacaaatacacaagggtacatacatacatagccttgggtatgttctggacttaaattgttgagttccattagcccacctgcctattcctgagctgatactatatacattacaatcattatgaatttaagatggttttaattttctgataaggcaaaaagacaccctcattattattcttttcaaaaatatattagctattcttaaatgatcattcttctgaataatttagaattatgtggtcaaattccaaataaaatgccattaagatttttattgggatggcattaaattatagattaatctatagaaaaaaacttaatattttcaataggaagccttctctttagtctcacattaggattttgtaagtttcttcctattcttccttgatgtttcttggtaggtttgtgaaaagttgattttctctggcccttctcaccccttgtctggtcacatgcagtgtgttggaatctctttatcagatttacagttgtaggacaggtttgtatatctatagctctcaggcaaagtttcacttcccacagactttccttcagttttcttgaggtggtaccttcccctgacctccactatctggtttctggttccagagaaacaatttaatcattctcatttccagcatgctctgcttcctgggagtttatttatttcctgccacaatgcttacatcataaagactacaactcattgtactggtttgtttattttttttttttctgcataacaaatgaccacagacttagcaacttaaaacaacacacatttattatctcacagtttctgcggggcaggagtctgaagatggcctagcttggtcctctgctcggagtctcacaagggtgctatcaagatgttggctggctgcatttctttctgggtcttgagatcctcttcaaagctcagggggttgctggcagaattcagtttcttgcagctgtagaatgcaggtccctgctttcttgctggctgtcagccagggctgctctcggcatctacaggccccctctgttccttgcatgtggccctctcccaggtccactcatgatatgtcagcctacttcttcaaggccagcaaaagaatctcttgttagggcccactaggacaattcttagataatgtaacataatcacaggagtgacatccatcaccttcacggtactcaactggctagaagccagtcacaatttccactcattctcaaggggaagggattattcaagggtgtatccaccccactcaggccttggaccattgtcagcacaccactacttcctgatcaccttttttctgagatttggggtcttggcctaaatatgacagggtggcagcctgagtggggacaagaggcagagggcaggtggctgtgggagaaacgtatagagaggcactctgctctcctcacagaactggacagttttctgtttgatataggcaccaggtcttcaaatgggggaggcaaagtagaggtatgacatatgaggaaagctacaccggttattctcggttctctccatctggcttagaattattgtcagtttcttcaaaatgctggaatttggttgttagtcatttttcagtgttgtacattttatcttttttaaaaatctctttgtatatatgttagtgagaagttagggaaaatggctagcttcctgatgctttgaaccagagtttcaaccaagccagtttctggcaggcttctgcttctgtcttcttgagatggcaccatgccttggtttctagttctttcgaagcaagtgcaaaattgagaacaacacattttataagaactttcttggttctgttgtgctacctcagggaaaccaaagagatagctaatctataccttgctcaggaagctgtgggtatcagaaatgtatctgcagtactggtagtcatttcatcctcccaataacctagtgaagtacatattattatctcacttgatggaagtggaaacagaggctttgactaaacaaataactttcccgttttcgcacaactcaaatcacaggttgcctaactccatagttctttctatcacattatactttcagggtgggggaatgtcttctgaaatattgagaggcatttaataataatcaacaagtttcttccaatcttcattcagcctacaacctcacaaccctaatgtatatctttctgaaatagggagttttttcacagtaaaaatggacagcattctttttcctgtcattactccataccgcctttgccccacaaattttacaacctgaaaaacaaagcaagcaaagtcaattattgagagatctggtaagcacacagagcggctcaaactcaaggtttttattcagccgcactcaaataccttgtctcatgtatcccagaagcaagccacactaagcaggggtataagccagtcagagggaaactcccttctctcttttgggaagctctgacaaaagtctccagggggcactgcaaccagctgggggaagtcttagtctgtttgggctactgcaacaaagtgccatagactgggtggcttagaaacaacaaacatctatttctcagttatggaggctggaaagtccgagatcaaggcttgggcagatttagtgtctggtgaggacctgtttgctggctcatacatgacctcttccagctgtgtcctaatatgatggaaggaacaaagacgctcccttgggcctacttcataaggccaggccttggtgacctaatcacctcccacaaggccccacctcctcacagggggttaggatttcaacatgtgaattttgaaaggacacaaacgttcagaccatagcaggggaggacacaggtgcaacagtcagagttcctgggtgctagagtcagagatcctgaggctgggtgcctgccagctgcctccagggaaaggtcatgtgatgggtggtgggactctaacagacacacaccaggagtaaattcctaaacagcaggtgatacagaaactgagggagatgtcttgcaaaacgagaccacacagcatgccagcaggtggaggtatagacccccatgtctcccagtccccatgaaaatatacagctgctgctgaccacaaacccatccccccagctgcccgagctgcatacctgcctgctaactaggtgcaagtaactactgaaaccaacctcagcacattcctaagtgtttataggtcataaaaggtctatttctcatgcttagtaccctcattaggcccaagttttaggcctaccttgggtccattcccgcagcaatcttgggcaagtcataagatcttgcccattatcagtttcctgtaatacagtagttctcaaaatgtggtcccccagccggcaacatcagtaccttatgagaacttcttagaagtgcaaattcttggactccaccccagacctactgaatcagaaactctgggtatggaacagaaggatctgttttgacaagtcctccaggtcattccgatgcatgttaatgtgggaaccaccgctccctccaatacctcatagaattgtgagaattaaataagataatacattctgttctgctaccgtttccgtgtatgaattagcccatcagagattgatcacagagaaatgacatcagtataatgtgaaaattgcactggtttccataatttcgtaggtaatttttactaaccaagaagtcctgagatagcaggagtagaaccataacgttcaatgggaaggaaaaggcttgaggtttggctgctgtaccagcagcagaaatctttttgctgtattccaggaaatgtttaaatgagtacctgccaccagggctacctcctcaggtaggtgcacctccagccttgtgagctctcagcttgtggaaggttgtctggcttcctgtgtgcaccttaacaacagccctgtgactccaagctacatttccatcgccctgtcccagcccctgccagtgtcagtctaattaaaatgttaccagcttttcatctttattgcttttgtgcattttaatacccgtgtggcagcctctagcccctcagctgctgccaaggtggtccaaatgatctccccaggtagtagtgattgctttccttaatcacagttgcatgggatttgaatggtctgccttggcccaacttttcccataagtcctattattttttatgccaagttttgcagacagcaacattttctagaaagtgtaattttaggttacagcagaaatgcctgtatatgtaaattacctggcacatagtaagggctcagtcattattattattagttcatgtctaccataccttgtccttgaaatgctgacaaaaaaaaaaaaaaatgagccaagaaaaccctacagtgacaattccagtacaagagcaaaggaacacaacttcatatagcaggttttgataatgaaaggcagaagttcttattctcttttgccaatatttttaatgacagtcatttgaagcaattcctcctgtgttttttgttttttcccagtttgagtagcttttttttttgacatggggatattttatctactcctatgtacttaaatctttaatgacattccatctctttctttttgactttagaaaatcagacacttattcttagaaatagccaggtggagagtaattatcttggccataattctctgatgtttacagaatatggcactcagacttgaaatctctgatggcctttgctggaagggatttcagcctcctcgtccgacatgaatgggaattgaggtctggctcaaggtcagacagcagaatagtctggccatgaaagccagccaggtgtcctggcttctaattcagtattccagctcttaatgtttactctctagttatgttctgcttcatgaggtcacttctaaattgtttcctcaaacctggggtcacagaccagtggtctgtaggtcaaattcagcccacagacatgttttatttgcccgtgtcgtatatcttaacaattgagaaatttcacatttaaaaaaatgtcttgcttcacttgaaaattcagaacatctggcacctctgagccactattcccacacggcaacaatcagcccagctgaagagcaccttcccctttcaaccgggatgagctcactcaaaactgccggggtccccccaactccccattgcttgacgtgcatgcacacacctttctgtattagtttgctagggctgctgtagccaagcaccacagattctgtggcttcaacagctgaaatttatttcctcacaattctggcggctagaagtccaagatcaaggtgtcgccagggttgatttcattctgaggcctctctccttggcttatagatggccctcttctccccgtgtcttcatatggtcttccctctgtgcgtgcctgcatccaaattccctcttcttataaggatatcagttatacagactggggcctacccaaagaatctccattaacataattacctctttcaagaccctatctccaaatgcagtcatattctgaggtactaggtttaggactttaacatgtgaatttggaggagacacactcagcccatgacacagtcattcctcctttagattacctgcttgatcccaaaggcatttgaatctgcaactgtgacaaacagcaaaccttggtttgttcttgaacaactcaaaccttcatgtcttctttcatcaattaaacagctcctctatgaagtaccttaataatgaaacccgaagtacacttagaagagacataaaattttaaagacaggaagaacctcagagactatctcctccaggggttttcaaaccattttaagtcatggaaacttctaacaaaagttaacaaggaattgataagtaaaatagctaaactccactcctgtttgccaaaatagctactaagggagctccagaagacactgggcctccctatataaaaatcatttgaaaaccactgatctaatcaaattatttggtttatatctgaggaacctaagggccttccacacagccatggccacacagagctgggagcagaaccaaatcctctgtctcctgcttcctatggctccgggtctctatatggttccaaccaggatctgcacaaggttgattgaataatacttttaggttggtgtaaaagtaattgtagtttttgacactacttttaacagctaaaagcacaattacttttgcatcaaccaatatcatcaggataggaaaatcctgactttttgttggtgagaggaacaagctggagctgaagtctaggagtcaggaggcccaggttctaactgtgtgttgtccattctagctgtataacactgaggacaaaggattttacccctctgttcctcttcatattcagcacacaaagggtttgactctatgaattctaatatatcttccaatattaaaatactaggatcctggaatgttacccttatagtaattatgctctcctttacttatgctctattgatgtaaaaggaccatgataacttttgccccaagaggcatgtataccagcaatgggcaggctcagcctccccacacacagagatcccccgggccctgcctgctgacaaccaaggccacctaaacatccatactccggcttgttatcatagaaaagaaaaaagagaaaaattaaaaagaccttccccagaagaggtaaagccatgtggcccactctttggtcagtaatataaaccaaacattttgcaccacagggaaagtggaagcaaaagagtaggaagaattgctatgctgtttgggaactgtaattacatgactccaaagtggaaatggcaggaatttgttctgcaaccaacattctagtaacaacaagcatattacttcatgaggttgcctgccatggagcatactaattttcacaagtaattagcatctcattttgagccaaaatctatgaccctcaaacatccaaactttggttaccaccaacacccatgtcctcttcctcttcatggacacacagctggactaccttttccaggctctcttgcagttggctggagccagagaactgcgtcctcaccagtggaatgtaggccaggtgttacgcgtctcaccaggcttggtccataatatcctcccacatgtgatccttgctctttcctcatatgccagttgaatgcaagggactttggaggcagggaggagggcaaggcccaagatgaggaaacctagatccctgaatgactgtgtggaacagagacacacccccacccccatcctccctgtgatgtgcacaagaaataaatgtttattttgtttagtgattgaaatttgagaggcatcagtttcagcaactagcattattaactttaacgcgtgtatcttttgaagtaagacaagcctactacttcttgtctcacttactagacttgatatattttaagatagctctcatctaaaggtgataagaagacaatctcttgactctcttctcccttagtacttctcctcttttgtccttccccaattcaagaaattccccaatgtaaaatcctgagcccattgtatcagggaaggagtttgcatgggaggaacactgagagtctctttctccctaacatttattaaaaacctaagcccttggtattaatagatcagagagaattcccaacaaaatcagaatatttgagacaactgtcatcagtgacagaagtgagactgaggggactagagtttctccgcccccatggtgaaaaaatattccatagtcccaacagtctttctcaaccaaactgccacagtagaattaagccttaatgcccattgtatcaaatgaattaacttctataatagagtgatacttatttatcatccttgggagaatttttaaaaaatatttctgagttacatggtttagatgagaaaggctggctggaggaaaggagaaaggaaaaaagaaagtgaaagcatcaaagaatcctggacagcaaagggaaaggtgccagggagccagcagaatgccaaggccatgcggcgaaggaacttggccttgttgagctggtagagcccagggaggtagcaagacccaggggagggaccttcttctgaccaaggaggtgcatcttaggcactttcttctggcccaggaggctttgaatcagtgacagcaccattctggaaggagcaaggctggctgaaaggagatccctccaagctgtaacctgcaggaccaactattaagaattctctgggtcagggaacatcttcatgaatacctttgaatgaaactcaggacttcctaaaatttccatgtctttttctttcacctgtcaggcagggtattcagaaggcctaaaatgattaggccagatactgttcagtcaatgttttccaactgtaacataattaagaatatgagctgttttctctccatgttgacaaataactccaagataccagcacagtccttcttccagtgcaaactcagtctttggacctcctggaagacttccccagaccaccactgtactgacaggctgtgtttgttcctttatttgacatttggccagggggatgtccttccttaatgaaatcagagtctggaactttacccaaatattaggttggtgtaaaagtaattgcagtttttgccattgctttcaatggcaatgtagcaattctgtaataataggtcatgaaaagaggaggctcaccacaggggctcctgagaagacattgattaccaaggggagggctggcaagcatattgttgggaggaaatatttagtgagcaggtgaaaaataatgaattaaaaattttaaacttttcttagcaaaagaagatatttaataagtataaagtgttaaagctgagaattaaagtaatattcactaaagagtacacagcaaacataaaaaatataattacatctataacttgagaaatattcatgtgttattttaacctggggctttgcattttaagtgagaggaaagaaaacagatcaacccaaattactgaaggccctggaaggaagattaaaggaattgagatggctttattttggtgataagaaagccaagggagggctaaatagctgttttcaaatattttaaaggttagtcccaagatacaggcctgctgagctcagcccctggcctttcccaattcagagcccttgaactcagcagctaacaaagaactgctgtcttaagtggaaagtagagtcagaagctctcccatcctccccaagagcttccttctgggctttggctctccagatgggttactcacactcctatccctccacctcatccattaagttagaaaattgctgactccccaaaccattctccccaaccagtccctggggccttactgtgtctaacaccccactaagctgctcctcagtcctcctgcctctgccttactgtggcttctcgtaacttctttcttatagcttttcaatagccatctaatggacctccctgactcagcttccccatcctcccacaacagtccatttccacactgccccagagctcccatccaaaacacagatttgatgatgtcactagcataaataccagcaatagactttctgcaggcttagattttcataatgaaaggtatttttacagtatctgccttggctccttttttcatccaatcccgttagcactgctctcaagcccctttccaaagtgactcattcaacctgtcccctctcatttgccccacccacccgcactgaagactctgcttcggccacattagacactcacaattccttgaacatcctcatgctccgctgcctttcttcttgcaaattcctgtgcctgaaatgtccatgcttatctcctccatgtggaagaatctgagtcatctttcacaaccctggccaaaaaacacctctcttatgcctccctgcatctgggcagaggttgtgacttcctcctgtggttcccacaatgcttggttctgaagtagcacttgtcacatattataattttttgtgtgcatttctgtctttcccattcaactgtcaacttcttaaaaggaagaaccatatcttatttatttgggttttcttctattactattatataatatttcctctattactactacatactattacacagtatctggtgtttagtacatgtttgatcattgttgaatgaaaaaataagctcccagttcaggttctcttctagtttacctaccatagccagcctggccaggagctaggagtgttcagcttggagccagaggcaggatcccaggagcaggttaagaggaagtgattgacaactgcccgcaatggctcctgctgggcacattttacatcccagggtctggatcaaagctgtcagtttctgccctgtctgttcctaagtgtcataactggagcaaaactccttcatcagccagtctggccacatcacagacacgtgggttggacagcagaggctgcctggctcttttcaggttcctatggatacagtgtctcccttgacccactgaattcatctgtgtgggcagctgccacttctggactacaaatacacagtaagcaggcgtgtaggagagcaagaatagggtagaaagagcacgtaggaggaggggaagaaagaactgagagagagcctatgggtagaagtgggcaggaaggaaggtttggtctttttgttcctacagaagatgtttttgaaaagcttcttgacaatcaaacagacttttgaaaaaagttacttttgctaaatataaagtgtgaaaatcaccagtggaagattgcctccctttctgcagccagggcagagctcttgggtgtattttgatcagtaacttctagacacatccttcacaaccacaactaggcagccaagcattctgacatgtgcttaactaagaagcaaattaggcagccaatttgtaaaaatgtaatatggcgtcctttctcccttctgcttatttcattgataaacacacattcatgcacattgatgtacatagtaataataatattagtttacatggctgactctacagtttctgtagagcttttgcttagagcttcacaataaatgaagcaggcaaactgcattgattagatagtccatggtttccgagttactcagtagaggtgcagtctagactcaaaccccggactccagcttccaagaataggcacactcattcccacacccaaaccccccacccccattccatgcctggctgctggctaagccacaggctgctccacagttggagtgtaagggataaagaaagaggaaatgaatggtttaagttgggaagggcatcttgacaaagttgttagagtctaccagttttttcaaaccccacattagagtacagcaaataaatgcatgtctaatcatcactccaccggcttctaacttttttgctcatcactttctctgaatttatacatggaagacttttgaatgtggttcctacactgaaccaatctccaaaattaaggttatggcttctgtccccatgggggcctgtaagttgaggtccatatggcagcctatgatggctatcccctccccatgagccacaggatgtctctgggcacaacacaatgcctccttttcaaccgcattttatcagtttctcaaatatctgtatttgtgggccaagtgatgacaatacactacatttatagaacattacagtctctggagagccttctgttttatacaccctacccactacaccctcccaccataggattccctccctggccatgaggctgataggacagatatcaccattttaattttacagattcagatatagatatatatatattgagacagagtcttgctctgtcaccaggctagagtgcagtggtgtgatcttggctcactgcaacctgtgcctcccgggttcaagcaattctcctgcctcagcctcccaagtagctgggactgtaggcacatgccagcacgcccagctaatttttgtatttttagtagagatggggtttcaccacgttggccaggatggtctcaatctcttgacattgtgatccacccacctcagcctcccaaagtgttgggattacaggcatgagccagggcgcctggccgcctggctatatatttttttgtcaagctctaattccacagttgactgaactaaatgatatttagttcaggacccaggtaactaaccaaaatttaagagagaaattatttgaaattgagaaaaaatatttgactcttaatgctgttaaacatgatatgactaactcccactctacaatgttcttccagttttcccatccatggactctgccaccaagcaaagaagaggatttacatatgaccaacttcagcagagcaaatggagaaattatatggctgtgttccagccctggctggttacatattttatattttatagctatttctctgtcagaattataaatcaaccacacacacaaaaaggtctaatttaaaatggggcatatcagaaaatcacaactcagcaaaatatggcattttcctgacaaatactgcataactaaactatatatgcacattctggttttagagactgtccaaactacagggtgatttgggacttcagttcctcatccctgcatgctggacggatttcaagaagataattaaagtcgacggtacctggtatatgaaatcaaacacccatcctctactccctgggtttggaagatcaaagataataagcctgtcataaactaaggcaaagggccaccagggagtgacaaatccctatcaggtttaaattttgtcagaacagtcagtgtagaaatagagttggtgaacatgccaaccctccctgtaacctagtctgagcagcactgaaggaaaactggccaggcctttcaacatgttggcaaaagccaccccctgacatcctggaaaagagcagagaatgggagaaatgtgctggagagcagagctcatctgtccagccagcactcaacttaactgtggccagaacctgccattggatatttccatgcagttattaataagctctacacaaaaactacctggaggctgaatctgactctgggatttggtgttaaataccagagggtatacagtgtcctgccaaggataaattttataaccctacattcctttactggtgatttatattcctttccttatcaggttagaaagaggtaagggtacaatcaacggattccttatcaaatcaaaagtcctaaggtctggaatatgttattgaacttgtgaacaaaagacattctaggatttgagatatcaattcaacttgtttcttgcaccattatgataaaaaggagaattctttgtagtttattatctcacatctacattatcttaatttatcttcccaactctgcaaagcaagcagagctgatattctgtttgagagtgtgtggatatgaaattgaagatcagggcctgaatagcttctcaggttcccatagccatttccagagctgtctcatgttttctgaccccaagtccaagttctctccaacacagtctttcccgggcagattataggggttctacccacttcaacagcaggtcttcaaataatgtttcattcaatattatttcgttataacattgatgagaaggaaaaaaatagatttctccccagagccgctgtctttgtggagtttgcatgctctccccgtatctgtgtgagttctctctgggtcctgcagtttcctcctatatcccaaagatatgcacattcagttcattggtgtgtctaaattgtccctgagtgagtgtgggtgggtgagtgagtgcaccctgtaatgggaaagtgtcctgttcagggttggtgtctgccctgtgccccaagctgctgggataggctctggccactgtcgaccctgaactggaataagcagttgaacaattatcttgcttgtttgtattaatcttaaatctatgtataactcaaatttatttcaatgcttaatatccaaagtatattggtgtttatttggaagttcgatgttttgagaccaaaaatatgctgtaggaacttaactcttgtttatatcatttagcctatggtaaaattggtttcgtcatacactattttgcttatagttgcagtttccaagaacctatcaacagtgttaagtgaggacttactgtattgctatcttaatagtccctggtatgagcaatttatcacatagatgaaactcctttataaagaggtacttttagcaatttgacagctgaaatccttcaggtggatccaaaaggtacccatctggtattgcattctgttctttctataatggtctagagtaagtttattttaatagtttaactataaaatatattcacattcattattaatacatggtttatgcctttaaaacaattagtctaaggcctttgaacaaaatttaaaacattttaaaagcatcttttaaggaacagtttgcattgtttattcagttcaaaaaatattcattgagcacctatcaagcattgtctagggcagtaagaaggcagaagtggtcaagacaaggaccctcctctaaagagcttaaaccagagagaggaagtcaaataagaaaaaataaataaatgcatgtattgctctaagaactaaattggaacaagggcagagggatccagaagcagagaaagggcacttgatccagtttcagagaaggctttccaggggaaataacatcaatgccaatagtttgggagaacagagtgttgtaacatgtttccagcctcatgtgtacctccagggccgctggggagctctgacgaatatttaaacgcacatgtcctttcccactgctttgctttacccactctactcctttagccagaaaacctcctcttgaattttattcctatatcatcttcatcatccttcacagctcagctttaatgtggtgtcttctcagaagctttccttgaccatatttgaagaaactgaactaaagctaatctgaaaagcttgtaaatgcaagactcaagttctattacattgcccttgatcattcagaaattctaagcccctcagctaaatttagtcattaaaagatcactgtccattctttaatgttttaagaataagttgtactatttcctagttgactgttagtggagcctacagggggaaatcatggccattcctaaatttctccaaggcttgtgttattgcggcatcttggtctccagctgaagcccttggggaaagagataaagttgccccttctgttccactggatcccagcttgggtacgtcaggcagcttaaagggtgaccaccatcagaatccttggtcaactggtggcagtttggggtgaaaacatgtcaaaattacattgcaatttttttactctaaaattacatagtggttcctttgaccatcagtaaatctttacaaatgggaccaaaacaactttctttggagacaccatgggactaaagaaagagacaatattcctattatagaattttgcaaactctccggatgtcctaacaataagttacagatgtttaatcctaaattaagaagctaaatataatgtggactttacaaatggcaattttctataatttgaggaaaatatctggtagctcagttcccactagaaatgtttggcaatggttctgctctctgttaaacatctctggtatgatttcctaaggacagaatcatagcagaagacaacagattttttttttttttaaagaaaaacaacatagaattgatcaagaaactataatttgaattttcctctgggcatgtgggtattgttttataactgagagaagcattaaaatatcaagggaactacattcatatttgtattaattctattgaatcatttcttggcttatcatattttgtgttattgccttgttctcctttgttttgaaaagaaactttatcagttttcctgtgtcatgccattttatctcttcactctgcctgcaataagatatcagcctaatattggcagagcaactccgtacaatgatcctttgttctgggaaaaaaaattgcatgaatagtatattattaaaatagagaaggaagtgtgtttcatttgttatttatttagtgaatattgtcatggtaccaggtgctttacaaaagacaaataagtgaagcaataatacggtgcacttggatcttgcatttaatgtaaggatctctgagtacttaccaaacactgactcataaatcaactcacttcagataggatgtaaaggttgctttaaatctacagtcaactttgcagaacctgctgtaaaaaatgctccacggcaccaagcactgtacagcctgccttgccgcatctctgatacctctgaggacacagggaaagatgaaatcacaatgggagtggggctatgagagatggtgggtgaattttgaagaaaggaagctagaaaaaaaaatggtaacaaatagaagagaatctgggaaactgaaagctaaagcagtgaatttcatagacaactgacagataacttcaggttctaaacaaatgcaaacttgacagctgtcagagtaaatattttattgaccttagatttggctcttatctttgtctaacacattcgtgacttctgaagttggtttcttctgcacaggagaaaatttctcgaaatttttcaagatatgaatagactggattgtatttttctagtcacaaagctgaaatctgctctatccttaataattatcacgtagaatttgctgcataccatcttgatgtgaaagttgaaattaggaaaatcttaccaactcagatcacactaaattctgaatctgtcggaagatagccagaaatctgtagaagactacgcttctgagatttttcaggtaatgcccaagcagggttacagctgtgacacagcagaggccaaaggcaacagacagcaaccattcaggtatccctgacatccctctgcaggccttcacagagagtcaaaactcaatatttcaaaatgtatgctttttctctcggaagagtttggtgagccctataatcagaaagaaaacagacagcagagggccggcagccaggtcttccaattactatttcaaaatcaggaaccagagaccatgcctgtgcagaggatctcagcttgagcctgggttttctgccatccatttgcagggtccaggcctctcttggcttaggctggtggcttgggccagatggaagtctagtgcatggggaatgagcagcctcttgggaacaagccagcattgcacctgctgctgggaagtgtgtgatctgggcacattacagtctagtggagtaccaggcaaaattccactctcagggaagacgcaggtacccccaggagacagctcattataagagaggaagaagccaggaatagggctgagtaacgaagtcttagaattcaaagagggtgtaggaggggtctacatggagcaagtggtctctactcaatgcccagcccaatcccttagaccacatgcttaggtcctagggagaggcaccataacaaaacttgagtagctgtttcaatagatgttttagcccactgggctcatgtcccacatctaacacagtgtgacacaaaaggacaggagcccttcttcctgactctgccagaggccattgccaactttggcactcagtgattacaactgtgcctgccctgcctgacaagcctcataagctcagcaagagtgactccaggttggagaacagggaagaggagctgcagcctgggacagctcagatccataggcaggagggcctggggacacctgtaaacctctccttgaggacccctagattacttgagggaggaaaaaaagaacattattagagagcttatgacagctgtttgagaaaataaggtatttggggttgtgattcgaataattttatgtgtctgaacattcataattttcccacatttgcaatttcagctattgtctgtttcaaaatcaatacatgacaagagattgcacgtttgtcttcagagaacatgaggaacaggttagatgaaaacctactccacagaccctattgggaagaacacagcaaagtcatggagtggattattggtggaagaaagagaaacagggtaatattttaggttctgcaataagaaagaaggtgaagtttgaagaacctgacgatccccaaaaggacttaacaaaagtaatataaatgtcttaaacattggggaagaagagggaattttcaaatttcatataggagcagactgtatccaaccatgtagcaggatgtattctcctcttcaacctgtatgcttattacaaacaaattaatctaatctatttagaatttagccatgtagtacatttttcttttaatcttctatatacaaacatccattaatgctttttgataaaatgataattccaagtccctacggtccccctgttggcaacattttatagccattagttgagttactacgtaggcattaaagtaatagaattacatttcttttgctattcaggcccttttgggaattcaaacagctctttacaaccatcaggaccaattagggaggtgatactgtgttttaattgacagactgcaagaggtttctctgaccagtcaggaaaccaataggatccaaacaaaatgaaatgccctagaagcagaatgatttacagttgtgtctgtatttagcaaagcattccataaatagtgaaaaaatacaggctcttcttgctctgtttggttttcctcaaacaataatcatgctaatgataatactgtctgtgcacaatgcaaacacactttactctttcttcttgcctatgtctctgtaactggggctcttctggttgaattatctgcagtggctaagaagtgacctgtgacggctgctgttctctactgtagaatggggaccccatagcaagaatcacagtaggattacctcagttaaacgcactaactttgatgttagggaaatgaatcatcaactgctttataatttatttaccaaacaagatttctctcctctttccattctatgtttccttccactttctgtttcttttcatctatttgggcctcttatctctttataatgccccttttagttgggctactcaggaccatagtaggctgctcacacatgagcagccagagaatagggagaaatgatgacagccctccacctgccttttacctcttttgcctgtatctgtctttctcccttttgaatgtcttttgacttcctccttgggagtagtcttttatgcttccaaagcacttctgcatttcctatctgtatccagtgatttagtctttagtgccatgagttcagggataaaaattaatgtgctcacatagcaacgtttccattttgattatgttgcctgatcctaaacaggtaatcagatatattcagaaatgcacaaggatttatgggtattatatcatctttttaaactttttaatcgcagtttttccacagttgtgtaaagtacaacctttccctgcttctgcctccccaagtgacttttctgactttattatagaattagaacaaggagtaaagcatgagagaacaaccataagcataaggagattgggtcaggatccaagggtctcctgaggatgggatctacaaaaagctgagctatagattctatctatccaccgatccatcactccatctacttactgcctaactctttattacacatatagtgggcatcatgctattgacaactccctggggtctacccactctacaaatttgtctgtctgatggatgccacttaatgttcttaggcttcctccagttgtatcagattccttttcctcatgctgccattgcaacctctgcgtatcctaactgatcatatcactttgtatcataattgtaattgttactcagtagctatctgtccctgtaaatcttgaaattcttaaagtcagactcctgttcttccctctcacatacctcccccacccccaggccatctgctcctttgcagcctggaaggacacaatgaatagctgccaatacctcactgccacaggggagagcctgtctgagaatgcaggcaactgtgaggaagggaaacaagaggtagagaagaagaaagacttcaggagggcaagggcagcctgatgcacttttgaatcttttgttcaatataaagatgatttccagaaaaaaaaaatcttagcatctactttaaccatctagtatctatttaaatttttaagaaataatactggaaatagtcattgaaaaacatcctggttaacaaaatatgacacctaacaactttgtatccatttccacctgcctattttctatttactttttttcttttcttttgttgatgtcaaggataaaccaaaataggaacacttttcaaattaatgaattaggctttctgactatgaatatgggcttgaaatctcaggcacgtcttgatctctgttacatgaaatacaatcttctagaaaacaaagacatagttgacaatcttctagaaaacaaagactatattttactggcaacctcaaagacaagctcattatattcattacaatttaatatgtttcttaatgactcatcagcaagacataaaatattgcattttgaaaagaagtctcatttggatgttaatttgcaaataaaagtcaggaagaagtttgtataaattatttttgtaaatatatgtacataaaatatcttctaaaattttaacaaacctgtgaataaaatcttcttgtgaagaatgataatcaccctgacttggaataattttatcacagtctatctaccatgagcttctttagtaatctgaagggtgagattagactctcattatgaactacttataaacataatttaagatgatgggaaagtaatttgaagaatttggggcctgataatgagtttcctttgaagttgaggaggggtggcagtgggaacagaatttgagataattgctggttgtctccaaggagtccaaatgttgatgaagcttctgtgtttaataattaaagacgctaacctcagagaaagatggagccacgttgtcagttacccctggatacttccaaagcctgtgtcttggtctaacaatccactctgactttgtcctcctcctcccacttaactcccacttctgcacttgctgtgtctctgttaggcactgagaagaacaattgaaagcatgaagaatagaagaaaatctgcttaggaaacttgactctggcagcatggcacactgagttcgtgcagtatgcaccttcctgcctcacgtgcctttctggagaacaaggataacaaggatatctctcccatgcatgttcaggaaatcaaccaatgtttgccatactcttaagtttataagctttgcatctgggtgaagtccaattaatgcatccataaaaaaacttttcctaggaaaaaggaggaactctgagtgtagttttttcttcccatttatttgaacctattgctagactcatgggaacttcagttaatcatactatgcctgcaatattctcccaggatcaactaccatgggaactcaaagttcatttgcagtgttctacatttgtcctgggtgacctttagtccaatcaaaggtgtctcttggtacagctgtgaattctaacgaatattggagagagttgtgctcattttttcttgccaattcctgagtatccttctggtctagagccattttatagccaggcaagcagagcacctagaagaagcaataagaaatgaagaggacggccacagattgcccagaaaacaaggtcaaaggcatgacctcacctgcctcaacttgactaattacatctgcaatgactagtcccaagtaaggccacattctgaagtactgagcattaggacttcagtatataatatttaagaggatacaattcaacccatagcaactaaattgtatctaaatcagtcattccccaatcctggtttaaggccaaagcagatgggagctgcaacctccctctcagatcaatttctcccagatcaagtcttttctgctctgctgtaggccacactgtgtgaccctgtctcttacagacctccctgatcccttcacctctccccaccgcccagacatgctgtctattgcttcctgctccccccaacccagggagggggcagaggaagtagggggtaggggaagccgctgtttgtccacttctcttggctcacacagaatgtgggccctggtaaagagtgggtcaataaaacacctttccttggtgtcaacatatgataccacaggagctcttaaaatcactaaaaacaaaataaccaagaaaactgtattttccctcatgggtgggactgcacagccctctgagagcatgttcaaataacaacatatgtctctctgttgtcttcataggagaacagattctgctaactaaaggattttggatttgtagagtagggttttcagggctgggggcaacatttaattgctcacatcagtcaaagcaaaactgagttctaccagttttccttctctgcccttcctctattcagtgactaccaccagcaccccccgccaccccacttaacaaatgtggagtctaagtattaccaatgtgaaggtagttccaaattatttcataggctcgggcacctgcaagtatcgctctgcccaggatattccaaatgcagtgaagtaacaccagaaatgatgttttcatttgcatcaacataattatgggagaatggacttatagcactgaatgtgattttaaaatgtcactcccagaagctggacatttgggctctgcttcatattgtagagcagaaatctttaagctgataaacttgcgataaaacaagtgtctagaaggtggcatgataaactaaaattttactttatgatttttctacatttaaaaattgtaaatatatctttctaaacatatgtatgggtttgaagttgctgagcactttcttgggaaggatggtgctgcttcccactctttagggatacattgtcctttcatagagcaagcaatgagaagagatgatcatctttttttcaatatcctttcttggcacaaatgaaaactggcaaccctaaagcgatctgccccctccctttacacacacacagatttgcttttatttatatatatttttagcttttttttttttttaactaagtctgtgatatccagaagtctaaaaccactggtcaaaatgacgaaagaccaaaacaaaacaaaacaacaacaaaaatccctttagagctggctcagataatacggtctactgtaaaggaccttaagaaatagctgcagaagagaggaaaacaataggcttgatcacaaactccttctgaaatgaagctaacacatgtccccagtagccttccccctatgaagcatgagctcatcttccagcatggatagcagtcttgactaactccaaagaacattgctgcttaatcccacctaaaacaatctctctgcaataccagcatctttacgtctgctcgttgtccctctctgcctagcacggcctttgtgcactttacaatatttatacctctctgtctgaactgctggctggtgagcagactgtctcagactgtctagagagcaggaagcagatggaaaataaatacagatgaggagctctgggggcaaagctgcagacgggacaagagggccaggaaataaacaaacaggaaagagactgactggtctttctgcctttcatccctggctctaagagataagacttaaacagtaagacgccgactgggctcgctttcaaattctacccagcttctacttcagggtagttttttcgtttcaatagtctatctctgcagttttacaaaaggatggttaaaataagctcttaataagtgataataattcatttcaaatacaatgatcattattacattagagaggtataggatgcaagaatttgaaaccatcttcaacatagttgaatatagtgcatgtatgttaaaagtaggagcactgacttagacagatcttacgtgttttaaagcagagcatcaggtgcccaggtctagggaaaacatgacaacaccgccttcgtcattctgctaatgttccctcttctctcttcttttggctgtcaaagccagctttaatgaaagaatctcaaaccaatcatttacgcctcataatagacttaagtcaaagcattatctctgaccataagtcattattcttattgtaaatactttatactcaaagcctgtttgatttatactcaaattctgtttgattttcctcactaggaacgccttccttaaaactttccattattgtgtgatacgcttttaatacctcaccccaggaccaaaggcctccctcttggcctatgcttaggtgattggtatgaacagctctggtgctagattacccaagttcaaatcctgacttccccatgggtagtcatatggctttgtcaatactttttaatctgagtctcagttttcttgtctgcaaaatgaggatgataataacatcaccttctttatgagattatcatgaagattaactgtggtagaaatgtaaagctcttggaacaatgggtgacctttgaggattagccaatattattcctgtcattgtatggtcagaaatgatcaaagtgaacatatttttcttcatattgcaggaattgaatttttaaaagcaactctgcagaaaatactaatttaagaaatcttgtatttattaggtcaggatcttttcacagaattctgtctccaaggttgttttatatcacataagattttttggtgacattttttaaagtatagtaacttaaagaacctttgggtagaaatagctgaaggacaagaaagtctcttaagttttcaggttttttttttcaatatagaaaataataatctcttgttactaatctaaaaccttaatatatttcctatatcttgattcaatacatgctttgtttctacaaaatctgttttaatctctctgtgttatcaatgtaaaatatcattgaataagttttttgaggggaagaaacgccatagaatgagttagccaaagacagaaatggttccctttatcttaaaatacattttgcaacacctaacatctacaacatggcataatggccatcagagaaggaaactgtgtctactgcacaatgttttctggcagcaacaagatgggtcccatttttccaagatcttattgttactctaggccatctaacaagatgtcctttggtacaaagtcttacctcaagcaaatacacttaaatgtcaaaggatcataagagtcctggagggaaaggagcagagaagttcctgtacctctgaaatcacccagtgtaagtggcaatctgcttggtcttcacaaataaggctggcagcaggcaaggattaattctgatgtaaattaactacatttctattttgattaaatataaacttgttaaaattaaaatagctgttcttcttgcttggatttcaatttgtaactgtgaaagagaataaagtttgaggagcagtgctctcaacgttatctttctgaagggacagggttttatagaatgcccagtccaaccccaccttcctgtcttccaatgcccagtccaaccgcagcttcccatctttccttctggtcgagtcatggagccacttggtgtgtctcctctgcaaagctccaatcagaatatttaattgtctacaaaggatgttctatggattatctgtcaagtgttttgggactattaactacttgataaatgctaataagatgcatcaaggaagctgatattatttgttcacctaacatatattattccatctctctgtataattacgttaggttttattgttgtttacagagactagtttttaaacagtattgcaactctatattgtcctccaaataatcatcatatttcaattataaagtcttgcatttttcaactgtcattgctgagttgatcttcagggactgtattaggatcagagaaaaggcatatgcctaagccttaggtttgagtgataatcaccaagacataataagcctgcgagttgaaacagagacagtttaatagttactttaaagaaagaagatcagctgggaatctgggaagaaaagctgggctgaatgggaaagtaggaatgatgaatatattctaagcttcaaattaaatccagcaattaaaccaaagaccttatgagtgctttagaagaaattttagaaaatatagactttgcagtttctttgatttccatctctctgactctaaacatatttgaaacaagctacataagattcattgcaaatgtatctctcctaaggattttttttaaaggcatactgcacttacccaacttttccctgggagaaaaaaataaatattttattccttatttgggctacaaaatgtccagctccattcccaccctggccctgactcattcagagcccttaagcaggtccttgaacctatatgtccgtcacattccccacctccacctgtaaaaatacaataaaagcaactggctagttcctacctcacaaggaagtcataaagattagagttagaacattgaacttcaaagatgaaagactcaatataaattccaagcattattgtcaagatctcagtgtgaattaacagaaatgtactgcttaggcaattgctacctgtcagcagatctaaaccaggctgaccttgatatgcccagggaagggcaggagcgcctgagaccaagaagcacattttctcagagccaatgtaattgtcttaattatccatacttggtagctcaccatgattgcatttcttgtttttctgaaagactgaatactataatataatgcatacctgctatacaccctatccccaccccaataaaaaaaataaacatttattctctacctacagtgttcaaggctgcactaaagattggaaatacagaaattaatatatagttctttcatcttcagagatcacaattaaaacaagagaactgtgcattctctatttagtctctagagagctgagtctcccaagagcttaaagcatcccaaagcaagattttacacaaaaaaaagtccaataattttgtagctggctttcattagcaatgactgcctcagcccatgacatgtactatgacaaatcaaaattttgcacactttcttctctgtatctacaagggttacaaattattactaaagttatttttaaagggcctaaggtattaataccatcattctattctcagaattactaagctcagaggcatccttcatcccaggtgatgaatgcttacacaaatgtttgacgtctcattagcctcgagatgatttttaacatggccaggggtgtagagaacagagtcctctgtgtgtgtgtgagcacgtgcctaattgcccgactcctgacttgggccccctcacttcttcttactgtttggtagtgaaggaatgaatggcaagttagggtgctgcctgggaaatatcatcaatcttagcctaagtcattttgagcagctgttcatatctgttttaaagatatccaggccctggactcccttggaaatataattccaacatctgacccatttaaagttggaaaaacctttcctatgtggaaatggagaataacagttcagcttgcttctctaataacttggaagtaattattgtcacatctttagtttcctaacttctatcattagagtttggtttttctcaaaggacatctaattcttggggtttttttcctccaaattccctccaattttttccttgtgtcttttaaaaatacagattaaagctagcggggagaatgtgagtatccatttcctcatctgtgaaatgagacaagatgattcctaagactcctttttgctcaaagatcttaattcttgagaaactttacacaatagcctaagccagggatcagtaatcttcttctgtaaaaagccaggtcgtcaacattttaagctttatggccacatagtctttcttgtaacaactcaactctgccgacttagggcaaaagcagccatagataatacttaaagcaaatgatcattcctgtgttccaataaagctttatttacaactacagatgacatgctggatttggcctatgggccttaatctgcccctggtctaaaagaaaaaaaaaaagaaaaaaacaagctctatatctccataccacccttcctgtccctgtgttcaggctcagattttctgaaatgacccacaatcattcagccattagtgaacccggaaatccctcaattgcctatgtttataatacacacacacacacacacacacacacacacacgggggagggtgagagtggagagccaaacttgaacagcagaatgtcttctgctttttgttgtttttacaaaaaaccattcctgactttcaggataagaagaagcctacatttttacttacagtgctttataatgagactcaacttttacatttcttgggccatatttaccagcaattctgaccatacagtgagtaggaaaagtaagtaaggtccatagaccagtagcctcagcatcacctgggtgcttcttggaaattcagtgtcttgggccccaccccaaacctactgaatcagaacctccatctaatcagatccccatgcaactcctatgcacattccatttgagaagcacacaaggtcctggcaaaaaaaaaaaagatgtcaacctcagatggagtgaatggagaggtgacaatgaagggatggcttagtggggtgtggcaagaggtagatgaagaaagggatgggaggaacctttggactagcaatagctgcagtcattacaaccactggggctgaagggatatacaggagaaattgtgatacccgagtccattttgcactggagtcctggaggaggggcagcctggtgaagctgtctttgaagaggagacagcaacttctgtagacacatcaccagagcagggagcaactacagaagaaataacccaagctgtctgcactcctgcctgccaggctcttgctggtatcttccactggccaaacctaaccagaagatagggggcccaggagatgcagtcctcaaggcccaggcttcagagcacagagcatacagtcagggaaggagcagagaacaaccagcccagccagagggtgcttcccactggggtctgggtcccctggagccctaagctggcatcccttcagctggtggttctcatctgccattgtcactggcactggtagctctgtgtcctcagttaacattatagtgtttgcttctccttttattcagaatgcaaaattgctcaacttgtattattgcccaaactaaaacaccattaaaagaaaaaaaaaaaacgttatatatctccatgtcacctcaagaagcccacacctcaaaatggtttctttttactgtcactccctaatgctagttaaattacagcatgcctgttttaagccatcaaagtagccaggctgtgggaagtactgcctgcctaagctggcaacgagcttggctcagagaagaccgcttttctctctcttctacctgcagcaaattccctgagatggttttcaaataagacttcactttgtttcctggcatacacagtggatcaagttatttctaagtaaaatataagaatcaacagtgttgaaagagtaaagaaaggaggtagtaagtactgccccttagtcaccctgtctttaggcaaataacttcatattacagtttcaatatctaagatggagcattaaaataattaattgggaaaccattagactgaggtagccctactgccaggttcccatgtaagcaaacccaaactcaattcaatgtgaactgccatatccgagaaagtgaaacttatgttttcccaatcagaaactgccaactagcctctaactatggactttaccaattagaaaccaccaactatcttctaactatggacttggaggttattgctccactttaaccagtcaaatattttctttgccttgcctcctagttttgcttataaaaacctcgcccaacccctcttcgttggagccccaaactatctgcatcctggagctgcctgattcatgaatcccaatctgttcaaataaactcttcaaaattttaatatgcctcagtttatcttttaacagggataataataataatacctacctcatatgttttaaacaaaggaaatagcagtgtatcagaaggttaaaaaagaaatgatataataaaaacacttagctgggctaatagatataacttagtaccatgattgatatttagcaatatttcaaatgctactagaggagtttttcattgctccaagctaacctccacttccatgttatcaggaaaaggccctgtcaaatacatcatctttgctcagggacagcatgtcttccctttatcccatcaggccaatctgagtcatatgaacaacccagagagaaaccacagggtcctcttcctccccgttctgggtctaacaacaacagccccgggtaggaaactcatgggatctccaccttccagcctcatgcgactgtctggtttttcagagacaaggtgtctccaacgtaaaaccacaggaccccagcactacccacaccacccacctgtcccaaagagaaagcatatgcatgacatcacttcctgttctcctcttttgggttcccatccattttctcctagaagaggccagagttcaggctttgtgtgcaggagttagggaggaatgttggcaaaaaagaaaaagctggggctgggggttgaccccacaccctccctgtcttttctgttttcagataactttgaccaatcatttacttgccaactccctacacctccccctacatctcccattatatattcttgtagccacctacaatccttgtctgaagacattacagtatggtaggacagatagggttttatttggctttttttggctttttatttttttgcatcattggatgacacaaaaagtgaaataaacggtactggggtgcatgaattgcaaaacaaaagcaaagaaagacaaagaaagaaagaaagaaggggaaataaggaagaaaggaaggagggaaggaaggaaggaaaaaagggcggtaagggcagaggaggaagggaggcaaggggaggagaagagaggggaagggatgggggaaaggaggggaagggaagtgaaggaaagaaaagggaaagggagaggggaagaggaagggaagtggaggggaaaggaagggaagggaaggaaagaggagggaaggggaagggaagaataagaaggtccatgtactaggctgttctctcattgctataaagagatacctgagactgggtaatctataaggaaaagaagtttaattggctcatggttctgcagactgtacaggaagcctgatgctagcattgcttggcttttggggaggccttaggaatcttacaatcatggtggaaggcgaaggggatgcagaaatatcacttggcaagagcaagagagtgaggggggaaatgctttaaacacaccttttaacaatcagatttcatgagaactcactcactgtcatgaggacagtaccaagacggatggtgctaaaccattcatgagaaatctgcccccttgatcaaatcactgcccaccaggccccacctccaacactgaggattaaaatttaacatgagatttgggtggggacacagatccaaaccctatcagttggacacttcaaaataatttcaatttgatatttcaaaactgttcccaattagtcatcagagcaaaaatactagaatctcgttgaagttccttatacagtttttatggtttaatattgttttcatttaaaattatattagaggaggtgattccattctcagcatgcctgcaccccaaattagaaaaaagtagataacctcaattgacctgggaagacctggaaggtatcgtgtggaccacttcaaacccttactgtaccattgtaggcaggcaaaatgactcactagaaatcaccctataagtccgccaagtgctcagggcatctgcccatcaaatctgtattcatttcacccatactcttattctcaggacaagcaggtggtgtttgtttttcaaaaattcaacacaaatatcagccacaaaaattacctgaacgaagaggaatccaactgcttactttgtttgaatcgaagctctctttcagagtgcttggtacctggaggtcacatacttcctatgtgaagtaaaggatcccaagacaaaaagtgttattcaatatgtgtggatgaattgcaaaatctcggttacctggcacaactacaaggagttgccacagtcagcaagcttattgggtaacttttgcaaatactcatttgactcattaagcatgttttcttttgtatattagtgtgcaaaagtcacaggaaaaaattacttagtaggagtgtgtccttgagtgctgtttaaataagattttctcaccattacttggaaagaagaagacacataaatgaaaactatattaatagacaatctcctccaacaatttttgcacatcttttgttttttttaatgcagattcttgaccaaaaagtgaatataaatagtggaaaaaccacaaaactgcaatttccatgttatacttataatatatgtcttattgtggtaaaatatacatagcataatttttaccactttaaccatttttttttgagacagggtctcactctgttgcccaggctggagtacagtggcacaaccacagctcattgcagccttggcctcctgggcttaagtgctcttcctgcttcagcctcccaactagctgggaccacagaggcacgccaccacagccagctaattttttattttttctagagatgaggtcttgctatgttgcccagagtggtctcaaattcctggcctcaagtgatcctctcacactggcttcccaaagtactgggattacaggcatgagccacccattttaatcatttttaagtgtacaattcagtgacattaagtagattcacatcattatgcaactatcaccaccactcatctccagaacttttttgtcttcccaaactaaaagtctgcacctatgaaataataacttcacattctccccttctccagcccctggtaaataccattctaattcttgtctctaaggatttgactcttctgggtatctcatataaataaactcacacaatatttgtctcttcatgtctggctaactttagttagcataatatcttcaagtttaatccacaatgtagtgtgtatcaaaatttgattcctttttaaggatgagtaatattttattgcattacattttgtttctccatttaaacattgttatctgtgtctgctgatggacatttggattgtttccacctttggttgttgtgaataatcctgctatgaacatgggtgtacagatacctgccaagtccctgctctcaatttttggggtatatgccccccatgttattctaatttctttattgaaatgccttcctctatccaagatgaccattctttcaacctagtatgcatttttgagagctgttgttagcctggtgacagagagagtgggcagctccccatctccatccactaagccaactctggcaaatcagtagttgcaagacaagagttgcagcctgaacacacttgtgttctttttttaatacttctttattttataaatttttaaatgtctatggcttctttgaaaaagagggaggctgtcttcaccatgagaatgtacgggatgaaatagcaattcagtagcaggagaaaaatggccaccctgtgtggagaaagaagtctcaggaccacccatggctgctggggaagactgaagggagctcctttgataaacaaagatatccaggatggagagtaagtgaagaaatgaaatagaggacagacaggattcatgtaggagtgaggaccaggccttctttaggatcctgaggcacaggaacccaagagttgctgatacagagtagccaaaattgtggaatttacagtgcggcctctagggaaacttggccaaggccatagagggaagataggaagcagatccctagtgaaaacccagcttccattaaaatatctcccatggagaggacaagtctcacaagaacttggccacaaactgaagaggtgcaaccagcatccagacagaaaagactctccttgccccagagatcagtgagcatctgaaggctggatcaaagcccagacctagagagcagatgttaaatggagtctccagaaggcctctagccccaagagacccagcacagagcattaaaggtggatcagtacacgtggggatcattccagcaaataggctgtgtgaactcaacaagacttggcaaagaccttgcctgagctggtcatctcagagggcctcacagcccatccaggctcagtcacccacaggagccaactgttcatgccagatttcagtgtaagggaagaaaaggagaaaagaaaatggctggaaccaaggagttctgaaataaaaggacatttccttgcattctctcataagccattttcaccttcatttggtatcttcaaagagtgacacccagatcttaccaagcgggagcagcagacacgattccctttgatccatgtgatccttttcatccatttgaaaatccttcatgtggcatcgatttgattagttcacattattaacccatgattgtgttcttacttcatactcagctctgcacccagaactgagacacaaaaagggccaattccctgccctccctaacctcagggagcttacatctagtgaggaaacaaaaaattaaagggacagttacacaaaagaatgaccagggctacaagagaaaaaagtttggggtgaattaaaggcacagagaagtttgtaacgcaggagcaatatgtaacccagaggatcaggaccactcaatatgtttttgttagttccctcttgctgcttaaatgacttaaaacaatacgactttattatcttagacttccgagggtcagaagtccaaaaatagatcttaagggactaaaaccaaggtgtccagtgctgacaggactgcattccttcggaaggccctgcagagattttgtgcctttgtcagtttctggaggccatctgctgctttggctcagggcctccttccagtgatggcatcactctgacctctgcttctaccatcacacctccttctctcccctgctctcatcatcttctgattctgacactcctaccttccttttagaaggatccttataagatgcttacattgggcccacccaaataatctgtgatctatctccaatctcccatctcaagatctttaacgtgatcacacctgcaaagtccctttgacctgtaagataaaatattcacaggtttcagggatcaggacatggccatcttggcaggggcagtgggttaaggggagtaaggagttggaaggtggcattattctgtctaccatgtagttaattcctttaaaaaaaaaaaaaaaacccctttgcggccgggcgcggtggctcacgcctgtaatcccagcactttgggaggctgaggcgggtggatcacgaggtcaggagattgagaccatcctggctaacacagtgaaaccccgtctctactaaaaatgcaaaaaattagccgggagtggtggcgggcgcctgtagtcccagctactggggaggctgaggcaggagaatggggtgaacccgggaggcagagcttgcagggagcagatatcgcaccactgcattccagccgaggtgacagagcgagactccgtctcaaacaaacaaacaaaaaatcctttgcgtgaatagattgtatcattattatccctgtgaaaaggtttttttttcttcatctcccccttttattttatcaaagaaataactcataaatctttatcttctgaaaactagccacaaatcatctaaattatatgttaacattatatggataacatcaaacatcagaggccttctataccgcctctgcttcttttaccatttctaatttctccaaaatgttcccatggcagatgactctgattctcacatgctgatcttctcatattccagtccctttttctcttatggtggaatcccataagcagactcaacttttcacaaactgataacacgaagtagtcaatttcactttatgagttaggtataggaatagaattcagaattatttccagaaattatttcttggtatctataaaatcatgtgttgaaagtctacagtcctctatcataattgtatttatatcactgtggtgtgtgaggggaaaaaaggaaaaatgtaatctaaactggaaccaagaagtcgtttcacccaagattaacccaagattacacagattattaatggtatgacctggtcaaaacccacagcctctggactccagaacaagtgctctttgccctagccacactattctgccattcttctctttcagattaaaaaaaaaatttggtagaaatttacacattaatgatacacattaatgacttcaaatacttgtcctaattgtcctctttattaaaaagctcccaccactagtcctgactggtgttccataaagggtccttcctgctggttgatgtttgactctgtgaaatataaacaagtttcaacaagaggacagagaatttgtaatcaacacaccttggctcctgttcagaacgaccatgcctgtcacttgatatttttgcaggaaatggatattggaaagaaatatcacacttcatttaaaagcagaacaacagatgtaggggcaatggtgtcaatgagaatcagttacgtatctgatgaaagtctttgtgaatctcaaataataacaatatggcaatccttttacttctctttagaattccccaggaccctcctccaaaccccctccctatttcatctcttcgtcacagccagatggcctcagcagctactgtgcagaggacaccaacactgtccctcaccagctaccttcacattcctccttcccacctcgaaaacacttttaccctcactcagctcctctccctttccctcagtgacaacccctcttttttggatatcgtgcctttgctcagctggctgcttccccttgatctactggtacgttgaaatcccaactactcagcatagtgtgcaatgcaactcataagtgcctcccaagtcaatgctacgcttatagtgttctccaatccagctgtgaagctcactgagatccccccattcctttgcacccactgttttctctgcctggaaggccattcctccattttttgccagaaaactcctaatcatccctcaaagcctagctcagcattgacctctgtgatgctgttcccaaccatcggccatcttcagtgaaagttaatgatagatagaggcagacaagggtgggtccctggcgaaaccccaccatcaagccaaaaagcctgaaacccacagcctgaagtgggaacttctatccctgtttgcccactctctcctgattggttctttctggcctagaactcctgacctcaggtgatccacccaactcggccttccagaatgctaggattataggtgtgagccactgcacccagttggttctttctgaataatgtctttttaccaatcaaattttgccttttccaaaactacctatggcctgccccacctcctatcctgtgcctataaagaccccagactcagtagtagagagggagaagtggcttgactggagagaggtgacttgacttcagagcgacggctagacttcagaggagagacagcttaacttcagagaagagccatgtggagacagccagacttcagggaagattacctgcccatcctgtcccctctccagctatcccctctctactgagagccacttccatcactaaaaaaaaaaaaaattctctgcctccaccatccttcaagtttccatgcaacctaattcttcttgggcactggacaagagctcaggacccaccaagtgtgggtactcaaaaaaggttgtcacactggccctttgcccttgctggcagaggacagccacccaacgtgatgaggcaaggggcccactgagctgataacacactgctgtccacagatggcagagctaagagatcatcgtaacacaccctctggggcttcggcggtcacaggcatccccatctgggcaccaccatggggccacatggaacctgctcctgccagcacccaaagcatccagccagatcctgcactcgcttgctaatgcactccctcctgcaaaaggttgagcacagtgggcctggtaaatggaccacccctgtagcaagtccgatgaaggggtcaaaaaaaattcctgcatcattaatactctctgccctgtgtggcaagagccccaggctttcctctcccagagcttttaacacatgacattagccttgtctgttcacctctcagacttcctcaaaaagttcccagactgagagctctttaagagcagagattgctccttttatgtctaaatcctcagcacttagcacagtccttactagtagacacccaataaatgtttgttgagtgattgaaagtccaaatctttctattaaaagaaagaaattaaaaagaaaaaacgatcactttgctgtcttctggaacagctatctaaccaaacttcccaaacccagttggcaccatgtacaagctgatttctgttgccagcctacccctggatctgctttattgacctcgattatttcctcatcacttagctaactgactgctcctcattccccactctcctttccccctctgcagcatctgatggctttatttttaagttttgagctggtccattttcctcttccaccatctcatccaccctctttgtctcagcaataatttgttttctcagctcctcatttggttattttctaaaagtgctagtcacagccactctccaaaagctctcagtagctggctgatggaccattggtcaatggaaagcagcatccttacgccagtttctggaaactagacagcaattaaatgaagcaatgtgcataaagcacttagcagtgccttagacacttactgagtgttgtcatacctccatcctgggcaaactggccttcaaactggccatccctcttcccatttatcttcgcttgaattctgagcaccactgctataatgacattcctaatgcagagtgccaataaaaaggaggggttcccaaatatccatccacagcaaaatgagaaagataaaaacagtgcagtgacctttcatcacattacttatattcaactcaaggctttgctctttattgagactatgtacttctgctttctgtgttaaaatgccctttttataatgaaacaatggcaattttgttttgtttcttatttcagtatctttatttgggaaaatagttcacaaccataaatggcctacattttgtattttggaaactatattatctagtctgttactctggatttctacaagggaccaagtaatcccattcctacattcttttcacattgataagaatgaagagtttactaacacatataacattttaaaagtaagatataggcagagacccccccaaaaaatgtttatgatagtaaagacctatttgagatgttcacagccctatttcttttatatttgtttattcacacatttcaatgtcttaatggttatttgccgttagtttgcctttagttttataggcacatgcatactaatagtgactgtcatcaaacacatacacatacacacacacacacacacacacacacactttaaagcaggcaattaatcattttctccctcaagaccgtattttacagtcggaagccaattgtcagcacatatgctcctaaataaactgacacacataccagctaatagattaattcgcatgaagaaggcgtcgtgggaagaaaacctgtgttcccagatttctcaggcaggtgctctgcctgttaacataaagatcagtcctcctggctccaaccccttaggcagtgtgcccaaaattacttatggtttctaacacagttgatgccaatgcagttctgcaattgagagcctggtttacacaacgtatcctaagaacagctcagctcaggagcagccagtgtagactttttgtatgctggtgggggggcgttggggaggaattgtttgtttgttttgtctcacatgtggcttttctaatagaagacaatcatgaagcaataattcatgccttaatatttctttgcagctatcacccattgttcttcatagccctcccataagtgggtgatgttatgggtcctgaggaaatggagacctattgggatgaatttgttcagaagagagaaggcttgcacacacgtgtgcattctcacaggcacgcactctctcgcaccaccctcagcactcagagctctgctagtatccctttcccctttctgactttgtatctcttaagccagtcttttatcccatgcactgtgcctcagtggaaagttcagcttctctataaaacaacttattaagggaaggatcactatagagcttcctcagagctccagaaaagataagctgacggtctgcttttctttttcaccaaatcacccttctcagagtattaatgcaaagaatagcatggaggagtggggaaggaggtaggagaacatatacatgacacaattattagacttccaaaatcctgtaaaaaaaaaatctatcaatagtattctgtgttagttttagctttcttaaataagcatcatccatgctcttttccaaacaggattcacaaaaatgctaaatgcatttgctgcagaccagttctgggtcctcaatgaagagtggttggcagtcaggctagggctgctcctgggaaatgctggaagggccggatgctcccctgaggagtctgttcccccagatcagcctagaggtccagtagaatggttgcgtcccagcaggatgtgactctttgttctacctattcctctattgtgacccttcaaaaatcctacctgttttcaaagacatcatcctcattgttcgtaacccccaccaccaacaacaaaaaagccagattgaggcacccgctgacaaagcaactctcttgttctggcaccttaagaaggaaatgagtttacttcccttctgtaactgaagcaaagccttccctccccgctgtggatatggtaccactctgtagcacgtttccttcagagagtcagcttttctgaacaatgacccaactgtttgtacagtatgggaaactatctcttgatagagtttggtgcacaccctcctacgaacccagacatgcacaaaagttccacatttcaccacaggaagtaagactggtcaggcttcaggcatcattaatcattttgaagtgattattcttaaaaagaaaaaaaaaaaaaacagggatgcagcttgagttaagtcatgcccaataaaaatcagcacttctcctcaaaattacatttctctacttccgtgtggaaagttaagagctccctgtactgacaagagctggggtgaaatcgagaatcttcgtctctttaattggagcacagacaaatacttgggatctgacatggtcagatggggaagaggtgggtggagttttacttcctttgcctttcggctcagaaatacacacatttaggaggaagataaagcaagaacaatttgggattttgttccgggaacttcattttcccccattgaaatgccattaaacaaagcttaggacaatcctgctacgtgcactcatttagccacgggaactatggagtgccccaccccccatccccatcactgaggccctgcagcccagcaggcaagggccagagaacaatttaattccccagataggctgccccacacagaggttcctcatcaagggagtagcaccagcccactctgcaaatctgttcaccctgcaggaaacacctccttgtctgcttctttgaagtaaaactgtttctctagcatgggaaaagggataagtagaaaatga

SEQ ID NO: 335 - DNA, 56947 bp, Homo sapiens
ggactaggaagctcggctgccgctgctactgctcccccctgggctccggcgagagcctttccctgtcaagcaagaggggtgaggatcatatttttattttggaaactaaaaagtgctcccagggtcggtgattattaaggggaaatccctgaatatactctccagccaagaaggcagggctgccggggctgtacaagaagaggcagcagcctcctacagcaccactacaggcactgcgaggacataacaccagagagctgctcctctgccctccgaaacgacaactttcctaccatcttggaggcagagcaaaggggggccagggggaaaagtgcacccgctcccgataaagtacaaatttttacttctcatctctggaaaaaagtccacaccggccgtctacacccgcgcctgggggagaaagcagggaagaaacggggggtgcatgagaaacgttttcatttgctccagggggaaaaatgtttctgcatcttctgatggaaagaaatctttacaagacacaggttttccggtggttattgttttttattttctgtttttaatttttttcatgttagtgacagtgatattttaatatttttttaagccagtaataatttttctccattacagggctaagttctgtggctggtggtcagtttgtaaatttatacttaaagagacttaatagtaacttcatttatttgtctggttatgttattgtatatataaatatttatgttttcatatattgcatataaaaatttgtgttacatgttactctcagaacagattgctgtaagacaattgtaaaaaaacatgtctttcgtctgtttctcaaagcaatgtaaataaaacctatggactgtccagaaaggcatgatacagtgtgtcattttccacagtgcagataaaggcagctatcactggggatttaaaaacggcccctgtttctggaaattctgttatgctgcccatacagaaaggatacagtaaaactggaaagagattttaaagacagccttagatttttcttgaggtaaaatagcttattaagaattatatccgggcatttaatttttttatttatttagattctttaaactctagctagatctttggtgcattacacatgttgctatctgctttttgtgtcacagaattgagaaatgtggctatttttgttagttatgttagttcagaacttccaatgtgctgccagcctgtatgatagactttttgtatattgcagtggatgtcatgaatttacttttttaaatgagcaaagcttactagataaatgggatcagagttaaacaatgctgttagcacagaggtgagagggacaaagggtacccatttacatcgattccaatagaacgcttattggaggataaattgcagagacatttttctatttttgtgaagaaagagaaaaataatagaaaaagaaccgactatctttgtatgttctactggggatgatgatttaaatcttgtattaaaagttatttttctaacacatgttgactaacctggcaggaatgaatttgttatattagtgccctgaatcagtagaatatttaatttctttgtaaaatttattacacaacatttagaaataacttccaaatttagaaattgtcctgatttaaaagtgagttcatgtaatgcatatatcggatatttattagtttctagctgaaccttatctttatcatataactttgaatatagtacttacctaaatattctggattttctttttttttttttttttttttttgagacggagtcttgctctttcgcccaggctggagtgcagtggcccgatctcagctcactgcaagctccgcctcctgggttcacgccattctcctgcctcagcctcccgagtagctgggactacaggcgcccgccaccacgcccggctaattttttctatttttagtagagacggggtttcactgtgttagctaggatggtctggatctcctgacctcgtgatccgcccgcctcggcctcccaaagtgctgggattacaggtgtgagccaccgcgcccggcctattctggattttcttctgtggttttcttcctctttgtttggtggaaaaagttaagtaaaattaactgattctcatcatcttggaaacctcaattgtgaagctatgttctatttacaatattttttttaaacatttagacatcaaacacattagttatcacaaggaaaatcccttaactagacctctggcgaaattgaaaaacatgttttctaacaacttatttttctttatatatgacatgactttatagatatgttttgaatttttcaagaaattaaaatgtgatcagattccatggcttatgtctgtgatcccagcactttggaaggcctaggtgagagtattgcttaagcccaggagtttgagaccagcctgggcaacacagccagaccctttctccaaaaacaaaaattaaaataaaatgtgcttgtttgcattaagctggctgcacccttttttgcaatgccccttgtgaccaaaggaacttgtctgtcagtggatagggctatgctgcatcagcttagcatttcagtgcttttctctttataaagtttgacttctgcttagctatagtctatgatatttatccatcaattgagcaaaatattcaagacttgaggccaggcacagtggctcacgcctgtaatcccagcactttgggaggcagaggtgggtggatcaactgaggtcaggagtttgagaccagcctggccaacatggtgaaaccctgtctctactaaaaatacaaaaattagctgggtgtggtggcagatgcctgtaatcccagctactctggaggctgaggcgggagaatcacttcaactggaaggcggaggttgcagtgagctgagattgcaccattgcactccagcctgggcgacaagagtgaaacgctgtcgcaaaaaaattgctatgtctgattcatagaatctgcaaatgctaacaaaactactgatataatttttttttttaattttttttttgagacagagtgtcaccaggttggccaggctggtcttaaactcctgacctcaggtgatccgcctgcgtctgcctcccaaagtgctgagattacaggtgtgagccaccacacctgggctaaaactactgatataatttgaggaagctatttttttcccaataaaatttccactactcaaatttggctacattattgagcacttaatgcatctttatgaccttattggatacttttctctatgttttcttatttaattcctgtaagagctccaaaaagtattacatttttcttttcttttttaaaaaaaaataaagatgggataattgtctttcctgtcagggatcatgtaccttctcggcccaaaagctttccaataagattctcaattctcctggtttagagtgtccaaggtgcctgtcacaattctgtgcactatgcttgaagtgctaggttcgtgctctatgctctttgccaaaaacaaactgagtagccagctattggagcccccttcattcatgggtggcaaccagtggcttatttcactttcgtgaagtctagcacctaatctatcagttgttttgaggaatgcgaataaataacaaaaataaacgcgttatgattaacagagactttgttcctgatcctgaaaatgagcagtatattgtataaagcactaacttattctattataccttcatttcacaaatagctgtttggccgttagttgaagtaggaaatgcttaccttaattcttttttttttttagacagagtcttgctctgcccaggctggagtgcagtggcgcgatctcggctcactgcaacctccgcctcctgagttcaagctattctcctgcctcagccttccaagtaactgggattacaggtgcccaccaccacacccggctaatgtttgtatttttagtagagacggggtttccccaagttggccaggctggtctcaaactcctgagcttggcctcccaaagtgttgggattacaggcgtgagccactgcactcgggcaatattttttaaaaattatttttattattatttttttttacatagagatggggtcttgctattttgcccaagctagtctgaaactcctgagctcaggctatcctcctctctctgcctgccaaaagtgctgaggttacaggcgtgaaccaccttccccaacaaccttaataattttagtatcattagactctttcattgatctaccttttggtattaattattttagttttctgtctttcttttttttttctgagacagagtctcactctgttgccaggctggagtgcagtggtgtgatcgcagctcactgcaacctatgcatcccgggttcaagcgattttcctgccgcaccctcctgagtagctgggactacaggcatgcaccaccatgcccagctaaaattattaagaaaatatcagccaggcgcggtggctcatgcctgtaatctcaatactttgggaggccaaggcaggcagatcacctgaggttaggagttcaagaccagcctggccaacatggtgaaaccccacctctactaaaaatacaaaaattagcctttcagctactagggaggctgaggcagaagaatcacttaaacccagggggcggaggttgcagcgagcggagatcgcgccactgcactccagcctaggcaacagactggagtgcaagactctgtctcaaaaaaataaaataaaataaataaaatttaaaaactcccaaggaggtgagggagtagaaatagggtatgtacatagcctgaaagttttcaaagccacactattatgatggccatagactcaaatttttttcactttaaagcctttctgttttgcaaacatttgttggtaatgtttctacctaaaataaagattttggttttattgtggttacaagaaagtgtttctgagataaacactgtatttggcagacagacatacacatcatagctttagattgactatgaaatttcttcaataaagattcaaagctgggcgtggtggctcacacctgtaatcccaaaactttaggaggctgaggagggaggatcacttgagcccaggagttggaggtcacagtgatctgtgatcgcactacggcactccagcctgggcaacagagtgagagcctgtctcaaaaaaaaaaaaaggccggtatggtggctcacacctgtaatcccaacacttttaaaggccgaggcgggtgaatcacgaggtcaggagtttgagaccagcctggccaacatggtgaaaccgtgtctgtactaaaaatacaaaaaattagctgggcatagtggcaggggcctgtaatcccagctactctggaggctgagggaagagaatcgcttgaacctgggacgtggaggttgcagtgagccgagatcacgccactgcactctagcccgggcgacagagtgagactccatctcaaaaaaaaaaaaaaaaaaaaaaaaaaaatatatatatatatatatatatatatacacacacacacatatatatgtatatcacatatatgtgtgtatatatatacacatatatatatacacacacacatatatatgtgtatatataaaaaaatactatatatatttatatattcagctgtagtcaaacatgagcgttgatcaggtaatctccctaatgctaatatctagcctggggcagttagacctctgatttcataccagaaaccaagaagtgggtgtttggttttgttttgccttttttttttttttttgagatggagtctcactctgtcacccaggctggagtgcagtggtgcgatctcagctcactgcaacctccacctcccaggttcaagtgattctcctgcctcagcctcccgagtagctgggattgcaggtgcctgccaccacacccagctaatttgttgtatttttagtagagacgggttttcactgtgttggtcaggctggtctcaaactcctgactttgtgattcgcctgccttggcctcacaaagtgctgggattacaggtgtgagtcaccgcgcctggcctggttttgtttttaaatccccacaaaggccaaaagataccctccaggaaccagatggtcaattttgtgctgccttctcatcatactaaaggcagaaaatgtgacattctagacactgtataccataggcattcttgggctattttactgactcctaaccttggaaaaaggaaaacaactccccaactgaagtcatgttttcagtaataattagtaaaaagaaacaccccaaagcagtatgaatgattgggtggtggaatcagaagtgatagtcagccttttccatataattttaaaaactgtcccaaaagtggtggttagctaaaacattgaagtaaggcgagaaatccattgagacctctgaataataggcagaggttaacacaaaggtgacagtgttcatttctgctgcattcctggctaagcaagcttttgtagacctgctgggaatttaaccactatttccatgggaaaacaaattccaggttccaaacaactaatttacagtgatgttcatgggaacacagcccattaataagtttggacttcctgtgctataacatcttctccatgtagttgttatagactgccagagttcgatgataagaatgggaaaatacagggaaaatcctctcaaacaaaaaaggagtaactatgaagacaacctaaatagcttgacttaaactcaggtcaagggaaagattatcaaagatattaaatggtaaagccagttctagtacaccaggaaggaaaaaaagacctcaataactgaaaattgtactatttactccatatacattgaagtttgttgttgttgttttgagacaaagtcttgctcttgtcacccaggctggagtgcaatggcacaatctcagctcactgcaacctccgcctccagggttcaagtgattctcctgcctcagcctcttgagttgctgagattacaggcgcctgccaccacgcgcagctaatttgaagtttgtttatgcatacctgggtgccatatgatagtattataggtatttgcattttcttctattcttaaagaaaaaacaggtaagattctactaaaaattactagatctcatcgttctactaagttaatgctcttttggcaccacacagcaagtcatggccattcttgttctcatgcctctattcttgttctgatgctctctgttttcagctctgccaattaaatcccactctgcttgatgacttgctcacagtcttgtccctgaagccttctgaggccaagttgagtctatactgaccttattgttaatttaataccttgagttgttttctagcttttcttagttttttgggtttttttctacatgtgcaacaggagctgtagtgattaatagcttcatctctggagtcaaggccatctgatttggaaacttggctctaccattttcctactgtgtaaccctgggcaagctcctagtctagtctgttttatgctgctataacagtatgccatagactgagaaatttataaagaagagaaatttatttcttacacttctggagacaggaagtccaagagcatggcgctgacatctgaagagggtctttttgttgtgttatcgcatggcagaaggcagaaggtcaagagagtacatgtatgagtggggaaagcggggaggaaggaaaggaaggtggcagaacttatccttttatcaggaacccactcccacaataactaacctacttctgtgataacagcatgaatccattcagtagggcagagcttttatgacctgatcacctcataaaggtctcacctctcaacctctttgctttggggattaagtttccaacatataaaccttgggatacacattcagaccatagcactccttaccctctcagtttcctcatttgtaaaactagagataataatagtacctgcctcactggggtattctgaggattaaatggcatagtagataaagcacaaggctccagcacttttagtggagatggggtttcaccatgtaaggatggtctcaatctcctgacctcatgatccgcctgcctcagcctcccaaagtgctgggattacaggtgtgagctgccgcgcccagccccagatattcttaaatacccggataattttaagtttagctgagattttggtgcccttcagaatcaatgaaggtcttaaaatataaaagggggttcagaaatagtacatagagaatacaccacaagccaggcacagtggctcatgtttgcaatcccagcactttgggaggccgaggtgggaggatcacttgaggccaggagttcgagaccagcttggccaacatagtgagaccatgtctctataaaaaattttaaaaattagccagctgggaggccaaagcaggcagatcacctgaggtcagaagttcgagaccagcctggccaacatggtgaaaccccgtctctacaaaatagccaggtgtagtgacgcacgcctgtgatcccagctgctcaagaggctggggcaggagaatcgcttgaacctgggaggcggaggttgctgtgggcgtagatcacactactgcactccagcctgggcaatagaggagactctacacacacacacacacacacacacacacatatgtatatatgtatgtgtgtatatgtgtatgtgtatatgtgtgtgtgtctacgtgtgtgtgtgtgtgtgtgtgtgtatatgccacttgtggtggcatgagcctgtagtcccagctatttgggaggctgaggcaggaggatcgcttgagctgaaaaggttgaaaaaaatttttttaataataatagatacatacatacgtattcaagaagtgtctataaatcacttacagtgtgctaggcacaggtggtaaggatattggggaaacagctcctgcctgcgagtgtcttcagtctggcaagagacaaaagaattattgttttagggttatttatttttatatagatcctcttgatatgtaagcttttataaatataagcttttgaaaatataagctccacgaagcctggagattttgtctttttttgttttgtttttgtctagtttgttcatttggcctcttgaacactgcctgggatgaaatatacaccgtaaatatttgttggattaatgaatatttgagattttggattctttactatttgataattaaggtatggcttttagatggttaaatgagaaggactctgaggaattgagcatggactttctaaccatctcactacaaaagtccaagatgattagcaaaatatctgtgtaattctagttatttcagccaccctcaagcattatattccaattggccatactctagtttaaaaacctgggagtggtattaagtattctttttcttttctattgacatatttctgttgtgcatttctattgccaaagatacttaaaacgtgtgcatatcctaggttattttaagatgactagccgtacaggtcaaaaaatttaaaaatggaatataagagaatcacctggagtaaaaagcaaacatagaagatgtaaaaatatatatggttgccattatagccttttgtgtggaaactctagcatatttgagcaaacatctttgagtattcccttttcacattttgtaggacatgatcagatataccatctgcttctctgggtaacttggcagctgttaattgactaacattccctgagttctgttgtcaccatcagtggttctagaacataagaacaaaaaaagattgtaagaatagccttcataacccaagtttcctttaaatcatagagagaaaaaaaataagaacctatattgaccaactgggaaaaactaaaggaatatttacataatcataagtcattttaattttctctaaggctattactacaatatatctaaatattttaaatgtatatataaagcaagagcaattaagtaatttaataccaacagaatttatatttcaaatggggggaaaatggatcatctcattttgtggtaagatatacagatgcttcctgttgccctgtccagaatgatgttaacattaacctcagaggaggccgttaagccagcgttgagctagacagtaaccattatgtctctctctattgaggaggaggggaaaaatgatgttacctaaatttatgagctgcaaactgaacacttcatacaatgatgatcaatgatatgataagttatcattcaatttctacggtttgtgtcctctctgaaatgaagctaagaaaaaaaattgtagggaaataacagactgccgtttgcattattagaaagctcacgtaactgcactatgcaggccatttgtcttttttttttcctgttagaagggagtttttattttctctgaatcaaactattagagtaatacattactgagttcatttttgcttctatctctttatcttgacttgagttcagaaaacttggaacatgtgcattcttttaagctgtctgaaaggattttgtgtatttatggttttacatgccgagctatttttcctcagaaattctgacatcaaatgtgtgaattttttctcacaccaaccaattctccaactttccggacaccaacggggtatcctacaattcaattcaattctaacattaacggcccagcattagcagcagactccacaggttttaaagagtcctcaattccaatgccattcgcaagtattgggtccccaggttacccacacacacttcttgggtacaaagtcagggagttcccacaactttctccccttcagcttgataatttgctacaatgactcacagaactcaggagcactcttatattaatatttactggctctttataaaagatataacttgggaacagccaaacagaagagatgcagagagcaagatattggcaggggtgttggaagccccgcgccctctctgggcacaccaccctcctagcaatttgatgtgttcaccaacccagaagctcactgaacctgtcattaggggtttttatggaggttttgtcaaatcaggatgaccaattattaactcagtcttcagctcttcacacttccccacatattgaggggatgggctgaaagttccaggcttctcatcaaggtctagtctttctggtgaccaggccccatcctgaagctatctagggccccagcaagaaacctcagtagaacaaaagatgcttctatcaaccaggaaattccaagagattaaggagctctgtgtcggaaactggggacagagaccaaatattagaacaaacgacgctcctatcatccctatcactcaagaaatggcagttttaagagctctgtgtcaaaaatcagggacaaagtccaaatagatagatagatagatacacatatatatacatatctctctctctatatatatacacatatatatctatttcttactatgtcacacatgctaactccttattctgaaataaaagcaaaaagcaaacaccaaaccaataacaaaaagcctccacaatgtacaggtgttatggggtcacatcatgataaacctattgcgaattgggaatattcttaaataaaaaatgcatttaatgtacctaatccaccaaacatcatagcttagcctagcctaccttaaatgagcttggaacacttacaatagcctacaactgggcagaatcattaaacacaaagtcattttacaatgaagtgttggctggacgcagaggctcatgcctataatcccatcacttggatactgaggcaggaagattgggccgggcacggtggctcacgcctgtaagcccaacacttttgggagactgaggcaggtggatcacctgaggtcagaagttcgacaccagcctggccaacatggtgaaaccacgtctctactaaaaatacaaaaattagctgggcgtggtggcaggcacctgtaatctcctagctactccggaggctgaaccaggagacttgcttgaacccaggaggcggaggtggcagttagccaatatcgtgccattgcactctagcctgggcggcagatcaagactgtgtctcaaaagaaaaaaaaaaaaaaaaactggacgacttagtacagatggtccctgatttaccatggtttgacttaggatttttcagctttaccatggtaaccatacaactattctgtctttcagtacagaactcaatgaatcggccgggtgcaagtgcccgtctgtaatccctgcactttgggaggccgaggcggacggatcacggggtcaggagatcgagaccatcctggctaacacggtgaaaccttgtctctactaaaagtacaaaaaattagccgcgcgaggtggcaggcgcctgtagtcctagctactcgggaggctgaggcaggagaatgccgtgaacctggggagcggagcctgcagtgagccgagatcgggccactgcactccagcctgggagacagagcgagactccgtctcaaaaagaaaaaagaactcttttttttttgacagagtcgtgctctgttgtccaggctggagtgcagatcttggctcactgcagtcccgacctcccaggctcaagtgatcctcccacttcagcctcctaagcggtgagtagctgggaccacaggtgccccactatgcatggctaatttttttgtttttctttttgtagagacagggtctcaatacgttgcccaggctggtctcgagctcctgggctcaagcaatcctgccaattagctgggattatagacatgtgccaccatgcccagcatatatttactttcattaatctatactactgcatcaaaattattataatgttgtggcatgttaagtcttttttttttctaagacagagtttcactcttgttgcccaggctggagcgcaatggcgcaatcttggctcaccgcaacttccgcctcctgtgttcaagggattctcctgcctcagcctccggagtagctaggattacaggcacgtgccaccacgcccggctaattttgtatttttagtagagacggggtttcttcatgttggtcaggttgttcctgacctcaagtgatccgcccgcctcggcttcccaaagtgctgggattacaggcgtgagccacctcgcggactgcatgttaagtcttttgaagcaggccgggcgcggtggctcacgcctttaatcctagcactttgggaggccaaggtggctgggttgcctgagctcaggagttcaagaccagcctgggcaacacggtgaaatcccgtctctactaaaatacaaaaaagtagctgggcgtggtagtgtgcgcctgtaatcccagctactcgggaggctgagacaggagaaactcttgaatccaggaggcggaggttgcagtgagccgagattaccccactgcactccagcctgggcgacagagcaagactccgtcaaaaaaaaaaaaaaggctcttgaagcacactaactcttccaaaattaagctcccttaaaggaaaatagaattattaaaatgaaaacagtaagcaacataactgttactatttcagctaagaatcttaaagcacattacagacacttttcatcttaacaattggaaaaaacaagtactagcaagtgaattgcttaagattacatagactagcccaattctagagagaaataattcaagtgtatcttattgtcatcttgttgttaagtacagacatattcagatttcaccagtttcccactaatgttctttttcttttttcttttctttttttgagacaggttctcactctgttgccaagctggagtgcagtggcacaatcacagctcactgcagccttgaactcctagacacaagtgatcctcctacctcagcctctcaagtaattgggactgctgacttgaaccaccatgcctggctattttttattttttagtagagatggagtcttgctgtgttgcccaggctgctcttgaactccttgattcaagtgatcctcttgcctcagcctcccaaagtcctaggattacaggcatgagccactacatttgacctaatgtcctttttctcttccagagagttaatctttccttgtctttcatgaccttgacatttttgaagagttctagtcagttacttggtataactgtccctgagtttgggcttgtcttatgttttctcatgattagatgagttaatatatttttggcaagaatctcagacatgatgtcctatcagggagtacatgatgtcaaaatgtgttattacagacagtttatgtagttttgttttctttctttctttctttctcctctcctctttctcctcttctctttttccttttttttttttttttttttttttgagactgcgtcttgtgctgttgcccaggctggagtgcagtggggcaatgacagctcactgcaacctccacctcctgggtttaagtgatcctcctacctcagcctcttgaatagctgggactacagtcatgcataaccaaccctagctaatattttatttcttgtagagacaggttgcactatgttgaacatgctgagtttgaactcctgggctcaagccatcctgccgtctcagcttcccgaggtgttgggattacaggtgcgagccagtgggcctggctaccagttgtatagttttatattgctgctgtaacaaattacctcaagcctagcagcttacaacaacacccgtttactatctcaaattagcatcttcataggttagatgcagattaatgagtttgtttccacttactgttctatcaagttaccacatcgagaggcttaaaataaaacaaatttttttcttacaattcaggatgatagaagtctgaaatgggttatagtgggttaaaattaagatctcaaaaggcctgcatcccttctgggggctgtgggagaatccattcccttgttttttccagcttctagaagctacctgcattccttggcacatgttccctttttccatctttaaagccaacagcatagaatcttctaatctgctacctctgatcctcctgcctcactcatacagatgcttcttattacattgggtccgcacagatactccaggatcatctccccattttaagatccttactttaatcacatctacagaaatccgtcttgccagatgaggtaacatattcacaggtttagggaattagaacatgggcacttttgggagccattattctgcctaccacatgaatatatttagactaataagacaatcagtccatataaatcaggcaaaggtaaaatgtccttaaataacatgtttctttttactcttccttcttattccagtgagtagctttttttttttccaagacagagtcctcctatgtcatctaggctggagtgcagtgatgcgatctcagctcactgcaaccaccgccaaccaggttcaagcgattctcctgcctcagcctcccgagtagctgggattacaggcatgagccaccgtgcctggctattttgtgtgtgtgtatttttagtagagatggggtttcaccatgttggccaggctagtctcgaactccaacctcaggtgatctgcccaccttggcctcccaaagtgataggattgcaggcgtaagctaccacgcctggccatgggtaactttttttaaatttgcaatacatttgcacatttatctagctccataaaaagtaatgtcattaatcttccattggtagcacattggctttcatttgtcctccagcaacagtgaagaactgttgttaatccatctgtctgtcagctcagatttttaccagttataaaagcaacgattataatttgccatgatgcattactcttctgtccagagagctcagtttatatgacctgtattcagatcattggttggaaattacattgccagacctaaatgaaaaaaaaagtaaacattctcttcatattcttggctataagtatgcttttacttttcattcatttattcattgaacaaatgtttattgaatatctgtgcaaggtactgcaataggtattggtgctataaggtcataattcaaaatatggggatattgcttttagtagcttaacctcaagtaataactcaagtactatctcatatttatatacttactttcttttttctttttgagacagtctcgctctgttggccaggctggagtgcagtggcgtgatctcagctcactgcagcctccacctcctgagttcaagcaattctcctgcttcagtctccagaatagttggacacaggcgtgtggcaccacacccagctaattgttgtatttttagtagagatggggtgaaactatggagacatagtttcaccatgttggccaggctggtctcaaactcttggcctcaagtgatccactggcctcggtttcccaaagtgctgggattacaagtgtgagccaccccagcctatatacttactttctgtctgggaggtagtttctaaaaccaaggttttctcattcttattactgttgactgactggaaataaaatttttgatataaagtattatgtgtaaaaaacaaaatatattatgtgtaaaaagtcatttaatgctttatatttctagtactgaactatagattggttgcatactaattcacaggatactcagtattcgctttctttctttcttttttgtttagatacagggtcttgctgcgttgcccaggctggtctcaaagtgggctcaagtgatcctcccgccttggtctcccaaagtgctggcattacaggtttaaggcactatgtctggcctcatactttttaaaagatgaaattcttagaagaattttttttttttagatggagtctcgctcttgtttcccaggctgaagtgcagtagtgtgatctcggctcactgcaacctccgcctcccaggttcaggcgattctcttcccttagcctctacaggtgtgcgccaccatacctggctaatttttgtatttttagtagagacggggttttaccacgttggccgggctggtctcaaactcctgacctccggtgatctgcctgcctcggcctctgaaagtgctgggattaccagcatgagccaccatgcctggcccagaagaatttttttaagtgtaatacaataaaaacaattaacatttattaagcacttactcctgcgcagagctttacacagattatttagtctttcaaacacctctatgaggtaggtgttattattatcaacatccccatttcgcaggtattagtaatagagatgacgtagctggggagtggtagagccagaatttaaatctggggaactgatcccattacttcctcccttaacgcacacatcagtgtgtacagtatctcatagtgttgccactcagtaaatagtgtaggatataatgattgctccaaatcctgctcatagattgatcattttccccaattttgaaatatcactgaaaaactataacttcgatggcttgtaaaacatgcaggtatggaaatttcagaaggagcctaagtgccacacagacttagtaaatcaaagtcctgttaaacatacatacaataactagcacccaggacattgctgattcaagttcatcattgctgctgttgaaatcacctctttaatttgatggcatgactcagggagaatgcagcttcagcacagttattcagaataaggtaactatattctagtgcctgttttaccattagcaattactttcccataattgagacagactgctgtcaatttagttattatttttccagttcttagaaaattcctgaagaaaatacttaggtaaataaattttggctgcctagtgatgattctttttttgttttttttaagatggagtttccctcttgtcacccaggctggagtgcaatggcatgacctcagctcactgcaaccttcgcctcccagattcaagcaattctcctgccttagcctcccaagtagctgggattacaggtgcctgccaccacacccggctaattttttgtatttttagtagagacagggtgtcaccatgttggccaggctggtctcaaacacctgacctcaggtgatccacccgccttggcctcccaaagtgctgggattacaggcgtgagccaccgtgcccagccacacacttggctaatttttaaattttttgtagagacagggtctcactatgttgcccaggctgggctcaaactcctagcctcaagtgatcctcccaccttagcctcccaaagtgttaggattacaggcgtaagccaccatgactagtcctagattcttaaaagtatattcaattcacacctaatcagaaagaatggttttcatgtttgctttatttctatatttgaatacttaaatatttcattcatagaaacgtgatgttttctaatccaggacactcgagtttataatatttccatgatgaagttcatggagcttcccaaccttacttaaaaaaaaaaaaaaaagccatccaggcacaatggcttacatctgtaatcctagcactttgagaggctgaggtgggaggactgcttgcgctgagttcaagaccagcctgggcaacatggcaagatcctgtctctaaaaaagatacaaaaattagccaagtgtggaggtatgcacctgtggttccagctgcttgggaggctgaggtgggagaatcacttgagcccaaaatgttgaggctgcagtgccccactgcactccagcatggacaacagaatgaggccctgtctgtaataaaaaaggctagccaggtgccggggctcatgcctataatcccagcactttgggaggcttaggtgggaggactgcttgagcccaggagttcaagaccagcctgggcaacatagtgagaccctatctctattgtttttttaaaaagccagataagtaggaaaggaaattatttcaatttacatccacaattgtacaagtgttttaaatatggatacagttaacaagaatgaatattattcaagataattaaacattttagaataaaatagaaaataaaatgtaagaaatgtgaattatttagtccagtaaaatacactgtctaaaatatattcaaaatatgtttatgttttttataattttaaagtaagttttgtcagcatatgtatgactacacgtgactaatttctttctttcttttttgaatcagaatctcactgtgtcatccaggctagagtatagtggcatgatctcggctcactgcaacctccgcctctcaggttcaagtgatttgcctgcctcagcctccagagtagctgggattacaggcatccgccaccatgcccagctgatttttgtctttttagtagagatggggtttcaatatgttgaccaggctggtctcagactcctgacctcaggcgatccggctgcctcggcctcccaaagtgctgagattacaggcatgagccaccatgcccggccacataactaacttctactgaattgctaatcatttggaagaggttttgataaatttgggtctcctatcaacaaatttaaagaaatagaagatagtgtcctgaagaaccaataaattgcacagtatgataaatggaaatggttactagttgataacagagcaaaaaaccttatgggaatccaagtggctaccaagcttacatgaatcaccagtactaagatggtgaacaaataggaatagttaatgattatagttgctttgccagaagaagaaaagtttaaggcatgatacaataattgcatgtaagaatataactggaccgagcacagtagctcacacctgtaatcccagcacttcgggaggctgaggcgggcggatcacaaggtcaggagtttgagaccagcctggccaacacagtgaaaccccgtctctactaaaaataaaaaaattacctgggcttggtggctggtgcctgtaatcccaggtacgccagaggctgagacaggagaatcgcttgaacctgggaggtggaatttgcagtgagccgagatctcaccactgcactccaccctgcgtgacagagctagactccatctaaataaaaaaaagaatatagctgattattaatcaaacctgcttagtaaaggagttctaattgacagtgaacttatcacttggatgggagagaaaatggtgaccaacacctttgatgtattagtttggtgggagcggggagttcaggggaaaaaaagacgctgagggaaagaactatgggcccaataggaagttgatatctggaatctttttggtcactaaataagctagattgcatcagagactctagcaaaaacaataatttctcagatgtttattgtgtgtgaccatgctgagtcagagggtgcgtcaaccccactctgggaggaaagtgctcacaaggagagaggaatgatctcttcctgggtaagaggatcttttttttttgagacggagtcttgctctgtcgcccaggctggagtgcagtagtgcgatctcggctcactgcaagctccgcctcctgggttcacgccattctcctgcctcagcctcccgagtagctgggactacaggcgcccgccaccacgcccggctagttttttgtaaatttttttttagtagagacgggctctcaccttgttagccaggatggtctcgatctcctgacctcgtgatccgcccgcctcggcctcccaaagtgctgggattacaggcgtgagccaccacgcgcccggcctaagaggatctatttagtaaaattccttgcctagtgccctaatcagtatcttgatgcctgggaaaaattaactattacccccaggagtgagcagttgacttcctttactcaacagtaaggatggggcataataattagggttaacatcagaaagttcacatttaagagcatgttgaatactgcccagggtacaatttcaagtaggcacagtccttgcctagtaacctgaattgtaaagctgtgaagaattgcagtcactgtattagaagcataaaaggtttctgcccctttttagggtgtttttcattttctttctgaaaattgctattgttacacatgtacttactgaattaaaccacaaacatgaatggaagaatcaattccaaccaaaaaattaagtggaataagatgtggattctcaagacccacatatattttattttgttttgttttgttttttgtgacggagtcttgctctgttgcccaggctggaatgcagtggtgcgatctcggctcactgcaacctccgcctcccgggttcaagcaattcttctgcctcagcctcctgagtagctaggactacaggcgtgtgccaccacacccggctaatttttgtatttttttagtagagatggggtttcaccatgttggctaggctggtctcgaactcctgacctcaagcagtctgcctgcctcagcctcccacagtgctgggattagaggcgtgagccacggtgcccggcaagacccaaatatattattaaagataatttgaaatcttttctggcactcagatttatatggggtaccaattctttacaagatatttgtcctaataccccattttaattttttaatttttttattttttttgagacagagtctcattctgtcatccaggctggaatgcagtggcatgatctcaactcactgtagcttccacctcctgggttcaagcaattctcctgcctcatcttcctgagtagctgggattacaggtgcccaccacgacgcccagctaatttttgtattttttttttttttttagtagagacagggtttttgccatgctggccagggtggtcttgaacccctgacctcaagtgatccgcctgcctcagcctcccaaagtgctggggttacacacgtgagccaccatgcccggcctaatatcctgtttttaaatgagaattatttcagtcttaccaaagggatatatatatatatacatatatatatacacacacatacacacacacacacgtgtgtgtatgtatatatgtgtgtctgtgtatatatatatatatatatattttttttttttaatttattttttttgagacagagtctcgctcttgttgcccaggctggagtgcaatggtgcgacctcggctcactgcaacctctgtctcctgggttcaagtgattctcctgcctcagcctctcaagtagctgggattacaggcacctgccaccatgaccggcattttgttttgttttgtttgtatttttagtagagatgggatttcatcgtgttggccaggctggtctcaaactcctaatgtcaggtgattcacccacctcagcctcccaaagtgctgggattgcaggcatgagccaccacgtctggctagggcaatatattttataagtcaagtccaaatgaaggatgtgcagacaaagtaaacttttaatagttgtttatcacttctataatacacacgatgtcaatgaacctgtagaagatgcacttcatgtatgactgggaatgatgtgagaggaaattattaggtaagcacattagaggaaaaccatcagagatatggggagtaaaaggagtaaggagcccatcccatctcatatggaactaaaaggtttgaaaaaagattgacacatgcacttggctaggagagtgatggataaacaaggagagagtaacggtcacagaggacacacacaggagttacggaggaataaccccattttcccaagggaatgcagctgcccacgcatacaccttcccttactccatttcccccaggtttgcagatacaaaataagccccatcccatgaaagggtgtggctgtttagttcctgctaagtacacaatacatttccactttatgctttatgggaattgtagctggaggagctacagaaaggcatatgttctattattatttaactttatccacataacgatatacctcagatcaaggctaggttgctcccagcctttttttttttttttttgaggcagtctcgatctgtcacccagcctggagtgcagtgacgcaatctcggctcactgcaagctctgcctcctgggttcacactattctcctgcctcagcctccccagtagctgggactacaggtgcccgccaccacacccggctaattgttttgtatttttaatagagacagggtttcaccatgttggtcaggctggtgtctaactcctgacctcgtgatccacctgccttggcctcccaaagtgctgggattacaggcgtgagccaccgcgcctggccttctcccagtcttaaaagaaaaaagaaacaggccaggcatggtggctcatgcctgtaatctcagcactttgggaggctgtggcaggcagatcacttgagcccaggagtttgagaccagtctgggcaacataatgggaccctatctctacaaaaaaatacaatagccaagcatggtggcatacacctgtagtcccagctactcggaaggctgaggtaagaaggtcacttgaacttggaaggttgaagttgcaatgagctgtgatcgtgccactggactccagcctgggtgacagagcaagaccctgtctcaaaaaaaaaaaaaaaaattaaagataaaagaaaaggtggggcacagtggctcatgcctataatcccagcactttgggaggctgaggctggcggatcacttaaggtcaggagtttgaggccagcttggccaacatggtgaaactctgtctcattagtaataagaatacaaatattagccaggcgtggtggcccacgcctttaatcccagctgctcgggaagttaaggcaggagaattgcctgaacctgggaggctgaggctgcagtgagctgagatcgtgccactgcactccagcctgggcaacagagtgagactcgaaagaagatagaaagaaaagaaagaaagaaaaagaaagagagaaagagggaagggtgggggaggggaggggggagagagagagagagagagagagcgagcaggcaggcaggcaggcagggcgcggtggctcacgcctgtaatcccagcactttgggaggccgaggcaggcagatcacgaggtcagaagatcgagaccatcctggctaacacggtgaaaccccgtctctactaaaaatacaaaacaattagccaggtgtggtggcgggcgcctgtagtcccagctaccggggaggctgaggcaggagaatggcatgaacccgggaggcggagcttgcagtgagccgagattgcaccaccgcactccagcctgggcaacagagtgagactctgtctaaaaaagaaaagaaaagaaaagaaaagaaaaaagaagccaacaggcaaacttgggagggcctttattcttcttggcagggaaaattgagattagtgaaattcagtcatgctttcttgtttcttttagacttcaacactatcccaggacttcccatcagcaaagtagatgcttttgttctacaacaatggggcaaggtccccctacccacaggaacatgaagaaaatcccaaagtcttggaagggtttaaagatctcaagaggctcagtttctgtcttagtttgccttgtgacttgacactttctttaattcagaaaataatttatattaataatgtacagtacatagtctggcagggaggttacttatgttgctgaaggatacagtaaatctcataaagcggaaatgaaacaggagaaactgtaaaactagtttggctttcacccctgtactcaaactatagtaccattttactgaaactataatactaaatatgttatttgaggaatattacttcatttgggcctagtacttaactactctatagcagcagagactggacaattatgtgccaaggttcttgaactatatttaaaagcttaaaaaggccagggatggtggctcagacctgtaatcccagcactttgggaggctgaggtaggtgtatcacttgagcctaggagttggagaccagtctgggtaacatggtgaaaccctgtctctacaaaaaatacaaaacaggctggaggcagtggctcacgcctgttatcccagcactttgggaagctgaggcaggcagatcacttgaggtcaggagtttgagaccagcctggccaacatggcaaaaccccatctctactaaaactatagaaattaactgggtgttgtggtgcacacctgtaatcccagctacttgggagactgaggcagaagaatcccttgaacccagcaggcggaggttgcaatgaaccaagatcacaccattgcactccagcctggacaacagagtgagactccatctcaaaaaaaaaaaaaaagaaaagaaaagaaaaaacaaacaacaaataaacaaacaaaaatattagctggccatcatagtacatgcctgtagtcccagccacttgggaggctgaggcaggaggatcacttgagtacaggagtttgagcctgcagtgagtcatgatcctgccacttcactccagcctgggcagagcaagaacctcactcaggaagatataataaaataaaagcttaaataatttgaaacgaagggaagggcctcaactctatcctaaatacaacagaagactcaccaactttatactggacacaagtgcagtagagtttggtatgcggtaagtgatgagaaaatagttatagattgataaattacagaggtttcatttttaatgtattattgtctgttttctcttttttttgatgcaaagtctcactgtgtcactcaggctggagtgtagtggcatcatcaaggctcaccacaaccttgaactcccaggctcaaactatcttcctgcctcagcctcccaagtagctgggactacaggcacatgcgaccatgcctggctaattttttaaaaattttttgtagagatgaggtctcactacattgtccagactggtctccaactcctgggctcaagcaatcctcccaccttggcctctcaaaatgctgggattacaggcgtgagccatggtgcccagcctgttttctctttttatgtccctctttaccactgtgatacatactacagggctctagcaagaactaatatctattctttcgttagggcagttttaattctttcatactcctctcatcaagaggtgaggtgtatgtttcccccacttgaatcctggtgggttcagagcctggcttgaccaataaaattcaatggaagtgatgtcatataatttctgaggttaagtcataaaaagtctcgcagcttcctctgtgatctctaagaattaccttgcccttggagccttgagctaccctataagaagtccaactaaccagaggctgacttgctgaataggccacaggaagatcctttctggaaggcaatcccatctgatcatgtcattccaccattccagcctaggagctgaacatacgagtgaagatgccatgtgggaactgaatcctccagccagaactgttcaaacttcttcagtccctagttgtttgagtcatccctaaatattccagtcatccagctgaggccctggccttgtagaacagagaagagttgcccccctaactgctgtgccctttctgtattctggacccatggactctcaggaacctaacaaaatggttgttttacatcagtaagttttggggtagtttgttgtgcagcaataggtaagtggaacacctctcagaatctgtgtgttttagttggggagatagctgcccagctagatactgcatttcccagcctcctcacttacgggtgaacgtggctgtaagtcctgtgtagggtatgtgaatggaagatgcaatttccaagtcatatcaataaaatgttaagtgctcattctccgcttgcattccctcaccgcttctttctggcacaccgacctggggtacacagatattaaggacggctgtcacagattggattccctaggaagcagactcagagcagtttagcatgcagaatatttattaaggcgttccctgggagtcaacacctgtgtaagggaggggacaaaagcaagagcgggcaaaaggaaaagttgagctgcaatgcagattcaatggcagcctcagccaaccccacagagaggtcaggagctaaagtggtccttcagaattgtccctcattgggctgagatggctagacctttatacctccacaggtatcagtcattggatgggggtcatcctggcatatgcttttgcaaagttataatcaggatatattagtcatctattattgcataacaaaataatccaaaacttagtgactaaaaacatgcatttattatctcacagttgctgtgtgctagaaatccagaagcatgaggttgggtgcttctgactgaagatatttcaggttgcagttaagctgtcagctggggcagcagtcatctcaactctattgaggccaaaggattcagctcactcacgtggttgctggtaggccccttccttaccacaggatgcccctctgagcatgagagtattcctcaagaccaaggaggaagctgcctatgggacctcagaacatggaaggtggtgatcaagcgtgggagaaccatagagaacccaaaaacgaaacccaagaagaattaggttttaaaacctaatctcagtagaattaggttttaaaacctaatctcagtagaattaggttttaaaacctaatctcagtagcgacatccttattcattagaagtaagttcagcccacactcaagggtagcggattacccaaggtcatcccaggaggcagggatcattgaggccattttagagtcttcctaccacacataccatgcataagattttgtatacttatatttttactttttttttttttgagatagagtctcactctgtcatctaggcgagagtgcagtggtgcgatcttggctcactgcaacctccgcctcctgggttcaagtgattctgctgtctcagcctcctgagtagctagaattacaggcgtgtgccaccatgctcagctaatttttgtatttttttgttttgttttgttttgttttttgagagagtctcactctgtcatccaggctggagtgcagtggtgtgatctcggctcactgcaacctccatctcctgggttcaagcaattctcctgcctcagcctcctgagtagttgggactacaggcgcatgccaccatgcccggctaattttttgtatttttagtagagacagagtttcaccatgttggctatggctggtctcaaactcctgacctcaggtgacccacctgcctcggcctcccaaagtgctgggattacaggcgtgagccaccgtgcctggactactttttatcaacattttgttttcctacagattcttcatttaaacaattttttttttgagatggaatttcgctcttgttgcccaggctggagtgcaatggtgtgatctcagctcaccgcaacctccacctcccaggttcaagcgtttctcctgcctcagtctcctaagtagctgggattacaggcatgcaccaccacatctggctaattttgtatttttagtagagatggggtttctccatgttggtcaggctggtcccaaactcttgacctcaggtgatctgcccgccttggcctttgggattacaggcgtgagctaccgcacttggccacaatatgttgtttctaaaaattataaagcagtatattgtaaaatttttcaaatgtttgatcaaggtataaaattcatttccttatactataccacatgttaattgatccaggggtaatcacaattaagtttttattgtatctgctgagatactttccatacacacgtaagcatatacatatatacacacacacacattattgtacacttaatttatgtccttaatacattctgaagcactttccatatcagcacgttgagatctagctcattggtttaaacatctgcatgtttcattttatgattatacaaaaaaatttttcagcagttccctattgatggatatttacatatttttgttttgtctgacatgacaaacattgcaaatgtacatcctttgtctcatgatgaatcatgccttgagtctcactcatatctgatttagatgagactttggactttgactttaaagttgatgctggaacaagttaagactttttaggggctattgggatggaatgaatttattttgcatgtgaggacatgaatctggggagcccaaggtgtggaatgctatgttttgaatgtgttgtctccacaattcatgtgttggaaacttaatcccaatgcaacagggttgggaggcggagccttctgggagatgattaggtcacaaggactctggcctcatatttgattgatgccattataaaaagggtttgcgggagcatgttagctctcccttgcccttccatcttctgccatgggaggacagcaagaaggcccttcccagatgctggcacctgatcatggtcttcctggcctccagaattgtaagaagtaaattttttttttttttaacgaagaagtgagtattttattattttgctgtacagctgttgcttcactatataaaaacagcaccagcaaatgcagtgtattgcaaaattaagatagtgttgttcttcatctgacactgtacaagcaacaaaaacttcttcactcccagttatttccaatggaaagatcattaagtatttcatcccaagtccaggtatggacatacacaagttacaatattatataaggcttaagaataacaacattatctttgaattatgtaatttttgtaactaatttttaccatggataatttcatggataatttcatgaatactagagcctagtctaaaaatcataggatgttgtgaaaaagacacatattatgtttatctacaatcattagaaagttaaaaggcatcttctttcattagcagtgttaacagtagtttttttttcccatgggtaatgctaaaagttgctattctaagtcttctatccaccactaatttaggacaactctgctgggttgcgttatttcatactagcttatttagtggttccattttcactcctcaatagattttatgtatttctcatatgcttcttcactcataagttcatctagttatgaagggttactcagtgtcatcttgatcagccaaccatcttcataacgagatttgtttacaagtcctggattttctgcaagagcttcattaatttcggttacttctcctgataaaggagaatagagttcactagcagctttcacactctccaaagcaccaaactcatcttgtttgttcaattttgtcccaacttcaggcagattacagtaaccagacggcgcccatcccaagctgccagggcctcgataggcagggcgcggcaggtgccaggaccacgtgcaggctgcagagcacggcccgcacgctccgcaccactcgcagcgccatgttcccaggggtgcggggatggcagcgctacgcctcagccactcgcgcggggaggcggggcggtgtgggcagaagtaaatttctttataaattacccagtctgggcctggtgtgttggctcacatgtgtaattccagaactttgggaggtcaaggtgggaggagcgcctgggcccaggggttcaagacgagcctgggcaacatagtgagacctgtctctataaaatatttttaaaaattagctgggcgcggtggcttacgcctgtaatcccagcactttgggaggccgaggtgggcagatcatgaggtcaggagtttgagaccagcctgaccaacatggtgaaaccccgtctctactaaaaatacaaaaattagctgggcatggtggcgcacacctgtaatcctagctagatcctagtagattgaggcaggaaaactgaacccgggaggtggaggttgcagtgagctgagattgtgccactgcacttcagcctgggcgacaaactgagactccgtctcagaaaaaaaaaataaataaataaaaattagtggggcatggtggctcacacctgtagttccagctgttcaggaggctgaggcaggaggattgcttgatccagggaggttgaggctgcagtgaactgtgatcatgccactgaaccccagcctgggtgacagagttgcctcaatcagtcaatcaatcaacccatcacccagtctgtgatattctgttttaacagcagaaacaaagacaactagacatgcccactgtgttatgtacttacctctattagaatatgttatgtcattactataattgatgcctacatatctcttttagtatactgttagcttcttgaggacattagctaaattgtatttctctttgtagtcttgggtaatgtacttgacacacagtagatactctgcaaaaaaattttgtttttctttttgagatggggtctcgctttgtcgcccatgctagagcgcagtggcgcgatctgggatcactgcaacctccgcctcccaggtttaagcaattctctgactcagcctccagagtagctgggattacaggtgtcttgccaccatgcccggctaatttttgtatttttagtagagatggggtttcactatcttggccaggctggtcttgaactcctggccttatgagagccaccgcacccagctgatactctgcaaatgtttaatagatgttggagctgaatttcaggctttgtaatgtcacagaaccaggcatcagaagagctgatccaaacccaagatctgcccctaacttgcctcttattctttctggcctccatttccacaattataaaatgcaggtataatactaaaatttttttttgtatagtcctttacagatccaaaattatgattttaagaaggaaattaataagttattcatctcagtatctctttaggtgccaatactgtaaattaatcaccagtctcagatcatatatttgccatttccaacatatgcttttagtccagtctaatcaccagtctcagactatacattgccattttcaacatatgcttttagtgagttatttaaaaatattaagatatcagatgttttgagtatcagcaataggtaagtcaatctctaaacattttcagtagtgaaaaacacaaaaaacactttaagcagagggtatttggttttgagatccttgttctcttaaaatctgtgatctgaaatctagtcagttttctcattaacatccttgtcccttgggataaattaaatcagcaaactaaagtgctatgtaactattaaaatattttaaaatattggttatttaaaacttattaggggccgggtacagtggctcatgcctgtaatcccagcactttgggaggctgaggcaggtggatcacttgaactcaggagtttaagaccagcctgggtaacatggcgaaacctcgtctctacaaaaaatacaaaaattagccaggtgtggtggcgtgtgcctgtagtcccagccacttgggagactgaagtgggaggatggcttgagcccaggagatggaggttgcagtgtgctgagatcatgccatgcattgcactccagtctgggtaacagagccagaatcttattagggaattctgacatcttcatctttttataaaagatggccaggctgggtgcgctggctcacatctggaatcccagcactttgggaggctgaggcgggtgaatcacctgaggtcaggggttcaagaccagcctgaccaatatggtgaaacctcatctctactaaaaatacaaaaattgactgggcacggatagctcacgcctgtaatcccagcactctgggaggttgaggcgggtggatcacctgaggtcaggagtttgagaccatcctgcccaacatggtgaaaccccgcctctactaaaaacacaaaaattagctgggcgtggtggtgtgctcctgtagtcccagctactcaggaggctgaggcaggaggatcgcttgaacccaggaggtggaggttgcagtgagctgagattgcgccactgcactccagactggcaatacagtgagactcaatctaagataaaacaaagaaacaaaaaggaatgcacttcttaataagctggagattattttaggcatggctttccctcatagtctatgaaattttcctacaatgatcatcctcagttagcacatggggcatttagtatatgtcaggaaacaggcctaaggtttttacaagctttctgatgtaatcatcaaaacaattctatgaggctggaagtaggtacaattttacaatttttatcctcattttacagatgaagaaatactcttaaagaaaatgttaatgtcaacaacaaacaataaattggtactgggtattgtcaaatatattttttaatttttactttttttcagacagagtctcactctgtcacccaggctggagtgcaacggtgcaatcttgactcactgcaacctccgtctcctgggtttaagtgattctcctgcctcagcctcctgagtgagtagctgggattacaggcatatgccaccatggctggctaattttgtatttttagtagagacagagtttcaccatgtcggacaggctggtctcgaaaactcctgacctcaggtgatccgcctgcctcggcctcccaaagtgctgggattacaggcttgagctactgtgccaggccaagtatatttttaattaatgtattcattataatacaatttactacaaatttgaggggggaggctttccatatggaattcaagatatttttggatatatattcaacttttttttttaagagttgggggtcttgttatgttgctgatatggtttggatggctgtcacttccaaatctcatgttgaaatgtaacccccaatgctggaggtagggcctcgtgggaggtatagaatcatggggcaaatccttcatgaatggcttggcaccatcaccttggtgatgagtgagatcttagttcatgtgaaatttggttgtttagagtctgggacctcctcctctctcttgctccctctctcaccatgtgatatgctcgctcccattttgccttctaccatgattgtaagcttcctgaggccctcatcagaagcagctgctggtgccatgctttgtgtacagcctgcagaaactgtaagccaattaaatctctcttttgcaagaattacccaatctcagatattcctttacagtaatgcaaacagattaaaacagattagtactgacagtggggcactgctatacatattggaaaatgtagaaacagctttggaactgggtaacaggcagaggttggaagaatctggagggctcagaagacagaaagatgagggaaagtttggaacttagagactagttaagtggttgtgaccaaaatgctgatagacatatggtgaagtccagagtgatgaggtctcagatggaaatgaggaagttattgggaacaggaataaaggtacatctatgtcatgctttagcaaatagcttgggtgcattgtgtccaggccctaggaatctgtggaagtttgaacttaagagtgatgacttagggtatcagggtatctggcagaagaaatttctaagcagcaaagcattcaagatgtggcctggctgatgctagcagcctacaatcagatatggaagcaaagaaataacttaaagttggaacatatttaaaagggaagcagagcgtagaagtttggaaaattcacagactagtcatgtggcagagaaggaaaaagcactttgaggagaggaatacaagcaggctgcaggaatacagttgtccatgctggactcaactcatttgctcaagcaatccttgtgcctcagcctcccaagtagctggggctatagcttgtgccatcatgctcagctattcaccttacattgctgtccaaaatgttttcatttgaggcaacctgggatagtaaaagtacttctaattaaacactcctgccattagtatctagctgtgtagccataaataagttatttgatatttcttgagtctcaattaatacctactattagcagagattttgtgaagaatagtcttaatgtatttaaagctttaatggcacttatttagaaggtcctcaggaaatggtattattattccaaggtctttctagattgccttattcacctaaagagacttgatcttgagcctttgtagattttctcattggtgattccttcactgcttagaatgtcatgattccaccagacaggttactctcatctacgtgtatttttcttacatctttttcagtctatttttctctagcaattatcttcaatgtttatgcttacaataaccttagtatttggcattacgacactaatatgtgcccatgagacagacggagcactacttatcccagaggaggtattatttatttatttatttattttttgagagggaggcttgtttcttcacccaggctgcagtgcaatggtgtgatctcggcttaccgcgacctccgccttgactctcagttcaagcgattttcctgcttcagcctccccagtagctgggattacagccatgtgccaccatgcctggctaatttttgtatttttagtagagacagggtttcaccacgttggccaggctggtctcaaactcctgacctcaatgatctgcccgcctcagcctgccaaagtgctgggattacaggtgtgagccaccgcgcccggtccagacaaggtattttttagagattatgattgttcaccacaagctgcctagcaggtagcccaaggatcctggatcaacttagctatatagcatcttttctatctgaatgcagtattctcttacccacaaccatatgaagtctacacatattcattaacagtattatataaaatacaaaattgggactatgtcccctcaagatgagcacagtgctaagaggtaagagatgggaagtttgtattaagttcaaacacttttggcaagaatttatacaatttcaggtaactgggcattttaggcaaagcacacaacttcatgatgtatcactgaggaggataagataaacagttctaaaagctggtacaggtgacaaattttgtgcaattttaagttttacatttttttgtacaaataggatcttgctatgcagtccaggctggtcttgaactcctggcctcaactgatcttcctgccttgaacccccaaaatgctgggcttacaggtgtgagccactgcacctgctgtttttaaagatattgtaacatactattattctaaaaccttatcctttgttgtatcagaaaaacgacatcctagactgggcgcggtggctcacgcctgtaatcccagcactttgggaggccaaggcaggtagatcacctgaggttaggagttcaagaccagcctggccaaattggtgaaaccctgtctctactaaaaatacaaaaattagccaggtgtggtggcgtgcgcttgtaatcccagctaccggggaggctgaggcaggagaatcgcttgaatcagggaggtggtgattgcagtgagccaagatcatgccactgcattccagccttgggtgacagagtaagactccatctcaaaaaaaaaaaaaaaacaaagggaaaaagggcatcctatacttgggctgagtctttagtgaaagcagaaaagaataaggattacaaaacaaataaattgtgaacatagttttgtttgtttgtttgaaacaaagtcttgctctgttgcccaggctggaatgcagtggcgcaatcacggctcactgcagcctcaacctcctgggtcaggtgatcctcccacctcagccttccgagtagctgggactataggtgtacaccaccacacccagctaatttttgtattttttgtagagatggggtttcaccatgttgcccagactggtctccaactgcctgggctcaagcgatccacccaccttggccccccaagtgttgggattacaggtgtaagccaccacacccaaccttagattaaaaaaaaaaattatctatttttaattatctcctaattgtaaaatttttacttccttttttatttttttaaattctcagtgatccttattctgattccttttggttttgacaattaaaaattatgaaagctggttgttttgtctcctattgctgaaataatttagttgatttaacactacagatggtgttaggataatgaatacagaacatcaatgagaatctaaattatatctcttgagacctccctcattccaagggaggtctcataagtatacatgcatacatgtataacttataaaaaaaaaaaagccacataaatcaccatgacattatagaagcagattcaagagaaaatagaaaaatgtgttcaccattaaactcaatactaatttttagaagtaacaacctatagaatcaacattaatgagacgaaataatatgttgcagttaagaacaacaggctttggagtaaataagaagtaggtttgagttggtgacttttgctgtgtggccttgggcaagctatttaatatacctaggcttcagtcttcatcagtaaaatgagataatactactatctcacagggttgtagcaagaacaaaagaagataatgcatgtaaaaccagagtgcttagcacatataataaagctaaattatcattagccattgttactatgattattattaattataattatcctagatacatatctgagcatgattatgtatttttcctatttacccagcttgacaaggtgcttaaatcttttctttagcactagaaaaaagtaggttttaattgaacctcttttcatttcatccattttacagacaaattatttatgaagataagccaacaactcataatttaaggatctctttatgttcgtcacaaaggttatcaatgcttttaagagcatctgcatagttttgttatttaacctttacacacaatacatgtttttcaaactgcaaagttgataactaatatcattttcaaataggcatagtataaccttaaatattacatgattcaaattattattatttttttttacaaagaaataaacctgtaaaggatcactgcactacagttgtccattaattatctgcggcaaaactgggatcctagtagaagcttcagcatatggatggttcctctactgcctgggcaccctctgtgacagctttgacacatttggccattgtctgtgaggctctgctaattgaatctgaaagatattaagaaaatgtcattttgataatacaactttttaaaaagcacatactaaaactttaatggtgcacatattcaggaggaaaaaagattataaggccctatgcaagtatatataattatatgtaaccaacagattccaacgataaaccccttactggccacatgctttcaataactatccctggaaacaatcaaataactatagagcagctagacagtgcaccagtatgcagccattaaaaaattatagaaaagtattaaaaacataggaaaggccaggcgcggtggctcacacctgtaatcccagcactttgggaggccgaggcaggtggatcacgaggtcaggagattgagaccatcctggctaacacagtgaaaccccatctctactaaaaatacaaaaaattagccaggtgttgtggcatatgcctgtagtcccagctactcgggagtctgaggcaggagaatcgtgtgaacctaggaggcggagcttgcagtgagccgagatcacaccactgcaatctagcctgggcgacagagcaagactcttgtctcaaaaaaataaataaataaataaatataggaaaaatgtgtacaatactattattgaaaaaggttacaaaacagcatatgtactaaaatacattgaattgtccacttcatgagtaaattttagggtacatgaattatatttcaataaagctatcaacccccaagtgaataatctcacttttttttttttaaagagaccagatctgactatgttgcccaggctggtctgaaactcctggattcaagccatctgcccccctcagcctcccaaaatgctggaattacaggcatgagccactgcaccaggcctaatctcaccttctgtttcactaaaaaatatataggccaggggtggtggctcacatctgtagtcccagcactttgggaggctgaggtgggtggactgcttgagtccaggagtttgagatctgcctgggtaacatggcgaaaccccatctctacaaaaaatacaaaaattagctggatgtggtggtatgcgcctatagtcctagctaccgaggaggctgaggtgggaggatcacttcagctcaggaggcagaggttgcagcaagccaagattgtgccactgcacttcagcctgggtgacagagtaaaatctcatctcaaaaattatacacacacacacacacacacacgtacatgtaaacagtaataattacatataaataacaatagttaattaatataatatatatgtgtataatgcatatgtatgtccctggaggaagagtgactaaaatgttaaaaataattatagttatttcttgatagtgggagggtagtgatttttctttttttaaaaaaaaaaaaacttttaggttcaggggtacatgtgaaggctttttacaccagtaaactcatgtcacagggatttgttgtacagaatacttcatcaccgaggaattaagcccagtacccaagacttatcttttctgcacctctccctcctcccactctccactctcaagtagactacagtgtctgttgtttccttctttgtgttcataagttcgcagataaataccatagaagtgattttttgttgtgcttttgagcataggtattattttacaatgaaggtaatctttattatctaactaaaatacttatttaaaaaatcttagatacaaactatataaaaaaattaagagttctatgtgcttttagatagaaaattagtcaaaataatctatcaactattaactacctcataacctagatgttgtatcaactgttctaagaatctgcaataaacaagtttcagtttgtctgcattccttaaaaacattcctaacaatttacatcagaagcactgtttaacatgtttcacatttaaatgttttgattcttccacctataattctcagaaaaacctgcagttatttgccactttggaaaattcaccataaattgctacacagtgactttccttacaacagcaaaattttatatttaaaatctattaattgcttggattttcaaactttgcttacatttcagaaacaaaaaaactagagtagaatcagaaaatatgcttacgttagttccaatgtttgaaaaccttcaaagattaagaattgcaaacactatcaatcacaaattggaattataacaccaaatgaggtgatctgattacttcttacctttcgtatttggcagagtcatgttgacaattacatacctgtcatgtagaagtcttttatagttagctgaggtggaacaagtgggtcagcaagaagctgctggttcactagctgcacaaaaaagaagagatcaacaataatatggaaaactagtactgttacaccagtagatacaacattatgaaaactgctcataggcgagctgttacctttgagagctcatttgcttgctggaagtaattagccccttcaatatcatcatatcgaacaagattaggagagacttcttccaatctgttccttacttgatccagagtatcatatggaagagtcattccagcaatctacaacatgtcaggtccccaaaaacaacaaaaagctttaatacttaaaaatatcaaataatagataattgtaactatggtgaaataatgcagcactactgaaaaacctattggtgtccattagtagacatacatttatgaaggaagcagttaagcagggaacacaaatatcaaaaattctaattcattcacagctgtcagtacattagtgactctatgaaatgaagagacaatactatgctaaatccaaatgtttttgctaacctgttattaaaatacataaagtttacaatgtgttattattttaaaagtcaggatgcttacttttacatcaataaagagctaacagatgtattttcaggcaaaagacaagtcaacaattttcaacaataaaagcaccaatttcaggccaggtgcagtggctcacacctgtaatcccagcacttcgggagaccgaggtgggaggactgcttgaggcccaggagttcaagaccagcctggccaacatggcgaaaccccatctctactaaaaatataaaaattagccaggcttggtggtacatgcgtgtaatcccagttactcaggaagcttgcgcccgggaggtggaggttgcagtaagctgagatcacgccactgcactccagcctgggcaacagagaaaaactctgtctcaaaaataaataaaataaaataaaagcaccaatttcaagttcctttattttttaagagacagggtcttgctctgtccctcaggctggagtgcagcggtgcaatgagagctcactgtaaccttgaattcctgtttctgaatacatgttttctatagaaattattcaaatcatctctgcatttcagactggcatcttccttgactttgaaaatcattctaacaggctaaaatatcaaatatgcctttagtagcatcactaagaaatgactcagaaattatacctcagagagtgctcttataattttccagtcttctcttgccaagccaggaggtgtcactgctaccttagtctgctgagctctaccctcagtgttgacatatgtagcagacttctctgtgtaagcagctcctgggagaataacatcagctatgggagccccaacatcaccatgatgtcctgcacaaagatggaaaatggtaaaccaaaattttattaaaaactgattttctactgtacatgaagatagtatatatcattttaaatcccattttgtaaagtcacaaaagtttttaaaactaaaatgaaacagtagtgaagtaataaaaattaaagcccacctcaaccctaattcaactcccttcccaaagaaaattattattatttttttgagatggagtctcgctctgtcgcccaggctggagtgcagtggtgcaatcttggctcacagcaagctctgcctcctgggttcatgccattcttctgtctcagcctcccaagtagctgggactacaggtgcctgccaccacactcagctaattttttgtatttttagtagagacagggtttcaccgtgtttagccaggatggtcttgatctcctgaccttgtgatccacccgcctcagcctcccaaagtgctgggattacaggcatgagccaccgcgcccggccccaaagaaaattattgttaaagcatttgggggccaggtgtggtggctcatgcctgtgatcccagcactttgggaggccaaggtggacagatgacttgaggccaggagtttgtgtccagcctggccaacatggcaaaactgcatctctactaaaaatacaaaaaaattagcccaatgtggtggtgtgtgcctgtaatcccagctactcaagagggctgaggcatgagaatcgtttgaacccgtgaggctggggctgcagtgagccgagatcacaccactgcactccagcctgggtgacagagtgagactctatctcaaaaaaaaaaattttttttttaaagaaaaaaaagtatcttctcagactattttatgcaaatacaaatatgtataatataatacacacatataaaatagccaagtaagtatactgatgcttacaaagtagaactgctcagatgtaccagtttgtgaaatttggtaaagtagactgaaatgggggaggatgcaaagacaggaatatgacagtaatactgaaaaaggcataaacgaaaaactacagaaaaatttggaaacactgccacccattaataacaactggcagaagaaaaaagttattcagaaaagaagacctttagaaacatctgaatcaagtgtaagaaaatcgtagaataatatatagtttaatataatttgtgcacatttgtatatgcgtatgaagatgttatgaagtacgcatatcaaaactcaacaatgattatttcttaaaggactaaaaacaggattttagtttattttgtttttaattttattaaaaataacattttttattgctctgtcacccaggctggagtgcagtgacgtgatcatggctcattgcagcctcaaactcctgaactcaagtgatcctcccacctcagcctcctaagtagctgggatcacagacatgcagcaacacgcctagctaatttttaaattttttgtagaaacagggtctccctatgttgcccagactggtctagaactcctaggctcaacaaatcctcctgcctcagcctctcaaagtggtgggattacagcatgagccacggcacccaaggaacaggatttagttcatatattttggtttaactttttttttttttttgagagggaatgtcactcttattgcctaggctggagtacaatggcatgatcttggctcactgcaacctctgcctcccaggttcaagtgattctcctgtcttagcctcccgagtagctgggattacaggcgcccgccaccacgctcggctaatttttatgtttttagtacagacagggttttaccatgttggtcaggctggtcttgaactcctgacctcaggtgatccacccgcactggcctcccaaagtgctgggattacaggtgtgagccaccgcacccggcaggtaataattcttaaaagcagtatcaattatgtaactaataacacttgtggtttgtttaaaaaaaaaggaggaggagtgggggaggcaaaattctcaaatggaaaacattcagttcactaaatatattactaaatggtttctaacatacataatgtactactctcttttgtttctggtgtcacaggtgatacttaccttgataaataatgaaacaatcctttggcaaatcctgtcgtgtgatacaacctccatctgctcccaggagaaacagcaccttgggagggttcttccgaattgcttccaccccaggcttatagccaaggtccaaagcagctacttgacttgcaatcctgcaaagcaattatggaattttaccataactgcagtattttcaatgtaaaaaattaaatgtgatttttggaataatttcctttcaacaatgtcaaaaaacccattttattttattttatttttttctcggcgatagagtctcactttgtcgcccaggctggagcgcagtggcgtgatctcggctcactgtaacctctgcctcctggattcaagcgattctccttcttcagcctcccaagtagctgggactacaggcacatgccaccacacccggctaatttttgtattttcagtagagatggggtttcaccatgttggccaggctggtcttgaactcttgacctcaggtgatccacctgtcttggcctcccaaagtgctgggattacgggtgtgagccaccacacctggccaaaaaatcccattcttacccatttaaaatagatgctaaaaccagaaacagcagtcttttactgttttgagaatggcaaccaaagaaatgtcagattcttaggacgctctgtctctccatgacatagtattgaatgaaataattctagaaattttatgccaactgtaattgctttaagtctgattcttattcaataaagtaagacataaaacatgataagtcatatatattcaaagaagaaaaatcagattatttcaaaaatgaaaagggagaaattgaaaaccactcattaaactgtaattcagcaaaaaccataatgagaaaaccaaaaccttatagaaattttttctacgaatatatattactcttataagcacaaaataatcttttaaagaagaggtctggaataaatatactttgaatagcagggttgttgttttggtttagcttggtatttgttaactatctagaaatagtagccattctgaggacctaaaacaagttggaagcatgcttcgaaaggctcagaaatggttatcctgtgtgccccaatagttctacttttagaaatatatcctaagaagataatttcaagtgcaaaggtatctgtgaatcactgtattatttaagaagttaaaaactaccatcaacatacatgttaaaaagaagaaaatggctaaaaaaatttatagtatattcatgatatcaattagccattaacatttttatttacaaacaatttctagaaaaaaatttctgaccatagtaggaaattctcatttggcaatgaaaacctattgaaaccaggacacaaaattgtattcacagtataatttcacctatgtaactaaaaaatattacacagctgtgaggtgaagtggctcgtatctgtaatcccagcactttgggaggccgagggtggcagatcacctgaggtcaggagtttgagaccagcctggcgaacatggtgaaatcccatctctactaaaaacaaaaaaattaggccgggcgtggtggctcacacctgtaatcccagcactttggaaggctgaggtgggcagatcgcctgaggtcaggagatcgagaccatcctggctaacacggtgaaacccagtctctactaaaaatacaaaaaattagcctggcatagtggcacgcgcctgtagtcccagctactcaggaggctgaggcaggagaattgcttgaacttcagggatggaggttgcagtgagccgagatcgtgccactgtgctccagcctgggtgacagagcaatacttcatctcaaaaataataataataataataataaaataaaaaaattagccaggtgtggtggcacatgccaatagtcccagcttacttgggaggctgaggcaggaggatcgcttgaacctgggagggggaggctgcagtaagccaagatcatgccactgtacttcagattgggcaacagagtgagactctggtctcaaaaaaataaaataaaatattacgcagggtaaagaaaaaaactagaagaaaatgcatgaaaatagtaataattatctacacattgtagaataaggatcagttccatttctgcacatatctgtctcttttcaacttacctaaattaaacctgcattattgatatggtttgaaataaaggctaggtgcagtggctcacgcttataatcccagcagtttgggaggctgaggcagaagtatcgcctgagcccaggagtttgagatcaacctgggcaacatagtgagactttatctctacaaaaacaaaaaattagctgggcatgtggcatgcgcctgtagcttcagccatttaatacttgggaggcaggggtgggaggatcgctggagctcaggaagtcagggctgcagtggactatgatcatgccactgtactgagaccctgtctcaaaacaaaaagccaaataattaaaaagaaaaaaaaagaaagaaagaaatcctttagctgaattctcatattagcttacatttttatcatttaattaaagaacttgttgcaatttttgaaccaaggtgtaactaatataacaatttttatagtacttcactttttttctcaacactcactgttatttcaaatattttaaatattccttatcatctcgggctcttctcacacagagtaaaggtctatatttcacatgtgtaactgggataatgttgctaaatgttgtttgtaaattaaatttaacagtgtatcaggaacacatacatatacacaacattacttgaatttatagtatataaagcaattactcaacaaacctatgaaggatattcataactttccaatcaccagtaacaccactagtcatccgaatcttttgtgcaatgctagaaacagctgcaagaattgctgctccatcatttctttggagtgcagaactgcctaaaaccaccattggttttttagcttcctttaggacctatttaaaaaaaaaaacaactttgattttaaaatattacaagtaagctgaacaccaaaccatatttgcctctataatataggttgtcccaagtcttaggtgtaacatgaatgtcttcaatttgttagcccaacatacagacacacatatacaaccagatttagtttaatccaaagcatcttgccaatgctactgtgaaatatgcctgagtatcagctaaaacacgttttctaaaagtaattattcagaataaaaagcctagcaaattatcctgtggtcagaataactatgggcaggtcccagaaaaattggggaacttctctccagagattcagatgttaattaaagaataggaaaaactatgcttaagtatcatgcctactatcttccatctacttaccatgccacagatagggaggaggaggcagggaaagcaatgatcaccagatcacaatgttaaatacctacaattttaaggctttgttttaaaccatagtaactctaaatgacaaaaactaggagaatgcatcccaagagtaaaggaaactacaaatttcacagaagatgggcaaataagatgtaaagttataggctgggcacggtggctcacgcctgtaatcccaacactttgggaggctgaggtgggtggatcacttgaggacaggagttcgagaccagcctggccaacacggcgaaaccccgtctctactaaaaatacaaaaaaattaaccaggtgcggtgttatgtacctgtagccccagctacacaggaggctgaggcacgagaattgcttgaacctgggaggcggaggttgcagtgggccaagattgtgccactgcactccgtctgggcaacagagtgagactctgtctcaaaaacaaaacaaaacaaaacgtgtaaagttatagaatacacgtctcattctcccacccatcctttgtgtcattcttcaataaatagctggccacaatcaaagaatcagcatggaaattatgctgatatattataaagaggaatacattaatcacaagaggaatttgccaaggaaatgtgaatagttgagagaaatagtttttaatagtctcaaagacaatgaaaaataacacactctttctcacttaaaaactcaaagaagcaacactgtagagtattatatagtaaggagattttcatcattgaattcaggatagaactggaagacaaacaagtaataaataccattccagaaacaataaaaaactaaacaggccaggtgcagtggctcaggcctgtaatcgcaacactctgggaggccgaagtgggtggatgacttgagcccacaggttcaagtacagcctgggcaacgtggcaaaacctcgtctctacaaaaaattggccaggcatggtggtgtgcacctgtggtcccagtggtggctgcagtgagccaagacagcaccattgcactccagcatgggtgacagagccagaccatctcaaaaacaaaaaaaaaagacagaaaagaaagaaaacatgattaaatacaaggacaggaaagacagggtacaggatacaaaacaaatggaaaaaggaaaaaaacacagatatgaaaaaccaggcaaggttggctcatgcttgtaatcccaacactttagaaggctgaggtgggagaattgcttgaggccaggagtttgaggccagactgggcatcacaatgagccccatctatacaaaaaaatataaaaattagctgggcatggtggtgtatgcctgcagacccagctacaggggaggcttaggtgggaggactgcttaagcccaggagtttgaggctacagtcagctacaattctgccattgcactgcagcctgggcaacatagtgagaccttaaaaatacatatatagaaaagaagattcgacaactgcattgtcaagagttgtttttttttcttttgagacagggtcttactctgttgcccaggctggagtgcagtggcatgatctcggctcactgtgacctccacctcccaggttcaagctattatcttgcctcagcctcccaagtagctgagattactggcacacgccaccatgccaagcaaattggggtttttttgtattttttagtagagatagggtttcaccattttgcccaggctggtcttgctcctgacctcaggtgatttgcctgcattggcttcccaaagtgctgggattacaggtgtgagccaccacatcaagagttcttaatgaaggtaacagaattaatgaaaaatgtatttaaatctattatagaacaaaacgttctcaggccaggcacagtggctcacgcctgtaatcccagtactttgggaggccgacacgggcagatcacgaggtcaggagattgagaccatcctggccaacatggtgaaaccctgtctctactaaaaataaaaaaattagctgggcatggtggcgtgcgcctgtagtcccaggtactcgggaggctgaggcaagaatcgcttgaacctggcagactgaggttgcagtgagccgagatcatgccaccgtactgcactccagcctggggacacagcaagactctgtctcaaaaaaaaaagaaaaaagaaaaaaagaaaaggaaacgttctctcaaaatagtagtcacctatcacatggggatgggaattagagaggagaaaggaagacttttcacggaatattttttaatatttttgatcttttaatcataattttttttctattcaaaataaacaagttgtgctttgctacttcatcctcttgcacatcaccttcttccctacacctgagactgtaagtgaagcaaccatcttggaaccacaaggagaaggacacacacaatcacatgtgagcaagcaaatgcactgacgacagcaaagcaggaaggcaggctctctttgatgatatgcttggacaactgcatcagcttttttttttttttctttcttctttttgtttttttgagatggagtctcactctgtcacccaggctggagtccaatggcgcaatctcagctcactgcaacctctgcctcctgggttcaagtgattctcttgccccagcctctcaagtagctgggattacaggccactacaaccggctaatttttgtatttttttttttttaagcagaagcggggtttcaccatggtggtcaggctggtctcaaactcctgaccttgtgatccgcccgcctcagcctcccaaagtactggaattacaggcatgagccaccgcacccagcctgcatcagctttcaatgtgcctacctccagacccccttgtgtgacaaacagaaactccttagtttttagttgttggttttttttttgtttttttttttttgagatggagtctcgctctgtcgcccaggctggagtgcagtggcatgatctgagctcactgcaacctccgtcttctgggttcaagcgattctccaccctcaggctcccgagtagctgggattacaggtgcccatcaccatacccagctaatttttgtatttttagtagagacggggtttaaccatgttggccaggctggtctcgaactcctgacctcaggtgatccatacaccttggcctcccaaagtgctgggattacaggtgtgagccactgcacctggccggaaattccttagtttctttctttttttcttttttttttgagacagggtttcactcctgttgcccaggctggagtgcaatggtgcaatcttggctcaccacaacctccacctctcaggttcaagcgattctcctgcctcagcctcctgagtagctgggattatgcatgcaccaccatgcccagctaattatgtatttttaatagagacggagtttctccatgttggtcaggctggtctcaaactcccgacctcaggtgatccacccacctcagcctcccaaagtgctgggattacagatgtgagccaccatgcccggccaactccttagttttttaatcacctccaccaccacacatatattctaaaataaagagaaccttgtatctttagactgaaagtacattctgtcctatagtcttatagtgatgtcttcacctttaagacatattttggtgaagttactgaatttcaagaatgataatcagaatcccagcactttgggaggccaaggcgagtggaccacaaagtcaggagttggagaccagcctggccaatatggtgaaaccccgtctctactaaaaatacaaaaattagccaggtgtggtggtgcgtgcctgtagtcccagctactcgggaggctaaggcaggagaatgaacccgggaggcagaggttgcaatgagccaagatcgtgccactgcactccagcctgggtgacagagcgagacttcgtctccccgccaaggaaaaagaaaaaaaaagataatcaggacagggtttggggcggggcggaggaataaagtttacatgcttcttcactaacaaaaggcagtgtctataaagctcagaaaggggggaaaaaaaagtctgaccctggaatttcacatcctgacaagctgtctcttcaggaatagacattctcaagcaagcaagaactcaaggaatacaggcaaccatgagccacctttggggaaaagcaaaacaataaagccaacaacaaaatgaattaaagaaagaactcaaatgaaaaaaacatgtacctcagaaacaaaaatagaaggactggtaaaattttaaggaataactccttttgtaataaagaaagatttaaatgaagttaaaagtgcaattctttcaggtttactttgatttcttttcagataatttcaagaaaattaaactctggcaaataaaaactgcatgtacagtatgatctcatttttgtttgactattcatccatcttgctttgctctctacataaatggagagattatgatgttttatcaatacctgttttggggtggtggaattttaggtaatgttttactttcttcctcatgttcttttctgtattggtgtaagtttttttgggggtgggacagagtctcgctctgttgcccaggctggagtgcagtggcacaatcttggctcactgcaacctccgcctcctgggttcaagcaattctcctgcttcagcctcccaagtagctgatactacaggcgcacgctaactttggtttgtattttagtagagacagggtttcaccgtgttgcccagtctggtcttgaactcctgacctcaggtgatccacctgcctcggactcccaaagtgctgggattacaggcgtgagccaccgcgcccaacctggtgtaagttttaacacttacataggattattacaaaaacagttaagtttaaataataataattaaaaatcaacaagagtagatacacataagttgagagcacctggctaaatggatggcttcccgaagcaatgtcttgaagaattttgggggagtctcccaggtggtcatatgtgtaagtgaggtccactggactgcctataagggccacttttaagtcattatgcagccagctgaaataaaaacaacattttaagaagtaaataactaagctaagcagttactggtctcatcaatcctaagtgatacatctatttactattacaaaatgttaaaagcacagacaatacatttaacagatatgatttactacgtacctttcaaaacagtgttgcaaaaaggcatgccaaggcaattcagtgatttaatttgctgtgtagaaatgctatccagaccaggcgcagtggctcacacctgtaaatcccaacactttaggaggctaaggcaggtggattaattgaggtcaggagtttgaaaccagcctgaccaacatggtgaaaccccatctcttctaaaaatacagtattagctggacatggtagcgcatgcctgtagtcccagctacttgggaggctgaggcaggagaatcgcttgaacccaggaggtagaggttgcagcgagctgagatcgggccactgcactccagcctgggtaacaagagcaaaactccacctcaaaataaaaaatttaaaaaaaaaaaaaagaaagaaatgctagtaagccagctataaaagttatttatttattaatttatttatttttgagagagagtctcactctgtcacccaggctggagtgctgtggcgcaatctcgactcactgcaagctccacctcccgggttccagcaattttcctgcctcaccctccggagtagctgggattacaggcacctgcctctacgcccagctaatttttgtatttttagtagaaggcaggctttcaccatgttggccagactggtcttgaactcctgacctcaggtgatccacccgcctcagcctcccagagtgctgggattataagcatgagccactgtgcccggcctaaaaaaattttaattttagaattaatctgtaatttttattttgcagtatttacatgacagggtcaattatctcttaattatccattaaggatatttaaacattttcataattcatgaaaatataccatgttattgacatttattctccacagcagggaactatggctccagttcctccaaaaagtcataagtgcaatgactatatagtctggtttgtctgagataatgcttttttttttccctgttatcctgatgtaattattaattccctctttcactcccgtagtttagacaataaactatatggttaccctctttataaatctctaagatgtaaatttaaaagacagaaagcatgctagaaaataactggcttgtgttcttaaaaaaaaaaaaaaaaaaaagtcaaaaaagggaccagaagagtcatgaaactaattgtaatgtatgactccagaatggatcctgaggaaacaaaaaaattgctataaaagaaattatgaaaaaaaaaatcaatgaaatttaaatataaacgtaggcttatgaaataatattgtatcaaaactaaatttctggctggatgcagtggcttatgtctattactcccagcactttcagaggccaaggcaggaggaacacttgagctcaggagttcaagaccagcctgggcaacatagggagatcctgtctctacaaaaggtattttaaaaaattagctgggcatggtggtgcatgcctgcagtcccagctactcaggaggttgtggtgggagcatcatttgagcccaggaggtcaaggctgcagtgaggtgtgatcatgctaatataccttagcctgtgtggcagagcaagacccctaacacaaaaactagctggacgtggtggcatatgcctgtattcccagctactcaggcagctgaggcaggagaattgcttgaacccaggaggcagaggatacagtgacccgaaactgagatctcagaaaccaaaaaaactaaatttcttttttttgagatggagtgttgctcttgttgcccaggctggagtacagtggcatgatcttggctcaccacaaccttcgcttcccaggttcaagcgattcttctgcctcagcctcccaagtagctgggattacaggcatgcgccaccatgcccggctaattttgtatttttagtagagatgggtttctccatgttggtcaggctggtctcaaactcctgacctcaggtgatccacctgcctcagcctcccaaagtactgggactacaagcgtgagccaccacgcccagcctaaatttcttcattatttaagagaatgctccttgttctcaggaaatccacgctgagaatttaggtataaaagggcaccatgtccaccagaaacttccaaatgattcagaaaattagattcacacacacatatatatgtagtgtgtatatatatatatatatatatacacacacactgagaatcataatacaaatatggcaagatgttaacatcagttaatctatgtgaacaatatacaaaatggtatacaaagaccatttcaagcatcttgaattatttcaaaataaaaagctaataaagtaaatttaaaagactcgcaaggagaggagaaaacggacctattagaaattgttgcaactgggcgtggcagttcatgcctgtaatcccagtactttgggaggccaaggtgggaggatggcctgaacccaggagctcgagactagcctggcaacatggcaaggctccatctctaaaaaattaaaaaggccgggcgcggtggctcacacctgtaatcccagcactttgggaggctgaggcgggcggatcacaaggtcaggagatcgagaccacggtgaaaccccgtctctactaaaaatacaaaaaataagctgggtgcaggggcgggcgcctgtagtcccagctactcgggaggctgaggcaggagaatggcgtgaacccgggaggcggagcttgaagtgagccgagatcgcaccactgcaatccagcctgggcgacaaagcgagactctgtctcaaagacaaaaaaataaaaaataaaaataaaaataattttttaaaaatctaaaaaattaaaaaaattaaaaaaaaaaaaaggctcggtgcagtggctcacacctgaaatcccagcactttgggaggctgaggcgggcggatcacgaggtcaggaaatcgagaccatcctggctaacatggtgaaaccccatctcgaggcggagcttgcagagccgagatcctgccactgcactccagcctgggtgacagagtgagactccgtcccaccaaaaaaaaaaaaaaaaattgtcttccagttatcttttggagtctcactaccactaacactattaggaagatgccatttttcacatataaaacaaaaaaattacataaatatttttaaaccttgaataaatactattaccaacctctttcgaattctagcattaaacagtggtgcctcaaaacgtgggtttgtaccaaccagaagaacaacatctgcctcttccacaccagcaattgtagtattaagaagataattggaacgcaaatctgtgctagaaatacaatatataaaatgcaaatttactttaaaattaagacatacagagaatccatgaaatattctcctatcatcaaacccattgccttctcaaacaaaaaattttatgaagtatttctaaattaaatgaacatttcagatacttattttttttctcagatagagtctcactctgtctcccacgctggaatgcagtggcgtgatcctggctcactgcaacctccacctcccaggttcaagcaattctcctgcctcagcctcccaagtagctggaattacaggcgcacaccaccacgtctggctaatttttttgtatttttagtagagacggggtttcgccatgttggccaggctggtctcaaactcctgcacttaggcgatctgcctgccttggcctcccagagtgctgggattacaggcgtgagccactgtgcctgagatacttagtgataagtggattcctctatttcctacaacttctggtttgatcttggtctatatatgaaaataaactgggggatatgttggagaatccaggttgtcacattttatacataacttgtaactaaaaaaagaaaggaaagcctagatcctagcttcatatttctcacccagctcctgcagtggggaagacctcttcagtgcataaggtgtcagagtccactctattaagcaaatctttgagagctaccagggcttcagcatccaccaagccacctgcaattgctgccacatctttgccttgaaaactctgcaactagaaacagatgaaaagggcatcaccaagaaacctacacgcagcaaagaccacaatgaaatgttcagaaaataaaacagtacttgttttcaagta

SEQ ID NO: 336 - DNA, 30755 bp, Homo sapiens
taaagttttattcaagttaaggcaaactaacttgtatacactttccatctcgtgtttttcttgttgttgttaagtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgagttattttacaagggtataaataggcctgaaaattagaagttagaagtaaatagaaattatttttagaaggtggtcgcaatgttttgattttgtatacctctttatattgtgatatgtacacgtttaaaaatttttctgtaattctcactatttttatcaagcttcatttttttctcatcagttattctttgaaataatcattctttatgcacataatttgttttgctttattctcttaaacatactctcaattcttttctaatataacatcctttttattacctgcttttaaagctttagtcaggaataagatactggcttttcccctcccccctttttctcctgttccatctacctttcttcctttaaaaaacatgactcaggccgggcgcggtggctcacgcctgtaatcccagaactttgggatgctgaggcgggtggatcatgaggtcaggagttcaagaccagcctggccaagatggtgaaaccccatatataccaaaaatataaaaaattagatgggcacgctggtaggtgcctgtaatctcagctactagggaggctgaggcaggagaattgcttaaactcagagggcggagcttgcagtaagccgagatcaagccactgcactccagcctgggcggcagagtgagactccatctcaaaaataataaaataaataaataaataaaaaacattactcttctttcttcttctatggtttgctttgctgcattactttaatcatgaaaagcagctggcacatctaattatagtttttctagcttctggcctgcacttttctgtgttgaaatggctgtatatattaaataaagtgtctgcgagaaaactttgtaaaaacatctaaatattatatcatttaagtacaactttttaactaattattttcctcttcttgtgccctttttaggtgatttggatattgaagatgacatgaaagcacagatgaattgcttttatttgaaagccttggatggttttgttatggttctcacagatgatggtgacatgatttacatttctgataatgtgaacaaatacatgggattaactcaggtaaaatgcacacatattaagagctcttctatatgtttttatgattttatgatctagccctaatttttaaaaatgtgtttacagtttgaactaactggacacagtgtgtttgattttactcatccatgtgaccatgaggaaatgagagaaatgcttacacacagaaatggtaagaaaagtctgttgtttgatttaatgtgacaggtggttttacataataagatactattgctaattattaaactttgctattgtacttacccaaggcaaaatgttatttcatgtttaataaaatgtctattctttgttaaaactattattttagtttttaggaatttcattttgaaagcccacctaattgcataaataattgtgtgggtgtgagaaataaaatggaaaagtaaaatcatgaccaagagagttacaaataactttttttttttttttttaagatggggtctcgctcttttgcccatgctggagtgcagtggcacaatcagctgactgcagccttgaccgctgggactcaagcgatcctcccacctcagtctcccaagttagctgggaccacagacgcgtgctaccatgcccagctaaatttttaaaaattatttgtagagacaaagtctcactatgctgctcaggctggtcttgaactactgggcttaagccatcctctcacctcggcctctcaaagtgttgggattacaggcatgagccaccacgcccaggctaccttttttttccttttctttttaaattgtgataggggttcttgctgtattgcccaggctggtcttaaactcctggactcaagtgatcctcctggctcagcctcccaaagtgctaggattataggcatgcgccaccacacctggtggagttaaaaattaaaatacaccattaaggcaaggagaaattataatacaaatggcagataataggactttagacagtcattaaagttgaggtgccagtttgagtctaaggcccaataaaaaaagttcaccagaattttaagacaaacaactgcttatttgacttctttggatgttctcaataattcgagaccgtgtagttagattataaagtattacattgtggatgcccacatattaacaaaaatagagagtaagacctctaattcttaggaattaattgttaaaaataatcaagtgttccaagattttttggaaactacctcttgaattaaaaaattaaagtctttctacatttttatcttgttaaacagtgtatactgatcataattatttaaaaaatcatgtgttctaagatttttggaaagtacctcttgaattacaaaaacaagaaagtctttccacatttgtgccttcttaagcagtgtatactgatcataattgaacttttcttcatgatggaaagttaccacaaggaaaatttcttatgttctgctgttctttgttgctctccaatttaagtgcatacgtttgtttgcttctatattataaaacctcaaatttactttttgtataatttttgaggttttctttttcatctcatttattataataatagctaacctccattgagagaatgctgtgtgccaggacactgttcttcctattttatatgcttttaactcctttattcctcacaacaaccctgtgaagttaactgttagacaatttctattttactaggaaactgaggtacagagttactaagtaactttcccaacattatttggttagtaaatggcagagcttgggctgaacttcagtagactggcttcagagtccacgctcattagtcctttggagcgcttttcatattcttgaattctcacattctgtcttttttcactctgtcagcaggacctgactcctgtttttaaatttcatattgtgtttttactgttaatttggaaaacaaatgcatactttttagaattctgtataaaggaggagtaaatatgctgtgaacaaggacctaagtgggttgtcaatgagtttaatatatgagttctaatgtgcagagttgaggtttatattgactgctcagtgcttccctggggctagactataaatggatggatattaggaagtcttgttctgatttggtaatgatgttaatgcattattctaaatcagatagtcttaatatagtttaaatgtatgtttcgaaccaaatgttcttttttaaagcacacaaacattttgaaatcattactaatgtggttaatgaattattgatgttccattgggaaactaaaatgcagatttttctcttttagaaatcagggactattgcaaagcatcacattttagtgatacactgagagccagtggtgtgtttatacaaatagtcctattttccaaataaattctagaaaaatgctttagaatttataaattatacaaaatatgacttatttttagagagtttaaaatttaggtttttttaatggtttgtttttgtttgtttgttttttgttttttttttcctcattaggaaaacactagtacttttcagttaccttgatttttaaattaatctgcaggtccccattcaaaggccttgggttcctttcaaaggtcagtataattcaagcttagtttatgaaggactgaacatacccaaaggattttgcatgtggatctttactgccactaccacaaccatcaacacctacacacacacgacacacacacattctctctctctctctctctctctctctctctccccctccctcccgcactccttcccttccccctcctttgctctcatggcatcttttaaaaatatactcttaaatccttccagggagggcaaattcacttcttaatctaagtaaacccaaatggcatgcatcagcaccaggactgcccatctttcctagttccattattcatagagtataggctggaattcatcttgttcctcaagagtccagcatttctagttaaccatgcctacatttaaacttactctcatttcttttctactttacagtgttttttcaatatactagcattacagtttccagatttgatttctctcctgtcttatttccatcagttttcaagtctattaagattctacctcttcatttgtcttttgccaccattcttttccctcatactctactggctcagccctctcattacagtcacctaattctaacatatatattgctgctaagttaattttccttaagttactgattgtgcttttttaaagccccttgttgaatatttaggcaggactccatgtggacatccacagccctccgtggtacagccctaaccttcccttctagctttgccttactactcttctacgtgtactctacattgtggacaaactactatatgctgtttttcaaacatgtcctatttttcctacctctgtgcttttcattctcttacttctccttggaatacccttctaacccatctctacttactgacattctaatgtctctttttctaagcaagacttcttgatttcccttgactagaaattatcttctaagctctccctatccttctttaaagcatttttataagtctcaagtaccaactctacattgtgtttttgttgaccttactatatctactacatttttaacttcttcaggaaaggtggcgtatcttactcatctttgtattgcctacaatatctagtccaggttctgaataataaatatttttatatgtgttctgaagcacactgaccaatgaagataagaaatcaagaggctagttccttattttttttaatttttttttttgagacagtgtctcactttgtcacccaggctggagtgcagtggcacaatctcagttcactacaacctctgcctcccgggttcaagtgattctcacgcctcaacctcccaagtagctgggattataggcatgtgccaccacacctagctgatatttatatttttagtagagatggggttttgccatgatggccagcatggtctcaaacttctgtcctcaagtgatcttcctgcctcagcctcccaaagtgctgggattacaggcatgaggcataagccactgcgcccagcaagatgctcttttctcagtcacctaaatataatctcatttttagttatagaaggtttgaaattggagtgaatagactttacttaattctgactttatttctgtagctttttttttttgagatggattctcgctctatatcccaggttggagtgcagtggcacagtctcagctcactgcaacctctgcctcccacgttcgagtgattcccctgcctcagtctcccaagtagctgggattacaggcacccactatcacacccagctaatttttgtatttttagtagagacagggtttcaccatgttggccaggccggtttcgaactcctgacctcaagtgatcctcttgcctcagcctcccaaagtgctgggattacaggcatgagccaccgtgccctgcctatttctgtaacttttgataagtcatttgatctgttgttgttgttttctcatagtaacaaagtagaagtaattttctgcctgctttactagataaattaaggggaaaaaaataagatacgtaaaaatgttatttgttattaaaaagaaagttgttattttaaaggttctataaagacatagagtgcttattagaaattgagctaacacattcaggaaaggataggaagagtttgctgaagttctttctttagggattcttgtgtaccgatagcacagttaaagagcaaactcataccatttttatatttctgtgtatttgactaagcttactggcttcaatgattaactgttatcccaaatatggattatctttcagccaactcagggaatcacagctactgagtagtgtgtgtcagatctcttgggtgtgctggagtgagtaaaaggggaatgaattactgtgttcatgctgagacttaattgaacgggtattcagttgatctaggtgatgggcactttgttacttttattgtaacaaatttgtatatttagttgctttaaaactttatttcatgctttcattaggccttgtgaaaaagggtaaagaacaaaacacacagcgaagcttttttctcagaatgaagtgtaccctaactagccgaggaagaactatgaacataaagtctgcaacatggaaggtaagtgaaaattatttgtgattgattatacactttatttatacatagacattgtagtattaagataactttagaattgtgagggaaggtttacagttccatggtgtttggttatgtaacatttatatcttcaactcatttgcatgtgatctccaaaatgcagaaccgtgtagtaatttgccaatttgaggcacaaacttaaattacgtgaattgtggcactggtgttccaggcttaatcagttggctttgccagccacacaatatttgaatcctgatagggcttaattttctattaatcatggttttatatctttgttcaatgttgaaacatagtcatcagtgcaagaaataactatcaaacagccatgatgatgagatgaatgaaaaagcagcctagactttatacgaggggaattttttaaagagtaatgtataggccctgggcaggaagtaggtcataggtggtatcataggaaaaatgttcattgattttcaaaaacgtgattaatccactagtgacagtaaattttatcaaagcttactggccatgtcagactcaactacttatctctgctttttttttccctagcattgtaaatattttttttaactgctttgttcttcatacacaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaaggtaaattagatctaaaatgtgaatttgaaatttttaattagtctacagcattactgaatattcaccatagcaaagattcagcgctggccatgcatggtggctcacacctgtaatcccagcactttggaaggctgaggcaagcggggggtggatcatctgaggtcaggagattgagaccagcctggccaatgtggtgaaaccccatctctactaaaaaatacaaaaattagtgggacgtggtggcaggcactactcaggaggctgaggcaggagaatcgcttgaacctgggaggtggatgttgtggtgagctgagctcacaccaccacactgcaagcctggatgacagagcaagactcccatttcaaaaaaaaaaaaaaaaattactcaatgttaaactatactttccactaaattgaacagaatgatacatcctataatattagattaactttgtaaattaattcagccacatttattgaacatttactctgtactatgaacacttactttactaggtgctatccagaagttaagatgagtctttttttccccaataggggctctacttacttagagaatttcaaagatatgcagtgtgtattttgagcaaagatagattaccttaggttggggactagaaagccaagtgtttgtacatctcttcatcctacatattttccctgagaagcttcaaccttgcccatggtttctattactatttcccacatttcttcctgtaactaattctatttaattgccaacttaatatttctatctggatattcttctgtattgtaaactaagtattactgtaacaactgtactactactgcccccaaacaacatcatcatcaaaaactgcctttcttcctataatgcttattgtggtttaatacaccaccatacacacatgactccagcaaaactttggaagtcatctgtaacttttcttttacattcattggctacatacagttggtgtctaaatcttacagatttactatctacatatatctcttgatccatttcctcctttccatccttgcactcctgccattgaattcattagctcattattactcttgacttgagttgttggcatagctgcctttttgccaacagatttgtacccttataatctttcatctaagttgccagaaagtgggtgtcctaatgtgaaaatcagatcatgtcattctgttgttgaaaatgcctcaaatgcttccctccatctttgcacacaaaaatattttgtttataaaaatactagatgagggaagtaaatttttcatttatcaaaagaagatgtgtattttagaagactgaaaaaaaatagacctacacaatacaatctaaacttagcatggcaaacaaagatatttatgctctggccctaactctgtctttggaatcagatgttagattcactcatggcttgcagctctgatacttacaatgtggccttggccttggtacttaactgttgtaaaattcacattccttatctataaaataagaatcatggctgggtggggtggctcatgcctataatcctagcactgtgggaggccgaggtgggtggatcacctgaggtcaggagtttgaaaccagcctggccaacatggtaaaaccccatctctactaaaaatacaaaaattagctgggtatgggggcacatgtccgtaatcccagctacttgggaggctgaggtaggagaattgcttgaatccaggaggcggaggttgcagtgaaccaagcttgcaccactgcactccggcctgggagacggagtgagactccatctcaaaaaacaaaaacaaaacaaaaaaaagacctcagaaggatgttgtcaggattaaaggagtccattgagtgcctagtacagatagtgaatgcttcactactggtgtcaactttaagaaaatgaatatagaaaagctaagaattattttaaggtgtttactactagcatgtaaatgtatgatgggacagagatttccatcctattttgaggaattattttttatttttttgaaaacttaaggtaacaaagtagagaggaggccagggagaaaggaaggtagtggagcaaaaatgagaaagggagtgacattcccctctagttatagcagaaaattagcaaaatgatcatgacaggaggtaacagtaaagacagccagctcatatatcaaccaagacagttttgagtttgaccagcagactgttattttctggtttagagctctttccaggaacttcttgcatctataacccctgagaaccaagctatggaaaaaattttgctcaattttaagaaaatctaacatatcaagctcctcaactccaaaatattccacaaatagctgctatttactatactgagtaataatcatttaaaattattcaacactttatttgagcatctactatgttcatggcactaaagtagaaatgaagatgaacagttcctgcctcaaaataaatgagtagtatactgctttagatcatgggtttcctagtccattaaaaacactttttggtcatattttctggacaccccgacccttttggtatagaatataacctatgtaattctctaaagttaaattaacctcacttttcttgctctaatatgtgtaaaactgaccttctaggaaagcatatacagtttatatttttgacttcttggtatcttttagtgatagacatacctcagattgagaagcactgattgacattagattaaatcagagcttcctatgacaatataaacaataccttcattaatctgatccccctacctacttcttcagcatcatctcatatctgtctccactaatcatattatagaatctttgttacctgcaccatgttaagcatttttaaaaatcttttgtttataccatacctttttcctgaaagcggttttgcctttcctttgtctctagtcataagtctcctataagaggctgttcctcattctaccattcctttgcatggataggattccatggaatagattctcatcactgcatttatcacattatttcctaagtagtacagtacatctactggaagattagccacgtattgagttttgtctttgcattttcatgcctagaataatgccgggcacacataggcatattaagatttgaatagtgaaaaagtttttaattccatggggattttatttaaacagaaaaatataagaccaattagaattatttttaaagcataatttcaagaaatatgactgattttgtttaaaaacatgttttcctttataatgctgccacctggtgttgctgtgtttagagatgtccctttgtaaagaattgagggtttgagttgagtttggtttggtttttggcaaatcagcttttcctttgtatatttattttgtaataaactatggaagatcttgcctttaagtgtgagaacacaagcaatgttacttttatacctttatagaatatcttgcctatgtccttcctgtagttaggtagggttttttttttgacacacagcatgttatataaggtttgcttgcacctcggtaggaaagtcctctgaaatctaaaggctgagaatctaaaagcttaactcatgttttgctcctagaaagacttgagaagagagtatttctgttcagcatggtactaagaagacagctttctcttcctcatgtcatggttgccatttcatactgcttacagagaataagatctagtctctgtcttaaataaaggtctactctctgccagcgagctagatagggtaattggattgttttccaatctattttcatttgaaatattgttttatctgaaattactcccataatttcatgtaatgccaaaaactaaactaagtacaagagcatcttcaaaaaccaacataattcctttagttcccatttagtgtagatgctctttggttgatgatattagaattgtgtaatggctattgatctctcaaagtgaggtgttgcctaggggcttaaaagttactacataaagaatttggctttatgaagaaatgttacagattttatctatattttaaaataagtgtaagtgactacctttataacttttaccatgtagtttagtagtatttcttatctgtttattaataccctgccttgttaccaaaagtatgtataatgagatgtaataagaataggtaacaagtaggctgggcacgttggctcatgcctgtaatcccagtactttgggaggccaaggcgggtgaattacctgagttcaggagttcaagacgagcctgaccaacatggagaaaccccatccctactaaaaatacaaaattagctgggcatggtggcacatgcctgtaatcccagctacttgggaggctgaggcaggggaatcgcttgaacctaggaggtggaggttgcggtgagccaagatcacacctcattgtgctctccagcctgagcaacacgagggaaactcttgtctcaaaaaaaaagaccaggtaacaagtttgggtgaacaggattaaagagttaaataacaggaggaatctagaggacttaaagaaatgtgtggtgttggatttaataactgtagttgccaaaggtgaggtgtaaatttattctaagcaaaggaggatgctcatttttgaaaattcacttgtccataagattaatgcctatcagttaacttgggaggagaaaaatttttctttatcagtgtctcccttttttttcttaaatcttgtattttttactaacagaattaccgaattgatgggatatgagccagaagaacttttaggccgctcaatttatgaatattatcatgctttggactctgatcatctgaccaaaactcatcatgatagtaagtacaatggaagaactcagagatattctaattacttaactgttgcaacctctgtacagtttggctacccatctaattctctggttaaaagttctagactaaatgtgttaacaggcctattcagtagagatcttgaccattttgtgttttgtatgtgttgcaacaaatatcagtaaaaatagaatcatttaatcatagaaaaaacttcctggcattttaaatacaaagacttttgaaaatccaaatattatagagtattgaatagcataattttcagaattcacataaatactcagaacagtggttggtatgtaaaaggcactcagaaagtatttgtacaatcaatgaatgtgaaggtggtgaacatcacctttggtaataagtaccattttaaaaaatgcttataagtgcatagttaggtatttatatttatgggttcatgaaatattttgatataggcatgcagtgcataaggataaatggagtacctatcacctcaagcattatcttgtgtgacaaacaatccagttatactcttttggttatttttattttattttattttatttttttcttttgagacaggatctcactctcgcccaggctggagtgcagtggagcaatctcagctcactgcaacccccgcctaccgggttcaagagattctcctgcctcatcctcccaagtagctgggattataagcatgtaccaccatgcctggctaatttttgtatttttagtatagacagggttttgccatgttggccaggctggtctcgaactcctgacctcaggttatccacctgccttggcacccggcctcttttagtttctttaaaatgtacaattaaattattttttactatagtcacccaaaacaagtacctttgacataagatttgattctgaattttactcaaatgaatgttaagatccccaagataagttaaactttggactatctcacctgtttaatctgtacctatgcatgacttcccactgtgcttgaggatacctgaatatcactgagtttgtgtgactgatcagccttgaactcaagagtaaatccaagtctgcagtcaggacaccccaatcctcaaaataataccatcattagcatttatttagtactttctcccaaatcagtatttaatttaaattgccaaaagacttacaatgtggtatcaatttatatttaaatatgctacatatagctttttaaagcatctttggttctctggaaaccatagtcagaatttaaggaagttattgtggcaccattttcttgaaaaaggctattgattattctctaatctgacaccaacctaagtcattaaaggaattttagttactgaagattgtatattcatgaactcttcacttagctcactggcagcaaaggagttttatttagggggtttgaaaaaggaaatgggtacattttcagctattctgggacgcactgtcagaatgtaagcagttacaactgattccactaaataaacatttgttttccaaaacaatgatgaacattcagcatctgttcatttaattgaaaattcaaagttaaaatattttctctgcatgattctttttcttttcccccctagtgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgaggtaagtaagtttgagaaataaacatttttggggaacaaatagtaattctttttggatactctgttcatttataggaagataagataataaatattaactaaattttaattcttttacatcgctaccaaattattattttctatactctgacctaggtttccagtccagctattccacagtgatgctgctaaacactgtcagtagttgtctatccccataccttcactcctatttttaaaaagaccatgaaaaaaataccagatccattgattggtttggtctaattatacagatatcggcatatactatctcaagacagctgtgttctttttgtaggaagaatcctggcctagatttgtatcatagctctaccactcattagctccctgaccttggggaagtctcttcatttttctgaatttcatctatgtagataatccttcagaaggttataatgaaaattaaatgaaattctatgagattagggaggggggagggatagcattaggagatatacttaatgtgaatgatgagttaatggatgtagcacaccaacatggcacatgtatacatatgtaacaaacctgcacgttgtgcacatgcaccctagaacttaaagtataatttaaaaaagaaaagaaattctatgagattaataagctatatgatgtaatacatggctcttgtatattcatgaactcttcacttagctctttggcttgtgaatattatgtacatcaaaatttaatttttcatttgatctattttactagactcctgccccatctagtctacctgtccacattattaccacattctagtccatcttgcccattactaccaggctaagctttctagtgtggatatgtcatcatcttattttccttagaattttagcgatctttttatcatttccaagataaacacttgcctaggtgtacagcatccttgtttaccatcatactcacgcattagagatttagccttccctttaaaatctagggtcactcctcttaggaagactttgggcagtttttatttttgctacttctgacaccatcctttaatgttttaatattagtgccacagagttcttttgtgactttaccattatgtaagaatcttccacttggaatgtctttctcttcctcacaccccagtctgcctagcaaatgccacttgatcccaagtatcagcttgttagcttctcagtgaagcaagccttctctattttagcagttatcacagtgtattttaattgtttacatatctactttcacaatgggttataaatttcttaaggtcaagggttggctattttaatctttgcattatcagttcatttcagatagtgaacatttaatacgttaattaaaggaataatttacatttaagccaaacgtgaagataaactattgctcatcatccctcttcagccgtatcctgtaggtggtatcaccttatattcttaccaccaaagaaaatatggcccctctcttagaaagatcttaatcatttatctgtgtatctttaggactatccttagatcatgcctcacatattgatgccaaagagttcttttgtgccaatttcataatgtgtgtcagcacaacaattctgaagatttgttggtgtctttcatgtacttgactacaaattgccttgccattactactcttctcaaaggatatctgaaattctttttttcttttttttttttgagatggagtctcactgtcacccaggctggagtgcagtggcgtgatcttggctcactccatttcccgagctcaagtgattctcatgcctcagcctcccaagtagctgggactacaggtgtgcaccaccacaccgggctaattttttgtatttttagtagagacagggttttgccatgttggccaggctcttgaactcccaggctcaagcgatccacccgcctcagcctcccaaagtcctgggattacaggcatgagccaccacgcccagcctggatatctgaaattcttaactgaaattagtcaaattatcttgtactggggattttttttttaatttcaacttttatttttgattcaggggatacatgcataggtttgttacatgggtatatcatgtgatgctgaggtttggggtacaattgatcctgtcacccaggtagtgagcataatacccaacagttgttcaacccttgcccctctcccctagtagtcctcagtgtctattgatgccatctttatgtccacaagtaacccagtgtttagctcccacttacaagtgagaacatgcagcatttggttttctgttcctgggttatctcacttaggataatggtctctggatgcatccatgttgctgcaaaggacattatttcattcttttttatggttgcatactgtggattttattgggtctttattttgtattagcattttaaaaccctaaatgtgacacagtacgcatgagtgatcatgcatctcaagaaatcttgaaatgttcctgtccataaagcagaattttttaagagaccatttcacagtctcccttcccctcactgtatcaagtgctcatttgtgaattaccaatttctcttgttttgacagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacggtgagtagttatttttgttaatcccctaaattgtgtctgttgctacaagccccatttcaactaaacattactttacggtttttgttggtaatcatttggacattacaagctaatatatgtttatagttttcttaaatgtatttgcttaaatatttttgcccccgtaatttcttaccattcttgcttttttatactgttggaaattgtgcttcaaagtgtccttaaggtatttcttcttcccacataaatttttcctggctactctatttctgtatcctgctgtcagattttctccacagtttagcagagttatatggaagtaggcattgttgcattaaaggataaaaaagtagtcatactataacatcaagcattgaagatgaaaactgcaattttaaagtagagaacattttaatgtataaaaaggttggtattgccttttgtcttttatgccatagagattaagacgcggtatcaatagtggattgtaaaggtaactcagacttatggttatactatactattgtatgtaaactttctgatgaaggaaaatttggtgacattttgttgtttgatgaattagacaaaccttttgtgaaaaagaacataaattttttatatgtgaaaatccttgtggccgggcgcagtggctcacgcctgtaatcccagcactttgggaggccgaggcgggtggatcacttgaggttaggagttcgagaccagcctggccaccatggtgaaaccccgtctctaccaaaaatacaaaagttagctgggcgtggtggtgtgcgcctgtaatcccagctacttgggaggctgaggcaggggaattgcttgaacctgggaggcagaggttgcagtgagccaagattgcgccattgcactccagcctgggcaacagagcaagactctgtcttgggtaaaaaaaaaaaaaaatccttctatactttagattgactcatattttttccccacagacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgaggtaggtgtcatgatataatcagaaagggacaactttcagattttaacattcaagaatgtatttataagtttgattcaaacacttatttgaaccacaaattacatttgtgtgtgtgtttgaattttagcactttaaaattattgcaagagctactgcctaacctagacctgagcacatgttttaggctcaaagatagtcaggaacatgggaagaaactagcttaatataaaccaaaaggtgaaacgtacattgtttctctattatttatatcagtaggacaaaaacatcttgaatttggacatttaaagagaatagtactaagtgtgctcaaggtagctacagcctatacctgttaccccttttagtttgttttattgtgttttgttttgttttgagaaagagtctcactatcacccaggctggagtgcagtggtgcaatcacagcctcaacctcccaggctcaaatgattctcccacctcagcctcccaagtagctgggactacaggcctgcatcaccatgcctggctaattttttaacctttttttgtgtgtgtgtgtggagttggggttctcactatgttgctcaggctggttttaaactcctgggctcaagcgatcctcctgccttggcctcccaaagtactaggattacaggcgtgagctaccatgcctggcccattacccctttgagttggagaactgtctggtagcaatagacttacgagggtttaaatgggaaaggaccttataaattctttgcccaatttagtctaatttccatcactattttgaaattttgggtaagtataatatgaaaataacaagtgttacataaaataaatacttagtaactggtcttttttattctggatctgtcttgatattaattgtcctatgaacacaaaaataatctttaaaggctaggctggccaagacttagagatatcacacagggctctatttctaaatctagaatgattccattttagggcttcctacatctaaaaatatgctcaggagtagggcaacttagatctgaacattataacttgataaatgaggcataaataagctttaataagtggtaaataattctacattaggtatttgttgaataaaactgacaagctaagagtaggggatttgacatctcacagccttgtgttgaatgaatatatatcctatgctctggttgcttaatttacccagaaaaaaaaatgtttgattcatcttggtttttatctaacaaaagtaaatctaacaaaaacgttagaatgaggaaagcaaaatttcttgtttagaatacacagctatagttttttgttaaacttcttgcccagaactcttaaaatagtaataatgtacattcgttcaggtatatgcaggtaaaataacttaggtttctactcccacccccgacagtaacagtgagatttttaggtagctcagtcaccacaggagtgtgccttctcagttcaaaggtaaattccagtgaatgtagcatctagttaattggtcaattaggtaccattgtgggatgtgaattaccaaataggttttattctttagaataaggtgtttcttttcatctcaattttgtaaatgatgttatattacatagtcagaaatatatatattggcaaaattagttaccagtataagcttcaaaatgtcactattttcacaaatttttttttttttttttttttttgacatggagtctcactctgtcgccaggctggagtgcagtggcatgatcttggctcactgcaacctctgcctcccaggttcaagtgattctcctgcctcagcctcctgagtagctgggattacaggcgtttgccaccatgcctagctaatttttgtatttttagtagagacgaggtttcaccatgttggccaggatggtctcgatctcttgacctcattatccctccaccttggcttcccaaagtgctgggattacaggcgtgagccactgagcccggcctagttaaataaaatttgataaacacgatggacttggttgtgtgttttctggtttttctgagatctagtttgaaaattctgacaactagcaaagtatatggaagcttcttcaggaaatagtaaacatatttctttttacagcctaatagtcccagtgaatattgtttttatgtggatagtgatatggtcaatgaattcaagttggaattggtagaaaaactttttgctgaagacacagaagcaaagaacccattttctactcaggtatatgaacttatttgttttatattaaatttcattaatttttagtctgaagtgactttgagtttcacttgttttttatttataaggtgtggccattgtaaaaactcatgtatttgctgttttaaaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaaggtatttatatgtaacattcaagttatagttcttttattatttttgagataaatgtatgtgatagtacatgatttttaaacttatagcaaactttctgatatatatgccctaacgcaaattcttgagaactcaaaaaactttctaaattaacctcatatattttttctttttctttcttttttttttttttgagacagagtctcgctttgtcgcccaggctggagtgcaatggcatggcaccatctcagctcacggcaacctctgcctcctgggtgcaagagattctcctgcctcagcctcccgagtagctgggattacaggcatgcaccaccacgcccggctgatttttttggtatttttcatagagacagggtttctccacgttggtcaggctggtctcaaactcccgacttcaggtgatccgcctgcctcagcctccgaaagagctgggattacaggtgtgagccaccatgcccgctcctattttttctaaaataattataaattctaaaattacctatctaaatggaggagggtcttctgacacctttaaaataaaatccagctcagtactgtaaatgtgtttacagaacttgtttaaagttcttacagttgtttaaatcagactagttaactaccctcactacttagatgcttccatttcttagagctcttttttaagcttatctgaagaaaagcccttccaatttaagggttatttccaattgcacattccaaattgagccttccatcttcagcattcaatatagatatttacaggcccctcttttaaaattttattatagttaacttgtattaaagttgcttttatttttcattacgtatttgtagaacattagctatatatatattgcaggctacataggttttcaaactgtacaacaggaatctaagcatgaattgttacttctatggagctagttcaaacaaacatatggacatgacccaatttttaagttatactttctgtatataatttgtaaggggatttcacatattttaagtttgaggctatagctagaagaaattaagttttatctaataagtgtgtggaaaagggaaatgattccttctctactatgtctagactaagccagatatcaatagcaataggaaagaaccactgtcgtagccagaacacatagcttttttccctgcctaacattcccaccttgacctagagtgctgggagaggtcttttccctaagcttggaaaagacattggggctttagatgaactcagaagtactttacattactttatttactgtgtcacttactcacttttgactctgagctccacgagggcaatcacagtgtcttgggcattttagtgatactaatacttagctcatgacctaatgtgtagtacttcctcaataaatggttgttgaggcagggcgcagtggctcatcactgtaatctcagcactttgggaggctgaagcgggtggatcacctgaggccaagagtttcagaccagcctggccaacatggtgaaacccggtctactaaaaatgcaaaaattagctgggcgtggtggcacgtgcctgtaatcccagctactttgggaggttgaggcaggagaattgcttgaaccctggaggtggaggctgcagtgagccgagatcgtgccattgcactccagcctgggcgagaagagtgaaactcggtttcaaaaaaaaaaaaaaaaaaaaaagttgttggactgacagatgcatgaatacagtagtaaaaatgacaatcacttataagttacagtttactatcagctacagaggatgggatatccagttttctgaacaactgttctcttgtacttgtcaaagccaaagtgtaacaacacatcaagtcactttagcaatttatttttgagacggagttttgctcttgttgcccaggctggagtgcaatggcgtgatctcggatcttggctcaccgcaactgccgcctcgctggttcaagcaaatctcgtgcctcagcctcccgagtagctgggattacaggcatgcaccaccacacccagctaattttgtatttttagtagagacagtgtttctccaggttgatcaggctggtctcaaactcccgacctcaggtgatccacctgcctcagcctcccaaagtgctgggatgacagttgtgagccactgtgcccagctagcaactgtttttaaacattagttccaatgtagtgtacactgaaaacttttatgaaaggaatttcaaaaattaagataaaccattaaaaacgtaattactaagtactactactactacaatgatatttacataatagactgagttacatttcataaagacaatatatctgtataagaatttttaaacttccctgtctatataatagaagttttagagaaattttttaaaaaccaaagaaaactgcaaaataagatcacttacctatttggcattctcaactgtctggaacagcaaggagccattatgattatgcatttggtttgtggggtgtcttgaaaagtcaaaataatgtaacaaagctgatgtactttactcattagaacaattcttcacaatttaatattaattttagatatacatagttcatgtttgataaccagatcaatactgagtgaaaaatagcatagtgggaagagcaggggaggggaggtagggatctggagacctagagtgtacttccatattgcaactagtgagcagtaggactttgagaaagttacccaataggcctcagggttctaatttataaaatgggtatgatatgcctgccttatctgtcttgggaacttaagtaaggttaaaatgaactaatgaacttgaaatgttttataaactgaaaatgctatacgaatgtgagattgatcttgtatttcaatagtcccaacaatatcactgcattgttatattaggtggaataaaaggacaatatttaactgttttgactctacaatagtgtcaatttagttgtgttcagctctattttataaaatagggatacgcatactgtagaaaatttcctgttaaattaagctttgacggccaggtgctcacgcctgtaatcccagcactttgggaggccaaggtgggcagatcacttgcgctcaggagtttgagaccagcctgagcaacatagtgaaatcctgtctctacaaaaatatgtatatataaattagtcataatcccagctacttgagaggctgaggtgggaggatcacttgattccagaggcagggcttggttgcagtaagcagagatcacgtctctgcactccagcctggctgacagagtaagaccgtgtttcaccaaaaaaaaaaaaaaaaaattaagcttttacttttaagatgataaactttagtgatcaggaaagttatcttatgtatattatattccttaatattggagaactaaagaattatgtattttctttaaaagcgctcactggatattttttttaaaaacgctatattttcatttagaatttttttcttttcagaactacagttcctgaggaagaactaaatccaaagatactagctttgcagaatgctcagagaaagcgaaaaatggaacatgatggttcactttttcaagcagtaggaattgtaagtatgagtagtaggttttgcttttctagctaatgtgctatttcgtgtgtgtgtgtgtgtgtgtgtgtgtgtgtgtgtttccacgtttcttccaaatagtaaagttatattttcagaagttatacattgggtttttttactctgtatgcactggtttttaaaaatacaaatgtttaatacatacattcttggtataaaaattccaaacaattccagtgtattttgagttaaaaagtgaagttctccccttactccaccctgaatatcaccaccaatctcattctcttccctttaagttactttgccttattaaaagaactgctattggccaggcacagtgcctcacgcctgtaatcccagcactttgggaggccaagatgaggatcacttgaggtcaggagttcgagaccagcctggccaacttggtgaaaccctgtctctactaaaaatacaaaaattagccaggcgtgttggtgcacaactataatcccagccactctggaggctgaggcaggagaatagcttgaacccgggaggtggaggttgcgatgagctgagatcaggccactgcactccagcctgggtaagagagtgagagtccatctcatatttaaaaaagaactgctatgttttggggtaagtcaatggtggtataatacattctgatattttcaaactaaattaactggaaagtatttatagacagaatggtcataatggatgacaaataacttaagaaagaattcaaaataatttagggtagtatttaagaaactgcctataatgttattaaatttacaccaatttcaaggtttttggttgtttaaaaaaaaaattcaacaaactaaacttgaaataactttactgtttatagggaacattattacagcagccagacgatcatgcagctactacatcactttcttggaaacgtgtaaaaggatgcaaatctagtgaacagaatggaatggagcaaaagacaattattttaataccctctggttagtttattctttttgaccttgaacatcacaaagacaaaatacatgaaacatttttatttaggagctttaatctaagtgagaatgactttggttccttagcaagattaaaaagtaaagttgtggctgggcgcggtggctcacacctgtaatcccagcactttgggaggccgaggcagccagatcatctgaggtcaggagttggagaccagcctggccaccatggtgaaaccccgtctctactaaaaatacaaaaattagctgggcgtggtggcgggcgcctgtaatcccagctacttgggaggctgaggcatgagaattgcttgaacccggaaggcagaggttgcagtgagccaagatggcaccactgcactccagcctgggcgacaagggtgagactctgcctcaaaaaaaaaaaaaaaaaaaagtacagttgtatttcatgtgatggtcttaatacagagattaacatttcaaggtggagcttttcatttttagtaattttctttgatttctctatgtccatgtgctgtcaatattgatagaagctgaaatttgtgaacttttatgacttcttttttttttttttttttttttgagacagggtctcgctctgttgcccaggcctggagtgcagtggcatgatcatagctcactgcagtctcaaactcctgtgctcaagctcaagcaatcatcctacctcagcctcctgagtagctcgcactacagacatgcctcaccacacccggttgctttttgtagagatggggtctcactatgttgcctaggctggtttcaaactcctggcctcaagtgatcctcctgcctcagcctgtgctaggattacaggcatcagctttgatgcccaccatatttatgcctttttccaaattgttatttctttgtgcctttattgtatcctgtaaacatttctgacacagcaacagtatcactggattatacttactttttaacatagttgtggttttgccaggtaaactaaaaacccttccagaattttgctttattttctatgatacctaacacattgtgggtgtttaataaatattcattgactagatgaatgtatacttaggtatctcttttgtttttcagatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcccctttgatcagcttttatgttcaaatattaataatatttgcttcaacacctccaactcataaaattgtttaccaacaatttaagcacttatgaaaattacatggtactggttatttctacatttatcttagtgccatcaccttaatgtatgttgagtccctaaatgtcatgttaaataataacaaccataatatcccattgaaaagagtatgttgttagaaaagaaacatcatttttaagtttctgagcctattaaaatgctcaaacacaaaatattagtatttttaaaatatgaatgggatgagtgaagcagttctcagcattatagtcacaatgttacaaaggctagagcttctctgaagatttctaatctgttcccattaacagattaataaatttagacttcaaatgaataatttgcccaagctttaaaagtaatagatggcagaccaaaaatgtaagcttaagtttcctgactctaaagtcaaacttagaacaaatttggtttgtttttgttttaatgatactgcgttttaaaacaaagtagctttatcctttttctcctgtatttttcttttacaaaatagctgtatttcttttatactgataatctcatttttaaaaatcagacagtgtagaaagatattttttaaaacagaaaaatcactatgaatccctgcacctacaggtacagaaaattatttttatgaacaaattatgtaggaagtgccagagccttaggtcctttaccctgaggtatatatactgaacaaaaggaactgagccacagatctcttaggtagctctttttatcttacaatggaggacagtgattacaattatatgaaaattttggaacaaaagttaatactaagattcagtgcaaaatttggggggggggggggcacaggtatacttaagcacaaacactgtgacccaaagtgcttcaacatttagttacagatagtagtatactagaagtggtattttagaataaagtggttgcttagtattcacaggtcacaaaacaaaaaattattcttgtatagcaaattagcttcagttgaaaactatttgtaaaagcagattatgtaatgaccaggagttcaggaaaatgacttctgaaagcattgagaagggaaagccacgttaaaggacagtacagctggaaggaagcaagtacttacccactgctcagtcactaagacaacaagctccttggagtgctttaagctacggaatagcagaactggcccttcccaattttatgcaccgtcacaaatttcttcataatggttttgtccaaggcttataacccaaccctggcaactataatccttactttatgaaacagctgtatttcttttatactcataacccagaaaaatgagaatgtatgttctgagtataaaagaaatgtagctattccataaaaatacaggagaaaaagaataaagctattttaatttttttaatgcagtatcattaaaaaacaaaccaagtttgttctaagtttgactttagagtcaggagacttaagcttacatttctggtctgccatctattacttttagagcttgggtaaatcttcatttgagatctaaatgctatatatagttcattcatagcagtaccagataagggaggagtatatctatacagtatatagtcttgaagaagtgatctaaggctcggagcttttgaggtggccatgagtgactccaaagtccatggagctaaccaccctgcagtgctagccaatccagttgaacatacccttttctccattgttaactgtttgtttaaatagcaaacagaaggcggcaatggaggtgtggaaaactgaggatccgatgtcacttgaaagtaatgagatcacataacattgagggaatgtcctaagaggagtggcagggcataaatagaaatgaataaaagtgttttcaagtgccatttagtgggttctgaatttgaactagagattgagatatccagttatggagacattaactcaaattaacaaggtagtgaatgggaaagcacaaactataaaagactgtatcaatgtatggtattttttcccagagctgttttgacttaatggcataatagatatgtttaagtttttataacctcacgattatcattccaaatcttattttcctcctagaagcctctgtacagaaaagatgaacttaaaattactcgctttgtagaaacttaatctaaaagttcaaaatgtttaagtagcaatacctaaaacaagttgcagagtaaagaatcctctttttttctttttttcaacattaagatttggttaaataaaacctttgcaaacgtgttgccagctggaaccaacaaaaatgtaaagaaaaaaacttttacttttttttttttaagttttccactaaccactttgctcacatttcgttcctttaaatagagatgaacctgtcgtcccagattattttacagagaaatagtgaaattagtggaattcgatacaaaaatagtctccctgtaggataaaagttatactttaccataaaccttcctatgaacgccttctggagctttgatgtgttcacacctttcagaggtttggacataatttttattcttacctgtagtggatagtttttccaagacgctgcccagacacccgatctccgtgtactattgaatttcgtttattcccttgtcttggctccattctgggacggagaggaaagacaggtgcctgagagcggcagcggtcagagccccgcggggagaataccaagcatgcggaaggtaccc

SEQ ID NO: 337 - DNA, 16724 bp, Homo sapiens
gttaagggatttgatagggctagaaagcagtagacctgggatttaaacccaggcaatatgattattagccatgctgctatatggcctacttattgccttacttcacggagcttacagtctaatgggagtaaggaaatctgaagggtgagttgaaactgggggaagacaggcatttcaggaaagagattcacatgcgtaaggaagggttcaagtcatcaaagggcatttacatgtaattcagggtgcaagcgggccccttgctcagcagaatctgtaggaccctggtccattggagcctaggaataggttgatttaacccaaccaaggcttaacaaggttggatttcctgtgatttcttagatgatgagcttgatttcagttgggatttatgagaaccatgtttagggaaagtgttttctgcattttagatttgtactccagactagattctaggaaaagccaagactctgtttctttaatgaccattcccgttaatatggagccagctctctgccctggataagactcagaccctgaaatatcaaaaaacttgcagaaaccaaacagttcacattccaggagctatgagggtacagcaaaggtggacagaaagtctttgggacaaggggaaagttagtaaagttcatctctcccctcaccctaattgcttgacaaaagctagccttccagctgggggtttctgatattttccttagcaaagtgaagatatcaccccagtagcctagtcatataaccctgtcgtttatcctcagagcgaaatgtctgaaaggttgaatccaaattctattcccagtgcttaggaaattctaatcctattgtcaggtgctcttgtttttatgccactttttaatacatcacttcatgatatagtcattgttccatattggcggtactcgctgagccttgacaaatactcgatctcaggagagattcttttagaattctagaatctcagcactggaagtaactcttttagtccagccgtccccatgacacatagctccttcctataacatcccatgtgatagtcttaatttccgtttggatatgtgaagatgtaggtgttcatcagaattgctcagatgcctgaaggaaaagcttaacaagcaatatttataggcactgttactgtactatgagttttacatttattctctctattcttgacaacctccctgcagatttggttttccatcctgtttcatagatgaggaaaccaaggctccaagatgctaacttacttgcacaggatatataggtagctgtagtattagcagcacggctgcagttgttaactccttggaaagctctctagggaagaataaagaagtagtttcaggccaggcgcagtggctcatgcctgtaatcccagcactttgggaggccgaggcaggaggatcacttgaggccaggagtttaagaccagcctggccaacatggtgaaaccccgtctctactaaaaatacaaaaaaattaactgggcatggtagcacatgcctgtaatcccagctacttgggaggctgaaacaggagaatcgcttgaacccaggaggtggaggttgcagtgagccgagatcgcgccactgcactccagcctgggcaacagagtgagactctgtcccccgccaccaaaaaaaaaagaagtttcagcttttacctcctcagctattaccagtacattcatgcctaagaaatacctacattttaaatgtttaatttgattgatcagtctacccagacagcttctgaaacccagttaagtattatttctctaagtgggcaaaatggccaaccagtggacagagcaggtgccttcaggctgcatggtggctggtatacacagtgaaaatatcccatcagctagtcttcttttccagggccctttgtctgtggatccctccatgggactatatcatgccttatgtagcacattgggtgtccttttactcagtgcctcatgaacttagtctgagttagtaggagcttagtcatgacaggaattcttagggtttatgttaatttgaggtcaccagggaagatagttgccctatttttgaaattgccactagcaggtaacccacggaagataactttacaaggaagaacgaagaactatagtcataatgtgcttttgagctaaagatgttgctgagtattctcatagctgttatccacctagctggagagagatcagccacttgggaaattcagagccacttaggaaattcacatgctttcataagaagttcatttagcaatctaccttttcctagaaaaacatatgatttaagtgtttaataatggggaaaaatttaaacacaagcaaatcaatcatgttctttgctaaaatctgaggtctggactggttagcattgtcctggtatttgtaaagatttccacattctcagtcaggtatattttctgattgtctagccaggataccagtgaactaacaggccctgatgtaaatgcagtcagaatgatcaaaactttcatttcctcagcaaggagtctaagatacagctgtaaactgtacacagaagccccatgaaacagatgagtctctcagaccttatttcttgctctctgaatgccgtggatcatggcagaattgaaaagtggtgacagtggttaaagtcagggatgaggttcaaacatctacatgactatcactcaccagtgggagaacaaatgaactaatagcttcatatccaaatgaatttttcagggtttttccagtttgaattgacaaaagagcaaaccaaccaaccaaccttaagctggtggatgtggagtggaatgggtggtgaatataaaccaagagtacaggagtagatcttaatgtcacggccaaatggctccaggcattcagcccatgttgtaagaattagtctccatctctgtgctgctttcctctgggaggttcactcccaggcaggttcttccttcatggaaataagatgcctattccagtcttccagcctatcctctggaaaccccagtgggaagtgctgctttccccagtagtcccagcaaaagccctgaggttggggtccatcagactaattggggtcatatgctgacctgttattgtttccaggcttggggtttggtgtgtgggctggggggtgaagcacatggatgagatggggatgggagggttaccgaggaaaatacaggttctgttaccagaagaaaggggaatggatgctggacaagcaaaagcacaaatgtccactaaatcaaagggaaaattcaacagagctcatggaagactgaaattcagtctgtaatgtctgagacagtttgtcctgcctctagcatacagccttccccccgaaatgtacacaaacacacactctcacaaccttgctgcctccttctcgtcaggtaccacctgaagcaggaagttgcaaccaaccctcttgtcaccgtccctggctattacatggtatcatgaatggggaaaatagaaaggagcctttcacacagtagactgatccatttcctattaacaagattttaatttcaggggcgccgatgtgtgttgaaagactgctgcaaaattcttgacaacacagtattacctccagaaactgtggttccaccattcactgtcttctcaggctgcccaggtaaccttggctgttgattaattttattttaacttcctaaaactcagttgtattttccatcgcaaaagtaatgcttacgattcctatctctggcaatatgttgatagagctaacttagaaattcacctgtacaaagtacctagaaatgctacctaacatataacaagcatctgtttaaatgcataattgggttcaccagaaaataaggaaattatgaagggccaaacacaaagaggaaactaagcccaagctgtgagattgcacgggttaatgctgtcttcataatagagtgatttgaggggtgatactcatgtcgggatggaaataaagccttggatccacacatggcagagagatcctcaaatactcttaaaggattccctctcaaggaaaagtcgatgtaaaacaaatctgctgccaacacagggaatgtacaagaaagcatttcttgcctggcctggactctgggtagaaaaagtctgtctagagaattttagtactgggcttaccctcacattggtcatgggtttaatttgtacattccacatggcccaggaattcccagactgaaaagttagcataaaccatggtctaagaccagcaataccctggggatacctgagaggggcaaatattaatacattatctctggaccttggctgatagaatgctcacaagtaaagcccatcaggagcccggagttccaaattataaagcttgaggaaacaaaagtgatacgtacttctctcagaaaacttggaaaacactgaaaagcagaaggaaggagaaaacctcacattcccttagccctaccccaagacagtatcttcttctccatgttgttttacacagctgaaatcatgtagcatatacagaggcacgtcataaattcacagatggaaaataatatgaacagagagatttgacagtatatgatacctaccactgagtggtttaattgtttttccaattaaaaaataaatctcatctctcagatcattgaatctgagtttctaagatgaacaaaatcatcactcagattcttcggggaggcatttggccattctaccgtgtcatgcatctctgcttttgcagaggaggaaggagagacttttgtttagtaatttctccatattggggtcctgctgtgaaaaagtttagctgttcttagcaagcactggaccagaacagcctcagcgattatttaagtgattgtcagacatgcatctgattgaggtgagaaggatattgccagagaaatatcttaacttcttgtaacttcttcaagctccttagagctgggtctttctttccccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacaggtaatgcccagcttttctgctgctaacacatttggccagttgttgcagttgctcatcatcttgggaaaggtgtttgtgacttttcagagcccagattcctgttgtctattaaaacttgaagggaggggtgaatagtgtttctctcttcttcccaaaatgaccttagctgtcctaggatagttagtaaaagactttttagcattttgacctagggcctttggctttcactaaaagtggggacctcagtatcccagattgtaattttgccaagtgttagatttgagtctctcatgtggatgcattagtcaggtggttactccttgcttcaaggtacttaccttatttcattgaagacaccgcatttgtgaactcttgcttcctggcctagaaccattcagcctaccctgtatttgccataaactccacaattcacaccaaaatgtctgtacttagagctaattcgcatatatacaggaagggctcttagaatcagtttgtgggcacagagcctcaggagtaaatgaagttactagggctgttcttaccatctccttctggccaaatagcacaacatttcctcgttctgctctgacctcttagcttagaaggaagattcagaagtgaggggctaagaaggttgtccttgcctaatgctctgatctgtaagtgaatagggcagaacagttcagccttgaggttagaatttagcaggagctatcctgacttaatatccagttgtggggtttgcaaaacaaaacagctgtatgtaatcattgccactagttccatctagaactcctttctagtttgttatttttaaaatgtttatacataaaaccaccaaaatacatagcttcgacaagatggaagtttatttctctctcccataacagtgcagtgatagtcagctggtccaggccaggcaaggggctggtccatgatgtcatcaggcacccaggttcctactgtcttgccatgtggccacagttagcaacaaaggaggctgtaaatttagtttctacttgggcagccaaaactctgaggaaggagattctgctagtaaaaaggagtgggggaagaatggccattgggagacaacaagcagactcaaccaggcctctttgttggcttcctttcctcctgctgcacatgagccttcgccgtgcatttggagccatgacagctgatagctccagacctgcatcctcctagcttgggggctctgaatgaaaggtttcttcccttccagttcgaatttggaaactcccaaagttctcaatggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggcttcacagtgtggccccacagcaccagttattgataaaaagagctcccctttgctgacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggtcttctgtctggaactgcttcctttttgttttattatttttccccagatgagctgactgggccatggaactgcatccttatggttcccatagcaccttaccgaggcgcccttatcaatagagttttagttatgtacctgtgttcttgtctgaacccctactaactgtgagctcctgaggagtcaggcctgagtctgtgggtcatctagcacatccttaatagaatgattgcctggatgtgaccaccctcacccccaaccctcacacaccctgccagcatgcctcagaccttaccccagctcaagataagtctcagattgcaggatacctgctgcagggaacaaaggtgaatgattgtcttgtgagcctcctgttgactgattctgttttacatggctgcacagagcccttgtggttatttggggttggggtggtggcttctgtattagtcacttctgcatgaaccatttcactcaggatctgaggccacagttcctttcttagtcactgatacatctggcagacttgaaattaatcagacaaacattgttcatagttaacatatccttggaagtttctcagctataaggaagaggtcttggtggctagggaggcctttctctgtatcctgttctatccagtgagagcctagagggtgctgcccagccatattctggctagcctcagcggttctcctgaaaaaaaattggcatctgacaacctggatggtgactataggtagtcaaatccagctggctggtctcctgggggttagcttccatggagctgcaagtcccctgaaatgatactggcagtgttgggacagcgtgtccgaaggcctggttttttcagaactggtctcagcaaaatgtctcgccaacttctacagttcccataagtacatgataactgaaacacttctagagccccccagcaatgggcttgtgcttttagtagaatatgtgcttgcttccatttaggggtaagaaggtgggcccctcaccatatgctgcacagagaagagagacaccatcactcatttattcatttaacaagtgctttccaagccactactaggtgccaagcacttcctaggtcctggggatacagtggagactaagatggagccagttctttctcatagggatctcacagcttagtgagtgagaaagccaaagagtcaaaatacagagagggtctgaggggcccattttgagagccatcatagtggtgaggagtgtgagtgctagagtcaggctgatcaaatcccagcctgccattggctagccttgtgactttgagcaagttatcttacttcgtggaacctcaggtttctcatccataaaatggggaagttggatagggtattatgatgattgaaatgcatttatacatgtaaagcataagtactggctcagggtgagcactcaataaacggcagtttattaggcacttttattaggaagtgatacaccttgagcaaaaccccttagagtataaggcatagcattcttacatatttttaaaatttaaaataaaatttaaaacatcttgccctttataatcagtccgccacaaacaagagatggagaaatcacccttccttgttttgtatctatggggtgcaaacatttaatcctcccaactgtcaaaaaagtgagagtttcacagcctgttttacagcagaggaaactgatattcagagaggttaagtaaatttgcccaatgccacacatctaataaatggctgagctggaatcaaggccagctcttacttggctgcaaaatccatgttttatgcagctcctccactatcttggcctccaaggcagctggctttgaacactacccttgcagcccagtcagccaatcccttgctctcctgaagcttttgctggtgggccagccccacctgctttccttgtgcactctgacttggaccctgaagtgagaagagttggcacaggacatcttacttccctgaaaacagtacctggacttttctgtatcttcacatccattgggcattgggcaaatgggtcatgcagatgaaaaccatccaagataagagacatgggagtgaaattcacacccactctggctttcataccatgggtctgaacattagcccatggtgtttcttggccatactgacctgtgccatttcagctgcattcatctcagttggtgttgtctgctggctgctctttctgatttcccacaggagcagtaagaacctgaggaagagtagggtcagaggagtctgggagaatgaggaaatatgagagccccaggaactgaaaaggcctgtgagagactctgagcttcctgggaacaggtataggttctttttatttcaataataacagaaacaactgtcaaaaccatgtgcctgtactatttggagtgctgtccttgcagaatctcattataagaaccttaggaaataggcacatcatctcctggatagaatcctaggaaatgggcactataatgggcactttatcccattttataaacatggaaattgaggcacagagagattaagtactttcccaaggtcatacagctagtgatggaggagctagcatttgaacccggagtttttagtctattgagtttaaccgacagatcatactgtgttttggtagggagggagggaggaagcaagcaagtgaacaaatgagtctgggatttaggacttgccagacaaacaaggcccaagaggcaagtgtgcaggtgggtgtagttgggagtcagcagagttgggttggaattcaagctttgccacctgctggctataaaccttggttgggtaagtaacccaaggtaaatgagatcatctctgtaaaactcttagccttgtgcctggcacatagtaaatgcttaataagggttcactgttagtattactgttactgataacatacaaatagattgtattaatggaccataattgcaactgtataaaacaaattccatgtttggccaggcgcagtggctcaagcctgtaatcccatcacttcgggaggccgaggtgggcagatcacgaggtcaggagatcaagaccatcctggctaacacagtgaaaccccatctctactaaaaatacaaaaaaattagccaggcatggtggcgggtgcctgtattcccagctacttgggaggctgaggcaggagaatggcgcgaacccagggggcggagcttgcagtgagctgtaattgtgccactgcactccagcctgggcgacagagcgagactccgtctcaaaaaaaaaaaaaaaaaccacaacaacaacaacaaaaattccatgttgacaaggatgggaatatgagaacatggaaacagctatgaaaagacataagagaattaggaggattttctttaatatatcattttttaaaaaaaaacttgcttgtatttgtttattttttaaatagagacagggttttaccatgttgcccagactagtcttgaactcctgggctcaagcgatcttggcctccctaagtgctgggattacagtcatgagccactgtgccccgccattttttaataaacctttctaatggaacaagtaaaacacatgcagtggatgctcagcaggccttgagtgtgtgaatgaaaaatatttgaacttgtttttactggttgatttcattgcttaaaaaacataccttagctggacgcagtggcgtgcgcctgtagtcccagctactcatctcttaaaaaaaaagttttatgcttgttaatttcataaatgctagagggatcaccctaatcaaataaagctactcaaaaataaaatatgaaaggtgttagtgggatacagctttctagttttttgccactagtggataggttggaatttaaattcttcggatattggaaccagaacaggctgtaactgattatttttgctgtgattcgtgcttactggagcctcgggaaagagggagacaacatgtaaagagaagcaatctgtttggaaaatgaaaatacagttaaattgctaatgaacccttgtcaaaatcaaatgtctccccttagaggctgatgattgtctagtctaatatgcattttttttgagtgggtcaattggactctaagaccaacaagataaaaaggcagccttgcatgtcacttggaccacagctgtctggccatgcagcatgccttcactgctgctgaagaaaagcagctgcttgttgagaatctcaaattctcagatcctaattgcctggccctgactctaagctgaaacctgctactgtctgccttgagctgttttagcctcaacacgagctatgctgaactgaaagcaggcacaggctcaatgaccaggactcagacgttggggccgttggagattaaggaccccctccgtggagcgctaaactatgaaaacgtcctggaacctggctgaaaagggcttattctctaatgggaccatctaagatcaagctgctgataggctctttgtctctaatacagaggctaattgcattcctaacttctaatatttgccaaacgctccaagctggggaagggcacatcgcaaggactatgacctctcctcctgcttttgacagaccagactcaaaccttctctggggcttctctcactgctgttgacttgttgcattcagcttttgggattagttgcagcttgcaacagtggactgacagcctgactctacttccctcacttttctcccagcacacacagcttagtaaggtaggtggattattaaaacgtagctgtccccagaaaggtattaggcttttctagtctgctcattgaataatcaggacaaaaggggtagaagattatgtaaacacattttgaaatttttaaaaattcagggtttcatcctttattagtttgctaaggataccataacaaagtaccacaaactgagtgacttacacaatagaaacttattttcctgcagttctggaggctgaaagtccaggacaaggtgtcgacagctttagattcttctgaggcctctctgcttggcttgcagatggctgccttcttactgtgtccttgtatggtccctctgtctgggtgtctgtgtcctaatcttctcttttaataaggataccactcaggttggattagggcccatcctaacaatcccattttaacttagttacctcttcagggcctatcttcaaatatactcacattttgaggtacaggtagatggttagggcttcagcatgaatttttgtggggacataattcaaccctccacacataattaccaatttctgaatgtctttctggttaagttgcataaaaacgtttatctacttgaactctaggatgatagttaaaaaaaaaaatgttggccaggcgcagtgatggatgcatatgatcccagcactttgggaggccgaggtgggcagattgcttgagttcaggagttcaagaccagcctggcaacatggtgaaatcctgtgtctacaaaaaatgcaaaaattagctggacatgatggcatgtgcctttggttccagctacttaggaggctgaggtaggaggatggcttgagcccaggaggcggaggttgcagtgagccaaaatcgtgccaccgcactctagcctgggcaacagagccagaccatatctcaaaaaaaaaaaaaaaaaagtttatctacaaaaatgcttttgtgcctcttacatacaacccttccagaggaaaggcctagctgagagtaagagatggttgaaaaaatgcaatgttatgattgctgaacagggcacgactgtttttgtaatattggagaaaataattaaagcctggcacctggggaggcttgatccctggaagcctcctcttgctgaaggaaaattcccagtgctgcctttccatgtgctgtgagtgctttgagttcagactgacaacagagtgggtctagcttctatgctttccatgaagatctcccacaaatgtcatccatgctcatgagatggatcaacttgtatcctgaacaagcaaaactgtttgggactcactgccttcaggcagtcccttggaagccaaggactctgggaacttttcagatgggactggaaacacttgggcaggagttcccctggtaggaggtctgttcacctgtacagcctaatggatgtcctgcttgaggtgccctaatattgcaaattctttgtttacaggggtaccacctgtgcccctgggactgtgcttctgtacatgaccacaactctcatgatgtcccctcagccctggaaagcatttgggttagcttccgcttactggtcagagttatactgtgcctgaattgatgcctcaggtcaggttgaaaaaaaaaaaaaaggttcagacagcaattaagggctgggcacggtggctcatgcctgtaatcccggcactttgggaggctgaggtgggcagatcacctgaggtcaggagtttgagaccagcctgaccgacatggtgaaaagtaaaaatacaaaaataaaaaaattagctgggtgtggtggtgtgcacctgtagtccctacaaaaataaaaaaattagctgggtgtggtggtgtgcacctgtagtcccagctactcgggaggctgaggcaggagaatcgcttgaacccaggaggtggaggctgcagtgagccaagatcacgccactgcactccagcctgggtgacagagcaagactccatctcaacaacaacaacaaaaaggaattaaggaggaagccacctggcttcctaagatagactttatggttaatgggatttattttagctggttaagtccaggacccctaccaggaagaactgaggtccatatttgaggttggtctcacccttttgcatgtggtcctactaataataattttgctgtaaagaagcctcaataaggagatggactgtgtgaaaagagatgagaaagcaggcctgtttgcaaggctggcccttggctggcatctgaaagcttggatttcaggagggttctcattactccctaaatgataagagtggctcactgtgcctaaactgttcgtacaaacaatgtgggttatgcccaacatctgctttccttctgggagtcagattttcatatgtgttaggcagaggatgaggtgagcagctcccaatgagaaccctgaacactgagtctgtaatgagcttcccttgtatacaacattgcacatgggttgtcacaactgattgctggaggaattgtgtcctatgtgactctgctgggagaggactgtgggaggcttacacctggtttccctggactttgtccatgcgcttttttcctttgctgattttgcttcctagcctttcgctgtagtaaaacatagccatgagtatgactacaggctgagtctgtgaatctcctagtacatcatcagactaggaggtggtggtgttggcaccccccagcacagggcacaagggagacttgcagggtgtttgtcatgttccctttctcaatctgggtgtggtttacagatttgttcagtttgtgaaaattcactgagctctatgaacaattataatatgtacatttttttctgtaagtgtattaaatttcaataaaaagaattcacactataggggtacaaaataacttaatttttcaaagtcttccttttattcagccaacattttagtaagtacccttttttttttaccaagcactgctctgggagcttgggacatggggtagaaaggacggcatcattgtcctcattgtccttcagcttagctgcaaggcaggtgaaggatgcttatagtatggttgatttttgctgggctctatgaaggatcagagggtgctaaggaggcacagagaaagagcttttaacgtgggtattttactgttccagggttgccactcaagtacctacagaacaaacgggtgtagctgtaaactgtggcaaactgaaagcatgtaggcacagagtaagtagctagagctgatttttttcaggaaaggccacaaatcccaacttttatgagctcctcttttaaatgctgtaaatgttttacaatggcggggcgcggtggctcacgcctgtaatcccagcatttgggaggccgaggggcagatcacttgaggtcaggagttcaagaccagcctggccaacatggtgaaacctcttctctactaaaattacaaaaattagccgggcatggtggtgcatgcttgtaattccagctgctagggaggccgaggcgggaggattgcttgaacccgggaagcagaggttgcagtgagctgagatcgtgccactgcactccagcctgggcgacagagcaagattccgtcacacacacaaaaaaaaggcgtggggggaggccaaacaaaaccccgcaagacacatttggctatgacctgccagtttgctaggcattcttccaaccttccctccctctgaccaagaaactgagtgtccactattttaggccctgggaaattcagtagcgaggaggccagacagcttcgttgcatcatggggggctctggtactgtgcttctccaacttcaggatgtgtaggaatcacctgagcagtcttgttgagaggcggacactgactcgggaggtctggggtagggcctgaacgtttgcctttgcggttctaacaagctctcaggtgatggcgatgctactgttccctggccccgaggtagaggaagatttaagtaaaagcttcctggaggaggcgcaagtgaaccgcaggagctttcccggacgcccgagaaagggagaaaccccgaaggaattcctcctctctcggggctgggtctccgcatccacgccgggtttggtttcccaggctatcccacgtgttcgggcgtccgtgtcaatcaggttttccccggctgggtccgggtttaaaggctgctgctgcgcagggcgctcccatggtgccgcgcggcgggcgggttt

SEQ ID NO: 338 - DNA, 16543 bp, Homo sapiens
accatatcttccaatgtttttttggggaagtgaggttcccatataagggaaaatgccccattccaaaatacgacctttggacagggtgacgtcattggaaatccgaaataaactgaggggtggggaccagtggggggaagctctgtcacttctggttaccactgttttgaagcttcattgtggctaatccccctgcagaacctcaaaccacttagagatcaactccatagatctttggttttcttcatctgtttcacatggaacacagctttctcctagtctgtgctttgtttgctcacgtgtttttttcttcctcttgtggttcatctgtggcactccattccgacccttgccttctgtcccctgtacttctgaactgtctccctggggacctccgccctctagatgagttatacgctcagaagctcaagtacaaagctatcagcgaggaactggaccacgctctcaacgacatgacctctctctgagaggcagccaggtcgctgccctctgtccttctcacatggtgcctcctacgcccctgtgggcttctaggagctccggtggcctgccttctggtttgaacgtcagagccttcttctgatgtgtctgtgactctacaaccgaaataaagacgggcagtcctcctcttcatgccccctcattctcattttctccacttgctgcctttgagctgtagctgtgtgcccttaaccatagcctgaaacacaaagtgggtggttagcctctctcactcacaaatgaaaagcttattacaaaaagaaaattatgcctacaggatgcttttctgaagacgtgaaaacaaaagcaaactgggcatgtgctctcagataccgctgttagctaacggcatctgcatgccaataatttttttttgtttttttgttttgagacagggtcttgctttgtcacccaggctggagtgcagtgacaccatcatagttcactgcaacctccacctacaaggctcaagctatcctcccacctcgacctcccaagtagctggaactacaggtgtgcaccaccacacaaggctaatttttgtactttttttttttttttttgaggcggagtctcactatgtcgcccaggctggagtgcagtggtgcaatctcggctcactgcaacctccgcctcccgggttcaagcaattctcctgcctcagcctcccaagtagctgagattacaggcatacaccaccacacctggctaatttttcttttggatttttagtagagacagggtttcaccatgttggtcaggctggtctcaaactcctgaccttgtgatccgcctgccttggcctcccaaagtgcagggattacaggcttgagccatcacgcctggccatttttgtactttttgtagaagcgggagggtttcactatgttgcccaggctggtcttgaactgctgggctcaggcagtctgcccacctcaccctcccagggtgctgcaattacaggcatgagccaccgcgcccatccccaatggtttttccttaaatagaaattgttgtgaatggaggctcatccttgtaaaccgcttaggcagcttaagagtcaacagggatttggaaaaaccagcaagcctgtgtcaaaaatgaggctccccttgaatggggcttgagctacagattcaaacagcggcagtgacattttgatctccatttcctccttttcttgtgtcttttctctgtgttacactgtgagtgtggtgactggggcttcccgtggctttactcttcactgttcatccagctcccagtcctgggaggaagttcacctccacgccctgcccttagaaaactgactgtacaaggagtgaacgggcctccatgaacagggaaagtgctgtgacgtcagaagacgtgaatttagaattcttttcccgaattccagaattgcctgagactgctaacatcaatctccattcatatttcagttagttataacaggaaccttgctttagtttagaatagctcttaaggttgacctgtgggtaataaaaggtcatgctttttcctacatgaggaatatggagaaaacaaggtcactcttttttttttttttttttttttttttttttttttcaagacagggtctcactctgttgcccgggctggagtgcagtggcgccatcttggctcactgcaacctccgcctcctgggttcaagtgattctcatgcctcagcctcccgagtagctgggattacagtcgcggaccaccacactcagctaatttttgtactttcagtagagatggggtttcaccatgttagctaggctggtctgaaactcctggcctcaactgatccgcccacctcagcttccaaaaatgctgggattacaggcgtgagccactttgcccggcccaggctatgctttgcttttttttttcttctttctttttgagacggagtttcgctcttgttgcccacgctggagtgcagtggcgccatctctgctcactgcaacctctgcctcacgggttcaagcaattctcctgcctcagcctcccaagtagctgggactacaggcatgcgccaccatgcctggctaattttgtatttttagtagagacagggtttcaccatgttggccaggctggttttgaacccctgacctcaggtgatccacccgcctcggcctcccaaagtgctgggattacaggtgtgagccactgcacctggcccaagctatgcttttctaatgatcaaaaacataccaatttgtcccaaaatttcaaatagtgcatctggttctcccctgcatcctaccaccactaccacctcaaattatcacagataattgacatttagatgttcaagccacatcttccagactaccccttgaacctggaaatggcatgaaaatctccaactagatcctgaattttcggtatccattgttattcctcatcctatttttttgtccaggtgggaagctctgtccccattactctctctattcatccattcctccaaaatgcacctcccctaaaccacctccacctttccaccctcagcctctccctgctcctaactgccgtccatcctgaacttctgcaaaaaccattcccctcacacattgccatatatatgcccttggaaagattacagactgtgtagggggctggtttttgtttggagtctgtgtgtttgtccctggaatttctccaggcatttctggactccaccctttgaagtaactatgcagcctgtctatccagttattctacctaactaagcacataagtggaatttcagagattagtgctatggccgggcacggtggctcacgcctgtaatcccaacactttgggaggccaaggcaggcaggtcacttgaggtcagaagttcaggaccaacctggtcaacatggtgaaactctgtctctactaaaaatgcaaaaattagccgggcatggtcatgggggcctgtaatcccagctactggggaggctgaggtgggaaaatcaatcacttgaacctgggaggcggagcttgctgtgagccaaggtcgaacctttgtactccagcctgggcgacagagtgagactccgcctcaaaaaaaaagaaaagaaaagaaaagagattagcactatggaggtctacactatctgttgatagtctgtgagccttgtcgtgattctcaagggcagttaacactttcagggaaagtcattttatctcagacctaataacaaaatagatgctaaagcatctgagtgacaagatgaagcgaagtcaggatttgtagtcaagagaccagggtttaaggcctggcgcagtggctcacacttgtaatcccagcactttgggaggccaaggcaggcggatcacttgagctcaggagtttgagaccaatctgggcaatatggcaagaccccatctctaaaattattcataataatattttatttttaaaaaattttttaataaaataataaataaagagaccaggatttaaaatcctagctctactactttaaccatgccaacgtgaacaagctgcttaggttttctgcaaaataaaggtgatatctctgttatgaggattaaatgagataatggagaaactggctcgtccaacatagtcagcattcagttaacatctattcacccagactggataggcccaggtcactgatctgtctgatagaatcctcccaggtcatagtcacttgactctgtgtgtgtgtgtgtgtgtgtgtgtgtgtgatggagtcccactctgtcacccaggctggagggcagtgacgcaatctcggctcactgcagtgtccgcctcccgggttcaagtgattctcctgcctcagcctcctgtgtagctgggattacaggtgtgcgccaccacacccggctaattttttgtatttttaagtagagatggggtttcgccatgttggccaggctggtctcgaactccttacatcaaggatccatggtgtctcatgccagtaatcccagcactttgggaggccgaggtgggtggattgcatgagaccagcttgggcaacatggcgaaaccccatctctactaaaaatacaagaattggctgggtgtagtggcacgcacttgtagtcccagctacttgggaggctgaggtagaaggatcacttgagcccaggaggtcaaggctgcagtgagctatgatcatgccactgcactccagcctgggcaacagagcaagaccctgtttaaaaataaataaataagaaaggctgccatcttctgcagtcatttttttctttctgtaaatttccaggctgatgatatcacattttatgaggcattttgctttcccccagcattttaatgagtcttggccttgtcccttatcagccatcacttactgcaaactaagttctctctcgtgctctgtcacgcatagctctaaatggcgtcttttttctctctctctttcttttttaatttaaattgtttcatcagctcagttacttaataacatgcctgtagaatggcttaaatttcgcatttacctggggtttgtctccgttctcctggattcatagacagttacacaattatgtgtataatttaaacagccattcccagaagctccgaaggaaagatgggttacaggattttagatttaactatcaaaggctcaggggctaattaactagcacttgggtggaaatttatattaagtcacacatatctaggactgaaatcttcatgtagcagcacgtcataggttctgaagtatttctcctttattcctcatcataacccccacaccacgcattgatatcgttacccccatttgacagacggggaaaacagacctaggaaggttagatgcttacttaagtgatacaactggagcttaagttcaggtattctgactcaagggttaccagagttcacaaggaaaaatacaggacaccaacttaaatctgagtttcagataagcaatgaataattttttaatcataagtatatctcttgcataagtacatctcatgcaacatttgggatatacttacactaaaatattatttgtggtttatctgaaattcaatttaactgggcgccctgcattttatcttacaactgtgactcccaaatttggtgcttgttccttagtattctgtgatgttctgctgtaattaaaaatacaaagtactggacaggcatggtggctataacccacctgtattcccagcactttgggaggctgagcagatgggttccttgagcccaggagctcaagaccagcctgggtaacatggtgagaccctgtctctagaaaaaatgcaaaaattggccaggtggtggcatgcacctgcagtcccagctatgcgggaggctgaggtgggaggatcacctgagcccagggaggtcaaggctacggtgattcgtgattacgccactgcacttcagcctggacaacagagtgagaccctgtctcaaaaaaaaagtactttctctcttgtgactttcaccctggcagtttcaggtttagaaatctttgggggggtgctgggcatggtggctcacacctgtaatcccagcactttaggaggccaaggtgggtggatcacttgaggtcaagagctcgagaccagcctggctaacatggtgaaaccccatctctactaaaaatacaaaaattagccgggtggtggtggcacgcgtctgtaatcccagctactcgggaggctgaggcaggagaattgcttgagcctggcaggtgaaggttgcagtgagccaagatcgcgccactgcactccagcctgggtgacagaatgagaccctgtctcaagaagaagaaaaaaaaacaaatctttttttttctttcatttaacaaagacgcttattaatttatctttccccatactcttaatcctcaccagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaatttgcgtgaattttagaatgtgtgggggtacacagagcattttggttcaacaaatgttaaagggatggaaagggaaaataaccagagccaagaatgtagacaaggttatctatttgctttatactgtgacttcatgatacaaggatattacagtctcattgcaggcgagagcactcagcctcggtcactcgaaaactcctggccttccttatcccctacgctgcctaagccaggctgtgaagaatgagtaggattttaagagataaaagcagggaaaatcatctctgttgcctgagttaggaagatctgcctagctaaggctgagttacacatacaaaggaaagcagaccagcatgggcaccatagtgagaccccgtctacaaacaataacaaaaatttggccaggtacagtggccaaattacacctgtaatcccagcactttgggaggccgaggctggcggaccgcttagggccaggagttcaggaccagcctggccaacattgtgaaaccccatctctactaaaaacacaaaaatgagctgggcatggtggtgcacacctataatcccagctacccgggaggcggaggttgcagtgagccgagatcacgccactgcactccagccccggtgacagagcgggactctgtctcaaacacacacacacaaactagtggggtgtggtggcacatgcctataagtcccagctactcgagaggctgaggaagaaggatcgcttgagcccaggaggcagaggatgcagtgagctatgattggcctgtgcactccagcctgggggaccgtctctgagcaagaccctgtctcaaaataagtaaataaataaagcaaagcagaagcagaaaagctggaaggtaggctgagcccacactgatgacagcctgaacttaatttagtcaggagtggagagccactaaagactagaggaggccaggtgcggtggctcacacctgtaatcccagcactttgggaggctgaggcaggtggatcatttgagctcaggagttcaagactggcctgggcaacatggtgaaaccccgtttctactaaaaatacaaaaattagctgggtgcacacctgtaatcccagcactttgggaggctgaggcaggtggatcatttgagctcaggagttcaagactggcctgggcaacatggtgaaaccccgtctctactaaaaatacaaaaattagcgggtgcacacctgtaatcccagctactcaggaggctgaggcaggagaatcacttgaacccaggaggtagaggttgcagtgagctgagatcatgccactgcccttcagcctaggcaacagagcaagactcttgtctccaaaaataaaaaataaagactaaaaagactggaagaggccaggtgcagtggctcccacctgtaatcccagcactttgagaggccgagatgggcagatcacgaggtcaggagattgagaccatcctggctaacagggtgaaaccccatctctactaaaaatacaaaaaattaaccgggcatggtggcacgcacctgtaatcccagctactcgggaggctgaggcaggagaatcgcttgaacccaggaggcggaggttgcagtgagccaagatcacaccactgcactccagactgggccacagagcaagactccacctaaaaaaaaaaaaaaagactggaggaaacaagtcaagcaatacattaggaaaatccacttagcattcatcttcaagaaggtctagcattggggtggactaaggcaggaagcccagttaggaaaaggtttcaataatccagtacaggttgccatggaatacgagggaagaagtgattcgaaggaagtaatcttaaaatttagctcgctggatggcagagaacttagaacagaatgtcaaagaccactacagtttcactacctgaattttgatattttgcctcaagatcttcttttgaggaggggaggcagtgaatcagaaagagaaatgaaagcctttaaaacattaatggagtctgcagacaactttctgttatcgaaaaaataacaagccgggcgctgtggctcacacttgtaatcccagcactttgggaagccaaggtgggcagatcatctgaggtcacagacaggcagatcacctgaggtcaggagttggagaccaccctggccgacatggtgaaaccctgtctctactaaaaatacaaaaattagccaggcgtggtggcacacgtctgtaatcccagctacttgggaggctgagacaggagaattgcttgaacccaagaggcagaggtggcagtgaaccaagattgcgccactgcactccagcttgggcaacagatcaagactctgtctcaaaaataaaataacaggccgggcacggtggctcacgcttgtaatcccagccctttgggaggccaaggcgggcggatcatctgaggttgggagttcgagaccagcctgaccaatatggagaaaccccatctctaccaaaaatacaaaattagccaggtgtggtggcgcatgcctgtgatcccagctactcgggaggctgaggcaggagaatcgcttgaacctgggaggcggaggttgccgtgagctgagatcctgccactgcactccagccttggcaacaagagcaaaactctgtctcaaaaaaaacagcaggcagagacaggggaggataacgagcccagccaggggttcaagacctgcttgggcaatatagcgagatcccattctccaaaaataaattaataaaaaataaataactggctgagcacggtggctgacatctgtaatcccaacattttgggaggccgaggtgggcagatcacttgaattcaggagtttgagaccagcctggccaacatggtgaaaccccgtctccactaaaaatataaaaattagctgagtgtggtagtgggtgcctataatcagctactcaggaggctgaggcaggagaatcatttgaacctgggaggtggaagctgcagtgagctgagatcgcgccactgcaatccagcctgagtgacagactctgtctttaaataaataaataaaataaataaccgaaaatgtagttataataaaagtatacaattaaagcatttcctttaggccaatccaacctttaatgggcactgggctgattcagatggttggtgcagagaatgtgaatgaataaagtcacaccctccaataaaggccctgccatgatttgaccacagttcctcctttgtgtgtctgtttctccctcctccctccccacttgggttgtaatctcatctcgggatgctgttttagtcatgcttatggcctcagcacttcacacttcactgtgttcaacggacctgtcccaacttttggggagttcccaatgccatgaagtatggctggaacacagcatgaggtcagaaccagactgtgagggatttcaaacgctaagaggaagattttggactttatcctgcccagagaccacagatggctattaaaggaagtggtttttttgtttgtttgtttgtttgttttgctttttgagacaggattccactcttgtcacccaggctggagggcagtggcgtgatcatggctcacagcagcctcgacctcctgggctcaagcaatcctcccatctccacctcccgagtagctgggacgacagatgtgtacccagctaatttttgtatttttaatagagacagggtttcgccatgttgcccaggctggtctgaaatgccagacctcaagtaacctggttgcctcagcctccccaagtgctgggattacaggcatgagccaccgtgcccagcctaaagtattttagaataagcacactgcagggtggaatctgggttagagaaaatggtcagggagaccagtggagaaatgtaatgattccactgtggcaatggaaatggaagaatgcaattcaagagctatttgtttttttattttttatttttgagacagagtcttgctctgtcacccaggctggagtgcagtggtgcaatcttggctcattgcaacctccgcctcccggattcaagccattctcctgcatcagcctcctgagtagctggaattacagatgcccaccacacccggctaatttttttaatttttaggaaaaacggggttttaccatgttacccaggctggtctcaaatttctaactcaggtgatccacccacctcggcctcccaaagtgctgggattacaggcatgagccaccgcgcccggccctcaagagctatttagaacctccttaaaaaccagaatgtgacggatgagagatgaaaggcagatgtcaaagacagcttaagtttcactcctaaggaaaatcaggacaagccagtctgggtattggctgatgggttcagttgtgaacatgctgagctaggagtatctgacaaatccaaagggagatgtcctgaacgcaggtggatgtgaagagatggctgggctaaggataaaacactgagaatggtcagcatggattaggagcccccagaaagtgagaacagagacagaacaacgaggaccacaaacactaagggacaggcagaacccacccctcccccacctcaaaaagacttcaatggggtctgaggaaaaaacaaacaaacaaagaaggggaggcagaggcagaggtggtagggagaagaaaccagcaaataaaatagggacagggccgggcacagtggcttatgcctgtgatcccagcactttgaggggatcacttgatgtcaggagttcaagaccagcctggccaacatggtgaaaccctgtctctactaaaaataacaaaaattagccgagcgtggtggcacgtgcctgtaatcccagatactcgggaggctgaggcagaagaatcgcttgaacccggcgggcagaggttgcagtgagccgagatcatgccactttactccggcctgggtgaaagagcgagactccatctcaaaaaaaaaaaaaagggggataggggccaagcgtggtggctcacacctgtaatcccagcactttgggaggccgaagtgggcagatcacctgagctcaggagttcgagaccagcctggccaatgtggtgaaatcccatctctactaaaaatacaaaaattagccagatgtggtggtgggcccctgtaatcccagctacttaggaggctgagacaggagaatcactggaacccgggaggcagaggttgcagtgagctgagatcgtgccactgcactccggcctaggcaacaaagagtgaaactccatctcaaaaaaaaaaataataatggtatagggccaggcatggtggctcatacctgtgatcccagctttttgggaggtggaggctggaggatctcttgagcccaggagtttgagaccagcctgggcaacatagggagaccccatttctacaaaaaataaaaaaattagcctgccatagtagcgtgcagatgtagtcccagctacttgggaggctgaggtgggaggatggcttgagcccaggaattccagaccagcctgggtaacatagcaagaccccatctctacaaaaaataaaaattagccatgcgtggtggtgcatgccagtagttccagctactctggaggctgaggtgggagaatcactggagcctgggaggcggaggttgcagtgagtgaaatcacaccattgctctccagcctgggccacagaacaagaccctgtctcaaaaataagtaaataaatgaggataataccaagaaaaaagaatattcagaggtgatcaagactatcaaataccacagaggctgaggcctgtaggtggtcaatgcctctggttgaagcttttttaaccagagctagattagcagaagaatgagctgaagtggaagggaggaggaaaggctgggccctccttccacagatccttaagtaagcctcaaggccccggaggccccagagtgacctagaacagactggaccatctctaagaagcagggagccctagtgatcaaactgcggcctgggaagcttggcactctgagttcagataccaaattcccacttttaagcaggaagggggaaaagtcacttaacctcctctggcttcagttttctcaccattaaacaggaaaaaaacaataacatcgttttgctgggctggtactgggattaaaattttaagagtcaggggccgggtgcaggggctcacgcctgtaatcccagtactttgggaggtggaggcaggcggatcacgaggtcaggagttcgagaccagcctggccaacacagtgaaaccccatctctactaaaaatacaaaaaaatacaccacaccaggcgtggtggtgggtgcctggaatccaagctacttgggaggctgaggcaggagaatcgcctgaacccgggaggcagaggttgcagtgagccaagatcgcgccattgcactccagccctggtgaccgtgagagactccatctcagaaaaaaaaaaaagtcagggtcttgctccgtcgcccaggctggagtgcaatggtgcgatcacagctcactgctgccttgacctcctgggctcaagggatcctcccaccttagcctcctgagtagctgggactacaagcatacaccaccatacctggctaattttttaaaaaaattttttgttttttgagatggagccttgctctgtcacccaggctggaatgcagtgacacaatctcggctcactgcaacctccgcctcccagattcaagcaattctggtgcctcagccgcctgagtagctgggactacaggcgcacatgaccacacctgcctagtttctgtatttttagcagagatggtgttttaccatgttggccaggctggtctggaactcctgacctcaggtgatccacctgccttggcctcccaaagtgctgggattacaggtgtgaaccacctcgcctggccaaaaaacttttttttttttgcagagatggaggtcttgctatgttgcccaggctggtctccacctcctggcctccaatgaacctccacctcagcctcccaaagtgctgggattacaagcgtgcaccatgacgcccagctaattttatttgttgtagagatggggatctccctatcttgtccgggctggtcttgacctcctaagctcaagcaatcctcctgcctcccaaagtgctgactcccaaagtgctgggattacaggcctgagccaccacacccagctgcaagcccgattttccaaatgtatctctcctctgtttttctctttctttttttttttttttttttttttgagacgtagtctcattctgtcgcccagactggagtgcagtggcgcgatctcggttcactgcaggctccgcctcccgggttcacaccattctcctgcctcagcctcccgagtagctgggactacaggcgcccgccactactcccgggtaattttttgtgtttttagtagagacggggtttcaccgcgttagccaggatggtctcgatctcctgacctcctgatccgcccgcctcggcctcccaaagtgcgggattacaggcctgagccaccgcgcccagcctttttttcttttgatagggtcttgctctgtcgcccaggccgaattgcagtggggcgatcacggcttactgcaccctcaacctcctggcttcccaaagcactgggatcacagacgggagccaacgccccggccagttttttcaacgttgagagccctggcccctagataggacccagcatcctcactgctctaacccctccccccccaccatccccgggctggcccggacaacccctaaggtggccgagggcgggccctgaggaggccggcgcgcgcttccgggcacagcttgtggcggtgaagccgctcagatggcggaggccttgggtatctctaagcagatcgctaggccgcagacctcggagctcgtcttgggtcacttttatttattttttttgagacggagtctctctctgtcgcccacgctgcagtgcaatggcgcgatctcggctcactgcaagctccgcctcccagattcaagcaattctctgcctcagcctcccgagtggctgggattacaggcgcccgccaccacgcccggctaatttttgtatttttagtagaaacggggtttcaccatcttggccaggctggtcttgaactcctgacctcgtgatccacgcgcctcggcttcccaaagtgtgggaattaaaggcgtgaaccaccgcgtccggcttgggtcacttttcgagtatacagctcctcctctctccttcctccctaggcccccactgccccgactcgcaggccgcagacaaggctgagagcgctaccttgctttcccgcgctcgcctcggtgcctactgcgcctgcgcgagctgtgagggcgggaccca

SEQ ID NO: 339 - DNA, 97996 bp, Homo sapiens
cttctctagggagttctgagctgcaagagcccagctactcgccgaacccgggccgcctgcgtgagtaacttggggcggccaggagcacgggaagggcgccagacagagagcctttggctgcttctgagaccggctgtgggctgccaccgctgagcggcgcggaggctgcagcgttccctctcaggacagaaagcaggcgttggggactgttactcgcagcctgccaggggcagcagccgccccaggttcaagtggctatgtgccaggatactcaggcgcggctgttggctgcccatgggagagccagtgctctccgcaggtccaaagtgcaaggccgggctattcccggacttgcctaggagcaggggcccccagcgcgtctgggattgccccggcgcgtcgggcgcgcgaacttgtgcgcaagggagaagagcgcttaccatggaacatggtctgcgggaggcgggcgtagtcatgatgaccgcaactggagcaggagcaagctctcaccgcccatagtcactcccaggaccctggtcttccgcggagttgccgagtctgtgttgggcagggtgatctctgcagctggttcctcttacccacgccgcgactgcagtttcatccatcccaaggggggcggcacacactacggcgtggctctgcgctttgccttttccataacttccgtaggatccgccagcagtgtactttcagtttctactttgcgcttggtctgcaggttcaatctttgggatcatcagcatggaatcttcattatcccctctctcctgggcacctgcttcccgcgcacctggatgaggaccagaggaattcgcgaatttccgaatcaccgcaggaaaaaccagctggcctgaatcaaagcaattctgggtaaaagacttcccagatgatctctcaacgccttggcaacgcttggcgactgggagctagaaccatgagttgttaatgtgtgcacggaagccacaagtgtgcaggacgcaagctgggttattggaagcggacgacaccaaggaggcgttgccgcggatgtggtggacgatgccaagtcgtcttttaaaaaaggaagtgaagaatgattaagagggtcacgccctctaccactccaacctctctaatcagtctctttctgctccgtctgctgtacatgcacctgctcaggtgagacctcaaggaaaaataatcctgtgggtccacctaatctggtaagtgttgtatttggaaaatcaaaccccaaattaaacgcaggacgtggaaactgacgataatatttaactatgacttccacgtgcacatttatctgaattggctaataaatcaaactattcgtcttgaatgcatgccactgaaatgttaactttttcctgggcttgaattatgtagcttatttgctacattagtttggtttctgctattctgcagaaaccctgcttagatgaaggtggataatgtaaaccagtaacaacagcgataataataacgactatcatttatctagcatttgctctctgccagttttgtgctaagcattttatgtatatcatctcatgcaaaactttgtgtgaggtagaccattttcttatctgcactttacagatgtggggactgagacttccttaagtaactttccaaatttcacttagctaactgagcttagacacagacttgctgcatttgggctgtagaaactcctgcttggaactcctgtgaataaagtaataatgtgcacactgatgccgggagggagatgacagtacgtgtgtggctttgccccagtgtggggacttcaggaaagtttcctggagtctgtgacttctaaactgacacttgaagaggaatgaacttggggctggtaaggagtatgtcacattctgctatagcgtgaacaaggaagaggagggaaggagaaaggaaaaaaaaggatggcaatgaactagggagaacagagttgctcaagcctgaaacttgggtctctgattccttttttggtctcatttcccacatcaaatccatagacaagtcctgtctgccccacctccaaaattaaccctaaggtgactatagagactgtctaagggatcttccagctttcacttttgcccacaaccccttcattcttctcagagcagcaggatatctgattctattttgtgccccaccttctggtcacttcccactgggtaccaggccctcagtgccctggtgatctgggccccactgccctctctgacgtttcgtggtaccacatcactatcctccagccacaatggcctttctcttcctgcccagcgtccacttactatggtctttagcccatggctggcattcagtaagtactggggggtgacagagtaagagagaacaggtgagtgggaatgcatcagtgaatatgtgtgaaagagaaagttcatgaaagcagaaggaaatagaatgaaagaggaagcgaagggggtaagcaaatggaaaagagagacagaatggagtgagaaaagccacatatttccatttgactggaacctagagtgggaggtggggaggaggacagacatgacactggagtgagttttaaaaatgatttctataatgaaacacgcctaggttggggatttatttatttatttatttatttatttatttatttatttattttaaatccctgacagcagcattgaagtatgtaactgttcatagcctgcacctttttctttttttaactttccaggaacaaagtaaaagagcatccatcaatactttgcacaaaaggaaatccgtcttccttttatcacaatcaccataaatccaggtagaataagggttgtacatatctgaacttttgggaagcatgaaaggaagttattcagagctgcaggaaaggcaatgtaaatgttacactggattctgcccccaactataaagaatctttctgaagagaatattcataaagctttgggaattgttagggttatatgaaatgggcacattctaacaacatcaagtaatgattttttttttctgtctgtgagataattaataccatttagaaaaaaatccaaaatgaagtcttaaattagcttttgatattttgataaactgaatattattttttataagatagatggacaagaataaaatgtttataaatttttaaaatgctaatgttttatgattaaagaaatggaatggttactattatgtttgctcatagactcaatgaactggacagaaaagcctttaagggagaaaatagtaaatacattttatgaattatggtaaataaattttaaaagagaagacaacattctcagaatgatcaatataatgtattagaagaagttcaaataaaattatatgatgtcaatttaaagagaaaattattgaacattaaccaatatcttttaatgttctacagtcttcagtcagaatagtcaattattgtaaaccagaaaatattttttgattaatatctgaactatttttacccaacttaatatgactactttttgtagtctgtgatatgaattctatctatcattctatctatgggtagtatgaagttctttttatttaactttccagtaataacattcaacatatttaaaacacacacacagcgccacacagccaacattatggatatatgatctgtgtaattggcacagggccttgtacttcatttgatgctctgctgtcactgtattgaaattcctcatttttagataaagggactcttattttcattttgcactgggtttcaaaattctataatggtcatgcacactcacacatgttaagttacacattgtggatagcagtgtatgtctttgaggtgatttcagtttggtgggaaaaacagatgttaaatatctaatttcaaagatgaaaaatatcattaaaagagaaacatgatatattatttgaatcagaagtttaaagtagtataggcccattttcatagttaaatgaggatcaataaaggttaatttatctgtccaataaacaagcagctatgagaggatgacctgtaatttgataaaatttaaattttaccaaatgactaatgagcgtctatttacatggtcatggtttttttgctgaattcctaaataaaccataaatttaacataatgcaacgttcaaattggtaatatttaacctagaattttacagttatagtcataattgggttatgtttatttttaattttatattcaactgatactgggctagttttgtccagttatgctagtttcataaaataaattggaaattctattgttttctaaaactgtcaactgttaaacatgtgaactatttgtttctggcagacttactagagttcaacaataaaacttacttgattccgtggatgaagcccaggaataggacgagactgtcagttttgagcattacaagtgagaaaatgaagaagggtttattttgaaggctgaatcaaaatagccatgtcagactgtcagaactttgctggagatgggtatgttagcatatcagtgatggccagagccatggaaatgaatgcaattactcaacctgcatgttagaagacagaagagagaactaatgctagcaggaatcttgaggcatgagcaaccctaaaaagtagctggagaaaggggtgcccatcaacaaaacagacgaatacatagtaggcagcaaagtgggaaagtcagaagtcagtgtctcagaaggcaacggaaaatagaatttcaagatagagtaagtagccagtatttccaaatgtcacaaagaggttgaataagatagagactgaaaagtgtgtctattaaatttggcagagcagagattgtccatgatcctcatggcaacagtttgagaagagcagtgtagatgcaaataatatactagcttgcaggggttgagagaagaaagaaataaagtaagagaatataacttttacaaaatgtttggtaataataaaagggatagggtaatgatttgaaaggcatggaagtttttattttcaattattagaaacacttgagcatatttatatattaatggataaaattaggttctgcagaacggggaaagcatggaaccaagaaacccaagatactctgttgatttcttttcttattttctctccatttctccctcctctttaatttcagtcccaaaattctataattctaaacaatcagaatccactctctatctggggtctaaatttatgttccttactgaaatgttcccatcggcactcatctaattctggattgagtattggcttgtctaagaaagaagtctaatatttcccaaatcgcctttcagagagggccgctgtagcttttacatagatttgcattatccaatccctttatatgctaatgttgcattgttggcaatcagggctttcttttatatacagtcttgcatcatttaacaatatattccgagaaatgataaattaacctttgcttactctaactatttttactttataaacttttatttttttccaactttttgactcttgtcataacatttagcttaaaacacaaacacattgtacagctgttgaaaatattttctttctttatatccttattctatatgcttttttcttactttttaaacttttttgttagaaactaagacacaaacacacatattagcttaggcctacacggggtcaggatcatcatcactgtcttccatctccacatcttgtcccactggaaggtgttcagggacaataacatgcatggagctgtcatttcctatgatagcaatgccttctcctggaatacctcttgaaggagctgcccgggctgttttactgttaactttttttttaataagtagaaggagtacaatctaaaataatgataaaagtatagtaaaagcataaaccaataacataattgtttattatcaggtgttgggtgctgtacagtattgcatgtggtatacttttataggactggcagtgcagtaggtttgtttatgccagcatcaccacaaacacatgagtaattggttgtgctaagttgttacaatggctacaatgtcactaggtgacagacatttttcagctccattgtaatcttagaccactgtcctgcaggcagttctttgttatacagtgcatgactgtactagattttggagggactatgctttcaaccactgcctttatagaagattaattagaaaagaatacacctacaacaaatttcttcatgcaaactgaaaaaaatgtaaacatattttgtttaaatcactggatagattccctttatatgatccagttactatatgaagatgtcaacttgttcttatgagctcttggagagcagttactatctttttcaacctggaattctctgtagtcaacagaatatgtttcagtttacaaattctacccatgtatgacttgtggaaaagggagacatcagactgcacaagtcttgactcgctgttattacacagaaccatatctgagcgaacttgtgttcacatccaagaatgttacaaaaccaactactgattgatattgatatatctaaagttgtgacaagcttgttaaaattttaatatttaatatagatttagacttcttttcctaatatggaaggctgtctaatatggaagccttctaatatttaatatagattttagatttcttttcctaatatggaagtcttcctaatatggaaggctgtcttgttgaaatccttttatttttagattagaaattaatccaatctacctttccttcaggcaagccaggtttgatgcaagccaggtttggttcaagccaggtttgtctttgccttagactattattggactcttagtacatccattaactcatatacaatgtaaaatgattaggtttattgcaacagtaatgacatcataatctagaaatatagtgtatgtccctgagtttctggggtatcagtcatttttctatgtcaataacgtgtcaattaactggcatcctacaagcctggaactaccattaatgttttctccaaataatttaatatgttatctggcaatgacatatatatttcaatgagaaaagcacaaaaaatgaaatttttaagagacgaaaacactaagccatggagtttcatgtgccaatgatttcttcttcaaaccatggagcagtgtgtcatctatttcttgagtaacattttattaaatgtcggctgtatgctttcatttccttgtttctttttctaacaattctccactatgttttactaaaatgtttttcaattatgtctttctcatttttaatgtttttaatttaattttacattgaccgataaaattgtctgttttcaagtatatataaattgtgaaatgaataatctagttaccatatgcactacctcacatacctatcatttttgtgataagaacacttaccttcactctcagcattttttaaaaatataatatattgttattaactgtatcaccatattgtacagtagatctcttgaacttatttattctgtctaactgaaattctatatcctttgaccaacatctcctcaacttcccctacaaccactccagctcctggtaaccatggttcttctctttatttctaagagatcagcttttttagattctatgtatgaattaataagatcaggcagtatttgtccttctatgcctggcttatgtcacttaacataatgtcctccaggatcatcaattttattgtaaaccacagaattgcattctttttgtggctggatagtattccattgtgtatatacaacatattttctttattcattcatccactgatggacattttgattctacatattggccattgtgaataatgatgctataaacacaagactgcagatatctatttgaaatactgatttcatttcctttggatgtataccaagtagtgggattactgggtcatatggtagttctacttttattttgttgagaaactttcacaccattttccataatggctgtattaatttacattcctaccaacagtgttcaaatgttgcctttaattcacatcctagctaaagttattattgtatgactttttcataatgacctttctaacaggagttaggtgatgcctcattgtggttttagtttgaattgccccaatgattagtgatgttaaacgttttttttcatatatctgttgatcatttgtatgtcttctttgaggaatgtctgttcagatcctttgcccatttttaaatcaagttattcttttacttgctattgcgttgtttgcattccttatatattttggatattaacctcttaacagatctatcatttacaaatattttcttccattctgtaggtgtcttctctctctgttgttttgttgtctgtgcagaaggtttttagtttgatgtagtcctatttttcaatttttgcttttgtagcctgtgtttttggagtcatatccaaaaagtcattgaccaggtccatgtcatggagtttttctcctatgttttcttctagtagtttcatagtttcatgtcttacatttaaatctttaatccattttgagttaattttgtatataatctgagataagaatctaatttcaatcttctgcatttggatatataattttcctgaaatcatttattgaagagattgtcttttccctgttgtgtgttcttggctcctttgtcaaaaattagttggttataaatatgtggatttttgcctggggtttctattttgttccattggtatacattctgtttttatgccaataccatgatgagttttggttactatagctttgtagcatattttgaagtcagagagtgtgatgcctcttgctttgctctctttgctcaagatggcttttgctctttggtgtcctttgcagtttcatacaaattttaggatttctttttgtatttctgtaaagagtgtcattagtgacttgacagagattgtgttgtatgtgcagattgtttttagtaatgttgatattttaacaatgttaattcttccaacccgtaaggattcaatatattcccatttatttgtgtcttcctcaatttatttcatcaatgttttatagttttcagtgtaactatctttcatccccttgattaaatttaatcctgagtatttaattccttttgtagctattgtaaatgggattcttttcttgatttttttagattgtttgctgttagtgtataaaaataataatgatttttgtatgttgatttcatatcctgcaactttgctgaattcctttattagttctaatatattatatgtgtataatttctgcatataagaccgtgtcatttgcaaacagaaaatttgcctcctttctttccagtttggatcctttcatttctttcttttgcctaattgttctggctaggacctccagtcctatattaaatggacgtgacaagaataagcatccttgtcatgttctagatttagagaaaaacctttcaagttttccccactgagtataatgctagctgtggttttgccatatatggctttaatgtattgaggtacattcattttatacctatgtttttaatggatgttgcattttttcactttttctgcatctattgaaatgatcatatggttcttgcctttaattctattaatgtgatgtaccacaattattgatttatgaattttgtaccatccttgcatccctgggctgaatcctatgagatcttggtgaatgactattttaaatgtactgttgaatttggtttgctggtattttattgaggattttttgcatctatgttcatcagggatatttgcctgtagttttctctttttgtagtgtcttcatctggttttggtatcagtgtaatgctagcctcataaaatgaatttggaagtattccatcctccttgttttctagaacagtttgaaagaattggtattagttcttctttgaatgtttgatagaattcagcaatgatgccacccagtcctgggtttttatttgatgggaggcttctttattgctgattcaatctccttacctgtttttgatctgctaagattttctacttcttgataattgacaatcttggaaggaggtatgcatcatttttatccattttttctaggttattcaatttgttaatgtgtaattgttcctaatagccttgtatgatctttgtattcttgttttattggttgcagtgtctcttcttttttattttggattttatttgagtcttttttttttcttactctcttaaaggtatcaattttgtttgcctattcaaaaaaaaacctctttgtttattttttctagtctatatttcatttacttttgttctagtctttgttgttttcttccttctcctaactttgggcttagtttgttcttcttttctggttccttgagagacagtgttagggtatgtattggagatcttatgttttattgctataaacttctctcttaaaactgcttttgctttattccataggttttggtatgttgtgttttcatttacatttgtgtcaagacatttttaatatctcttttaaatttttcattgacccattggttgtccaggagcatgttgcttaatttgcatgtgtttgtgaattttccaaagctccttttgttactgatttctagttttatgccattgtagtgagaaaataaacttgatacaattttaatattttaaaatgtgttaagacttgttttctggcctaacacatcatatatcctgaagaatattctatgtgtagttcagaagaatgtgtattttgcagctgttggatggaatgttatgtatacgtttgataggtccatttgatctatagtatattggttaagtgattattcctcattaattttctatgtggatgatctctctgttgctgaaagtgggatgtccctattattattgtattgcagtctgtatctaccttaagatctactaatatttgctttatatatttaggtgctttgatattgggtgcatatgtacttacagttgttatatcttcttactgaaaatgccattatataatgatgcttttttgtctctttttactaaagaggtcatttatataatgacctgtgtaaagaagagtcattaatataatgaccttctttgtctctttctacagtattttacttaaggtttatttttatttgatagaggtatagctactcctgctctctttggattccatttccatgcgatgtctttttgcatctgtttgcttttaggtgaagtgatcttgtagacacaaaatagttgagtctttttttatgcattcagtcactccgtatctttttattggataatttaatcaacacaattattaataagtaaagacattgccattttctagttgttttgtagatcttttgttctttcttccttccttgctgtcttcttttgtggctaagtgtttttctctagcaacatgttttgaccccttgcttgtgcgtgcatgtgtgtgtgtgtttgtgtgtgtgtgtgtgtgtgtgtgtgtgtctgtttctacttacaggtttttgctttgtgattgccatgagggttacaaaaaacttattgtatttataacaggttattttaaactgattaaaataaaaaaaagaacaagaaaaccaaaaaacctctatgactttaccccatttctccctccacattttaactttttgtgttgcaatttgcatcttttcatattgcatatcccttaacaaattattttagctattatttttaatagtgttatcttttaaccttcatcctaaagatataaataatttccacaccatttttacaatattaaagtattctcaatttgtgtactttttcccatgagttttatactttcagatgtttttgtgttacatatcagcattcttttctttcagactgaaaaactatctttagcatttcttataagacagttctggtggtgatgagcaccttcagcttttgttcatctgggaaggtctttataatgcctgtatttctggacaactttgctaggtgcagtatttttggttgacaaccgtgtagcaggctttttttttcccccttgtataaatcatcccactttctactggcttttgtaaagttttagctgagaagtctgctgttagctctattgaaatttcttatatattatttgtttattttcttttgctgcttcccaaatcctctctttgtcactgatttttcatagttttgccatatatgttggggtagtcttatttgcatttaatatgattggagacctttgatcttgcgtgtctagatatttacaactatgttcaggtttggaaaatgtcctgctgctatttctttaagtaagatgtctgcctctttatttttctctttttcttcttgaagtctaatgccttgaacatttaatgttcttttgagactattccataaatgctgtaagctttatttatttacttatttatttatttattctctgatggtatattttcaaataacctaattttgagttcaaagattcttttctttacctgatcattctgctgttcatgctctcaagtgcattttttatttctttcattgtattttcagctccagaatttctgtttggtttttttattactttcatttttctaccaaatttttcattttggtcacattgttttcctcatttcattgaattgtgtttctgaattttcctaaagtactccaagcttccttaaaatagttattttgaattatttttcaggtagttaatacacctgaaaaataatttatttagcatctatttatttagcatctattactggtaccttattttgtctctttagtgatatatttcattgattgtttgtgatctttgtggttgtgtattgaagtctgtgtatttaaagtaggtactcatcttattctttatagacttttttttcttggaaagccctgtgataagcatagcactgatgtatgccagaagttggggaaattgcgactagcttgctgtttccagaagtttggggtccactgtcattggtgcagcactggggtgggctagaagactggggcagatgccactgcagtgctggagtagaccagaattccaatgcagctgtggctgacatggcactgccagaaaactggagcctgctatgacaggcacaatgctggaatgagctggaagtccagggccattgaggcctgcctgctacagagggctgtctggatcctgggtctcctgacatcagctcagtggtgtgggatagagattgaatttgccacgtaagactgaaggcttagcctgtgtggtcccactggttatgagggaaggcaggcctataagttaatttcaggggtacaagtctggaatatgggaccatggggctctcccaagtgcttgatttactgtggtgggcccagtgttggggtccaaggcagagtcctgtgctcacttccctctgtttcctctaagtgtacaatatctccctacatgctgtgctgcctgggtttgggggaggggtgatgcaaacaatccaaaactgttcttcttaccctcttcaatgcatcttttcctattattgtgccactatcaggaactatgatctctcaccttgcttccctggctcttatgaaagtatgttcctatgtgaagagttattcaaattgatgtttctgcagagggattatcactggagagttctactctgccattttgttccctatctggatacgttatgaataattataaagccatcctttaaatgggaaatcagcagaagaatgtgattgtagaggctaagaagttccacaatagaccatccgtttgcaagctggagaaccaggaaagccagtagtatggcttagtccaagtctgaaagccttacaaccagggaaactaatggtgtgtacctatcagtacaaggccacaagcttgagaaacttggggccactggtactggactctcagtcttggagtccaaagtctgatgaacctggggttctcctttccaagggcaagaaaataagtctgtcccagttacagaagagagaaagagataatttgtcttccctctgttttttgtaaccaaatagttttttttttttctgatcttccttggtaatacattgctttaatcagcataatgtaaaattttatattttctgttattttcctcatttcaaaatgatattctgaattattttcattctctgagacctttacatttttatctaaattagataaatgagatcactttgattctatctctaaactaatagaaacttttataactttcctattctaaaataaatttcatgaaactagggcttttttttttttctttttggcagagtttcactcttgttggccaggctggagtatggtggcgcgatctaggctcactgcagcctccgcctcctgggttcaagcgattctcctgcctcagcctcccgagtagctgggattacaggcatctgccaccacgctgggctgttttttgttgttgttgttgttgttgttgttgttgttttgtatttttagtagagatggagtttcaccatgttggccagggtggtctcaaactcctggcctcaggtaatccacctacctcggcctcccaaagagttgagattacaggtgtgagccactgcacttggctgaaattagggctatttatcaaacataaatatatctgtctatattaagctatttgagttttatttttaagcttttcaatacatgtagttttccctttatttgaatggtcttataacctacaatgaggtctaactgaaaaacaaaacaagaacaaaaatattgcatgttcaggtgtattgatcatttaagaataagccaatggttgagactagagatttttgcagtcattctccaataattaccagatttaaatcagtgatttagaaataaaatccaaaaccaaacaaatccccaaaacataaaacaataaaatggaagactttcaacagccacatggatcagtactaaaaggccaaaaaaaaagaaagaaaagaaaaaaatccaaggaaaactccaagggttaactctagaaaagatcaggagataccaagcagggcaatttcctgtttgatgttgttttaatcttgactaaaactactgtcttctttatgacgttaaattttttatgagtctttttaggcccttaatatcctcaataaatatttgttttcttggcctgaatttgaattaatacaacttcttcttttcttcatcctgtaacatctttattgaatatgaaactgcaaaaggaaataattgaactctatcacaaaactgttcttgcaagtacacttctttggaagttctctttcagtactttcccattgttttggtgcagctatttttttttttttttttttttttttgagacagagtcttgctctgtcgcccaggctggagtgcagtggtgcgatctcggctcaccgcaagctgcacctcctgggttcacgccattctcctgcctcagcctcctgagtagctgggactacaggcgcccgccaccacgcccagctaatttaatgcagctatttcaatatactatatcaggtaatggaattaactggaattttgattatcatgataataagtagtggttcaaacattgtgtgtttcccaaacattattgtcaagacaatgagtttctttctctgaaaaagcaccaccaaaatttttgcatagctatttgttctagcagtgtgcatctttcattactggaaataaaggacaggctgggtgcagtggatcacgcctgtaatcccagcactttgggaggctgaggtgggcggatcacaaggtcaggagtttgagaccatcctgaccaacatggtgaaactccatctctactaaaaatacaaaaaattagcctgtgtggtggcacacacctctaatcccagctactcaggaggctgaggcaggagaattgcttgaacccatgaggtggaggttgcaatgagccaagattgcaccactgcactctagcctgggcaacaaagcaagactccttcttgaaaaaagaaaagaaaagaaaagaaaaagaaataaaggccaaatggcaaagacacataatggtaatcagttttactctttactggcctataagatttcctgaacaggttttatctgtttactactgtaaaagtactatatatactgtctgaagaatcaaaggaaatctcataaggatttcttctgttgtcctgcacttcattgatcaggctcatccttctttctggaaatagtaaagttcagcttataaatgtgctcaagtctctccaatccgaaataacttttcttttaattcagcacacagttatcaagtaatcttatgtgccatacactgttctaggtactcaagatacctcagtgtccaaaagacaaaaataatatctttgaaactgagttcacctattagtgaaagagctacacaatacataataaagtatcaattatataaaatgctagatagttattaagttctatggggaaaaagtagaatcagggtggggaatttgtgtgtgaagtgtggaggaagagtgttaagattttaaataggccttagtgggaaactaacttttgagtaaagatgtgaaaaacatgagtgagtgagccatgtggatggtggatgcgaataagaagtaccttctggagagagcaaagccagcactagagccctaaggcaagtgcctgcctggaaacttcgagctgtctgctttcagttactttcctttctctttctgttcttacatactgggctcattctgcatagttttacacttactgtttctgctcctattattctccactccactgcaccctgacttctgtctaccatgtctgaaatcaccaatgaactagttgcctagttgtttttgatgttgccacttaaatagccatttaaaaattataaaacagaaacatgcaaaacataagtgtttaataaatggaattaaaattttaaaaagtaaaacttcatataatttgtgacaatcatgctgttaataccctactacataattgctctctgcacgcataaatgtttatgtgcagtatgataccacataacagtatttcggtgaacgacagaccacgtatatgacagtcatcccataagattataacactgtattttgactgtacttttttttatgtttagatacacaaatacttaccagtgtgttacaactgcttacagtatttagtacagtaaaatgttgaacaagtttgtagcctaggagcaataggatatgctttatatcctaggtgtgtagtaggctctacaatctaggtttgtgttaggacactctgtgattgcacaattacaaaattgtctaatgatgcatttgttagaacaaatagctgtcatttagtgatgtatgactgtatataaattttttcaaccctaatgagagcatattgttctgcaacgtggttgttttctgtcaatgatctccaatttatatttcaataagttctttatctaatattcaaatggttaaatttccaaaattgctcccaaaatgttacttgcattggagatctgtttctgggccatttctgtggttatagctagaaaagttatgagtttgtattcatgtttccaattgtattttaataaatagtttagttttttactttatttaaattaataactttgctcttttcactttcattgaaaagattgatttacttattaataatagattcttataaataaagttcttatgaaatatcaatactgatattacaccaaacaatataacttataagggaagtttaaattgtcttcatagtatttctgttccttgaatgcacctgatatggtttggctgtgtccccacccaaatctcatcttgaattttaattcccataatccccacatgttgtgggagggaccaggtggagacaattgaatcgtggggacagtttctctcattctgttcttgtgatagtgagttctcacaaattttatgggtttataaggggcttcccccttcactgggcattgattcttctcctttctgctgctgtgtgaagaaggatttgtttgcttccccttccaccacaattataagtgtcctgagacctctccagccatgctgaactctgactcaattaaacttctttccttcataaattaccctgtcttgggtatgtctttattagcagtgcgagaatgaactaatagaataaattggtactggtagagtggggtgctactgtaaagatacccaaaaatatggaattgacttttgaactgggtagcagtcagaggttggaacagtttggaaggctcataagaagacagaaagatgtgagaaagtttggaacttcctaaagacttgttgaatggctttgaccaaaatgatgatagtgatattgacaatgaagtccagactgaggtggtctcagatgaagatgaggaacttgttgggaactggagcaaagctgactcttgttatgctttagcaaagagactggtgacattttgtccctgccctagagatctgtggaactttgaacttgagagagaagatttagggtatccagcagaagaaatttctgagtggcaaagcattcaagaggaagcagagcaaaaaagtttggaaaatttgcctgacaatgcaacagaaaagaaaaacccattttctggggagaaatttaagacagctgcagaaatttacataagtaacagaagccaagaatgttaatcaccaagacaatggggaaaatgtctccagggcatatcagagaccttctcagcagccccttctatcacaggccttggagtctaagaggaaaaaatgctttcatgggcttaaggccccccctgttatgtgcagcctagggacttggtgccctgaatcccagctgcatcagccatggctaaaaggggccaacttataattcaggccattgcttcagagggtgcaagccccaagccttggcagcttccatgtgatgtcaagcctgcaggtacacagaagtcaagaattgaggtttgggaaccttcacctagatttcagaggatgtatggaaatacctggatgtccaggcggaagtttgctgcaggggcaaagccctcaaggagagtcctgcctttcatgtatttattagcagtatggacatatatacataggtccattctaatacatatgtaattttaacccaaatgacatactatacatattgttctgcaacacagttggttttcaatgatgtccacatttatattttaataaattctttaatatccaaatggttaaatttagaaaattgtcccctaaatgttaattgcattggaactctcatttttttttagtggattattgaattagcaactacaacctgggcaccagaaatgttaaacatttctgggccatttctgtggctatagctagaaaagttatgagtttgcattcatgtttccaattgtattttaattaatagtttagctttttaacttaatttaaactaataactatcttttttcattgaaaatattaattacttattaataacaaatacttaaaaataaagttgctataaaatatccatactgatattacaccaaatagtataacttataaggaagcttaaattgtcttcatagttatctgtgttccatgaatgtatccttttaaggacatatgtgacatcaaaatcctgtattctaaagtggcttataatccagcattctatttatggttattttgtcagcttaatatatgattagatttatttgcttatgtttgttttctatggtatttttgaaaactttagttgtatagaaagtgatatcacagaagttttgtatgttcaagttctacctgttttataccttagacccttttttatcttcttccaaaaggtaaatattttccatagaagaaaacatatatatttttgctgttgtttcatactggctgaattatatatgaatggcccataacttttaaaacaatgccctgtgtctaactacttggtttggaagtggtcttgcaaaagcactttgggtacattttaacacttaatttacttgatatctctgaggcatttagcacttgctctctctttcttggatattttccctcctgtgtttgccctgagatcactctcctgattccaattttacagacttaatctttccttctcattctttggattttcttcctctgcttgttgaccatattatttctattccacagagttttgcccttggcattatcatgtgtcattttatccacaccaatgcttttaaccacagcatcacacttattgtgtacatgttgtattctcaatctagtcatacatgatttcatgttccaaccctataatccaatggactgctctacctgagtttcttaaatatatcttaaactcaacatgcacaaaaatgtgctcatgttttctacctcattctccccaccctatatcctccctgagtatgtactttgactatatttatcacctaggctatagacctgagtataatagaattaatcactaaatcctattgataccaactgcttgctagtaactcccatttcatccatttctgctgcctttgattgagctatttctctatttctcctcaactacaaaaacctccttaacagatgtttttgagaaaattgtctgtttaaagtttttccatggcttcctgtttcctgaggtactgtacacggacactctgcttggaatacaaagttcttcataatttattctgccatcctctaatcacttacatgtcctaccagacagaacctcaattctttcatactatcaagcttcccaacgtctgcacatggtgtacttttagcctttcccactccatgcttgaggttaactcaggttttatttcctcagggatgttctgtgtaacattacttgtatggattagatctttattctctcaagtgcttcttggatatagtttagttgttttgacaattgtatccccacaatgtgggatctttgaaggcacagacttcccttttctttgtggtatcttttgagtctagcacagtacctgtcttgccttaagtgtttaaggtaagtttgttgaattaatgagtggctgcttctactgttacatgtcaaattgttatactttcacagtctccagagggcagatacatatcttatttgtggttctattctcaatttagtacagtctttggatatcatggttactcagtaagggtataatcaatatcacatttaaatgtattaattcattctgttatcattagctggcaactgggacgtagattagagtaactcactactaagaaattctagatgtagactgactcccccttttagacatattcaatttagtcataaatttaaacaacaaatccactattatgattccatcatgcatatctgatatcaacagtggtatctagcatatatggctatgttcaaaaggcagctctaagcataagaaagagttcctatcttgggatatttaatactcagaaacatcatacaatctaggtaggacaacactatcaaagtaaaacaagactttatttttaaaaatggtctccagatggatttaatgttagccaaatatgtgtgtgtttgtgtgtgtgtgtgtgtgttttgttccagagtgagaaatagatataataaaataggactgtgaggaggagcaaaatttagctaaatatgaactagcttcttgtgttaaacatttatttaaacatttccctttaaatagtatgattaaattgaaaaagattttaattattagatcagctttagattttattttcttcctattccttctcaaaaacaaacaaacaaatcattttaaattgaggatcctgctcctagaaagtatttcagaatcacttgtttttatttgcctgttcagtttgtgggaattatttgttatagcaatatttatgatgactaatggtggtttctaggcagcattataaatagaattttgtgtcttggcagttggaagtttatgttgcataaattgagtccataaaatatgttctataaactagtgtaggtgttggttttgaagtttatttatattttagaattgtgaatttaaaatattctaactgtaatacagtaatagtaggggacttcataaccccactttcaacaatggatagatcatctagactgaaaatcaataaagaagcattggacttaaactgcaccatagaccaaatggacctaactgacatttgcagaacatttcatccaacagctgcaaaatacacaatcttctcagtagtacatgaagcattcttcacagcagatcatatgttaggccacaaaataaattttaacaaacttaagaagatagagatcctatcaagaatcttttctgaccacaatggtgtaaaattagcaattaataacaagaggaaactcagaaattttataaatacatggaaattaaacaacatgcttttgaataaccacagagtaaatgaagaaattaaaagagatatttaaaaaattattgagacaaatgacaatggaaacacagcataccaaaagctatgggatacagcaaagcagttctaagaggaaattttatagcaataaatgcctacagcaaaaaataagaaagattccaaaaaaaacctaacattacacctcaagaaactagaaaaattaaacctaaaattgatcaaaggaaggaaataataaagataagtgcaataataaatgaagtagagactaaatacatacaaaagatcaacaaaacaaagagttggctttcataactcagggctaatgataagatcaataaacccttagttagactaagtttttttaaaaagaggatacttaaataaataaaatgataaatgaaagaaaaagacattgcaactgaaacaacagcaatacaaaggattgtaagagactattatgaacaattatattccaacaaatttaataacccaagagaaatagataaatccctggacacatataacttaacaaggttaaattatgaagtagaatagacttgtaatgagtaagaaaattgattcagtaattataagtctccatcagagataaacccagaacctaatggcatcactgctgaattctaccaaatattaaaagaaataataccaattcttctcaaactattccagaaaattgaagtggagggaaaacttccaaactcatttgacaaggccaccattattctgataccagaaacaaagacactacaaggaatactgcaggccaatatacctgacaaacatagaagcaaatgtcctaaacaaaatactagcaaaccaagttcaacagtacattaaaaatgtcatccaccataatcaagtggaattcatcccaggatgcaggaatgatttattggaagtaaagcaatatatgtgatacaccacattaacagaaaaaaaggacaaaaccacatgatcatcctaacggatgcagaagaagcattcaacaaaattcaacacctcttcataataaaaactctcaacaaattttgtagacatacctcaacacaataatggcaatatatgacagacccacagctaacgtcgtactcagtggagaagcttttcctctaagatcaggaaaaaaacaagaattcccacttttactgcttctattcaacatgtgctagaattccccatcagagcaatttggcaagataaagaaataaaaagcacccaaattggaaaagatgaagtccaattatctttatttgcatataacatatcatatatagggaaaacccagatagctagattagatagatagatagatagatagatagatagatagataggtagatagataaatgatagatagataaatagagtctgttagaactaatacagaaattcagtaatgttgcaggttaaaaaatcaacacatgaaaatcagtaggtttttaatacattagtactgaactatctgaaaaagaaatgaagaaaaaacaacccaatttacagtagctacaaaaataaaataaaataaaataaaatacctaaggtttttgtttgttttttgagacagagtctcagtctgttgcccaggctggactgtggtggtataattccagctcactgaagcctcaacctccctggctcaaatggtcctcctacctcagactcttgaatacatgggacttcaggcagccatcgccatgcccagttatttttttttaaagttatatatatatagaaatgaggtctcgctattctgttcaggctggtctcaaactcctgacctcaagcaatcctcctgtctcaacctcccaaagtgctgagattacaggtgtgagccactgtgcccagccccctaggaatatatttcactaaagaggtgaaagatttctacaatgcaaatttaaaaaaatgaaataaattgaggaagacacaaataaatggaaagataccctgtgtttatggattggaagagttaatattttaaaagtgcccacatcatccaaagccacccacagattcagtgtaacccctatcaaaatactgataacatttttcacagaagtaggaaaaaaaatcctaaaattcatatgaaaccacaaaagaccctaaatatccaagcaatcctgagcaaaaagaatgaagcaaatcacactatctgacttcaaaatatattacgaagatatagtaaccaaaacagcatgtactgacccacaaaaaaaacagacatatagaccaatagaacagaataaagagcccagaaataaattcatacacctacaacaaaatttttcaacaaattgccaggaacatacaatagggtaatgacagcccctcaataaatagtgttgaggaaattggatctctcaccatatccaaaaatcaactcaaaatgagttaaagacttaaatgtaagatcaagaactataaaactactaaagaaaatatagggaaaatgcttctcaacattgcactgggcaaatattttctgactaagacctcaaaagcacaggcaacaagagcaaaaaatagacaaatgggattaccttgaactaaaaatctgctgtgcaacaaaggaagtagagtgaagagacaacctatacattgggagaaaatatttgcaaactgtacatctgacaagggtaaatatccagaatatatgaggaactcaaacaactcaacagcaaaacaaaacaaaaacctgatataaaaatggggggaaagatcctaacagacatttctcaaaagaagacataaagatggccaaagggtatttggaaaataatcaacatcactgatcatcaggaaaatgaaaatacaacccaatgagatatcacgttactctgattagaatggctattatcaaaaagatgacaaagagtgttggcaaggatgtggagaaaaggaaacccttttacagtgatggtgggaacgtaaattactacagtcataatggaaagcagtatggagtttccttaaaatattaaacatagaacgattatacaatccagcaatctcactactgggtatatatccaaaagaaatgaaatcagtatgtcaaagggatatctgcacttccatgtgcattgcaacactattcacaatagccaagatacaaaatcaaactatgtgtccaacaatgagtaaataaaaaagataataaaatatatacatataatggaataccattcagccataaaaaatgaagtcgttatttgagacaacatggatggacctggatgacattatattaagtgaaataagccagacacagaaagacaaataccacatgtttttactcatctacagaatcttaaaaagttgacctcatagaggtgttgaatagaatagtgattaccagagattaacaagggtacgggagatggggcatagagagagtttgtccaatgggtacaaagttaaaattagaaaggaagaaaaagttctgggatcaatggcacggtagtatgaaggactatagtcaacaatatggtattatatatctcaaaatagccagaagggaagattttgaatgtccctaaagaactggtaactgtttgaagtatgatgtatatattaatgaccctgatttgattattgtgcaatgtatacatgtatcaaaacatcacattgtgccctacaaacatgtacaattgttatgtgttattgacagataaatattctgccagaattggatggatgatgatttgataattttcacattacacattgatgaattaatatttgcactgatttataactaatctggtcatacttccccacattgtccaatatatattaaataatttcaaaatatacaatgtcattcatattttattatatttccataatgctgatagtgtagaaatgatcacaagaagaaactgtgctctaaaatgaaccaatgaacaatatgtgtcgggatagacacacattaaacaataatataagtatctgcacaatatgtatctcaaattatcattttaaggtattatgagtattttaacacactggaaaatttacttgctaacagtttcttccattcacactggttaccttttgaatttatacttttgtactcatgctaccatccctcaaaatgtttcttggaaagctctcttaaagtaggttttagaacctccagcaggttattttttaaattcttgcacatggatcatgagtttgatttttgaaaacagtgagaaaaaaactcagaaacaaaaggaaataatggaattctgaaaaaattatgaattaattttggtagagttataaattcaaatgcctgcaagtgctgggtaggtaatgtaaagtgagtacagacagcatgctggacactgtagtagctggagagttcaggctatgtctaaaggatgctggaatgcaggatcagcatagcctggttttccagtcttgcagcctaggctgaaaatttacctattgtctggaccatctcaatgttttaaatgttggctcagttctttaaacacttgatttgcaaactctgctttacaatagtacattttcatcgtgcttatattctatgcagatttttcttaaacttttcataaatataaatgtcttcacactatttttttctcactaattcatcaatagcatatgacaaagagtgagaggcagaatggaaagatatcatatggtcttcccccatataaaatagcattttccttctactttaccctcacatatttttgccatcacattatcagcatttgacagattgtgcatttacttatttgtctttttcgctactgtaacctaagctctatgaagatttttgttgttgttgactgatttatacttagttcttagaatatttattggcaaataatagactcttaataaatattcattgaatgaatgaatattacacagataggcaactatatggaagaagtaaccagggaattatggatatttaactttgacaagaaaatacacaatcaggaatacatccgatggtatgttggagctggctcatactggcctgcaagaggtgatggtgtgcatctcttctcagctctgcatacagtgacgtcccattggttggctgaagtaagccatagtgagattaattccacctcagaaatcagcaaatgatacaaatattgtctcatttaccagcatactattggatacaagagttatgatatattggcttagtcaaaagaagcattttctaacatttagagctctctaacaacagaatggcctatctcacagtatttggtcctgcattaaagtttcacttactggaacttaacatcagctgtccccaatctttttggcaccagggactggtttcatggaagacgatttttctacagatgagggaagctgatgggtttgggataaaactgttccacctcagatcatcaggcattagttacattcttatacggaacgtgcaactagatccctcacatgcacagttcacaatagcttactgctcctatgaaaatctaatgcctcggctgatctgacaggaggcggagctcaggcggtagtgctctcctgcccgctgctcgcctcctgctgtgcggccaggttcctaacagactaggaacccatatccttccgtggcctgggggttggggacccttgctatacatcataaaacttattcaagcttgtagaatcgctgggacataagatattttgctcctttgaatatagtgtcatttttcctatggctgcttttaagatttttctaatcgtcattggtttttctaatgttttaatatggtatgtccaggtttggaattatttttatttataatttttaataatattttagtcatttactttagattcttagaacttcttgaatttgtggtttggtatcttttatcagttctagaaaatctcagttattatttctttaaatattttctctgccacattcactttgttctatttctgagatgttacactttctcattgtaccctcaaagtcccttccccttcctctatatttttccatccctttgtctactatttagtttcttctaatcttgcttctagtttattaattctttctttaactatatctaatcaaattataaatcccatagaaatttttttgcaaagttattacatttttctgttatttattttctatttggttgttttccaaatttgctatgtcaacttttatagtttatagcaccatactgaaatatttatacttgatattttatttttttctaaataatataagcatttatgtttttatagccttatacttcatttataataagcgtagtatatcaagaatagtatatatcaagcatttgtgggtatgtttctatttcctgttgtatcaacttggtttcattcctggattcttatttcctgtattcctgtttaagtgtgctggacattgtttttgagcattatttgtaagaataattggaaatctatgatgacaagcatattccttcaaagaagacttttgtttactttttccaagtaactggaaataatagtctgggaccatcttaatctcagttcaagctttaagattttctggattatccagatgacaaacgaccaggctaaaagtctggaaacattggtttatttatagttactgtttatgatggaagtacaacatttttatgtctcagtttaatgaaataaatgattaattagagtctccatttttagtggaacccaggctttgacttttcccttatagccccatgacattgcagaaagctcagctccacttcagagccttttctctgcagtgttagaatttacttattttggagttcttgtcttctcactggctctgctctgttaattctccaccttcttgttaactcatagctgcttttaagattttatttttatttcacttaatttgttgttttcctcatttaaaaggcttttctgaattctgagttctccatcactctaaattgaacagagattaatattttgagaatttgtatgtcttaaaatactcttatccttatttcactcttctacttaatggatagtttggttggttataaactactgtgctaaaataatttttcttagattttttgaaggcattctccacagttttctagattccagtattggtgttgagaagtctaactctagtcttagttccaatactttggctttatttcttcttagtgtaagctattaggattatacctttgtccttaatattttgtaaactttcatgataatgggccattctatgggtttcatttattgtgctttaatctctctaagtgtggaaatttatgtcctacaactgtggcaagctttctttgataaatttttattctccattttcttcctctcctcccctgaatcttccattagtcagataatgaggcttcctaggatgattttctaattttttatactttctcttctattacccacacttctctttttgttttaatgtgtgagaggtttctctgattttattttctaattcttctactggatttaaatttctgatgtatattttaatttccaagagctcttattctctgttcctatttttgtatatcaatctgctttgtttatttgtttgttttgttttgttttgtttttttgaaacaaggtcacattctgttgcccaggctggaatgcagttgcacaatcatggctcactacagccttgacctcctgggctcagttgatcctcccacctcagccacctgtgtagctgagactacaggcatgtgccaccatgctcaactatttttatttatttttggtagagatggggtttcgcatgttggccagttggccaggcttgtctcgaactcctggtctcaagccatctgaccaccttggcctccaaagagctaggattacaggtatgaaccaccatgcccagccaacctgcttttttttatggctgtggtattttcttttttgttgagagagagacagagagagagacagagaaagagagagaaacagagagagagagagagatatttaaatgccaattttgtgcttgtattatctccatatatttgtctttttttcctcttcctttatttttttctgtttctgtggttaaaagcagagaagattcttcctgtttcttagaagggggtagttgggataagcctagctatcaatggtgggagagaagagtctgaaggcctactcttcagcatgcagactttccttaacccccttgatttcctctgtccacaattgtccttcctgtactcttcttgctattccaaagttgagtctctcaggttctatttttcactaaatttcagactcctgtgaggcaattgggaagatgaatggaaacagtcatagcttatctttgtatggcagagttgtgagaatggaatcaacactaagctgcatagatacttgtcttcagaatcttgatttttagccacaatcctcactcccaccttctatacaacctgaaaaagagctttttgctaagagaaacccattgtcttctaattagatcacctctgaaggcacttttaaaaaatcacttcttttactaagtctgttaccactctcatctttcgaaaatttgttgacatctattctctccccttctattctcattgcctcagtggaattttataatttttatttctttaaatttggggtggtttctagacaaagcagaaataaaggtatatttcaattttctatcaagggatgtgaaggacctctttaaggagaactgcaaaccactgaccaagcaaataagagaggacacaaataaatggaaaaacattccatgctcatggataggaagaatcaatatcgtgaaaatggccatactgcccaaagtaatttatagtttaaatgctatcctgatcaagctaccattgactttcttcacagaattggaaaaaactactttaaagttcatatggaatgaaaaaagagcccatatagccaagacaatcctaagcaaaaagaacaaagctggagccatcatactacctgacttcaaactatactacaaggctatactaaccaaaacagcatggtaccggtaccaaaacagatatatagaccaatggaacagaacagaggcttcagaaataatgccacacagctacaaccatctgatctttgacaaagctgacaaaaacaagcaatggggaaaggattccctatttaataaatggtattgggaaaactggctagccataagcagaaaactgaaactggatgccttccttatactttatacaaaaattaactcaagatggattaaagacttaaagtaagacctaaaaccataaaatcccttgaagaaaatttaggcaatgccattcagaacacaggcatgggcaaagacttcatgactaaaacatcaaaagcaatggcaacaaaagccaaagttgacaaatgtgatctaattaaagtaaagagcttctgaatagcaaaagaaactatcatcagcatgaacaggcaacctagagaatgggagaaaatttttgcaatctatacacctgacaaagggctaatatccagaatctacaaggaacttaaacaaacttacaagaaaaaagcaaaaaccctttcaaaaagtgggtgaagggtatgaacagacacttctcaaaagaagacatttatatggccaacaaacataaaaaaaaggtcatcatcactggtcattagagaaatgcaagtcaaaatcacaaagagataccatctcacaccagttagaatggcaatcattaaaaaatcaggaagcaacagatgctggagaggacatgcagaaataggaacacttttacattgttgatgggagcgtaaattagttcaaccattgtggaagacagtgtgacgattcctcaaggatctagaaccagagatatcatttgaccaagcaataccattactgggtatatacccaaaggagtataaataattctactttaaagacggatgcatatgtatgtttattacagcactattcacaatagcaatgacttggaaccaacccaaatgctcatcaatgataggctggatgaagaaaatgtggcccatatacaccactgaatactatgcagccataaaaaaggataagttcatgtcctttgaaaggacatggatgaagctggaaaccatcattctcagcaagctaagacaggaacagaaaaccagataccgcatgttctcactcataagtgggagttgaacagtgagaagacatggacacagagaggggaacatcacacaccagggcctagtggagggatagcattaggagaaatatctaatgtatatgatgggttgatgggtgcagcaaaccaccatggcaccataggtattgttgtatacctatgtaacaaacctgcacgttctgcacatgcatcccagaacttagagtatatatatatatatataaaaatcctattgaccttaaaaaaaatcagatgaaattagctctttaaatgttttgtcctagctcccatccattgtcatgttttctgtggccacgtttaggcttgttctcagatctgtatttccaatctaaatcccatttctattctattattattactactacaaaaatagtaataaaaacaaacatttaaataatatctaataaataccaactattcttctaagaacttgacatgtataaactcatttaagcttcaactctgtgaaatagggtatcagttatgtattgccaaaataacgctatatagcaaactaccccaaaacataaaactgtaaaaacataattacaacaatagacctttttatcctttctcacaagccactgtttttgctgatctgggccaagttcaaaagacattgacttggcccactcacctgtggacagtcagctgccttgttggatgggtgctgggagtataagatggcctcagttaggactgcttggctgttctctagaagttctctcattttcacaatgctagcctggacttatttccattgccataggagggttctaacagagagaaagagagcggaagcaggcaatgcttcttaaagcctaggtttggaatgcacactgttacttcccacgtatggtattggacagagcaagtgaaaacacctagtgccaagagtatgcatccaggaaggggtaaagaacaggactagttttgccatttattaaggtattattattaatccttattttagaagaaactgatatatagaggagttaagcaacttgctcaaggtcgtggactaatgaaacaatggcactagtatttaaatactgtcagtctggtttcattctgtgctgttaacttctacatggtgctgtcaacttctacatggtgctgtctctcagctgaaggaacgatagaggaggaaaggcaaaaggcaacaatgggctttgaagtaactctactgagataattaaaagaccacataaaagaaggaaaacgtatcttacttcaggaattcaacactaagaatcctactcccttcgtgaaatcagaaaaggtttgcatgaaccctgtgggcctttgaaagagagaaggcatactgttgatggtcaccaacttactgaagcctgcagcttgcaggaacccatctcatcagagtaactgaaagagaacacagtatccaaaaacaaaaacaacaaaagtcacgtgctgggataagttcttgatagtgtgaatagtcagaaaaaaatgttctgaaacttcttgtcccagctgcgttattaactgtgaatttcatcatatggttgattaagttgctttataagactaaatttttataagatgtgtacataggaatatgacttccctctcctaagttaacataacaggtattcccaaatgtgttgtgaagtcgacattcttgttctaatttatagttgtattgctccctgcaatagcatcttctttcatttcccagtctccagtttttccattttgtttacagtagccagagaaatctatcaagatgcacacttgatcacagcatccttcggtaaatcaccattatcttcatactgacaaaggtcagtctttaaggacctttatcaggtgtcctctctttagttccccaacctatttcttaccatcctttatcccccagctaaataacttggagaattccaagtgcgtcatccactgtattagtctgttctcacatcgctaacaaagacatacctgagactggggaatttataaaggaaagaggtttaatggactcacagttccgcagggctagggaggcttcacaatcatggcagaagacaaagcaagagcaaagggaagtcttacatggcagcaggcaagagagcttgtgcagggggaactcctgtttataaaaccatcagatcttgggagatgtgttcaatacgatgagaacagtgtgggggaaaccacccccatgatgccattatctccacttgtctctgtccttgacacatgggaattattataattctaggtgagatttgggtggggacacagagccaaacaatatcatccaccttcatgtctctttctctttactcacctgctttcttgacaagaaatatcttcatcagcccttccttccttccctccctccctcctttctttctttcttgcttgcttgcttttccttcctttttcttctttatttcctttgccaatttgagagattggcaaggagagtaatgctggaattggagacacatataactaataccagccaaaataattgtgagcagaagtgatatgccttctgagccaaggcagagaaaagattatatgtgattctcagacctcttctcatcctcattggctaagaagggcataggtcccagatggaacagctatacgttaatggggccttcctccatttggatccctaagtaactgaaatggagcccctctccaacctgtgataaaattgtgctacaaaggagaactcaattttcttgtgctaaaatactgagatttggaaattaatgtgtgctgcattataacctaggttattataaagatattattgaaaattacttttaatattcatttttgtcattattggtgaatttgaagtttcatataattattgaacacttatatgtcatttatatatttattatacttagttctttggcaaaatgctgtttatgtcctttgcctatttttctactagactgtttatgttgatttataaaacatatttatatattaggctacagtaaccctttcatgtcattggtactgtttccaatttattaactgccttttattatcactttatgatgtattttatgtccaaaggtttaaaaattatatactgagtaatcgataattatttaaaaattttgttcttattttatgagaaaggccttctaaaatctgataggttggtttttctctggatatactattttctattttttaaaacatgaaattctatactccattatgatttatgttgttgcatgctatctggtcggaatatagctttgtaatgaatacattcgtcttaaaactgacttggctttttctcctaaattaaaaagacaactctgatgatctgcttttgagttatttcttaagctaccttctcatgatgttaaatatccattcagaggattcaggacaccttggccacttggctccccccggaggtctgtccactccagagttgcagagctcaccaaaggtgtacaggcaggaagcagggacctttgtggaagtcaaaaggggaaatgcctgactcggcaatgcaagcaggttgtgagtagaacaggaaacagttctcttcctcagtacctctttagtcagcaatttatttattcactgagtcattcagacttttctgtggtagtaaaataaactgaaaatcgagaagaattttgccaggcgaatgagaaacacccttgattttttttgcagttgtataagtgaaacaataagtaatttacagtcattgagacttccactatgcttagagaaaaacacacatagatattaaaaacttacctcactatatttttccttacatggtgtgttctaaaatttatattaggatataatacttggttctctcaccaagtacatgtagatgttcctcctttaacacaaacgtctaatgagaatcacaagatctataaaagcctataaaactgagattctacaaatctcactcagaaatgtgtaattagaagtatgtctgagttatagtggtgaggtatgggtttgtgtgtgcatgctttcaccagaaagggggagagagagagagagagagagagagaggagagaggaggtagagtgaaaagaaaagagagttataaatagagatgatagagagagactgagagacagaaagagagaggacatagaggaggaatcagagagagactgagagaaaaacctagagacagacagagataggcagcaagacaaagagtcagagacacacacacacacacacacacacacagacacacacacacacacacacaaagaaacagagagggcagagagagagagagagaaagaggggagagagagagagagacgttgagagagagagtgacacaggtatacacacaggggcccaaccagatgcagcctggtcagaggtaggtttacttaccaagtcaatagtcttctgctttaaaagcaggtcttcctcattcattaaatggaccatcccaccatcttaccttagcctgactcaccttacaaataatttttgatggcactgggctgtgatagttctggaaagaaggaagatggatgttcttagtaccgccaatacagagagctgataatagcaaccacattaccagtttggtttttttttgcatttgtagaaaacaaatgcaaaaacaggtcctatgatgctagctcaaagcactaatctttattttgatttcccaggaagttgcaagtgaaactctacatggaattggtctgttggtttaatattagagagaagtaaaaatgatgggctttaactctatccgttattgttttgtgaatttccttgtgttttaatatctagaggaaggtgacaaaaaacacacacgcaaaaacgatattttgtgcattaaatacaagttttccaaatattgacagagttatatttctaaacttagtgcacaaaccatttttaaacatcttgttctatttttccaattttatctttttgaagattattaattatctactatgtttcaggtatagccctaagcagtggggataaatcagtgaacaaatcagcaaatatttgtgcctttatggggcttctattctggtatggggagatagacaatgaaacttaataaatgattaagttgcatggtatttaagaaggttacaagtactatgaagaaaaataaagcaacataaggtggctagggaataaccagagggttaaaggttgcagtgaggattctggagttaactgaaagtagagtcataagaatttgttaacagattgggtgtaggatgtagaacagcaagtgcaaaggccctgagataaaaaaaaatttcctcatttatttcaataacaccaggaaatccattgtggctgaagaagaaagatcaaggggaagagaattagcagaggagatcagaagggtaatggtggggccagaaaagtaggactttgtcggcaattgtaagaatttgagggggtaggtatttatggcactggtttaagcagaagagtgacacgatattacactttaaactgatcactctggttgcgttgctgagaacaagctggagtgtgtaaatggtgaaagcaggaaaaccagtctggaaaatggtgtgataatccaggtaatagaagttagtgcttattccagggtagtaacagtgaggatattaggaagaggccagatcctatgattatttgaaggtagggtaaccagaatttgttattagattggatgtagggtgtgaagaacaagggggagtcaaggattagtccaaggttttatatgtcagcacctgagtgatgataattttattaacggagatgagaaaggggagcggcatttgggagagaagaaaatgtttgtttggatatgttcatccaacgtgtaggtgtcattttagaccttcaggtatatggatgtggcattcagaggagaattgtgagctacagatagaaatttgaaggttgtctgtgactgggtgatgttgaaaactatgagtcaggataaaatgaccaatgcagtgaaagtaattagaggagaagctaaaggaccgagctgtggcgcacttgggcattaaaaggtctaggagaagaggaagggcttacaccggaaactgaatagaaataaccagtaggagaggaagaaaataaggagcttgtcttgaaagccaagtaatgagccattttaaatgtttctaggtaatcaaataaggtgaaagctaagaacctgccagtggtttagcaatatggaggtcactgaagactttgatctagccatggttcagcagagtgacaggagtaggagaaagggaggatatgaaggtacaaggagcagagaaatgaatgtgtttcatttaaaaaattagtttcagctgggcaaggtggctcacgcctgtgatcctagcactttgggaggccaaggagggcggatcaccagaggtcaggagttcgagatgagcctggccaacatggtgaaaccccatctctactaaaaatacaaaattagctgggcctggtggcgtgcacctgtaatcccagctactcgggagcccgaggcaagagaatcacttgaacctgggagatggaggttgcagtgagccaagttcgtgtcattgcactacagcctgggcaaaaacagtgaaactccacctcaaaaaaaaaaaagaaagaaagaaagaaagaaagaaagaaaaaagtgtttcatatggtagaagtaacagtacacttgtatgctgatggaaatgataacatatagagatggggaaattgatgttgcaggagaaagaagagagatttggggagctggttccttgaataggttaaccgtaacctaaggcaacatagtgaataattgaggagttgcccttgggtaagaatgcaggcagtttatctataacaaaggaaaacagagtgaaggtagttactaggtgcaaatataatgatgagagcttgttagagtgtcttctgttgcttcagtttatttatatatatttttttgaacaaagtagaaagcagagccattgggtgagagtgacaatagaagaggtgttgagcatgaggagggagaaagacatttatgaaaatagtcatccagagaatggattagataatcagcacatgcaagtaatgtagaggtggggctgcatgacgggtgtccttctgaccattgttgctcagggtagttcagtacttccaggctggtcaaaaattagtagagttctgctcttagtctctctcctcttctgcctctgcttcccaaggagttcagccagaacctctgtctctttccctgcctaaactgagctgcttgcactcctgtgatttatataccatccttgtctccagttgttcacactttgtaacttactgttattagttattatattaaaaattaatgctgtccatggaggttatgattggctaagcttggatatataactagatttaaaagaaggaactgttatctctgaatcaagtttgtggattggaattatggaaacatgattataagttaatgtaaccattttaaaataagcaatagatagcatctggccataaagaccttttattctggatatttaatgaatgggcaagaaggatatatacttttgtgaatgtgtaggaaatgtcttctttacatatttctgttctttggtgaacaggaaagaaagtgagggctagaggagcccccagaaagtggagcattttcccatttttacttatatcaacttagcagaaaataaatgccttatggctgtagcggaatagtcagtaccagatgagcgaagctaaatgcaagaatttgcagtgccaagctccaccgaatccctaaacagccactgaccgatcttgattccaagttcaacgtattagtgtgagttgaatgagtgtttcattaatactctaaaatctaagtcaaattgaacaaagatcatgaatagctaagaattactcttgtaagtataatgaggagtagaacgggtaagagaagtcaggaaaaaataaagaaactgtggactcaaagtcagaagtcctgagttttaaacatggttttgccattgactagaaaccttaaacaaatcctgtaaccagtaaagccctgaacttcttatttgaaaatgcaggcttgagttagatgtcttctaaagactcttttagcactaaaaagtaattctatgaagttaatctttattaaattgtcttatctattaaaatataatgataaaatatcttgatgtttatcttaatgtatttagttttttagtttttaaagaaaataggtctttagtttttgataattaatatgttttgtttttgttaataaaattaacactttaaaaaaatacagaaatctaaacaataagaaagtgaaggaagaaagcacatccagtcctatgtctccctagtaatgtttgatgtttgtaaggctaccatataacagttgctattgtgaatgaaatatctttgttttattttaactagttgtttccttattatagaaaagctacctttaaaaatactaatttctcaactgattgtctttgctgaactctctaagttacttttagtcaatattcttgttttctttatgtagcaaactattttgtctacaaataaaatttaacaaattttgagtctttatcatataatgcctccttttgattgtttatacttaatattcttagaaaacatttttcagtgattcctttggctagctttcctagaagaatattattagtaatggtgagagagaaaatttctggctgttagtttaagctttttttttctttaaaaaatatgctaaaggtctttattaagaagttttaaaaaaagttgaataggcatttgatgactttttagaacatatggtgactacagattcttttcctcagtctatttgtgggagaaattatattaacaaatcttttagcattaaaccatttttatgttctgcaatgaacatcagttggtcattaatagaatttcagtacagcaatggattacaaatattaacatcttattactaatttttgctgttaaatttatgttgaaatgggtctggggttttattatttgtaggttgttttggttgagttttgcttcggggttacatgaattttgtataaaatcatgtgaagccttccttcttcctctgagctcatagaagtaaactcttccctgaaatctgaaagaattcttctacaacattttgttgttctataatagctctgtcagttttcttttattattgatttattttggtccacttatatttttccacaaaaaaatgtctttcaaacagatttttaaacttatatgaacagggttgaatactttacacagagttaataactttcctgggaacttgaaaaatggagaattatctgtatatgatagcttatattattgtacagctttataattaccttgacactacagtttctccttaaaattttatcctctttcctgaaataaatctatttgcaaagaatacgcctaatctatgtttcacatgctgtgctttctgccatatttttaaaacattttttttttttgcttgtactcatctttgaataaagactgtacaagacagcttttgttcctaaaataacatggatagatcattcatggtttctcctgtttacctggctgccattttaattcatccttcaaatttaaatataaattcagtcatgctgcacctgggcaggtaggaaaagagctatggccatgcaaagctttatttctgcattttttctctatatatttgctaggaaagaatgcaccaaatttcagttctagtgtgttgtgtgagatctagtgtgtgtgggttggtggagggagctaggaggagaagaggggagtgggttgtgtgtggcctgcgttgaaggtactaaggagtatgcctttgattttggattattcaggtatgttaactagatagattataagtcaggttggttaaaagccctggggcctgtgggctttcagcgtgctgaagctacattttttctcccatttcttgagtaataacttttacatctgtgaaaattgctcaatcttgcttcaaaagtctctagattctgaggatccctttcccactgccatgttggagaaaatagttacttttaagaaaagtggaatcaatgaagaaacaaacaataacaatatacggaggagtggttgttcatttttctgagtttgattagcttggggcagcgacagtctatggcagagacccatttcccccaaagctgtctgtgcttccagccagttctccaattacttactgttagtgagaagtgtcagaatttgctctaattacttccctgaaaactgcacattttcaggaagggaagttgcatatcaatcttcgatgtttttcttcacgctgattcaaatttactgtatctagcagagattcctgccagaaagttgtgatacacggtaagtgtcccttatctgaaatgcttgggacctcagtgttacagagttcaggttttcttctggattttgaaatatttgaatatacataatgagatatattggggatgggacctgagtctaaacacaaaattcattgatgtttcatatacaccccatgaccctcgtctgaaggtaattttatacattattcttaataattttgtacatgaaacaaattcgtgtacattaagtcatcagcaagcaaaggtgtcactatctcagccactcatgtggacaatctgtggttgtttggtataactgtcatgatgtgctcagaaaagatacattgcagcagaagcaggtggggggggggtcttttttctcttggggatgcttggtaaactgtgtgctgtgtgtctgtgctttgactgtgacccatcacatgaggtcaggtgtgaaattttccactcgtggtgtcatgtcactgctcaaaattttcagattttggagcattatggattttgaatttttggattagggatgctcaatctgtgtatcattggcagtatttattggtttaagaattgatgaacattttgtttctcatttgtatttatttttagttatctctctcagtttctcagaggaatcctttataagaaattctcacaagaagtaacctatttttttcttttatataaaaacaagtgagtaaaacatctatagggcgcttgattatttgaaccctgagacagttaacatttcaagtagcagttctcaaaatatgttctacagaagtcggttccaaatcgtgttaacagcatttataggagcaaaagtttccatggtcaaaaaaatgttaataacagaagtgaaacaatattaaacatgattctttactgaaggacgtttttttcagatagggagcttggttgttaatttttgttgttgttgttttttaacctttattttaggtttggagttacatatgaagatttgttacataggtaaacaggtgtcacgtgggtttgtttgacatattatttcatcatccaggtattcagcccaggacccagtagttgtcttttctgctcctctccctcctcccaccctccaccctcaaatagaccccagtgtctgttgcttcttactgaaagacttttcagcaccatgaatatgcaaaagaacactgtgaacttacaagacagacataatatgcagtatttcctagaacttatttaatttagtgcccttattttttctataaattatcagaaaggaaaaataaattagtataacaaacaccaaaaactactggtataacagcatcatttcgcaattataggtgaagcagttaagaagaaataaaaagtcttctaaatgttagccttgcaaatttaattataaaagtaatccctccctcccttttcctgtatctgtgcagcaaatatttggcccatgcttaattcatgatcccataaatgtgtgaaaggaaattgtaatacgagggaaatgatatgttcacctgctactttataaggatattgtgagaattgaatgaaaaatgcacgtaaagtgctataaaaatcccatcactttacaatgaaacctatagaccaacacttttaaaacatgctcttttaacataggatgtgtggtgagtcattgtgagaatatgttgcaaattactaatatttctaagtttgtgatattatatggtttttaaaaatacaaaatgtaacgtgttctaggttatgtttattatgatgtcattgtcactgatttctgacatattctctcaagtgggaggaaagggaaaaagttttaagtactctgttggaaattgacctgggaatggaatgtctctggtgttgctatttagcatatgctgtgatttgaacgtgtcccccaaagttcacttgttagaaacaatcccgatgcaatggtgttgagaggtgggacctttaaggtaaaactaggccatgagggatctgccttcctgtgtggcttaacaccattattgcaggtgagtattcctgatcaaaggatgtggttggcctcctttcctctctctcacctgagtgctcttttgctctcctgccgtaggatgatgcagcaagagggctctcaccaggtgccagcctcttgatcttggatttctcaacctccagaactttaagaaaatatatttctgtttattacaaattattcagtcttagatattctgttatagaagcacagaatgaactaagacagcatatgagctgtagcccataaaggttctgaattaaagcagcagaaccctccaccttgaagcagcaaacattcacaattttgataaatcaagagcaaccccctaattgcccaatgtggtgactggtaatattgctgacacatggctttgagtcacatgtgttgtgaggctgcaaagtaggatgtgtcacttggcttttggcagataatatgatttaggagaaagtctgaagtttataccagttgtcctgatgaaggcactcatttggctactatatttttctgtgaatagaatatgaacatttgtagaagacaatttttgtttgcataagttcatgttaacagaaaccattaggccacatgttccacagaagggtttttttttttttaggggctaaagaattttttatattggaaaagttataaggtagctgaaacgtaggcctgtgaggatgaaatcagacaatactgaaaaatagatgtgaacacacatatgcacacatctactgcggagatgccaatctcagtatttaaaggcataaaggcacactgacttttctacttagctgtgttttagcaaactttgtgattaagggcagacttgctctacactttgactaacctaagtgcatctagccagaaaaagaagggcattgtgcctacgtattagcagcccattacattaaactgtgacatggcacaacccctttggacagatttcattagggcatactctcttgcagacatcagaaatacaaagccaagtagaactttgtatgctaattctccattgtatgctaattctccattgtcccttatttattttgattggcagatattcttttatatacactaaaaatatcaaaatgttgacagaatcttgttgtttcacactttctctttggaaaacatgttgcaacaaagcaccttttacctacgtctaccaagtgctattgcattgacagtttgactagctatttgggagtgagccctgccaatggctgcttcaggatttagcacattttgtttgaaaaacatttggtcatgatagtcagaatctcaggaagacccacagattctatttagcacacagtgtatctgataggactactgcattaatggaaatgaaaagctaattgctgttaatatgtaatgtacatgggatttacagtttgtagaatgtttttctcatactaactctcaatgttgttgtggtagaaataacttggagttatatgcttggatgcaggtatcccaactgaatctttggcattaggctggctgaggtcttgttggaatctggggattcagccagagtcgggttgagaacactgaccttactgtcaaaactaccccattggagggtatgaccggaaggagttgtgactggagtaactggaatactgaatccctctcattcctaactctggaggtgtgcacaccaagtgataccaccctacaagtgagggcacaaaaagtgtgattcacagcatggttggaaaggtggccaggctgtcagtctttcctagagagctaaaccttgatagcaggaccctcatcctatggtactgactcaaaaagaaaaggactgacctacatatggtctctggactcaggcacacgacccagagttcagaaaagccttcaaatcctagcgggaaacaaagtgttaggcaaagggacagggcagactatggagtggaagtcagcatttcaggagaaaatcaggtcctgtgcttacaggatcaatcaccagggcttggccatggcaaagcacttcctggcatcattgtgtaagtactcagtcctatgtagtaatggtagagggctatagacaatgacaagacctgatccagttaaagggcagaggctgcacattaggattcccccaggagattttagggttaagaagtgtatcactgaaatacttcattctgcttgctactctgcagaagaattgatagaagaattaggtaaaacaaaaagttgttgagacacatttgttgtaataatggaaatgttattatgtagtatcttcattgttcttgatgccctgtttgtttgttgtttgttatactttggaatatatgttatactttgtactgtttgtgagtcctaggatgttttctcaatttccattttactttctagaatttaattttaaaattttgcactatttaaaaacatacaatttgtttctaaggaatttgccttctctgcttgtttttgccaggttgtttccaaacacattaactactattgtgacaataaacacgagtcagagttgaataaaaagaattctttttatcatcatcatcatcatcaatcactgtcatcactataccatgatgtctatcatattaaaaataagaaggctttcgtagtctacaggaagtaatttcaatgtagatcatagctttatattttatttaaaagttcttggtattactaatatgaaaattatattttattcaaccaccagagggagctctcaaatatatggattctaaaagggaaggagtaaagtaattaagtaggcagctttgtatgttttatagttgaaaatcaaagatttcatcagctgtgtgtcatggtttttgtgggatcacatgttgtgtcttcgtacatcaagtgcttaaaatcttgtcctactatagatgccacatcattttaattaacagctatgaaataataatcttgtttttatgtttttttttaagtttgagtaattgttttattttaactttatattttaattttggacaatattgattgatgccatgctttgcaaatataattatgctttcagacctcctctcttaggtcccagtttttcttaagttgtgtttttatattgtccaatttataaaacttatattcttttttataaccgtaaattcaatgctgagacatctccttttcatatttctttgttttgatgtattgcttaacttgctaaattttattgtcaaatagtttatttgagaagggtctttgggttctagaatccttgatatctttcatgtttgagaatgactacttgttgctttacacatgtatgacaatagagtgggtataatattgtgaggtcatattttctttctctcatctatgatttaatattccccctaggaaaatcaagtcttccaattttttttcactaatattatgtgggtgtggaaggggaaggaaggaaattatccaactgtttcctgcaggcagagcaagtccttacagagcaggctgccctcagtgatgatgagttttggatctcccagaacatcccacctcttaaatgtgtagcgtcttgtaagtatccttcccaatcaagtttattcatagcttactgagttctgtctctccttctctgttaaatggctttattgagatataattcataaataaaaaaactgcacgtttgatatgtgcagtttgatgtgtttggatctatgtatacattggcaatactatcaccacaatcaagataataaacatatccatcatctccaaaagtttccctgtgtctcctcaactccatacttttttgtgttaaaagcacttagcaggacgatctggggaggagcagtccctgggatcactgtgtttatctgttgtctctgtaccccactttaaagtgtccgaaagttttctcacacagtaatgtaatcaaccccattttgtggctgtggaaattgtcaggcacaaaggttaagcaaattagccaaggccatgaagcagatgagtgagacacctgggagtggatccaggactcacaactgctcagttgatatattgccttccattgcttcacaaggctgcgagctgtcctgcttcttcccaacacacttgactgaagtcaggtatttaagtttctatatctaagctgaagtcaacagtatttccataagtaggatcttgtcacaacagaaaaaatgaattataagcaatgaatagaggtgaaatatattcattcagagtcagtgtgaatacattccatctttcttcacttcctttaacctctcattttctccaggctgcttacaaatgtattcaatgtgttaacaaaaaaatttaataaagacattgccagaatatcagcattgggaacaaagaaaaatactttctatttggtgttagcataactgtgcattttaactaggtgtatatctctctgtgtataattaacatgctatttgtaaataaagtcaaatattaaatatatgaagtcaccattttgatttatgtttttctacaaagcacaaccactctctaacaaatatgtatctgacagattgatcaattatggtctctaccaggtcaaatgagctcacttcccttcaaaccttacaagcctaagcaataatgtggtctcccagacacaaagaggaaacagcaagcttctctactccatcgtgattgtttcctgggcaagcgtgtttcccagctgcaatcatagatgccccaaaatgatgccagtgtcagaccctgccgtgctgtagctcccttcaggggacatctcaactgctattttcccttcccctagtcctccactgaacctgccacaccttctaagaaaacgagggttggctctgtgctgaactgcaggggccccacacacactgtaacctgcaggaacatagaacataggcatttgactgctggctcctcagcttaccacaaggggcagacactgactgaatagaggtccaagaaataaattcctaaggaaaagcagggagatacaaaaatgcaaaatataaatgaataaaataaattttaaaacatgtattctggtgccgcctttaatagtacatttcgtgagatggaatttatttcacttatttacaaataaacgactcttcattattgctgaagatgtatgaatgtaagatttaaagctagagtgatttaaaatttttctgcagaaaacaacttctggatagtgttctcttttttacattttgcatttcaaattcaataattctatgaatatgtttcattcaaatgtcccagctttgttataatcccccaaatgaataatgcatttcttagaaagtatcttttccaaaggagaaagcactatgaacattcattttaacttcctttaccagtcagtgatttttatccttcactatacattttaaaagacctgacaaaggttcataaaacattgttattctttatcagtggagctacatgcaaaattcaaaattctcaaatctgtgggaaagattatgaagaaatattactactgcttatcaatctgcacagacttgcctatgttatcctaacattgtttttagcatggtgaagacaaggataaaccatgaagcctacctgctgggatctgaaattttgcttcaccacttcctatcttgagcatgttactcaatttttctatacctcagttttctcatgtctaaaatggagataataatattgcctctgttgttatgaagaccaaatgagttactaatataaattatgcccactaattaaaaaaatagaacagtgcctgatggttttatttttaaataaaataaaacacgtattttttacagcatcactatgctccaggtcaatatttccatattagtgatcaggtctcttttccttacctatccagaattcttgtgttagagttccatttgacagtgagaggcattaggaagctatctgggtcgattttctcatctacaaaatggtgatgatgatctatcttgtcttggaggtctaatgtgaaatggagtgaggttgcataaatgaagtgcttagcaaaggatcttactggtagaaggcactcaataaatgctcactgataaatagaagtaactatgtgcaaagtcatcatagaagctcaagtttcaagaaggtaaaatgactaacatggaaacaaaacaattgtttattgaaagggtcagattgttttatccttttattatcagattgaaattagatattttcaattcatactttctaaagggactattcagagagaatttctgaaaaatttcatccctccagggttttatagacatttcttgacttaaatacaataaaaataacaataaatttctacttactgggaaagccttgtagaaatactgttaaggtttacttagcagtaaacaaaagagattgagctacttttgtgtttcttgcttatttgtgttactcagtggtgaagaatagccacttatcatttcctttgtgagaatgattaaggaaaatgaaaaacatttgtctaagcacagtcaattgctaatagcaggtaaagtcatgtggtatggagtaggcaccatctcaattttaacaaactagtttttagtatcagatgactggcaatgagcctgaaaatcctcccctcgtacattatagcatattcagttaatgcctttgcaaatacttattgctgctgcataaaaactttagatacccataggcaaatccagataattgaaaattgccttagttctggtaaaaaataagtgtgatatcagaaccgagggcttggtggatggcggaacaggttggacttaggaatgtaagttcttgggaacacattaagtccactgagttacggcaaagtatctgggaaatcccctgaagcgggcacttggtaggaaatgagcaggctctgatgaaagctgcagccaatgagcaagaaatgcatggagaacaggaagctgagaagtactggccaggaagggctaatctcagggcagtccctctagcaccagatagaaaccattctgtcatataattttgagtttatggaaagcaccttaatacccaggaaggctggtaaggacaagacagaacaaagacctgctgggaaagatatagccttactggggcatgattcagttactaaaattgagttacgagacaatagtgtaaaattgaaggttaagacataacacaagaacagtatttaaaatttatctacttaaggaaaagataggttttaaaatctaggttaaggctggacctgcaggtgacagccttactgtgaagcataattaaagctaccgtcaccaatatcttaccacaaataaatgtgtgagtttcatagaatggtttcctttaatgtccttcagaaaggcagatggtatagaaaaccaaagtgtagttcagtaaaagtcaaaatagacccattcagaaggtattccatggatctctgagatctgcttttatgctaaggagtttttgctttgtgctggtagtgcaagactacagcctgggccacacatctccttttatgaagagcaaaagttagattcataagtatacatgaatatggaagactggggattgggaataaaatagttttcactacctaaaccaggtagtgaatgatggaggcaaagtagacttgtagtcttcagggggcagacaacttggattgcttttctctttgttgaatgtattattctgggtgccaccagtagaattggaaggctgctgaaattctttctagtatagacagttcaaattaagcacagagttgacagcataaaggatgacataggtgggccctggtggcaccacgccttctctcaggtgtgggcagctatgcgtatagtaaaagcctcatcctgtgaaggcttgtttgttttgcaagagaagacaacacagaagaaatggaagagaggcaaaggctggtacctgaattattatgcagggttctgataccctcactgtttccttcaaaacaactggatctctgatctgatcattttaaaaccacattaaaatacaaaattatttaaatgctgacatcaaaattgtcctttcattactaattgcatggtggaaaaaaatagaatagtgtttttcaagagaaaacgttaccactgaaaatccctatacccagccaaattattggtcttgtgctttggcaacagaaagttcttttatcacatgacgattctcagaaaatacactggccacattcacttttgaaaaaaatatttcaccaaacaagagattaaaatagatatcacaaaaatgaggaagttatagtatacagctggtaagcattgaaactatttgaacgttgttgtatttaatcaacagctataaaaattcatgtaaatataaaaacaattataaacaaaaagatacattgtatacattaatattaaattgaacctaataatccagaatattgtttattaaaactaacaagtgggtttggcttggtggcttgggtagaggaagtaaagcatgcttcatttctcatctatgataggaggaagtcaatagttaatacttctgtactgatgtagacaattttaaatgtatatattacagtatacattttaaatattaaatttttaagtaatcagtagaaacataaaacagggtagcttctaaactgctatagaaattaagcaaacaaaatatccatatagggaaaaacaaaggaaacagaaagaaaccacaaaataaaccgtgcatgaaatacagtgatgttaatatgattaaatatttcagatacaaccataaatttaaaaagattaaactcactattaaatcacaaagattaaaatgtggcaactccagtgtatctaaatatgcactcactatacacaagagttactccaaaacaaaaataacaaaaaagtaaacaataaaaggatggacaaaggtatattcagcaaacaagaactaaataaaggagtgagactattaatattcattaaaacgtaattccaaaacaaaaccagcaaagggaagaaagataaaagttactatctacactgaagatataatagactcaaactccaacgagcaaataacatggttttgacatatacagaacagaaactgctagagaagaaggaaaaaaagtaaaacaatgcaatcatttcaggacatgttatcaccactttcaatttttgacaggtgattggacataaaataagtaagcatacataatataatagatttaattattagaatgacaattgacatttctttctttaaaaatgtttcatccttttcatttttcttaaaatgtttatcaaattgatgatactctaatgaaacggaaaaagttcccttgtccccttctcagggtgtgcgacagagggactggctcgcttcttcagtgccccactgctcagacctctaggggagtgtacagacgggcggggagtgtacagacgggcaggctgtggggctccgacctcacggcagtgtgtgagggtgaatgtttataactcctcaagccccagtgggcgtgtgttacagggtgctcttttagttttgccgtctataggcttgtgttaaccagctcagttagaccttctacctcgtcgcaaggacagagggctttctatatgctgggttcttgccttggtgtgctggaagaatcgcatcacacctgggcttggagaataagtgtaaggttttagtgagtggaagtagctctcagcagatgggggagccagagggagatggttttcccctggaggcctctctgcgggctgggctctcctttgactataccagccaaactccgcatagttccccctgttgatggcctgcccgcctgccggtgtctgtcgtgtgctcttctgctggtgtgggcccctccaacgtctagccgcctgtgtcttcttctgctgatgtgttccttacgacccccgccgcttgtgtgtctgcccagtggggtctcgggttatatttataggcccaggatggggtgtggcgggccagggtgatcttggaaaattcaacattgggcgtgaaggcaggagcgcctgtcctcacctaggtctgtgggcacaggtccgagggtgaagccctagctagagaccacgccctcctctagccagcacttcccttctcccgctctgcatcatttaaatgcaccaccctcttcccttcccagcactcctctatcagtagaccatacaagaaatcccaataaattccccaatttgggaaatgtacaggtcatattttagaataacgcttgaataaaactcaaaatcaaacaataatactcacaacttcttagaaattaaaagttatcctctaaggaactcttgaatcaaagatgaatttaaaattaaaattgcagggttgctatttctggcaataatgcagaatacatgtctggaaaagcctcactacaatgcagatttgtatgtgggtaaagtaaaaccattttttttttaatgtgttgactataacgtaaggggatccttgtgagttaaaaaaaagagagttagcaaactgattgggaaatagaactgaaatctataactacccagcagaatagtttcagaaaaacaggaagctttcccagaagaccaggccttggacctaggcaaagagagagaggttgaaaataaagctcttgaagaaagttgaaaattaaaagggctaaaatattaataaaagagtagatggaaaaaagccaagcaaaacaaaaacaaccaaagaaaaacttcttaggaagaaaggtagaatacaaaaatacttatttgttttggttactactttcagtgggcaaacaataaaaaggttctgggagtgtgtaaccacattggtttggtgttcaaatttacactatttctgtggattagggaaacacaagctgagaaatgaacttaagttccttcaaaagcaaacaaaattatagcatgcatagcaaaagacaagtaaacaaacagaaagaaagaacaaaataaacatcatgaaataagatgctgagttatgttagaaggaaagtgtaaatcttctggaaagggatgtaaccttatccaggcctggtggacattccaccaaaaggttatactggatataaattcacaatcaaaattaaaacacatacacaaaattagccacactgaatgagaacaactgcaacagaaaatatgaaaaataaggatatgcaataaaaatattttataaagaaaccaaaaagaacttgtaatgaaaaatataattgaacatatatctaataggacttttagaaaaaaataattgagacaaggaaagagaggatctatttaaacagataaagactaagatttttcctaatcaatcaaaggcatgaatctctgtattaaagaagcataaatgactcttttttaactcttaagttcagaggtacaactacaagtttgttacataggtaaacttgtgttatggggatttgttgtacaggttatttcatgactcagatgttaagcctagtacccattagttatttttcctgatactctcccttctcctaccctcatttctctgaaaagccccagtgtgtgttgctgtctgctatgtgtacatgtgttctcatcatttagttcccacttataagtgagaacatgcagtatttgattttctgttcctgtgttagtttgctaaggataatggcccctagttccatccatagacaaaacctaaataagtcttaagtagatataacaaagatgaaatccataccgaaattcatccttgttttctaacagatcaccaaaggtagagagatctctaaaaagccacagaaaaatgatcctacacatgtataaaattgacagcaaatttcttaacaatagaagccagaagacagtagaggaatctttccaagtgttgagagaaataatctggcatttttgtattttttcaagaatgatggtgaaaaacattagagcaagtaaaaactgaatttatctctaatagacactcactaaagcatcttgaaaaggatgtacttcaaaaggaaagaatattatcctaggaagactatgaatgcaatatcaaatggagaaaaaaaacctcacatgctaaagaatataaaatataaccagtataaataaacatatagaacatatattgaacatataaaacaataatgtctaattttgtgttaaataagtcagatataaaatgctgcacaacagtatcatgaaagatgagttggagttgatcagagttaaagtgttgtaaggtctcttttgttgtttgaaagagtaggaaaagaaaatactaacttcattttcatattaaaattttcaggaaaaccattagaaaaatagaaatagggtgcataaattatgaaagaagagagaaaagaaataaaagaagagaaattaaccttagacaaaggtataaaaggaaataaaatatgctataaaagcaggacaaacagcaaacacaaaataaaatggtagaaagattccaaatatatcagtaatcacaataaatataaatggatgattctcaccactgaaaaaagatttacagattatgttaaaaattatcaactatatgcaagttaaacccaataacttaaggttccaaaaaagatgacaaaaggaaaaagtacccagaagagattaaccaaaagatattaatattgacatattaatatcaataaattacatttaagtcaaaaaatagaaataaagagaactactacttaaatattaaatgctgaataaatcaagttaccctatatttttggccagttccctgtatacaactggcagttaatatgctttgcttattttctcttgtgttgtttgtccttcttttataaattgttgaaattcatttttctattctagatattaaccatttatagttaaatgcattgcaaatgttttctcccagtatgtgtttgtcttttcaaacatttgtattgtgtttggggattggttcagttttcttttcaactaagcttgactgcagtgctcagatccttactgaaaggaaatggtatccaaataagtcatgaaatgcaggacatattattggcaaacttatcatatacagttgatggtggtgaagtgttcagtgaagcaagtatgtgcagcacttgatgcttgctgtgcttacctcttatgactgcaataattactaaaaacactgtgacatgagatggttgctcctcagtgcaaagaagcacttttagaaagaaaatatctcacatccttaaactttcaggtgatgggactctcagacaggtcccataggtaaaaacagataaatcctatggaaaatctaaatttatctcttgtttcttgatgtgctatgataatatctctgaaaaaaaaaacagaaactaaagttaattgtatggattgcagagggtgagtttgcaccttcattaagtggctcatgtgaagttagggcattgattgagaaggagtggaaccctgagacttggaatagagatatttgggaagacttggatgatattgagcattgcattggatcattctgaattttctttgctagtggaagcagcccttcttcctgtgtttagcatcttatgattagtgtcaattttcagcatgccccaggaggttatttagaaagtgagttggaaggaagtagcttgtattccaaaatgaattgcaaaatgcatacaaatggataaggccaaatatattgacacaggtacatctaacagagagtctgaatttcatgtgctagtttggcaggtggaagaggctctaacattttaccagaggggttgagtgaaacttagactcagtggtaactcaatgatgttgagacacaagaacttccttcatgtaatatagaggaatgaatccaaaggtttagagaagtaggcaaactgaaatggctttatcacatgcaactagtttttcccacagtttgctttttcctgaaggggcccaaagggcactcccttcattaagttattgagaaatttcattagttaggggaatgtccatcttcttgaaaaatggggatgccctctataggccaggtataatttgggagatgccatcattgagttgggctttcggtaaagataatgcaccatttaactgccagaggctaggtgggcacattaagtataatgtgcactggggttgaagtttttacccatagaggtctctgtgggattgacctctatcaggggtcagtcacatgtgcctaaaacaaagtaaatgttcaacccagtaaagcattatttgatatacataataagaaaactttcaggttaaaggccaaacccatgatttgagtcaccacaatgaagaaccacatcctttcccctaattctagacttaagtcagtttacagaactcaagcctcttgattgaaggagagttttgctctactgccataggaatctgccatttctcttcctctgacctcatcaaaagtgacctgaggacaattattagggtgattgtgcactggagaaaatggcatatccaaacttttagggaccaacacaagttttgggttactcacaataccaatgtgcaattataatagttaagaaatggaggcgtgtaccaagtatgaatcacccagtgtccagtaagtccatggaccctctctgtgtgggtcactatatcctaaatgtataattaaaatggacctacttggcactggcattggcagtattctcagactggctctctaagccagggagtgagggttattagtacaaaaaggataaatgaaagttgccagaactttccctccctgctagctctcacaggtagaatactgaacccaaaacaacactgtactcttttggaaattgcagaaataattgtagcccatgaaagacctcaaaaaagaagggcagtgatgctgttcacatcctcattgatatcttcctgttggcccatataaaatgtgatggttctttgaaaaggactgcattattttaaaccacatcaggtgataatcacaattgcgctccttttccaaatgcagatttttttctaagcttttccttagaaattctgatcagccacgattttgaagaatctgttttggatggagtggacttaatatatgatgggagtggatctaagaagttcaaagcttggactgaagtggacaatttgggtattctgcaaagacctccttaatattttttatttactatttttatgtgccatggctctagtgtgcttttgccctaaaagctagcatttgtaacacttatttttgtgtaatagccttcaggttactgatgcctactttgcttgagtggacatccagaagtggctgggaatgtgtactttgtgggtgcatccatttatcactgattgacacatactgaggtaggacagttctagcttccttgccatgactctcagctaacactccacagttccctgcaggatcaagtggaagttatcttttgcaggcctgagattctaccctttcttagctttgaccccttcccttccttccttttccccactcctttactggttttacccgggaacaattccttaataaattacttgcatatgaatatgaatccttgatcagcatctgcttttgggggaaagagcctaagacataagcaatggcctgttagaaaatatgacggaaatttattttattcataataaattgcagcaaaaatgtaaaatacttgtgaataataatagaaagtaatctataaaatattaatgagcaacattaaaagaaaggttgaaaatggacaagctatgtacttatgtagaatgattaactatcacgtaaatattttctcctaaatatacatttatatttttttaatttttaatttttatatgcacataataggtttatatctttatggagtatatgagatgttttggtacaggtgataattgtatcatggaaacttgaatatccatccactcagtcatttattctttgtcctataaacaatccaattatacttttttagttattttaaaatgtgcaattaaattattattgactatagccccactgttgtgctatcaattcgtaggtcttattcactctttctattttttttgtatcccttaaccatctctacctcttcccacccattgctccactacctttcccagcctctggtaaccattcttttactctggatctccatgagtacaattgttttgataattagatctcacaagtaagtgagaacatgcgatgtttgtctttctgtgcctggattgttttacttaatataatcacctccagttccattcatgttgttgcaaaaaaaaaaaaaaaaaaacggatctcattattttttatggatgaatagttctccattgtgtatatgtaccacattttctttatccattcatctgttgatggacacttaggttgcttccaaatattggcaactatgaatactgctgtaacaaacatgggagtgcagatatcaccttgatatactgacttcctttcttttgggtttatactcagcagtgggattgctgttgtaagctctatttttagttttttgagacacctccaaattgttatccccagtggttgtactaatttacctctccaccaacaatgtacaagggttcctttttccccacttccttgccagcatctgtaattgcctgtcttttggataaaagccattttaactggggtgagatgatatctcattgtagttttgattttcatttctttgatgatcaatgatgttgagaagcttttcatatgcctgtttgtcatttatatgtcttctttcaagaaatatctattcaaatcttttgcccattttttgattggattattagatgtttttcctatagagttgtttgagttcctttatacattgtggttattaatcccttgtccgatgggtagtttgcgaacattttttttccctttccgtaggttgtcttttcactttcttggctgttttctttgctgtgcagaagctttttaatttgttgtgatgccatttgtccatttttgctttggctgcctttgcttgtggggtattattctagaaatttttgcccagatcatgtcctggagaatatcccccaatgttttcttgtagtagcttcatagtttgagttctcacatttaagtctttaatccatttttatttgacttttgtataaatcaaaatgatgatgagagattggggtctactttcattcttctgcacatggatattcagttttctcatcgctgtttattgaagaggctatcttttccccagtgtttgttcttggcacttttgttgaaaatgagctcactgtagttgtccagatttatttctgggttctctatcctgctccattgatctatgtgtctgtttttatgccatattgtgctgttttgattactatatctctgttgtataatttgaagtaaggtaatatgattcctccacttttgctctttttgcttaagatagctttgcttattctgagtcttttgtgatttcatgtaaattttagaattttttctatttctgtgaagaatgccattattattttgacatggtttgtcttgaatctgtagattgctttgggtagtgtggacattttaataatactgattcttccaatccattaacatggaatatcttttcattttttagtgtcctcttcaattattttcatagtgtttcatagttttcattgtagagatatttcacttctttgtttaagttaatttctaggtatttaattttatttgtggctactgtaaattgaattactttttaaatttctttttcagattgttcactgttggcatatagaaatgctactgatttttgtatgttgcttttttattccacaatttttactgaattcataagttctaatagttgtttggtggagtgtttaggaaaaactttaagtctccatcaaatttatatttttcaaatataaggttatatcatctgcaaacaaggataatttgacttctttctttccaatttggatgtccttgattttttttctcttgtctgattgctctagctaggacttccaatatattgaataacagtggtgacagtgggcctccttatcttcttccagatcttagaggaaagacttatagttttccccagtcagtaggattctagctgtaggtccatcatatatgacttttattatgttgaggtatgttacttctatatccagtttttaccatgaagaggtgttgaactgtatcaaatgcttttggggcatcaattgaaatgaacatatggtttttgtccttcattctgttgatatgatgtatcacattgattaatttgcatatgttaaaccagccttgaatccccgggcttaatcccacttggctatgatgaatgatctttttaatgtattgtttaattcagttcgctagtatttttttgaggatttttcatcaatattcatcagagatattggcttatagttcccttttttttttggttttggcatcagggtaacactgtcctcatagaatgagtttggaagtatttcctactctttttttttggaaaagtttaagtagaattgatattagttattctttaaatatttgatagaaatcagcaatgaaaacatcaggtcacagttttttcttttttcgtttgtttgttttttttttttttgatgggagaatttttattaccgctttgatttttttacttgttgttggtctgtttaggttttggatttcttcatggttcagtcttgatatgttgtatgtttctaggaatttatccatttcttctagattttctaatttattgacacatggtggctcatagtagccactaatgatcatttaaattcctggggtattagttgtaatatttccttttttatctctgagttaacttatttgaatcttctctctttctttcttagtctggctaaaggtttatcttttcaaaaaaccaaatttttgtttcattgattttttgtattgctttcttcattataaatttgtttatttctgctctgatccttattatttcttctcttgaggaaattctgtgtttgatttgctcttgcttttctagttctttaagatgcatattagattatttacttgacatttttcttcttttttatgtaggcaattatgctataaatttcccaattactattgcttttgctatattccatcggtttgggtatgttgtgtttccattatcatttatttcaagaaattgttcgattttcttcttaacttcttcattgattcactggtcattcagtagcatattgtctaatttccatgcatctgtatacttttcaaaatacctttagctgtagacttttggttttattcccttgtggtcagagatgatgcttaatattatttcagctttttcaaaagttttaagacttgctttgtgacctaacatatggtctatccttagtattacagaaggacccatgtgttgagaagaaaattgtgtattctgcagcctttggaagaagtgttctgtaaatatcaattagttccatgtgttctatagtgcagattaaatctgatatttctttgttgattttctgtctgagagatctgttcaatgatcaaagtggggatggtaagtctccagctattattgtattgagtctagctctctctttagttccaataatattttctttatatgtctgggtgctccagtgttgggtgcatatgtatttacaattgttacatcctcttacttaattgacccttttattattatatagtgaccttctttgtctcttcttatgtttttgtcttgaaatctattttgtctgatgtaagtacagctactcctactcctttttggtttccatcggcataaaatatttttttcgtccctttatttttagtctatgtgcatctttatagctgaagtgtgtttcttgtaggcaacagatcattgggtcctattttttcgttcattcagccactgtgttttttgataggagagcttagtccatttacattaaatgttattgttgataaatagggacttactcctgccatcttaatttttattttctggtagttttgcagtcttctctttcttcttttcttccttacttcttctcttccttcttttcttccttacttcttctcttccttcttccttactgtcttccttttagtgaaggtgatttttctctggtggtatgctttaatttcttgcttttcattttttgtgtatccattgtatgttttttgatttgaggttaccatgaggattgcagatactattttataacccattattttaaactgatgacaggtgaatgctgattgtatttaccaaccaaaaaatgcaaaaggaaaataaataaaaactctacacttctttttaattttttgttgtttctctttatatcttattgtactgtcaatgacttgaaaagttgtagttattactgtgatttgttcatcctttagtctttttacctaacacaagtgtagtttacacattactattacagtatgatagtgttctgtggttttctatatgctcaccattatcagtaagttttgtaccttcagatgatttcttcttgctcattagcatatttttctttctgattgaagaactccctttagcatttcttgtaggacatatctggtattgatgaaatccctcagcttttgtttgtctgggaaggtctttatttctccttcatgcttgaagaatattttgaatggatatactattctagggtaaaaggttttcatctttagcactttaaatgtgtccttccactctttcctggcctgtaaggtttccactaaaaagtctgctcccaaagttattggagcagacttcaggatcctttctttatccttgatctttgggagtctgattattacatcccttggtgtagtcttcttttggttaaatctgcttactattctataatcttcttgcacttagatattggtatctttctctaggtttgggatattctctgttattatccctttgagtcaatattctacccctgtctttctccacctcctctttaaggccaatagcttttagatttgccccactgaggccattttgtagatctggtaggtgtgcttcacactatcttttattctatttttttttgtctccctgactgcgtattttcaagtagcctgtcttcaagtttactaattattctgtttggttaattctactattaagtgactctgaagcattatgcagtatgtcaattgcacttttcaactctagaatttctacttgattctttttaattatttcaatttctttgttaaatttatctgatagaattttgaattccttctctgtgttatcttgaatttctttgagtttcctcaaaagagctattctgaattctctgtgtgaaacatcatatgtctctgtttctccaagattagcacctggtgccttacttagttcagttgttggagtaatgtgttcctggatgttgttgatgcttgtagatgtttctcagtgtctgtgtattgcagttagatatttattgtagtcttcacagcccgggcttctttctgcctgtctttcttgggaaggttttacaggtaactaaacggacttgggctccgaggctgataacactgtgtaacactgtggtttttgcataattgtagagataccaccttggtagtcttggataatatatggaagactcctccggaatactagacagtgacttttttttttttttttttttttttttttgagatgaagtctcgctgtgtcacccaggctggagtgcagtggcatgatcttggctcactgcaagctccacctcccaggttcacaccattctcctgcctaagcctcctaagtagctgggactacaggcatccaccaccacgcccagctaatttttttttttgtatttttagtaaaaatggggtttcaccatggtagccaagatggtcttgatctcctgaccttgtgatccacccacctcggcctcccaaagtgctgggattacaggcgtgagccacagcgcctggccaactttttttgttttgttttgtttttaagttccaggatacatgtgcagaacatgcagtttgttacataggtatacatgtgccatggtggtttgctgcacctattgaccagtcccctaagttccctctcctcaccttcccaccctctaaaaggccctggtgtgtgttgttccccttctgtgtccatgtgttctcattgttcaactcccacttatgttcaaaccaaaacatgtggtgtttggttttctgtttctgtgttagtttgctgaggatgataacttccagatttatccatgtccctgcaaaggacatgatttcattctttttatggctgtatagtattccgtggtgtatatataccacattttctttattcagtctatcattgatgggaatttgagtttgttccatgactttgctattgtaaatagtgctacaataaacatatgtgtccatgtgactttatagtagaatgatttatattcctttgggtatatacccagtcatgggattactgggtcaaatggtatttctggttttagatccttgaggaatcaccatactgtctttcacaatggttgaactgatttacattcccaccagcagtgtaaaaatgttcctatttctccacagcctcaccagcatctactgtttcttgacttttgaataattgccattctgactggaatgaggtggtgtctcattgtggttttgatttgcatttctctaatgatcagtgatgttgagctttttttcatatgtttgttggctgcaaaaatgtcttctcttcggaagcgtccatttatttcctttgctcactttttgataaggttgtttgttttttcttgtaaatttgtttaatttccttatgaattcaagatattagacctttgtcagatgggtcaattgcaaaaaatttatcccattccgcaggttgcctgttcactctgatgatagtgttttttgctgtgcagaagctctttagtttaattatatcccatttgtcaatattcgctctggttgcaattgcttttggcattttcgtcatgaagtctttgcccatgcctatgtcctgtatggtattgcctacgttttcttctagggattttatggtttggggtttacattaagcctttaatccatcttgagtgaattttcatataaagtgtaaggaaagggtccagtttatgttttctgcatatggctagccagttttctcagcatcatttattgaatagaagattctttccccattgcttgtttttgccaggtttgttgaaaatcagatgactgtagatgtgtggtgttatttctgagttctctgttccattccattggtctatttgtctgtttttgtaccagtaccatactgttttggttactgtggccttgtagtatagtttgaaaacaggtggtgtgatgcctccagctttgttctttttgtttaggtttgtcttggctatacagggtcttctttgattctatatgaaatttaaagtagtttttaataatgctgtgaagaatgtcaatggtagtttgatgggaataacattgaatctacaaattagtttgtgcagtatggccattttcacaatattgattcttcctatccatgagcatggaatgtttttccatttgtttgtgtcctctctgatttacttgagcagtggtttgtagttctccttgaagaagtccttcacatccttgtaagttgtattcctaggtattttatcctctttttagcaaatatgaatgggagttcattcatgatttggctctctgcttgtctattgttgatgtaaaggaatgcttgtgatttttgcacattgattttgtatcctgagaacttgctgaagttgcttatcagcttaaggagttttggggcttagatgatgggttttctaaatatagaattatgttgtctacaaacagagacaatttgacttcctctcttcctatttgaataccatttatttctttctcttgcctgattgccctggccagaacttccaatactctgttgaataggagtggtgagagagggcatccttgtcttgtaccagttttcaaatggaatgcttccagcttttgcctattcaatatgatattggctatgggtttgtcataaatagaacttattatttcaagatatgtcccatcaatacctagtttcttgagagtttttaacatgaagggatgttgaattttatcaaaggccttttctgcatctattcagataatcatgtggtttttgtctttggttctgtttatgtgatgaattgtatgattgatttgcatatggtaaaccaaacttgcatcccaaggatgaagccaacttgatcacgatggatgagttttttgatgtgctgctggattcagtttgccagtattttattgtggatttttgcacaggtgttcaacagggatattggcctgaagtttttgttgttgttgttgttgttgttgttgttgttgtgtctctgacaggtttcgataccaggataatgctggctttataaaatgagttagggaggagtccctctttttgaattgtttggaatagttttagaaaaaaatgctaccagctcctctttgtatctctggtagaatttggctgtgaatctctctggtccttggctttttttggttggtaggctactaattactacctcaatttcagaatttgttattggtctattcagggattcaacttcttcctggcttagtcttgagagggtgtatgtgttcaggaatttatcaatttcttctatattttctagtttatttccatagaagtattttttagtattctctgatgatagtttgtatttctgtggggtcagtggtgatatcccctttatcattttttattgtgtctcttcttctctttttcttctttattagtctaggtggtgatttatctttttaaaaaattttttcaaaaaaaaaaaaaaaaaaacccagctcctggattcattgagtttttggaggattttctgtgtctctttctccttcaatcctgctctgatcttagttatttcttgtcttctgctagcttttggattagtttgctcttgcctctctagctcttttaattgtgatgttagggtgttgatttgagatttttttagctttctgaggtgggcatttagtgctatacatttccctctttactttgcttttgctgtgtcccagatattctgagtcattgtctccttgttcttattgatgtcaaagaacttcttgatttctgccttaatttcattatttacccaggagtcattcaggagcagattgttcaatttccatgtaattgtgtggttttgagtgagtttcttaatcctgagttctagtttgattgcattgtggtctgagcgactgtttgttatgatttcagttctttttcatttactgaggagtattttacttccaattatgtagtcaattgtagaataaatgccatcttgccctgagaagaatgtatactctgttgatttggggcagagatttctgtagatgtctcttaggtccacttgatgcagagctgagttccagtcctaaatatcctgttaattttctgtcttgctgatctatctaatattgacattggggtattaaattttcccattattattgtgtgggagtccaagtctctttgtaggtctctaagaccttgttttatgaatctgagcactcctgaattgggtacatataaatttagactagttagctctttgttttgaatctttgttggcttaaagtctgttttgtcacagactaggattgcaacccctgctttttttttttttttttttttgctttccatttgcttggtaaattttcctccatccctttattttgagcctatgtgtgtctttacatgtgagataggtctcctgaatacagcacacaaattggtcttaacgctttgtccaatttaccagtgtgtatcttttagcccatttacatttatgtgtgaatttgaacgtgtcatcataatgctatctggttattttccacattagttgacacagtttcttcataacattattggcctttatattttgatgtgttcttgcactggtttgtagcagtttttcctttccatatttagtgtttccatcactaaattgcaaggagctcttgcaaggcaggtctggtggtgatgaagtccctcagcgtttgcttgtctagaaaggatgttttttgtctttcacttatgaaacttagtttggctggatataaaattctgggttgaaaatgtttttctttaagaatgtttaatatttgcccccaatctcttctgacttgtagagtttctgctgagaggtccgctattagtctgaggggctttgctttgtaggtgacctggcctttccaggcagagactgtttttcttttcccttcctttctcccaactaagtggagtctctcacctgtgctgagccacccagagttgggagtgtgatgatgcaagcacccatgtgtccaccaacacttggactgcactgggtggaacctgaattcagcatagctctatgtcttgctcaaggccctgccctttaatatggtaagttccccaggccccaggcacatccagggatgttttctgggggccaaagattggagtcaaaaaccttagcagtttaccttatattctattctactccatctaagctggcactcacaccacaatacagaattctttctgctctttcttctcctttccataagaaaagaagcctcttcctgtggccaccaccaccactgacccacaggggttttgtcaggccactgctgatgttcgcttggctcttctgtcagcttgcagtgaatgctgccatgactgggactcacccttcagggtagatgcctcccttctgtcccaggatatgtccaaaaatgctgtgcaagagccttagcatggacttggggaccctaaaagccttgttgttgttttacttcattgtggctgagctgcagagaatacgttttgtcactcctgaagtcagcggcacatctcagatctcaagggccacagcatactccctgggtatcactgctggttattcagggcccaagagctctttagacagcaggtgatgaatcttgccaggattgggtccttctcttaaaggcaatggattcatttttggccaagggtgtatctagatatattgtccaggaggaagggcctgtaatggggacattatgactctttctggtggcctatcctactgtggctaaattggtaccaagatgcaagacaaagtcctctttactctttgctctcttctccttaagaagaaggaaggcatcacttttgttgctgtgaattgcagtgccttggattgggggatggatgatgtaagcactcccttagtcatgccagtcgatatctctgaggtcacgtgctaccttatttctctgactccaagtgcagcctagcactaagagttgcctccaagttgcagtttttgtgtcctagactgcctttcaagtttacataggaccccagagcacttcagcccacagtggtcaggcttgctgagaaacttggaactttattctctgctgtgacagggtagcactaagttcaatgtaaagaccccagtcattgcactcggccttctgaaagtgcaaagaatctctcactgtgctgcccagccactgctaggaatgggggacgggtgatgttggtggttcaagactgtctctgtggctcttctcaatgtctcttttggcaatatgaagttaaaaccaggtactgtaatcgctcacctgattttttgttcttgtgaaggtgcttcttctgtgtgcagatagttgttaaaatctggtgttctagtggggaggatcattgtcataggtttccatttcaccatcttgctccacccctctcaaatttatataaaaatttaaaagtcatttcaaaatgattctaaaacaatgtggaagaaataacaggcaataattattattcaccatactgagattatcatatcaagaattttattgaaattattatattaactttacttctaaaaaattgtaatttttaaaaactatacttatggttaaagacattatttacaaagcaaaaagtaaaataagttcagagaaaatttctcatcaaaaaatattaagagaaggatatcctgtaattaagtataataataatggcaaacatttatatagcatgttacatatacacaattatagtatacacacatattgatatgtaagtgattatgtgaatgtgaatgtactactagcaacttctctgaaaattatgtacagagttagagaggaataaatttaagtatagataagttactcattcaaagtcttacaggtcaaaattggtagagttgggacttaaacacaggtattttggactcagtctttgtttttagccactttgcaatggatacatatatgctaatagcatatattaccaaaacaataaaaaattagagctcatcactaacaggtaaatttgtcatatggaagaggtatatctctaccaaaagaaatatttccaaattgttttgagcaatgtcacttatagaaaatttgtatatctgttcaaaatgattaccctgaggaatggcactcacatgaatgtaggaacagaactcaattagatgtataattcttgggtttattaaaaccatctatctcaaaaatcgtgtgttgttgacagttatctttgtatgttcaattgccattactgcagagtcagtcctcaatatgtactttaaaaattgaaatgagagttattctttgctcttcttcattttcctttttatcttcaaacatgtgtagcagtattgaacagagatttattaattttttaaaacttagggccaatataaggttacaggtgtcttactgaaaaatttctcctctagtttcacccagatacagaagcatagccaccataaaatattttttattcctggtattatattacatgattcattgtcactatgggtatttcagtttcctacagaattaccacggacatttaacctgcacctaacattcagtctgccatgtgctgaaatgaaatgggtgttgatatgaagaccaggttagactcagctataaaattttagcaccttttttgataacctcttcaattacattttctcaaaaggcaacactgaagaaaagcatgttcttatataaaacatatatcatgattctattcctataatatttttcttttaaaaatattttgataccagagattacttacattttaatcattagaatttcacttaatatcccttttatcctaaatattaaaacaagtaaatcattattaaccaaataatgaagacaatagcaattttagttatgttaaataaaaattatacttattagcacatatattttcccttacgtgtatgctgttatagtcatataagtttatcgtgatcaaatgtttttcagtatctatattttttccataaaacttatgaaaaataaatcaagttaatagttaataatccaattttttcagaggttgattctgttataatatgcaagtaggaagaccagggactaacatcttttatgtgttctcttaatctgatcatcttaatcttaaagccagattcactgaaaagcgagaagaaatagagttaaatacaacaaaaataaatgatcatcttaatcttaaagccagattcactgaaaagcgagaagaaatagagttaaatacaacaaaaataaatgtttttcatttggtatggagggagaattaccaatgagtgtgatgattatgtatctctactgatgaaaaatgatccagtggtgaggagtgaacattctggcaggaagcagaaagcagacacataactcacaaaccagactgtgagagagaagcccctgaataaaaataagcttggacattataagtagatggcagagtgtggtggcagaggctgccgccactgtaggaagggcaatggcatcagggctctgagcacatttcatctgcagatactaacaagccccataaaatgtgaatgaatgttttgctgtagaaaagtgatggaattatttccaggaagaataatggagaggcatttttaaataggaaaatatagcttaactttctcctcatgcatacttaataaaatgtggacttagcttggcattcagtatgaataaacttagagaactcatctaatctaatctgtgtgcatatggacagcattaggcatgtaaggtaactgaggcccagagaagctaagtggctttccaaggtcctgaagtttagtcgtggcaaagtttagactaatgacaacacttttgagatatcagattatgtacacctgtttgcatttggatactaatgttccatctccaccctttgatacaaattagaaatgtctcaattaggagatatatttataatcttcactgtactttcatgttccttaattcaactccaaacatttattgcatgcctaatatgtgtaaccagtatgttaggaaatatagagttaaaagaaacactgtccctgcactgaaaagagttcataaattagtaagagaatgtaatatagaagtacagtccttggttgcttaacaacagggatatgttctgagaaacattgttaggtaatctcattgtcgagtgaacatagagtgtacttacacaaacctagatggtatagcccactacacacctaggttatatggtccagcctattgcccctaggctacaaatctgtacagcatgttattgtactgaatactccaggcaactgtaacacaataataagtatgtatgtatctaaacatatctaaacatagaaaagatacagtaaaaatacagtattataatctgtcctatatgaggcctattgttgactgaaatgtcattatggggcatataactacacatccagtctactaatagtgtgtctccagacctgcctgatcatgagacttacttatgataaatcaaaaatactgatttatgtgtctctgtcttggagattcagattcttaggtctggggtagaggcttttaacattatttaataaaaattccagttgattcttatgatcaagcagtttggggaactattgccatagttcccagatttgtctgtacattggaataccgaaaaaactttaaaaattacaaatgcttctgtcccacccaccccaatcctagagattataatcctacatttgattctaagatacaaacaagtttggagactactactttactatgctgtggagatctggtactcaaggaaggtgtcataaagtaaataccatccagtatgttcttaagctaatatatactgaaaacatacaatgttagaagcatttttcacatattatgtcttttaatcttcaaaataaaaaagctaatatgtattgaaaacctacaatattagaaatatttttcatatattatgtcttttaatcttcaaaataaatctatcaggttaacatgattattacctgtattttataggttagaaagtttgtttagaaacctcattcaagctcacagagtttgaaagtgactaagcaggtacataaaactaaatttgtctgaagtcagagctttagcctgtgtcattgtgccagactgactttcagatgcagcttgaaggatggagaggcttgcaactgacagaaatggtgatggaagacattccaaggagagacatcaatgtcagcaagggaggaagtgtgctaagccaagttgggaagcttggctccagataacggaggacttgacttcattgactgcatggctaattatcagatgattgattgatttactcatttattaattcagtatattactgttttataatgacaaatattatatatttaaattttttgaagaataatcactatttgattggatatcataggttaaatacttacctggactttagaagttaaatgtgtttcaatttttcattggttgtttctatgtaatgtaatgttataaagaagacattaaggcccatgccataaatgcagtcagggtgctgaaaagtgctgaataatcactttggctgggactttaaatgaccagagataattggtttaaaaaaatacagggatcatgttggttcttcctagccagtgagactttagaggtgtttagactaaacaaattgtgttaacatttattccaaaataaaatgcttccaataggcaacgactttccatccagagccctcattcttcaggacaatttgagttattctggttatcaaagagaaaatgtcagttatctaaaaatagctaatctctcttttcacagaaagtggttatcataagacctgcagacaaaagcagccactgtaaaatagtgaatattttgagaggtagtggaagtatgtcttaaaagctctgaatcttgactatttgagtgagaagagtttcttgggcacagaatcattttctctgttgattattaagttgccttcatttatattagtcgtgtgcataggggacctgtattttatcaatatcaacaagccctaaaatgatacaacaaagtgactctataagattacttttccaattatttgtttctgtataaaggaatgaaatgtccatggtgtgataattttaatgttcagtatcatattctttaaaatctagaaatttgtatgtgcattcaattgttgtttattcatctaacatatgtctttaagtatctgcaatgttccaggcagtgtgctatgtgatggggacacagagcaagcaaaagagaacatttcctattctcatcgatcttacaatctagagggaaaaactatcaaatgatcatacaagcatataactaatacacgttaaatgtcatctgttaaattacataatacagacaatagtatactcattaaagaattcccaatttagtaggagaaatatattgcaattgaacagttttttattgacacaaaaatgacaaatagatttacagttcagattagagagtccaaatttaaattcatatctatgtggggaacttcatttgtaatgagagtagaattaaaatctactaggaaaatgttgctttatttactgaatgttcttgatatgttttgttaaaattttataaaaataacagaaaaccacttatgtatatatacatatattaatatacgtatatgtgatatatgtatatattacacatatcatatacatatatgtacacacatatattaatatattacacatattatatgcatatatgtgtatacatatatttatatatgcatatatgtatatgtatatatgtatacacatatataaatatatttatatatacatctatatacatagatgtatataaacatacatggcttcctggtattcttataaaattttaacatatattgtatatgtttatatgtatacatatatatgtatatgtatgatatgaaaatggcataagcaaaggtttggagacttgaaagatcatatccagagaatagtgaataggctgaagtaggaggagagtaggttagaactgtaaggcataggaataaaagttagttaggggacaaaacttaaaaggcatggaataccaaggagtctgcaatttgttaggcatagcgaaccgtgcaatgttttgagtacagaatgccaggattatgtcttccttttaagaaagacaattccggtggatgtatagaagtcggattgaaattgactgtagagatggatgagaagatagacaaggcacatgcactagttaggcagccgttgtactaatgcagatgagaaataaagaagtttgcctcattatggagaggtgctgagaacaaaaagggctaaaaattttcaaaagtaaagtagaaaggtttcataaatggatttgaattgggggcgatcaagaaagggtaatataataaaatgactctgagcctcctaatgtaaataatggagggcaagtttgtcataatttcagaaacagtctggaatttgagcatggagctctaatgtaaaaaggtcattggctaaatgcctgttagaaaggatacatggagtataaattaatctgcacactttatgtaatgtataaactacaaatcaatccgtgttttagcaccacatataaaatattagtaaatgtagggaaacgtataagtcaaattacctatttatgtaaggtcacatgcagcattgtctttttagcacattgtctggtacagattaaacagctatgtagagaagctatgagtatgaggagagctacaacaaagaacctctttttttaagtccaagtaatgagtatgagagctacaacaaagaatctcttttgtcaagtccttctctcagtatctctaatagatatttgcttcaattatttaatgggaaagaataatgagaaaaacatgtaaggagagatattttttgtaattctagatatagatcatttgttaaatgacatcagtgaacttagtcaatgctgaactaatttgttatttacaaagaactagaagtcgtttgatcattcaaaagatgtatgctagatttgtagtttttttaagatcagtttttaaaaaatccaacctgtctcttcaacctaacaaatacagtgaatgtaattataataaaaaaacctcctcagaaaaaatcatgttagtatgttatgtgaaatctgggtaaagtcaacttagtaactaatgaaactgcattgtatttatgtgagtgtttgcaaatacatagcagaaagtcaagtttcactgtggatttcaaggaagttgccacaaagcaatctcccacaaaaatctctcagccaagttctatgatgtcaagtgtaacagactcgataattgcatgtttatccaacatggagataagatggcttctgatctagtgttacaccaataaaagcatgtcataggtcagcaagagctgttaaattagattaagtacatgctccgtgtgtgtgaatgtgtttataagcacactagctttatgaaactgaaatcccatctatgctatcatagttaccataaatagccccaaactaggcttaatgaagagtagtaatatttctatcttggatatgttatagtatacttgaatataaggtataacaagatattttcaagtttttgaatattaaaaagattcttattaatcactgaactggctgttaacttctcactaggcaaaatggaaatgttttaagaaataaagggaaaagcaatcattactgagctgaagaaaataattcagctttaaagcaagtgattctatgaacttaggttgttttaccactgtgaattgaagatgtcttgtttgtttccacctctttaatgtataattgtgaaagtagtaatgcttaaaatgtttccattataaattttcccattaacaaattaatacagtcttattagaccactagatgcaatgttgttgatttttcatagtagaacttaaaagatattctaaggttgcttcacattctttacagaactctcaaatatagtgtgttagttcttcctcaaaaatctcataaccaaactggaggtatttgaggcatcatggaaggcatgaggcaaagaaaatgggactctgatcatttatgtggctttcctgaaataacacagcagtttaagtgacttgactcttcaaattgtttctttttggggggatgaatttttgtaacctgcagaaagagacactatctcttataatgatcataccagtttgctaagattgctgtaacaaagtaccacaaactaggtggcttaaacagcagaaacttttctctgagttctggaggctagaagtcagaaatcaaggtgttggcaaggtgggttccttccgagagatgtgaaggaaagttctgttctgggcctctcttcttggtttgtagatggttgccttcatgttcacatggcattctccccgtatcttcacatcttccctctgtgcatattcgtgtccaaattttctctgtttataaggactacggccatattggagtaaggcctaagctaacaacctcattttaacttgattacctctataaaaatcctgtttttcaatgaaggtcacattcgaaggtactgaaagttagaacttcaacatatgaattttggtggagcacaattcagcccatagcaatgacctttggccacacacccaacaatgtgatatggctgttctccgaattgctagcaacctcagtgctgggatggatggtgggtacctgccagtcccacctttcagttgacctgctcctttacggagtcacttttttgccctgtgaacctgctccccttgtccatagtttactgttccacagcagtcagctgaggtgatcatattctccttggaatttggaatgggggacaaagagccactgatctatagaggctgaattattgaaatgtaggcaaataaatgcagaagctctggggcagctctccagtccatggcctttgccatactcactccaggctgttggtattcttcttgggattctatgagaaaccccatcccccaactccctctctctttccctcccttactctctttcttcttttttatcttccttttttccttccttccttccctccctccctcctccctcccaccctccctttcttccttcttccctccctccctcccttccttccttccttcctgccttccttccttccctccctccctcctccctcccaccctccctttcttccttcttccctccctccctccctcccttccttccttccttcctgccttcctgccttcctgcctgccctttcattatttttgagtgtattcgtcttgaacttgtttaaaatttatttatgtttcttacaacaacaaaaatcttggttaagaaagatttgtcatctttcctaaccaacaaaaatcttggttaagaaagattaatagatttgtcatcatttaaattttttaaatatatacttttctctgaatcccaatatacagaaaaaataagcagagtctactatgatgaaaggaggaggtgggtgccctcccaggtgctccttccagttttttcttactcctcaccatctccacccccacaggcatcctgttgctgagggctgtctctggaaccctgggtctgtggcttgaaaaccatgacggtgtctcacccagctcccaattcttggggctttaaacatcttcctctatctgtcataaaaaatccatcgattttttagaaagtaactgagtttgggaaaattattttctgtctatgaataaccagtgtcaaaaatatggctccccaagaagttggagccaatgagtttccaaataggtgaaaacatgccttgagatttctaactagaaatccaagagcataacttccccaaattacttaaaaaccagggattttcctatttctgactgtgcttgttgtttgttcaaattttggggggttatttgttattttcagtaccgtagagtttgataaatgaaggaaagtagattccaattacaagtaagtgatcatcagtataagagaacatttttttccctaaaaaatcatgtgaatgaaattgttattaattgagcaagatatgctgataatatctttcccttatttttgtgaagagaaatttaatgtagcctgtctgcaactcttaagacatgcagggaatataaggaagaataaaatgatctcattaatgggtccttgttttaattataaaatgttaaacactagtattaaacaagggtcttatgttcttcatcctgaataaagtatgcatgaggggttgcatgcagaggtagaattagggtctccatgtggcaaaggtaagggaatatcaggtgggacgtaatcagtatttcaaaaaatctaattttcttcaagcactcctgacttgctccgtgattcacattttcaatagaaatgtgccatgatgtctcatctttaatcgattatacttgtttttgaattaaaaaaaatcaccaggcaagaactgaactgcctttgaccatctaaggaacctactgggtcttactttccttgtctataataaagcctctaagttataatattttatatttctactgattttggaaagcacatgctataaatcaatttctgatcaatgatgctgcattgcatgagtccaggtgccactttttatgtagagcacatggcaacccagatttgataagtcaatattttaatcaattatatcttatcctcattgcaattagttagcatgatgccagattttactaagcacactgagttcaatttacatacacataaatcactgacaaattcctttggcatttcaatatgagagaaactaagctctctcaataatctttagaatataatttccattttgaaaaataaattagccagaaatcaaaaatttttttaaaaaaaacatctataatgaggaagagaatgttacaacattaattcatttcctagactaataaatatttccttttcttgtttggtcaattctttttcatctgaagataaacaataaagagcaaaagtaaaacttagagaaacattattcgttcagaccttcccataagtgatgccttctcctcagttagatcttctgtgaaaaaagttgttttacagacagggtctggctatgttgtctcggtttgagtgcagcggtcaatcataggtcattgcaacctcaagcaatcctcctacctcagcctcccgagtagctaggactacaggcatgtgccaccatgcccaattaagttctcttaatttactttttgtggagacagtgtcttgctatgtggcccaggttagtcttgaactcctagcctcaagcaatcctctcaccttagcctcccaaagtgctgagattacaggaatcagcaaccatgctaggaaatggatcttgtttctaatatcatccttcattgaccaatctacagcagctaccagttactttcaaccctattacttcggtttaattatcttccttgaatttatgactagcctatgtttttgattattaattaatttattatatgtatctctactaaaatagacttcgtgattatgggaacattgccttattcacgtcaattatattctcaatgtttactacagtgtctagcacacagtagagatgcagttgatatttgttgaagaaatgaatactagcgtcctgcctatctcaaaagagaaggagaagagtgtattgattaagaataaactagagaatgacaacccagtttcaaatccaagaaggattagctacataatttgaagaacctagcacaaaattaaaatgcaggacacattattcaatatgtattaagaatgttgagacagcaacagtacagcattagttagtgtggacccatttaaaggatgggttcttttcaaagcaactgcataggttacatggccatgaagctggctgtaaatgatcttgggcaagactctggggatgttaccaaggattttcatttgtgctcctggatgaaaggatttgttattaataaagaattctgaggaatgctggtaaaggagaggtttttaatttttaagtttttaaggcgttttgggggactgttcttcagaaaatcaagtgatcagttttagaaatgtgaacttttacaatgttgaatttcaaaagaatttaaaagatggagacttcaaaagatttcaaaaatttggaccttctctgtatgatgcagaagaaactactagtgctatcatcccaatgtgtcttttttgtttctccatgtaactgtgcatccaaaatagagtatatattacatattttcaaccttattaatggacattatactggatagatagtgttgcatttttaactctctcactattatattgtataaaatgtatctgggttttgtatgtatttttatttatttcaactacagtatactatgccattgaatgaatattattattacattctttttatgacagatatttaagcagtttcctctttacatcataaagtgctacaggtattattgtatatgtgtttctatgcacctatgctagagtttcattaagaattatatctggatgataaactattgaattgaaggatatggacatcttcagcaagacatggtataactgtttttatatttgttacataaactcattctcccattagactccagagttgataattattcataccatcatccgtgtcattttaattttgtcagacctctttttctattgccagtcagatgagttggaaaaaatacttactgagttttactctgcatttctcttatttctactgagttgggcattgttttatattattttcatgaatattctattgccattgtctgtaaattccctgtttatatcatctgctgatctttctattggattgtttatagttttttattaatttataagtactttgtttctggatgctaattcttggtggttagatgtatcatgaataatatcctgaatctattgctttctttatttgttttggatgtctttgtcatgaagatccagaagcaagtgaaaacctcaaatggcttagacatgtataatatataattttcttatacagcaaggattctagagtagctatcttaaggatttagtcaactcagtggtttccgtaatcatccaggatctgggttatttccacctttcagctcagtcagccttaatgtttctcttttgtcctttggcttgttcccttctttccaactgggtggctgccacatgggcatcacatacagacatggaaagaactagttgaaaagctgctggtgtaacattttaaaagcaatacatctttctgatgaacaccgttacatttctcagtctcactggctacccaaaaaccaatcctgtgtgaaaagaatggtaaaagtcaatgattaacttagtcttctataggattttctgctgagctgagaatggtgtcctctgctttgagagataggaatctgaacaccacaagagttctgttagcaaggaagatggaaaagttgtctactttgtagatgggtgcttttcaaagcaactgcattggttacacggccatgaagctggctgtaaatgatcttgggcaagacgctggggatgtgactagggattttcatttgtgcacctggatgaaaggatttgttattaataaagaattctgaggaatgctggtaaaggagaggtttttaatttttaaattttaaggcgttttgggaggctattgtaaataaatccctggtcaattgtattttataagcatttattgctgatttatatggatactgatgattatatgttgatctttttataaggaagcttgctgcatttcctttttaaccaaatatcataatacatttgtacagaacttttacgaatactgtatatttgaagggcaattttgtatttttctttttattatttattttctttgttttattatattggctaggacttttgatatgatgttaagtaatagcagttacagcacatttgtcttgtttcttattttaatgggaacttttattttccaaatggattcatatactagaactaatttcaatctgtggacatttctaagagatgtatatcagagccatgtatataaaatttgtaatggtcatgcacagaagaaattggctatctggtaaggccttaggattcctactgcaagaagtttccaagcaatagcttgccaacttctttgtaagtatattgtaagaatagttcaagattacctcaaaaacagaaccgtcccatccctggcttgtactcacaggattagatattccttttactcacaataatgggaagcagcaatacatctgttgacaagtttatttatttattttcttcattaaacaaacattttaagaagtcactaactctgggataaactttgcgaactcattatatattctatgtggagatataaatatgtacacatattaatagttaccaaattgcaccataactgctgcaaagagctatatacaaagatttcagggaaaaaatgttgaaaaatacacccacaagtaatgaaacagaggatgcgaaacagtgaaccagcccattgtagctagtgtgcagtgaaaaatagcagcagagtcaaaggttgcaaactgatgctgatgtgaaaaatgacagttttgtttttcagcaaaccctcaggatttcttattccatccaggtcctgaggaaaacgaagggtttcgtgtgtcccagtaagtccaacaaccattgctctccctcttcttgttctttggttacctgtggttgctttgctacaatcaggatttcaaattggttgatgcttctaagacaatatctgagagtgtaacagaaagaaaagaaaacaggttgggggctggataagaagaattgatgttgtattgttgttttctttcttccttctggatcccagaaccagggagtttatcacaaatgcttttatgatccctgaagcctaatgcttctgtaatagaatattgtcttagtaggtaattaatgaagaagccctcatgttgttcttgtcttgcttatagcattaaaatccaggtaaaaatttattttctggcaacccacaatcaccttcgatacacactattcacattgtgccccatttacaaaaggaaagaaacgattcagactaagtctcgtacttatagttgaaactcggcaagggttgatttctgaaggttttacacactgggaatccaagtccatctggacaaaaagataaagcttttcatagatcatgtaaatgaaacacatagatgacattccagaattgccattaaaagacttttaacaagttggacatgttcagtatcatccaaaagttttcactaccctgtgacttcttagagaattaaattgccgtcagagaacttcaataagccagtgttcaattagtacctttgtttgtttttccttagtcttgtcaaaaggaagattaatgtgcagtttttctgcactcaaaacagcttttcttaaaaggaatatggtgtctaaatcaaaattccatttagatgcagggaaactgtgattttttttaatagtgtgtgatgatcatttcacctttcctcccatctccttcactcttaagttttttcccttgtaagcaaacatttaatcctgcttaacccttcttctgcaccattccccagtcctgtgatgctgaatactataatctttgagttttaatgcataggtgaaagaaaaaaaagatttctgcaaaggtggaagctaagagaaaaaaactgtagggtcattttacaaatggaatcactaaaaagccatgcatcttgctgggtaatagcacagaacctttaaatcacagaaattagagacaggagacctgtcaggtcaccttgtccacctcctatagcagctttatgtattttgtgtgaaatgacatgcagtgaagcatttaccggagccctggggagactctagtcctcagtaatacatctccctgttgagaaaatgtcatagagaacagtccagcttttcttttgcctaatttcacattgttctgctttgctatctcttttaaaaatgcagccacacattcttttgctcctccatctttaaaacctacaactttgtaatattacgttattattgtcttcctttgtaattatttgagccaagctatacaatttgcatcttaaaatactactttaatcagtcaccaatgcaccatgtagtgacttcctaaaggcttattcattacactcccatttaccctgatcagaagctgtgtttcatgtaatttcatttttttcatgtgtgtttgtagaatcaaggagttcgctcaattcttacgacaaggaatgtggttctcaagctagtgactggacatcacaattccattaagattcagataactcctacagccattacttattttcctacacaagtttctaggacaccatcaagtccagtatctcacaaatctaaatacttcctggtgtgtcagcttgtccaagtgaaaccacctttgcaaaactgtgacagaaagagaaatctgacatggctgacttcatcttgcttctaggctcacaggctggctgtcttcactcattcctggggatgggccaagctaactttgggagaaatttagtttatagtttaaatgataatagctcttccccaaaactaaactgcccttgtaaaactaatgaaagacccccaagttaggaggatgagaagggcctgcattctactatgatgcaggtttagctaaataattatcagccattattcaggaggtcacaagatttgcaaattactcaattactcttgtaaataacatcactattgtagtatagtaactagccaggcatggttgcctgcacctgtagtcacagctactcaggaagctgaggtgggaggattgcttgagcctgggaggtcaaggctgcagtgagctatgattgtgccactgcactccaacctgggcaacatagtgagacactatctcaaaataaataaataaataagtaaaacctaagacggggcttttgagatgtcttttcaggcttttgcatttctgactacctaatgaccccacccagacctgttactcaaccagtcctgtggccccaactcagaagcagacccagctcaagaagactgtattctacatccctattattgcattccccaatcaatcagcagcactcatgccttagccctctgcttaccaaagtaactttgaaaaacccctaacctctgtgcctatggtgagattgatttgattaataactccatctcccgcgtggagtggctggccttgtgtcaattaaattctttctttactgcaatgctatggtctccgtgaattgattttgtttttgcagtaggtaggaataacttactgggtggttacacaattgtatgtgtgaagaaacactgtttaatacctcttgggcaaagcatgagcacagctatatgactgactctttctggataagttattttgtctacatgtatttcaaaatgccatgtattacactaccttctggaagataaaacttcacattttgcagatccaaaaaccttacttctcctaggtaggaaatggagacacaatctccactcaggtttctagggtgagccaaagtcaattgaacttaaagatctgattttgattccaagatgctgtgcattggaaggtagagacgctcttgtaattattccttctccacccaccaccagcacccccaacaccatcacactggcctcaagtgggtacactgctcactgtttaacatcctgccgtagcatgggcatgcagtctttctcacaatgccccaggacagggctgcaacatttagataagactttagtaaaggcttttggacaaccacagggacacacacacagagaatcaggtatgcagattacaacttgaattactggaatggtagatcacattccatatgagtttttggcctatctctatgatatggtttggatgtgtccccacccaaatctcatcttgaattgtagctcccatatgttgtggcagggacccagtgggagataattgaatcctgggggcagtttctattctcatggtggtgaataagtctcacaagatctggtggttttataaggggtttcctctttcacttgactctcattccctcttgcctgctgccatgtaagacatgacttttgccttcttcagtgattgtgaggtctccccagccacatggaactctgagtccattaaacttcttttttttttttaataaattacccagtctcaggtacgtctttatcagcagcttgagaacagactaataaactctacttagagatttttttcttccacccagggcccaaagtatagatattatgatgcctcaaatttaagactcttctgaacctgcctagtaagagtaatgctgagagaggagttacttgtcctaccctctagagactttactgaagctaggagctggaacatgcccatgcataccagatggacaaggatagtaagcttttgtgcatttttttttctcagaggggatcagaatattactgggccaaaaaacaacctaaaacttccccacaaaacctgacaaacttgtctcaacatgcattactctataacaaaaaaatggggaacaggatgttgcaggagcagtgggagggagagaatggctggtgggcagagagatagaaaaggaaagagaattatgtgttgagtacttaccctgcaggcatgtactttatgtacattatctcatttactcattacctaaatgatttccaggtaggtaaatggaaaacagttctgtctcactctctggcttatacccttccatccacacaatgctacaccatttttcaaagacatgaggtttaatgagacaataatgttggtaaagtgttctaatttcctctgagaaaaggagccataaaattttattgttattgttacacttattattgaagctcaatgaatgctttagtggtgtcattgatgtaactaatattactctcatttatttcatttagggaactaatgtctaaaaataagaacaagcaaatttagtgggctatagattcagctggttatcaagtgctactttgcagatagagaccttgaggactaactcaacaacccaacaatcaaggtcgaagatggtcttgggggcaaaagtgaaaagtgtaaccactagggactctttctaatgctgggctttcccaaggggtgagaaagggatggattaaaggtgaaatgcttgaaacattgtattctcggtctgtaattgctgagaaagggatggaataaaggtgaagggcctgaaacattgtattctctgtctgtaatcgttaaggaatatagcaataattcctccacttgtttgtggaaataacaatggacccagtttagataatttgattctccagaagggcaggcattttctcctttctatgaaagagtttattgtgttaagtatataaaacaaaattatgtcaaggacaggaaggcactacaaaatgacatggagtcatgcatatatttaagcacgagcaggaaccttggcatgattaattttaggtttgccatcttaaaaattctttacagtgggaaataattcaatttcctcctaaaagttacatttttgcttaaataatcaccagcttgaactgtaatttagaatggaagaatgagaattctacctgcctttttatttgtcaattatgtgtttaattatcatttgtctaagcttggacttcattgtgttcacattttttcctgacgtgctatgtttgaagaaatgtagaattctgcactttattcagaccttacctctgattaaagcagaaagggatgtccatgtgatccactttccttgttttcagagaagaaaactgagacctagcgaaaacaagtgcctcagctgagatctcacagttggttagcagtgcttggcatttaatccaggccccattccacgactacatttgtccatttcatttattaggaatttgtgtagacaagtctttctgttaaattactttaccttgaatttgtctcatctttttcctaaaagggcaatgcagaatgaacacaaggactcctttgctatctattgctaagtatagggaaggtggaaagtacctggttgcctctacagctcttctctgtgtccttgtgtgtggcaccactgtttgacagcaaaactaagccaatgccttgcattgaggcacactggggataaaaatctcattcattgattgatgaaaaacatgcaagaacaaattattccttcattgtcattcataaagcatttccctaccaccaaacttcacatctcctcttttccttgcctaatcttgctttcctacagaaaatgttcagcatggatagttgggggaaacaggagggaaaatataggaagtggttaggagaaaggcaagattgaccccagcaaatgattttgaagcatgcctggaaatagttggcatctcaggctagacataaattcattgtcttgagttcacagcacttgccttttattttctggaagtcacacttcttcagtgaaataaaaaatgtccctaatggtggtaatctcacttcttccatggaaaaaaaaattctcattatcacctcctctgcacactcctaaccaacctcccagtaatcttgttctctttaattaacctacttcctgtaattgaaaaaaaatgaaggaaatctttttatttggccagcttataatttagtttatatagaggaacattttattttttaagctaaaactataatacaatatcaaatagagagtaggtgctaaaatatctgatgagcgagtggattgattggatgatgagtttagtaatcatttttttggtacttagactggtcagcctttttaggagggggagacagatagatagttactgtgataagagtttgttgtagtttaatggaggagacatacaggtaaacgataaaaacagtgtaacatgataaatgtcgttaagagatagaaacaaagcactgtggaatctttgagaagagaatgagaaattctcttggggtgtcaggaaaggcttgtagcaatgttagcatttgagttggatcttaaaggatgactaagactgtcctaggattatgaaaatggacaaaagtggaaaaagaaagctttcaagcttatgcaaagacttggaggttatagaaacctggcatgtttgatgaacacttagaaattttagaaatttggtgtggcagaagccttgagggaagtggcaggagatggtgtacgctggaaccagagtctgaaaagtcttgaatgtcaactggggaggttggattttattttctgggcagtaggcaaccaagagaggctttaaacctgggaatttacatgcttgatttttttctgtttaaaaaagaaatctagggatgatatctataagggtcttgttacagaaaccagttagggagtaattttaacagttcaagtgagatgtcttattcggtttagcctactctcacaatgtaccataaactgggtcatttataaataacagagatttatttttcatagttcttgaggctggaagtgtgtcatcagggcatcagcatggacatattctgttgagggctgtcatccatgttacagactgctgacttttgttgtgtcctcacatggcagaaagaggacaagagagctctctggcctcttcctgtaagggcactaataatctcatttgtgagggaccctccctggtgacctaattacctcctaaatgtatcacctccaaatattatcacagtgggattaggggcttgagatatgaatctggtggcacacaaacattcagttcattgcaggtaaaatgaagattgtcagtgacagtggagacaaggagtagaggtccctaatgcagactcaacagatttcagtgactgactgagagggtagttgacagtagaactgaggttcttatagtgggaagtcattaacttgagaacataaaatacagataaggttttcacttattccacacacgtttcattaaaaatccttcatgtatcaagacctacttgggaatcttacgaaagagaaatatttcctaccattatagaacacactgtttggtggggctatatagatttaaaagttaattatgttgtggtaactacaatgatggctaaaaatggccacctttatagtgattattatgtgcttgacactattctaaatattttacatgaactaccccttttaatcttgaaaacactcttaaaaaggagaagctgttatgattcccactatacatgtgagaaactgaagcacaaggaggttaggtaatttgtccaaagtcatacaactggcaatgcaagagccaatatttaagcccaagcagtatgacaccagagtccacgccagtgaacacaaaacagaattcctctgtgatagaagtatgtgtagaatagtgtgtgtgtgtgtgtgtgtgttatgaattttgttgtcaatattaagttggagctgtgcagtctcaaagtttattgttccagtaaacaattagaaattttggcttacaggttggaaaatagatgaaagctaaaggcatagttgaaatctgcataaaattaaagctatgggagtgtatctccaagggagagtaatttttccacaattagaaggtcatagctctgggatccccaacacatatgggatgtgcaaagaacatgaaagagcaggaatggccagaggattgctagacgatgtcgagagtggaatatatagatatcagaattagcgtttctagaaagagggagatacgatgaacagtgccaagtgctgcaggaaagttatgtaggactgaatatagatgaatacagatggttgaatttagcaattggaaggttattgttggttttaatgagaataatttttgttgtctgatagtaaaggtagccacatttgagaggctgagaatgaaaggtcatgcaaagagggattgatattttttgtttgaagaaagtagtttccagaacaaaggaagtaacagtctgttaatgccagattatcaaacagaatttggaaatagtatggaggaggaaggaaacagagagatcatttgcaactactattcttacaaagcagctaaaggaatgagttagcccacaaataaaaggtggttaatcacagtgcttattatagacttcaatttcattatgtagcaaatcaagagtgcatccataatatacctttattcagtcactcattcatttgtttgttcagtaaacattaagcacttgggaagcactattcatgtagactgtatgcatgtgcaagtattggcatgtgttcagggcaatgcaggaggaaaagggtggtaggagagacagctgacctgaaagcttgcctggcataatgatcaacactataaagccagggagagcccagcagtcctgtttgttaaacagtgtgaagtgcaatggacctagagtatttgggggttggtaggtcatattgttattactgacaaaagacaagaaagccaaaatcaagagctgaaaataagaatgtagttttgtattagattttatttcttaaaatttaaaaactgtatatttacattaaaaagtaaaaaataagagctagcaatactaatatcacattctgtttctctctttgaaaatatgcttaatcatcacattgatgaatgcagaatgcatatcccatacagagattgttttgttagcaaattttctttttctcaagctaatatcttaatattttttattttttatttttttgtcgttgataacagctgtccatcatgcatgaagatggcattgactgaatattgtttcccatgcaaagctgttgatagagatggttcaagaaatagcagatttctcttcggatcttgactcagctcatgtgatataattacttctaaaacaaatttactgtcatgcgccagagaaacagactaaattacaataaaaatagatctatgaacccaccataataatcatttttcagggaggacagttgaaaaggttatttttaatgtcattagaaaaagtggaatgaatgggagtcaggaaaaggctaggcaagaagaagaaaggagaaatgatgaacagaacatattggcaagaggagctgcagcatgagaacctctgttataactggcttcaggagtgcatgtttgaatagacacagactacatatttcgtttttggttttcctattatggcggatggtatataaagtgttgatttggtgcagattaaaacttgagataccgaacatcattcttttattttcctgtgatgccccttgccccataaagaaagaaaacataactgctcatcatttgctgtaggacaatcagcacacacacacacacacacacacacacacacagacacacacacacacagaattaatgcagagtttttacttctgatgtaaaatgtttatgtatgtgtgtggctgagaaatgagaagcttccctgagaaatatggaggggaagggaaactgacctgttgtttaatggagatcattttacaagctgacttcaacagcctctgttcttacttggatatgggaaaggaggtgtttcaaggtacacccgtgcttcacaagaagttatcacagaatttgggacgtatgtccctgtgagttggggagcacatgacagatggtaacttctagacaggttggtttgttggtaactgagtaaggaggccacactgggagccagtcacaacagcaccaatgatggatgatggagggagatgtcttgagatggtcccactcagagtgaggggaatgcttcaaaaggagcctggaaacagatttccagatgcagaagtgaaaggtgatgggctttgaacaatgagaacacatggacacaggaaggggaacatcacactctggggactgttgtggggtggggggagggggagggatagcattaggagatatacctaatactaaatgacgagttaatgggtgcagcacaccagcatggcacatgtatacatatgtaactaacctgcacattgtgcacatgtaccctaaaacttaaagtataataataataaaataaataaataaaaaataaaaataaaaaataagaaaggtgatgggctgttgtaagctgtcagccagcctgaaggaggcatttccacctccaggaaactgtaatgagagatccccattgatgacagacattcctgagaaatccacaaaagcaccttatgagagaaagagccagaagaccaaattaaaatcctgccagtgtcttagcacctttgctgtcccctaccctctccctgacaccccaatttactcattctgaaggagccagaaactagagcaggta

SEQ ID NO: 340 - DNA, 5062 bp, Homo sapiens
aaagagccttttttaccagttcaaaaagtttaattaaccagcagtcaccgcatctgaatttttgtctctggggcatagatggcagaccaagattaaaagtggtaactcagctatacgagcatgggctaccttcctgggctctcctgcagtcctgtagacctgctgttccgcagaccatgggacacaaggtcagtgtgttcccagtgagggtcccaagtcagtcatcttaagtgtttgttctctgccccattcagtggactgttgacttcagtccctgcaagtgctttagcccgagtggggttttctcagagcactgccacgagttaagtgtgtgtttagccaaataatttctccgtaagggaaaaatgcagtcacccaaattttaccaacaatgacagagatgagagtagaaaagattaggcaacatctgagttttaacttgaaaagtgtccaagtcatcatgaaaggccgactgggagcaagtgattattagagattcttcaggagacctcatctgaaaatgttaagactgccagtgagggaaggaattgttaaaatgccagcggcttttttttcctctttttttctgtaattctgtaaaaatgcagagaaagttgagtggtacttcagaattgagggagagggttaccgcagagtagaaatatatttctagatttcagttccacaccacaaatccacaacaatgccatttttcaactgtacaaaaatctgcttatgaactggacatgatcttaatggtagtgtcaaaggccaagtttttcacctgttaatatttttccacatttgtccttgaatctgaataactttatacagtactgtaaatttaacttacatcgagtttgttgtcaattcttatgaaaagagctttctgcatgtaacacatacggttaaagaacacagcaaaggacaaaatttgcaggaacagttttggaaccaacagaaaatgtcaccttttatttgccatcttatatatatctatcagttttaccagctacttctaaatttgtacattatttgtaagggaaagaaggaaaaccctaagacttgtctaacttagtggagaatgtgtgtgttgggcttaggatggatagctaagtcttattgagctgtgttacctaacttgtatataaaaattgtaattaaaagtttgggttcacctgtttctcacagtttaaaatgatgagtaattgcaaactctggaaatgtgactagtatatgatttaaggctgtagaagcaaggaagctctttcaagtgctaaaactaaagacttctagtttttggctcaaataagtactgtttgtataccaggatatgtgagatgtaaatgtagtaggtcacttttcacccttgtagctataaaataaaaattttgtagaacagaaatagcttgtactactgaattaacaaaagttatactaaagtatcatgtttaaaaaaaatatatatatatatacagagttaagcttgttgctgttaccctgtctggatttgaaaagtgtgctgatttatatatatatattacacacacacacacacacacacacacacacacacacacacacacacacacacacacacacacacacacacacatacacctaaaatggcctaaagcagacatccatgtaattacagttgcaaaatgaaaacattttggaaagaacattgtatcatagttcattcatttgcagtggatctttgttcctttttactgtggtaattttagaaatgagtgtcaagtttgaaattagatctgctaagttggggttttgctgcttgaactctgcactgggtcctcaaataaaccgatgtgaatgtagttttttccccctgtgtgaagaagcagttacaccccaacaataggaggaaaaatctagaactatttcaagttttatctttttgtatatgaaaataaaataataataaaacaatcttgtctttcttaattacgtggcaggggattggagtttcctttcatgaggattagacatgaaatgaaatggcgttcggctgcttagagggctgactcaagtcagttcctgtttggtatgtgtaacattaacagatgttaatggctgaatgcctagtctgccatggtcctgtggggctggagctaagcacaggtctccatttctgccattcagaagtccagggtctagttggggacattatgaatggggaccattctcctgaacgaactgttctgggattttgagtaagtttctgcaggttagcatattttccaaatgtccaagacactccccattccctcatcctctgccaccagtcctgtactttgcagacaaccctgagcaatattgttgtaagtggagcagagaagccttgaaaatagttgtattcaggactattgcagatgacaaactctgtcattcccaaacgttgctgagtactggagtcatttgcggagctattaaaaaatacaattatgggtccttatccccaacctggaattagcaaaccaggtctccagtttcagagatttggacttaatctcactaaaggaactcatggttccccaataataaaataatgatagtctttaatacctaacaaaacaggaaggccccagaaatcacctcactgctttctgcagtaacaagtttttttggtcgatgactctttcttgcctaagtggagaaacaccctttaaattcaccctttattatgagaattaagcaacggtttgaaacttgtggagaaagtttttgatgaccctttattcagggaccagttgcccaatatttggctgtttttgctctttcacgtttagaaagttcaccttttattagtgagtgcctctaatgaaggaaggagagcaaagggctgacatttttgatacaggatcttggagctggaaaagctgaaaggttggaccttaggagtcatctggtcaaactttccctatagcaaaggaattctttgaccaaagaaatttgacacagaagttggtttataaaaccaggcttgtctgaatgagcaagtagaagagggccaagggaccatttcacttaccctcccatcccttcctttaagtctcaggtatccctatggaacacctaggaaccttgattaaagtttacaaatcactggcccaattccaattttacaggtgggcaaacaggcccagagggagttttcctaccctgaggcaggcaacccttccagttcttgacctcttgggaccaaaagtggggttacacttgttcagaagtagaggatctggattaggaaaagccatctaatatttatctctctagtatttagcacagtgtctggcacttacaagggccttaagaaatacagtacctcagtgattgtgtatttagtaaattctggggaaagctgctgaagtagccttgaagcctacagataccagtgttgtctggttgtatttgttaggattcttggttgcaggtgacagaagccattagacaaaaaagggggtttcactgaaaggattctgggggaaatgactagccaagacttcagaaaggcaggatgtatgtgggcttcaggagcctgtgggagttggggtcataacattgcaggcctccacctgtgtcctggtatttcttccattattgctcagagcaagaccagatgcatctgctcctttgacttcttagcaggaaacaaggctgtagacagtgccagagcttttttttttttttttagacagagtcttgctctattgcccagattggagtgcagtggcacgatctcagctcactgcaacctccgtctcctgggttcaagcaattctgcctcagcctttcgagtagctgggattacaggcacgcgccaccacacctggttgatttttgtattgttagtagagacggggtttcaccatgttggccaggctggtctcaaattcctgacctcaggtgatcctccagtcttggcctcccgaagtgctgggattgcaggcatgagccactgcgcctgtgagttttacgtcacagctttgctacccagagagactactagatcgaaaatccctaggaaggactctggttgatgtagcttaaccagtcagggtccttcagaagaggtattcctggcaagggggtagcctcccatttgaggctgtcaaaataatgtgcacacttcagtaggttgttagaagtggcctcctggtcagtgaatcatcagtgggatcagatgaaagttattcctaccagttatctaagaaataggaaacttgaagtttctgctaagaactaagtccacacggaatgctagagatcatgctgcaaaatgaagactcatttgtttgtgagtggtagtccatgaaatctatcctttctttgccagcaggcgttcagcaatctggattttatattctatcaagacaaagagtagagatgactcaaacatttctaacatttatagagcacttagtgacatgcccctggtacttccctaaacattttacatgtgtcatctcctttaatcctcacaagaacgctatggtctaagtattattattccaatttaaaagagaaggttggggacagtgacacacacctggacttacagcactttgggaggccgaggcgggaagattgcttgaggccagaagttggataccagcctgggcaacataaggagacccccttctttaccgctcccccactcccgccaaaaatttagccgggcaatgtggcacgtgcctgtagtcccagctactcaggaggctgaggcaggaggatcgcttgagcccacgagttcgagatcgcagtaagctatgatcattccactgtactgcagcctgggtaacagagaccctgtcgctaaataaataaatagacctgagttggaatatcggctctggagaccttagtgtaaccatgcgcaagtgtttactcacctattaaatgagactaaaggtattttcttctcatgactatatatagcataccactaagccctctagacatcatattccccatccatcgccccgtccagtggaccagggatgaagcggggatgcgctaggcatcccggtttgtcacc

SEQ ID NO: 341 - DNA, 29432 bp, Homo sapiens
gccagcgcccccacactgaggactttattagttttttaattttctgtctgggtgctcctgctgcatcaaactttccacagctgttaggagctattaagtccgtagcctcattgggccctttccccacccctaccctgctgaagaacatgggaaatttctggacatgctacgtggagcctttaaaatatgaatactttgtctctctggtgagaaagcactggggtccagatggggagaagatgttctgccataagaaaatctcctggtctggtccgtgccttggcttagcacagggctgttcaggcagtgtgaggacccgacaggagggaggggcaggcagaagggagaacccacttttttatccattctgcccagcaagtaggggaccggggttgtccgggcgtcgggggagcggggagctcagactgtttttagactgacttggaatccggcccagagcttgatgcccggttcaaagcattccctcctgagtggacattacaagacctgcagcgaagaataaaacagaaagacttgcaaacatttgccttgtaggcgcacagctgtggttttgtacaacaggccagtgctattgctcctgtctcccctgagaggggaacacgaatacctatccactcccaaagcccctccctgccagcatccctgagatgcccaggcagcccagatgaggcccagccgtccatgagactcccagtgtgtaaacccaaaagcaggtgtgcacgtgcgtgcatacacacacacacacacacccagcaacctggctctttcccatagcacccatgcatctggaaggcaacacaaccactcggccaactcggggaggatggagtaagggccttgagggtccagagaattctcagcctcgttctggctccagcctgcccggcaatttgctttccagcggctgcctttaagcctccctttgaggagacttatttgcagggtgaatgagaaagcctagagagaagaaaaacctttggagatacccgcctggggaacaattttgcctctgagagcaagttggtatttggggttaatccctctgtggaaacattgggttgaaagcccggaggaggtcaggggtctgattacggcttctgtttacatataaacttcctggtcctaggagacaatcggaggggtgggggaagggagcagggaaacaaggaaagtaaaggagaatttttttaattaaatggccttccctcttaaaaataaagtcaacaaaataaggaggagcttgtggaatcagggtttgatttgaatgtctatgtacaaatatttcttttacatttttaagtcatgatttacataatggagttgaagcatcttttgaaacaaaacttgaaatactgatattcgttgatgtgcataggtatatttttttaaaaaaagaaacagtaggaaagaaactttagtcagttatcttctgagaaccagagggacgcatagataatgaaactagccaatgtgctcagttgtcttggatttgttgagcttgggttctggtctgattcttatttagtttggtcagagaaaaatcatcgtgaagactctacaacaggtgaatgagctgaaaattatagtttgaaggacaatttgaaactaccataaacacatacatataagaaacgcctaaatgacagtattaaagccaaacaaacccatactttcaaaagaatcaagaggaaaaaatacttcttccacatcctctaaagaaggcaaagcaaagctatacagctgaggaggggtggaaaaaagtacaaaatggttcttaaaagggacagttactttttaagatttagagcttgagtaattttttagtagattaaatttaaaagacaaaatagtttcttttttgtttgtttggagagaaagagggagttaggagtctgtcctggacatacttaagaacattaaacaaaatatccgtgaagaaaatgtggcaactctattgccggggacatttaaaaccaggtaagacttgggtgtgtaggatttacatccaaaacagtctataataaaaaagagatcctaaatacttgatactagtttccttttgtgtttttcactggtgattttttgaggcttttgcaaatattgaagataattctcaccatttactcgtgtcaaataaaaagaaaagcatttcttcaatgaatcttctttctactttgagtttccaactgaagaattttggaaagccaaccacggacattttgaaagttaatttaccaacagaagtacttttaaaaaagtgaacaatagttgaagtcaaattcaataggctattacttacccctttgaaattttttttaaatttgtaattctcttatttttctcagtggattctgtgatctccctaatttaccatctattggtttcttgcctgcttggcccttttcttttcttttcttttcttttttttttttttttttgagacggagtttaactcttgttgcctaggctggagtgcaatggctgatcttggctcactgcaacctctgcctcccgggttcaagcaattctcctgcctcagcctcccgagtagctgggattacaggtgcccaccaccatgcccagttaatttttgtatttttagtagagacagggtttcaccatgttggtcaggctggtctcaaactcctgacctcaggtgatccacctgcctcagcctcccaaagttctgggattacaggtgtgagccaccacacccagctggcctttttcctcttttatttctctcatcccctaaatcaggatggtttcctgatattttccaacacaaattccttcggagcatctgacagcaggaaggtggctgtttcggtagcaggaataaaaagagacaagagaacaaggagaaagaatgatgcaggcaaacaattcggcaacaggcctccaaaagttcacacactgaggaggcccagaaaagctgtgacttgaggcattgtgaagagacacctaccgcaaaaggtttgtgggtcttaggggcaccgatttcctgccaaccccttgcagaattatttttgaaaaggtgaggcattttgccaggctgaatatggtggctgaataaaggggaaagaatctgggacccagtgacaaatatcagaggttgtcagggagcaagtggtgagttaaaggatgacatcagactatgttatgggcaggggcagagtctaacaatgagctgctctttgggcttcaaaatgccaagtggcgggaccctaggtctgcggtgactatggccaggatcatagaattgatgccccaaaccaggaccctttggagagaaaaaagagggagtttattataattatactggggcaacctgtgtgagctcggactgccctaggcaaatccagacattgctgatccttatcccgaaccacccgcctacccctaaagtctaggagaccaagcttggctgcccttcagcatctcctccaggcgaggctgggcccttagctgtgcttcctcttccccaggggaggagcctctaccaaggccagaagtggaggaagttccgtggtcaaatgggtgtgggaaatggactattcaccctcttaccccttcttgcagattcacaatatatattgtgaattaaagatgttgagaagacctgcagtaaattaaactgctgagcattgtggagcctctggtttccccaaaggtgctggagcacgaggagatctttttctactgaacgtctaggacatgcaggcaaaaactgctttaaacctttggaggcaaagtccagaggcaggtcttggtctctcggaggtagaagcctgcagagtacacgggagcttctagcacccctcaggatggcaccagcagatgttcggctgggtgaggtaatataggaacctaccaaggtacagccaaaaaacctgcagaaacatgtccgaagccatcccacgccatgaacaggaagcctttgtgttcacattaacacaggcaggcctccctagccccactgatccatcccatcacacaaggatggcaataaggaccgcatttgacatccagaaatggtaagcctgacccgaactcagctgagacacagagaacctgtttccctctaagcatttcatccaccggtgacctgaggccatacttcatatatcctgccatttctctggcatgtgtgtaccgaagggaatgctccagaccatctgggcgataaaattgcagtcaaggcctctctaaacaacatgagttctgataagggtggtgatgagtgaccacaaagaccaggagtcaaggcagaggttgtctgggctccaggtgaagctccacgtcacaggctgtggcagggcagtaccgacatgcactctatgagacagatgcagctggtttcatagacacagttctcaaccggattattgcaaaattgtctgagtgcatttccttgtgactggcctattgctgtttctgtttgttctccaagttgcagcctgaaggatttttccaaaacacaaacttatgcaggtctttcagagcatcgcacaatgagatgatgaatccatcagtgggcagggaagccctacagaaaggtcatggtgaagtgaggggtttgcagagatcactgattttcatcaacaaggtccacacttctgcacatgatgcccaaggctccttatgacagaggcgacttcccaatcgctcctcctctctctgctcctaccccctctactacattcacttacccccagctgctctttgatctctaaacacagcattattcttataatcccttgcttttcccaacagtgttcctttgcccataatagccttgtctccctaacaaagtctaaatcgtgtactttaagacccacctgagatttcacggtcttagctaagaagacttcaccaccacccctgcccctcctccacataagccgaatccaagcctcggtgggccggcgtcaccttccttgactctgagcacctgagtgcaagaagctgtcagattgactgctttgtcctcgatgtccaccccagtgcctttcgggtagtcactgctcagttaacgtggaggcgtggactaacacacagaaccttgtaggatcgcatgcaagattcaaacagttttcctcaggcattagcattttaaatttgaaataagaggaaccagaaaaatgactttatgttggagtctgaaaagaatgatcaggctgggcgtggtggctcacgactgtaatcccagcactttgggaggccgaggcgggcggatcacctgaggtcaggagtttgagaccagcctggccaacatggtgaaaccccaactctactaaaaatacaaaaatcagctgggcgtgatggcaggcacctgtaatcccagttactcaggaggctgaggcaggagagttgcttgaacccgggaggcagaggttgcagtgagccaagatcgtgccactgcactccagcctgggaaacaagagcaaaactccatctaaagggaaaaaaaaaaaaagaatgatcaaaatgagtaaaatgtggaaatggaccagggctttacaatcatgtttgagaaaaacaatgcttgttggaatgtatcatcctgtcaactcatttcccaaaagaacttgggaaattaaaagaactaagacactttaaagggacctaaagcccactcccctcaatatccataatccacatgagtctgtcatggagaaggtgtaaacactgggatgggcagttaccttcagctccaagagtagggatttctaagaaggagtaaatacgtggaacgggaagaggcaaggactgaagtaagaaaaagaaaatcaaggagaatgactgcgtctaggaagtcagaagaggaccagaagacttagcaatagtcttggttacttactcagggctgcaagtaaccatgatatccatgtcaggaaggaaggacccagtccaaggaagtacatatggtccaaagagctagggtacgaaagtaggaggcagggaggcagcttgtcttcaggatgtaaagctgaataagcaaccctgtatgtttgcagttccctggttaatttccagccataaaaaatatggcccaagatttacaaaaatatccctaaaacattccacatgcgtctcaaggcggagggtaattgttatgaacaaatccacacaaactcttgtgccaagagcaacaagttgaggataaggaaggaataggaaacatgaaaaaaagggccagtcagaaaccagaatgacagatgtgggctatcctcccctcccagcaaaacaagagggcgggaggtccttacagcacctcgaaggcttatcgcggtggggaaagatccagcacaacagtcctaaagggtatttccatggtggaggatgctctggcggtgcagctgtgggaacatcaggtaggaattcaccgtaaccctgcagaatcttcctttgacatggcagcctctggacctggagggagatcatccaggccaacccccgtctgtcccggaatcccctcctcacgggctccttcctagccagtttctgcctcagcactctcaggtgtgttgacgtataagaaagctctctcccatattgagccaaactcttccctggagaatagcagaagagcaggaagagttgggggtgggaagtgtacctttccctcgagactccctcgggtacctgaagtctaatgtcccaagctaaacatccctcagtccctttactttctgtgacatgagttccagtccgccactctcctggccagtgtcctggggacatgctcaggttggaacagagtggggaactcctgggccaggcctccctccctccaccactctgtagctatcagaagactgttctggtgcaacagcagctgtgtctccatgcacacacacacacacacacacacacacaaaagagtgctagacccttgctacaatgtttagtcacatggaaagcaactccttagctaccccttatctgccccccaccaaaaaattcgtctgaaaagtttgttttgttcctgacaaaaatccatggtgaggatatcaaagtcccttgtggctgccactcggccagtgtcacccttccctccttccttcctctccactttggtccttcctgtgctgagacggagccttatcagggcctctaccccatcttcagttctgtatacagttgtactgttcacctcccaagggtgcccctcacccctagtaagcacggccaaagaaagagagttcacaaagcatagcacggaacactgacaggcgctgagtcaggaaacatttagttcccacctaacaaaatgagatcccaacccacccaggctggaaacggagggaggctctcagcctggtcaaaggggctgaatccctgagcctccaacacctgctcctgggctcctccttcctcttagagacccctgagggcacctcaggtcaggaatccagccacctctttgaagcaaatccaatcccagcccttcaaggctggccatggacagagtctccccacaggggagcagctggaaggagccagggctgttaagacccagctgcatgaaaaaaatggctgcttgcttctgtgtagtgtcttgaagtttactgaccatttttacactgatcatctcatttggttctcggcataatccagtgatatggataggactggagtaatgttaattttccagatgaggaagttgaggcctggagaggagaaaacatgaattccacaaatttgtataacaaatcagagaaagagtttattttagaaccaaagtctctaatctctttctatcagtattgacacactaacagccttaaaatgcacccaccttaaatactttatgcattcagcaagagcccagtgaagggccccaaaagttgagactcaaagcaagcagcccctgtcctgcacttcagccctgaactcacgatggcacagtggcgtcctctgagtacagacatctgtatgagcccagaggagcacgtggccacacactggggcaatgcaggtcccgccgatgcaggaggaacattcccacggatgaccacagtctgcaccaggctgttgctctgggagatgagagaatcagcaagcaaagagctgccggccctgcccagtctctcaggggcaacagcctaggcccgaagctggcaagcgcccaccgcttgggtgtgactcggctgggtgcccagtcctgcagcccgtccaggtctcaattcctggtaacaccctagtgcttcaccctcttgcatatggaagaagagtcatcagtctggctgcagcccaacctcagcagctgattggaacgggagcagaagtcttcactagactaaccctttttccactagcttattcaaacttgagctttaaagctattatttcaaaggactggacatcagcctcataaaatatgcctcttttctaaacaagcacattttgtcatccacaacaggaacacatttagcacccttctaactaacaacctgcaaagaaattcctgatgtcattcagtgtttaccagggatttcctacatgccgtcacacaaacattcaccgacgggctcaccacgggcaagacactgtgcaaagtgggatgtaaagatactagggagaggatttggcttgctcagttcaaatcccagttcttgtatttaatagcggtatgaccttgggcaagttactcaacttctctgtgcctcagttctcgtatatgcaaaatggtgatactagggcctagctcacagagttacaagaattcaataagatagtcacatctaaaagcgctttaaacagtgctctaaatgcagaaagcccttgaaaaatgctagctattattaaaggtatatttttacttattcctttcaatatcccaatgaaatgggaactgttactatccccacttcacagatgagaaaatcggttcaaggcattcaacaagtttgtcaatgtcataatgctagtaagaggcaaactcaagaccctaaacaaggtttgtctgaattccatgctcttattcactgtactgaacaatgctacaatcaacttttcccccagaaaacgaaacacacacacacacacacacacacacacacacacacgcttgcatgtgggcaccacaaaagctcaaatataaatttggaagcttcctggtccctgaaacccctccaccccaccccctgtagagcctatgagagataggtcaagaaagtttgcttcaagaattttctttccccaccctcccccaagtttttaattatgagtaatttcaagcattaaagagagtcaaaagaatagaacaatgaacatccatataacttccacctagacttaacaattcttcacacttttgtgatcataggcttctctatttatatttctgctaaaacatttgaaaattgtagacaccgtaacatcaatcatagcatcacccttctctgtgattgtttgttagagtaaaacgagtcttggtaatagattctatcgaattactgttaatattcttgggtgtaatttgcttgttattatgacaaagatctttattcttaggagcacatgataataaggttaaggatctccaggtaagatcagccttcattatccaggtgggctctaaatccagtgctaaatatctgctaagagacacacaaagagacattcaaagagaaggaaaacaccctgtgaagaaggaggcagctattgaggtgacgcagtcataagccaagggatgcctggggctgccagaagctggaaccaacagaaggcttctcctccagagccttcagagggaatgtggccctgccaacaccttgagttcagatttctggtctccagaactgaaagcaaatacatttttgttgttttaagtcaccaagtttatagtaatttgtggcagcagcacagtcctagagaactaatatcccctagtcacggggtccctgatacactgttggagcaaagcgtgtgtgctgaattgaaaaactgaaacagctgagagtggctttatgcctttttcatatcccacagccagggaagcacctccaaaggccactggactctggctaacaaatatgacaccagaataggtgtcaactgaacaatttgttccttttaatcaggtgttttaaccccactctgtattcattgttctgccctccttaattttactgtaagtgactgaattgacttttgatgtattgccagcacacaataaattatgagcctctctctttaaggttggagaggggaggaactctacttccctgttcagttatttcaggcaagggtgggagcaggttttctgtgccagcagcatcctgattatgattcaggatgtgtggccgaaggcaaacagttcctcttcaaattcaatcaaataggaaggagcaaaggcccaaacaagaaaagcctggttctctttgtgtgcacagccaaggggtcctgggaagctcgtgagggatgacaccctatctcggcaagactgagcatagagcggtattcaagaaattctgcacatattcgaaacgggcttccaatcctggccttacagaaccacattttggacaatacgaaatccactgcaggggaagttatttgaaggctaaaggggcagaggttaactagaattaacgtgtctactttttagtctcttctccctaagaagaaaaaatattctatatgcaacttctatgctgttgattgtgtctccaaggggcccaagtgactacttccacttgtacatacatggtgcaactcgaaacagggatttttcactcagtaagccatgacccattaatggattgagaaatcaatttagcaagagggccagcaatttggcttaaatgaatggaagaggagaggaaatctttgagtacatcttgcatagtaaaagggtaaatatcgtaccacgaaattctccttcagtcttatacagatgctcctcaacttacgatgggttcatccagacgtaacctaaggaccatactgaatgcatatcactttcgcgccattttaaagttgaaacatcacatatggaaccactgtgagttggggactatctatatgtgtttgggtcactggtttgtaatagaaaagatactcctcactgtgagtcatgatccaaaaaagtaagaaagccactgacttaaaagaatagattccaccaaaccagaaagcactctgtcccctcagccaagcccatgttcctgagagcactgtttgcagttacaatagggcactcagttaacagggacaattcaccatgcacctgagaggggttggcatctgaaaccaaggcatgcccattccctggcaatccactggcatgtctttctcctgttcaagcccctccatgcgtgaggctcatcctcttggttcttgagatcctatttcttttttatttttatttttgagacggagtctggctctgtcgcccaggctggagtgcagtggcgcgatctcggctcattgcaagccccacctcctggcttcacgccattctcctgcctccacgccattctcctgcctcagcctccagagtagctgggactacagacgcccaacaccacccccggctaatttttttgcattttttagtagagacagggtttcaccgtgttagccaggataggatggtctcgatctcctgacctcgtgatccacccgcctcagcctcccaaagtgctgggattacacgcgtgagccaccacgcccagccttgagatcctatttctatactgtagtagagcctctcgcagttcacttccatcttgccgggacccactcttcgccctctgtagccctagaaactccacagccttttgcaatgactctgaaactgacccaccacagggggagttcctaaagtctttgaggaagtcattaaccatcttctttgtatttttttactccaatgtgtccaatttctcctttgccatttttccaggaatatggttgccctgtcctccattaagaattctctttcatgcagcaatttgaggactctccgagccttatggtctaatactgcggcaaatgttccacagtgatgtcctgttccctgcagggcctgcctcatggatccactatggactttccaatcacacacagttaaagactgtaactagaggccgggggcagtggctcacacctgtaatccctgcactttggaaggccaaggcaggcagatcacctgagatcaggagtccgagaccagcctagtcaacatagtgaaaccctgtctctactaaaaatacaaacattagccaggcgtggtggtggtgcccgtaatcccagctactcaggaggctgaggcagggagaatagcttgaacccaggaggtggaggttgcagtgagcagagatcgcgctttgcactctagcttgaccgacagagtgcaaataaataaataaataaataaataaataataaataaaaatgaaagactgtaactagagctttctgatctcacataattaggggctacagctaggttagttgaatggtatagaatggagcatgcattttggcatcagcaaaactggatctaagttttgatgctgttgctttgctggctattgaccctgagcaaattgcttaactcttctaagcttcatctgtaaaatcaagataatacccatctgaagggagttgttggagtctactttttaaaaaaaataggttgaagtttctgtgatgaattcttcttggacatcttatgaatggacttccaaaaaaggctttactctttcaatgtttttagaaatctgtagtacccaggaaaaacatacaaaacagagacaaaacagagaaaacatacaaaacagagaatatattttcagaaatgtatttctgaaaaaaatatatggtctaaagagtcaagtcgttcctgccactttagaattacagaaagtaaaaaaagggagggagggagggagggagggaggaaggaaggaaggaaggaaactctacatttgggctgacctcccatgactgtgccacagaggttttctcactcttgcattaacatcagaccatgtgcatcttcctgccagcagcatcgtctggtttggcaggactgcaaatctgtttcagcacaaaggatccgcttaatggaaagcaagcgtgctgcaggaaaaaaaagaaagaaaaaaaaaaacggcactcacatttccttgtgcactctttatcaaaggaacaaatggcacaataacccaacataaccaaggctgtagttgaagaaactgccttttacctctgggactaatctttcttctaaggtggccatggatggtgtggcatcaaaaggcatgcaggtgacttagaatggtttttaaaacctttagcagtgcctctggagcccacaatagaaaaaataccaacacttccatttttaaatggttaaaaacgtaaacagataattcagagaaaaaggaataaaaagttgccagtaaatatattaaaatgtttaagttcactaatgatcaaagacatctgtaaaagtaaaaccagagctccatacactctagttgaatttgtaaatattgaaaaatacaattaatgttagtgtaggtatgacaaatccagcattctctgctgacaagactagaaaggataaacctttctgacagcaatttggcaataattttagacattttataccctttggatagtaatttaaattcttccaatacatcaaagaaaaataatcagatacataagcatggtgacatgtagacataactataaaaaatcctcattacagtaatgtttataatagtgaaaaaattgaccacaacctaaatgtctaataaggaaattggcaaataaaggatggttcatcaatatgatagaatattatatagacatttaaattaagttttcaaaatttgtaacggtatgggaaaatggggtataaaacgttgcaagcagactattccaaattaggtaaataaaggcatagataaaagaaggttaaaatgaaatatactaaaaaatcagcagatgtcatctctggagggtgaaattataggtaaatttgtacttgtctgtatttccaaacttttgaaattgggcatatatagcttttatcattatgtgctctactcactaccatgttatcccagcattctagcaggtggtagggtgacttacggctggacacttagcagtccactctgcatgctggacaatgtgaagaatgcgcgtaccataagcaatcccagacctcaaggggtgtaacacatacagagataaacgatgctaatactcatcttaagggagttgtcggagtctgttgtggaggctgctggcggggccgacctgacctaccgtaacttccccgttcagctgctgaatgttggctgctggcagctcacagctgagtccctctccaggtaatatataactccaaggctatatataattatgatctgcacagagccttgaacatagtaggtacacaataaaccaatttcagtaacagatgaacaaaataagcagtaaatgctactacaatatgacggacaagaatcctatgtcctggaggagagaaaagaacacagttcagggaagggtccatagagtggctggtactttcattggagcttaaaggagaggctaactgtgtgcatgtgtggaggagaggggaggagaggatctatggtagacataggtatttctcatgggcagaccagagatacttactgtgacttcattggcatggtagtgtctatgtgctcatttcaagccatgttagagcctccctaaatgtttatctttttgctgcagcagcaagaaacaaatggaggcacaggactgttgggccacacagcaagtagcatttgctgttcaaggcaagaaaaatggcctctgcatgtccatcccttggtcatgatttcatctgagtgctgactgtggtggattctgaggagctagtcttactgaatccccctcatggatgccacactttacatgtagccagcacttccagatacagcctcttgcttaatctcctaccatcccatgtagtcttctcagtttacagtaagaaaatggaggctgactggagtgaaagggaagtttaaactcacaactgtctagtgataaaaaccaaagcttcagtttagtctagtgcttttcccctaatgcaagattaagctgtgataccatcctggaaaactactcttctcaaaaaatgttgcctatctcctcctttttacattaaaataaacaaatgaacccgtccaatcctgtgcacatctctcttgttttgaggtcactgtgtacttcagcattttggggtgtcagataataacacaagtaaaatataaaaacgtggtagttaaggattttcaaaaggagtgatcagaattcactccatacatatattaatggtccttagtcaattcccctttacttccaccaaatttccatagaaatctgtgagacagaaaagattaagagttattgacagagaactgcaacataacctgagtgggtttgtctggacaccaaagtctactctgagcttctggatctctaggggaaaatcaacaagtatttattgaaagctacaaaaaaaatatgatactcagtgattagtggaggttttcatgtaatctgcaaggatttttataagcaaaccttgtagataatgatgaagcaagaactttctattagaaaacaactctcttattgccaaaatataaatatacacacacacagacacatatatatcctaagacaattggaagccaaaatggaattggcctcttatatagtcaaccctgtgcaacaacaaggcaagaagtggtcagaagacagggcatattctagtaagtgggcttaatatttttagagaattttacaaaaattcataaggttgtattcatttattttctgttgctatcattgaatacctgagactgggtcgcttataaataaaagaaatttatttcttacaattctggaggctgggaagtccaaaagcatggtgctggcctctggtagggccttcgtgctatgtagaaggcatcacatggagagtggcaaagactatctgtgtcagctcaggcctctcttcttcttcttataaagccaccagccacatcatgggggccccactctgacaactttatctaaccctaacaacctcccaaaggccctatttcttttctttttttctttttttttttttttgagatggagtctggctctgtcgcccagactggagtgcagtggtgcaatctcggctcactgcaagctccacctcccgggttcacacccttctcctgcctcagcctcccgagtagctgggactacaggcatctgctaccacgcctggctaattttttgtatttttagcagagacagggtttcaccatgttagccaggttggtctcgatctcccaacctcgtgatccacctgcctcggcctcccaaagtgctggaattagaggcttgagccaccaagcccggcccaaaggccctacttctagtcaacataagaatttggggattatgtttccaacacatgaaatttagggagcacattcaaaccacagcactggctaagaaatctaaaatactcatttaaagatggaaaagctgaagctaggagaagagacttgacccaaatatatttgggtaactagctttagtatctataccaacatcctggaggaactcatcaagtattgacaaaaaaggttctacatgatccattgttttaaaaaagagacagagtctcatggtgtcgcccagggtgaagtgcagtggctatccacaggcatgatcctagcacactgcagcctccaactcctaggctcaagtgatcctctggcctcaggctcccaaatagctgggactacaggcacacaccatgtacccaaccatgatctatttttatgaataaaaaacttgtggatttcacattaacattcaaatatttcacttgctagaaagatgacgaagagtttagtttcttagctgtatgaaggcttctgcccgcctgacctgatttactgtgttaatcaacccactatgtctttctttacagataatgttatggtgagtgcctgcctccttcccaggtattaatatatttttctaaattctgaattaacgagatcctaatacataaagggatttatcagagaattcggtttttggttttttaaggtttggaggggttttgttgttgttgttgtttaatccaggggttctctttctctcatcttatttaatcctggataaaagttaaaaaaatcctgcatacagctactgtcacaaagccagctgaatcaaaaaaccttccccacagcctatatccctcctctgagtggttggtctgaatttctagagttaaaagatttctttctctgggtcctttgaaataaccgtaattaacacttacgtagaggcttatgatacaatggtatcgtctaaaacaggagtcagcaaactatgtcctgcaaaagattagcagttgcaacagagaccatatgtcccacaaagccaaaaatatttactggttggccccttacataaagtttgccatgccctgacattcactatcacatggatcctcgtaagcacctaccaagaagcttcttcctgttttcatagccacaaggacttcaatatgaacaagtattcgaattgacttctgaaacactgcctgcgaagaataccaacttaggggtggaggggggaaaggggcaggggacggtagagacgaggattagaaatttgaccccagtaaagaaaattagccatatggagagaaaacagagaaaaaactccatgctctcctactgaacaggatgcccaaatgccaggactgttgttccacaagcctctccccttccccacgttccccctaaatatcctcaggcttatacagtggtgtgttgaagccagcttgtgtgctcatgagaggcaactgtgtgcatcgtgttcgggctccacgttcagtgacatcacattggtagtttgacatcagccatgataaaagtatttacaccacaaaaatcagcaaaagctacaaatcagggctttcccccgccacccgccccctccctccagggctgactgttaaacatttcctaccacaccacagcagatatgtacatatatacatatgtacatacatacatacataatttcacataaaaggcaccatgtcatacatggtattttccccttcagctgccaaatgttagctgcagacagctcacagctgagtctctctccaggaattgccctaagctgaagggaactgccgcaccccaggtctgcttccctccctagggcaacctccttgcaactactcctcaaggccaagataaaaagtgaaaaggccagactcatcttaatgcagaacaacttcagctccaaagctcctccgggttcagctgggacttctgttgcaattgcattagagagagagggagtgagagagggagagagagggagagagacagagagagagaaaagagaagagagaggagagaggagagaggggaaaggggagaggagagaggagagagacagagagagacagagagaaaagagaggagagaggagagaggagaaaggggagaggagagaggagagagacagagagagagagagacagagaggagagacccatttgtccacaaccaacttctctcttcatctcccatcttgagttacctatttcagttcatttttgatttgcttaaggttctttctggagtatttttctcagatgggatacctggataatatacttttctcttttcagtgactttattttaatgagttttcagacttacagaaaggtgctcttcagatggggctgtgtcactggtcaaccatcttcactgtggagtcctagtcactacgattttgtgttgcatatcatgaagattcattcaaattgtctcctcttcctttccttcataataggttacatggtctgaaagtacatccctccttctctagtacattgtattcaaagaggttgctgctgcttctccattgtcattaatcttctcatcatcttcttattcctcttagcacagttggggcataatatgttatcttctatgcctggggatgggaaaatgcaggcaggtaacaagaagagagaaatcatcctcctgtgagtggtaggcacccaggcctgatctgcatgaaactgcaggtgtacccagctctttgtgtctgctgagagacgtctgccatggaccacacaccacctgacatcagaggtttgcatccaaaaggcctcaacagaaacaggaatggaacatgaatttacagcctttggctgaacagctcttgcaccaattcttgcccatgatgccaacatggatgcctgcactgaagttatcacttcaactatattagtctctctgttctttcattcatctcataacttttctgaagcctcttgctctctcggtcactgccttgtgttttctcgagcatcgctgtaatctggtcttatgtgatgtttcaggcgtatcttgctgttgttcagggaaagcacgcctacggagcctcagataaacttctattttcttgccattagcactcaaaccaagttgttgacaccagtcccgctaagtgtcccgacacaccttattaatgggaggcaaagtggtcggcaagggaagggctggtattttgcaccagctttttgtggagctgtaaattgttcatgtgtttgaagtgatgaccttgattatatttcttaggcttctccagtttgacatcagaagttgaagaaatacttggttccatttgttccatatttgggtcatctttaactggcaccagtgtcaaaatcacacttccctcatcaactacttcccccctcaaagaaattcttcttgctgctatccaaatttgagtctgacattttcagcaacacccctgtcttgtccactcagtgatacgatttttaaaaattaggccgggcgcgatggctcatgcctgtaatcccagcactttgggaggcctaggcaggtggattgcttgagtccaggagttcaagatcagcctgggaaacatggcaagacccccgtctctaccaaaaaaaaaatataaaaattagacaggcactgtggcgcgtgcctgtaatcccacctactcgggagggtgtaacttttctttttcccctggccagcaaaaggtattttagctggctcaagtattttatagacctcattcccctatttccagcttcccgttattataggtgagaagtgtgacactgtctcttttctgtttcttggtaattaatgtttttctctttgtattaaagggtgcaaaaggttctctttttacctgctattcaagaatttaatttggatgggtttaggtatgtgactttcaggaaccccacgagttctttttaaacctcagacccaagtctttttcactcaaagaaattaccttctatcatttatttaatgattctctctttcgtgtgttcatttttctctttctcttgcaactcctattaggtctcctggatctagcctcctagtctcctcttttgcccttaagatttccacctctgtgtttttgttctatatttgggatattcttgcacttggccttctcagcctgctttaatgtatccaatgagtattttagtcaaagctccaggaagtctgtgtttctttgtttttgtttgtttgtttgtttgggatactgtggttgaatgtccttcttgcacttctgccctggctgtctattccagcagtgtgatttccatgaagggctgttcggcggatgcttcctctccctctcactgcccactgaggccctgtagatgcagagttgtttttttgtatctgttctttgaagttcaaggccagcttctgggggttctttcagtgatcacagtcctgtgagtggtgggagggatggcccctgtgggccattagtgtagctggatataaggggtcagtcccaattaaggcacgggaaggaaggaggcctctcagtcccaccacgtccccacgttcagcttctcttcagcaatctgagaccaggaaagcccattcatgaatgccaaggtagccctttccatgggtccacgagtctaaaggaaccaagcgcagggcctgccacaattacagcctcatccccaagctttccacccactgatttacagaggagaaatcccctccccagctctcttcaccgggccaagatttgagtagagggccgacagggcaccatgtaatgaaaatctctatctcgcccccagccctttcatagacatccaggacaccctggatctactgtccctggcaaatgcctccttaacttctgagatggtttaactctttgttctccacatctcaaatccaagacaccctggcgaatgcctccttaacttctgagatggtttaactctttgttctccacatctgatttctttggatgagtcattcaaagttatgtgcattaatgacagatccttgaacaattagattcactttaaaattgtgttcattgggaaaacaactgggtgaaaagggcagattacaaagcacgtgtgtgtgtgtgtgtgtgtgtatctcccacatacacggatatatcacatatactcagaaaaatgttggcatggacgaacaccaaattgttacctgtagatgatgaagttataaatacttttattgtccgcctttttcttatctaaattgtgtaatatttcttgtttatgaaagacaaaagagcctgttcaattgttaattcagcaaaatgcattacaaaatgtcatttgactcttacaggtattttcagagggtgtgaggagggagatggcaactccacctcttcgtctcagtgtctgtcaatgagagcccaccttgagagccccacgctctcagcaggctcaccaggctgttagtaaccggtagagaaaaggaggagcacagacagaagcttcctgcccagagtcacccaggacggcccccgcccaaggatggaccccagcctggaactggctccagaagcaaaggttagacccctctgatttcccaggtgtccccagttgtctagtgctggcttaaagaggctggacagtctctcagagaagaaccatttccaggtgcctgctgagtctccagcaccaggcaccagcacttagcagccactcgggaaactggctgaatgaatgatctcacagcctctcggttcacttgataaaatcagacacattagtagctgtcattgcttactcttgggccgtctttggatttgcaattccatctaggtgaggcgtcaaaatttgagttgtataggaagatttcagctcaacaaaaggattcacaaaaggatttgtttaggaagatttcagctcctgctggttcacacaagaggcttcctttcaaagagctgaattccctatcagtgggcatggcctagaaggggctggctatctcctgtcagaggcgatacggaggagttccgtgctggctatgaagagagaccagatgtgctctgagcatccctctaattcaaactctatgacagatgcaattcctggttcagaaatcttacgcaaatttgcctcttccttccaaaaatattcttcaaccctgatgtcattcctgtgcctattaaaactctcctttgaggcagccaactatgactcaagggaaaggttgagtgggtccttgtggcgaccatgagagcagcaggcctccctgacccaagaaagcctccttggagcaccctggactggcctgggatcagttaaggagagttttacggaactgtgtcctggtctgctccacaggtatttgaaggaacaaatcccaaggaagacatattgtaggacaggtgatatttaaagtattaaccagagatacagaagcactagccactcagaaatgttgtgacaccagagacatgacacagagcaggatctgcaggtcctctgcatctgcttactggattgtggggaggttccagggtgggggccgggcagccagtgcagcagggctgtgcttgagaagctaagagcagcagccagttaccaaccggttcagaaggctttcaacagttgaagagccagagtggccacaccagctagaaatcagcctggctctccaaccacttctgagcaggctgaccttctggcagaggctgcagccccgttcctgcaagccacattttatggagttcttttattagtctctcatgtaacccatagccacatcataaaattaaacaccccattctgtacatcaagtccactgacttcttgagccctgattagcactgggcttttccctctgggagttctattaaagtaacattgtaacggacagaaaaggagtctttgctaggagcagccaaatccgcagactgactgagcttctgctggagtcaccatgtggcacagcgtgtcctcctttatcggaagcgcctttgccagcttcctatccatcgctctctgcctctttcattcctacccctccccatccttctgtggtaatccctcccccctcccaagctccttccatctcctaagatgacttaatgccatgagtggttaaatgcttgcctggagtcactgtcagggtagccccaactcacccctgagaatatatttagcctgtgggtaatcgcccagttggagaggttatctttagcctggcagaggttgggagtcaatctgggccatgatatgaacagcagagggaggagggaaaggaaaggaaacgaatactccagagtctacaacagcagcactcaagtgtactcaggtggtggagaactaaaagtcgaagtgtgcttcctgaaacctgaggctcttccgggaacaccctggaataatggtctgcttcattccatcccatgaactaagaacaattttaatagcagaaaatatggctgcattatgagcagacagtataaaaccacaagcacacatgttctttaaaaaaaaaaaagccacaaactcagcatgattggtggttttcaagctttcccattcatatctgtttactacttcttcattagttttgttgcctgcaggtgctaaaggtttaaaatggaagaacatgcatggaaaaaatttacatggaaaaattatattacctgagttagggaaaagaccactactatttgattttcaaggtggaacgcctcagtccacctcagaataccaagggctgagcttgaaaagctccaggacctatttctaaactattcaagaaagaccgtgcactttccctcagggcacaggagtaactttccttaacatcgtccctcctttccactcactaaatcttccctgttattgtttatatccatggcctcttggttgaccttccttatagaacaatcgattagaatattttttcaaaacaactgaatactcgctagttacgattagagggaacctaggtcccagtgtgaaccaaggccaagaagcctccgggggtggggagggactcgctctgtagggaaggagacccgccaggccctaccccagtcaaacagtcctgctctttggaggggaagagcagttcattctgagcgtccctcggccagacatatccgagttctgtgaagagcagcaggaccaaaagggaaattgggaaagaccatcttgctgaggtctttcaggaaatcagagcacagatggtagagctttgggactgaaagctcacacagagggaagagggttgaataatcttttttttccccccagattccccagagctttcactccagggtgccagagggtgcccggcaggagcaggcccctgggaactcccaggacaacccagaggcagtccagacagctgggagtcctttgctgcgggcaggctccgggtacagtgcccctcagaagatcatccctactcaggtggtgaggcctggggaaactcaagttactttaccatgtacttcaataagtgagtcatctcttagccttttcttccctagattgaatgatgctcgttccatcaactggtttattaaacgcaccctttatttcgccattatatgagtgcattttggtcctctgttcaactagaagttaccttatttgtctctaccagtgtacacacagtaaccaacaagtcggacatttacgaatactttaacaagaatcgacccaacaaataatttccagatctctatcagttatgctccttaccatccatcttgacagtgtactggcacttactacaatggcctaacatttcctatatcatttgtgactaaccgtgcatccttagatcatttttccaccacccttgagtcagactagcctttttccaggtaatatttgagatatccaaattttattactccacacttttaattactgaatgtcattcagaatgtgcaagagtagtcttctagttctcaagttcaatgggccttatatcccttttccagagtgccaacaactgtaacaatgtcatcaacacctgcaactgtattcagttcacaacagcctcattaagtcatcataagaaaaaatagaaatattgcatatgcatgcatgtagcatctctgggaaaagaaacttttaatgacggctgcacctgcggaaggagatgagttgagaagttgatggtgggaggcagaacgttcactgtatacgtttttgaatcattttaatttttagatcatgtgcatgtattactttttcaattaaactttttaaaaactagctctaaacaaacaaacaaaaaataacaaagaaaaagacacagccctgatcccctgggcactggccctgacggctgcctagagttgatattataccctatggtgtcaaatgtctcctgtgtcattggccctatggaatgcctcactgaattcaagatggactatgcagtgacctgcctggttcctggccctcacagccctctccccaataactagggcaacatgacttccgcttgttgactcaatgctagacccaagccccaggactaatcctgttcccagtctggagagatttgacgggctagcagcttgggttactctgtctcaacccacctggttgctggcagtgtcctgctcttcgtgctgtcttggcagagagtggtccagaccttgtctggtggagacacacatctccatttttagcttgcttgattgtgaaatttatcaaggggtaaagaggagacaagagatacctattcgatcacagccttcccactctcctccatttattcaccaaatgcggttactaagaaccttctatgagtaggatactaaaccagcctgggcagaagcaagtaagaagcaaatgagtataccagtgctctccaggaactcacagtctagtaataaacactaatgggctgggtgcagtggcttatgcctataattccagcactttggggggtcaacttgggagaatcacttgaggccaggagttcaagaccagcctgggcaaaagagtgagacccatctctacagaaataaatttatttttaaattaaacttatttatttatgtatgtatgtatttatttattttgagacagggtcttgctctgtcactcaggctggagtacagtcacaggctggaatgtgatcagagttcactgcagccttgacctcccaggctcatgcaatccttgcaccttaacctccgtattagctgggaccacagacgagcgccaccatgcctggcttattttttttttttttatttatttttttttttgtagagatgggggtcttcttatgttgcccagactggtctcaaactactgggctcaagcaaatctcctgccttggcctcctgaagtgccggtattaaagatggaagccaccgtgtctggccaaaaaatttttttaaattagccagaggccaggtgcagcggctcacgcctgtaatcccaacagtttgggaggctgaggaaggcagatcacctgaggtcaggagttcgagaccagcctggccaacatggtgaaaccccctctctactaaaaatacaaaaattagctgggcatggtggcacacgcctgtaatcccagctactctggaggctgagacaggagaatcgcttgaacccaggaggcggagcttgcagtgagccgagatgacgccattgcactccagactgggctacagagcaagactctgtctcaaaaaaataaaataaaattagccaggcatggtggcacacacctgtagtcctagttacttggcaggctgaggcaggaggattgcttgaggccaggaggatgaggctgcagtaagccattatcatgccacggctctccagcctgggtgacattgtgagaccctgtctctaaaaaataaattaaacaaataaaaaataaagactgatggagtccaactcaagaactttaatgcaaacaggcaggtgtgagggaagagagaggaaaggattgctttcaatcaccggcagcaagataaggagcagtccaggaaagttttcagaaggggatgacattgctattaagacttacgagctgaagggaattcagtagctgcagatagagcctttcagatcgaggaggtggcccgcgaaggggattccactgtcacaaaacataaaggctctgcacttccgttccccactcctcggagaaggagggtaaaacacgaaggctctgcacttccgttcccccactcctcggagaaggagggtgagaagagctgggccctcagaacccaggaccacataagaagttttttctgtttaagacagccttcttctccactatttgtctggtaaatacctcgtcttcaagccccagcctaaggacgcctcctccgggaagcccaccatgacttttccaggcagggttagttgtcctgtctgctgcactcctactaccctctgttctagagagttagggaaatttagaagttaggcaaacaggctctgccaccattctgcctgagttcaaatccttgctcagccactgcgttgctgagtcatctgaagcaaggcactcccctctctgggcctcagttttaccatctgttaaacggcgtaacgatggcactgtcctcctgaagtcaccgtgaggatgaaacaaggcaatgtccctaaaccaagtgcctgccgtagtgtctgctcttgttactcataaccatgggctgctcttactggacggtgcttgtgaccgcaagaaccctaagggccagggctattcatctctgaatctctctctgcagtgtttagaggtgctgtccacaagtcaggtgttcaatttctatcttctgaaggactgaacaaaacatggctatgaaaagggacaaaatgaatcaagccttaatgcaaagacacagtaaatgcaggtgaaatgacgggaaaggagaaaggaatgtaggaaagtaaatgggggagaggagacggtgcaccgccttcagaggagaaaaattcctattaaattcctgttccgcctgtaatctcagcactttgggaggccgagttgggtggatcacctgaggtcaggagttcgagaccagcctgaccaacatggtgaaaccccatctctactaaaaatacaaaaattagccaggcctggtggcaggcgcttgtaatcccagctactcgggaggctgacgctggagaatcccttgaaccccggaggcggaggttgcagtgagccaagatctcaccactgcactccaacccggacaacagagcgagactctgtctcaaaaaataaaaaattctcgttcatctcttaacgtggggacttgcccatttatatttggacggtatttttctctggctgtcccacttcccggggccttggagctccctcccccgcagggcggcttctctcctcctcctccctcctccctcccgctcccaggggaagggccgcggccgcagccctgacctcgcctcccacgcgggccagcagccggccagcccgcgggcggggcaggaagggggagccgaggctccgggcacccgagatccttaactgcagcttccaaagccctggctgatcctaatcagtgtgggaaaggagcgccgggcccagcccgccggccggagacgccgcctcttttcataaactttatcgccgcggtgcacagccgctgataaagcaccataaataaacgagcgggcgggagtgcgcggctgtctggaggctgccggagcgcacgccctgcctcggccctgcagctcccgggggaaatgaatcacacgccgggctgcaaagagcagcatgttctcctctccagaccaaggccgtaaataataatgcgttctttccctacgtggagaccctcaccttttgtcttgtgcattccgtaaaaagctcaggagtttccttccggctgcctggcctcccctccttgccccggggggttaggagtgctctgttctgacttaggcgtttccctagggtggagctcctgggcctgggttgggcctgggcgtgtggctccgtgatcgt

SEQ ID NO: 342 - DNA, 52469 bp, Homo sapiens
aatagtggtagtgatacccatgtcacagctggctgtgaggactcaacgagttaatctagtgaagtcttagagagggtctggcctatgggactcccacatggtcatccattcaggtgggatggctgctcctagagggctcccttcaggggcggccagaaccctgcctgtgtacagtgaaatggtgcagggatgatctctttacagcgggcagtggctggcaagaactgagctccacttctaggatcataactgagccctattcctcactgtctgtcacaggggccgtgtaggggcagcaggcagctggtccctgggcttcaaagccagcccattcctagagcttctcattccactggtatggggtgagacccaggcattggtaattatttcaaactccccagacaaggctgacaagcagccaagggtggagaccaccacctctggcctgggagaccaacatgagtgtggtgatagtgcctggcagagaaccagccaagagaggtcagcaagaccaggaaacacaggcacctgaggaccccagaccctcaaggccaccaaccttgagcaggcagcaaagggtggcatggagtctctggctgccaattcctcattcaattattccacagatgtttactatctgcctggtcggtgctggggcctgggcaaggcccttgggctccagaaaggcgagacgcagttctgtccttcaggccacaaggtctagtgggggaagcagtggcagtccagaataagagcagcagctgctggggcacagtataccctgagagagctagagctggggatcacggggcacgtatacggatttttgacattgacactatactgaacatactcttagcattcgtatttttcagcaataacttcccaccttaataaacagtcatgcacaatacgatttttcaaggccacatcgtatcacaccacatgggtgctgtaatttatctagccctccctctgctgctggatatttagttttttcagaggcatcactgaggagggcttattttccttgcacaatgagatgcacaaaggtggcagcaggctaccgctgatgttacagccgtgtgtgctgccatccacagcccaggctccctctagctttctgcccctcccgcctgaatttgtggcttcctcgttcttgctcagagaacggctgttggacttccagccatcacatccacgttgcaggcaagaaaagtggggagagagaagagcagagcatgctgcctgctgaaaactcccccctttaagcaagaaaaccatacagttgatcctgcaaggacatgctccccactcaccagggcccccttccctcccccagcaccaccacacccctccttggcacaaccagggatgggaagcccaggagtacagcctgggcctgccacctccatgtctcagggggcaagaccctccctagagctgcccacaggccccctccaccaggcctcaggcctggagaaagaaacatggccagggccatgtctaggcccaccctagttgcaaaggagcccagaaagtctagcctttgctgggcacactgctgctgccctgaagagagctggaattgtattaggaaggagggtggggaggaaaagcaggcacctaacaccgtctgccaccttgatcctatagcacaacaaactgaatgccttattgtggatacgcagcctgggaggcagtgggtcccccaggcacagattatcccaatagaggttagctgatgactttgccagaaatgtcttggcgaggattcaaacaaaagaaggaaatcaagaggctccacagctctttttggccttagggctttgggggaagagtcccacacccttaattaggttattctataacttgagtttaacggagaaagtatgatgaattggaagtcacaggttctaacctcactctacctctcactgtgcaacctgtagcaaattcttaaattttctgagcctcagattcctctgctataaaatgggaataaagtaacttacaattatttgtgattaatatgtgctggacactatgtgaattatttacatgaattatcttacttaattctgacagctctatgagatggttgttactatttcccccattttacagacaaaaaactatggcacaaaaagggttaacagtgaaacaatgctcttccccacccccctcaagcattattgatgtatagttgacagataaaattgtatatttttaaagtgtccaatgtgatgatttgatatatgtatatattgtggcatgattcccgccatcaggtgagttaacacatccacatccctcacgtaggagggaacatttattgccactgcagcctcctctctgccagaatctggtggagttaactgtgacacacatgtgaactgtgacatgctttacaaatagtccatgttggagccttctgtgctgccttaggactgtagactagaagaaaaataacaaattcacttattcatttaagaaatattcctcattcaactgctacactccagtactctcttagggcagatatcagtaaccaaacagaaaaagcatttgtccctcaaagagctcacattttaggcaaggcacggtggctcacgcctgtaatcccagcattttgggaggctgaggagggcagatcacgaggtcaggagatcgagaccatcctggctaacacgatgaaaccccgtctctactaaaaatataaaaaattagccgggcgtggtggtgggtgcctgtagtcccagctactcgggaggctgaggcagcagaatggcatgaacccgggaggcggaggttgcagtgagccgagatcgtgccactgcactccagcctgggcgacagagccagactcgtctcaaaaataaaataaaattaaaaaagctcacattttaatgaaaagagacacagaggaaacaaaatcggtgagtttatgttgatacatacttgatagatggcgatacatgctatggagaaaactaaagtagaaaaggagagtgttaggatgactaggggctgctattttagatgaagaggtcagaaaaggccccttctgtacaaagcggacatttgtaggaagcaagggagcccattacatggacacctggggaaggtgtcctaggcagcgggaacagctggtgcaacggctcaatgtgggcacttgcttgggatgtttgagaaacagcaagaaggctcaagtggctggagtgcattggtggattgagtgagccgagggtggggagaggaggtcagggggcaatagggtaggggctggttaaggttttgtggccactataaggatgtcagcttttgcttgaggaaatgggagccaccagcgggttctgagcagaagggtgacacgatctgatctgctcttaacaggatcactctggccactgctgagaattggctaagcaagggggcaggcaggaagaccagttgggggccatgcaataatccagctgagagaggtaggtggcttggcccaggtggtcatggtgagtgggtgagaggtggtcagattacggatggtttttgtttttctttttgatatggagtctcactctgtcgtccaggctggagtgcagtggcgcaatcttggctcactgcaacctctgcctcctgggttcaagtgattgtcgtgtgtcagcctcccaagtaactgagattacaggtgtgtgctaccaggcccagctaattttttgtatttttagtagatacaggtttctctatgttggccaggctgatctcgaactcctgagctcaagtgatccacccaccttggcctcccaaagtgctgggatttcaggcatgagccaccacacttggccagattatggatgtattttgaagatagatagagctgataggatttactcattgattggacaaagggagtaaggaaaagagagagagaagtcaaggacgactccgaggtttctgggtgtgagcaagctggaggaaggagttgtcatttactgagagagggaagactatggggaatgaagatttgggagagaagatcagacactcagttttggacatactgattttgatcttctcattagacctccaggaagagatgttaagcagacaatttgaatacacaagtctggagttcaggggaaagtctcaggcctaagatataaatgaaagggtcatgagcatataaatagtattaaagcaatgacagtgacttagtttaccaagggagtaagcacagaggagacacagaagatgtgccagtactgagccctaggtctttccagtgtttggaggttgaggagaccaagaaggcacagccagagaggtgggaggagaactgggagagggcagtgtcctggaggccaagagaagaaaacacagatgacttatctagaaacagccataaaagctttcaaaaagttaatgccctttaactaaaaaatgcgcttcaagaatacattataattaaatactcctgactgtgcacacagattgatggccaaggatgttcttgacagtgtgggttataaaagtgaaaaacaaaaaaccacctgaatgtctaacgatggggtcttggctaaataaattaggatacatccatgtgatggtatagccgacagccaggaaaactcactttttttttttttttttttttttttgagatggagtcttactctgtcaccaggctggagtgcagtggcacaatctcagctcactgcaacctctgcctcctgggttcaagcgattctcctgcctcagcctcccaagtagctgggactacaggcatgcgccaccacgcccagctaatttttgtatttttagtagagacaaggtttcaccatgttggccaggatggtcttgatctcttgtcctagtgatccgcccacctcagcctcccaaagtgctgggattacaggcgtgaaccactgcgcctggcctgaaaactcacattttgtggaaaattttaagactcctgaaagatctgcatgcaggtttgtcttcatgatctattactaagtgaaagcaagctggttacaaatcattacagtcaacaaggtctctgtatcagtcagttaagaacatgggagccactctaggcattgcaagcagaaagggatttagccctgggaattagtgtatacaaaggtgtggaaaggctggcttggtttctttgctagcttttagggtgttaggaagttgctgaaaccacaagatacctgagcctctagcaccaaagcaaagaaaatgcctggaggcttctcaaaaatctcctatctgctgaagcccacacagctgcccacagctgccaccaggaaaatattatgatttatgcttcttttccatctgccaaatcttgtgaaagtgcctctcattggctggcgaggattctgaggattgtagctccctggcttccagcccctgctggccagggaagcataggttaggggagagaaattatatcaagttgccagcagataatactgcacactttacaaatatttccttacaaagataatgtgcctggagaaaagactgaatgcataaatgctgtggcaggccaaataacgtctcccaaagatgtccacaccctaatgcctggaactcgtgaatacattatgttacttgtcaaaagggagtttgcatgtgattaaggttaaggaccttaaaatcgggatattttcctgggtcatccaggtggaccccatctaattgcatgagcccttaaaagcagagaacattctctctaactttgccttctgccgtatctcccatcttccccttttgccacatctctcctttgcttctagcacagtttggaaaggatccctccaagtctgaggatcgctggttctagggaggggagggcaggggctgttggtgtccctaagctgctaacaccaggtggtatctgtccaaagaagaggcttttctatggaaattgcattgtttttccaaaaatcagtcatcttgccctcttggctcagcctcatacagcacatctgggatgcgtttactagaaacttcccccggaggcctgagcctggtgcagaaattgagaagactggaaatgagtaagactcatgccagggcacttaacaggatccaccagtggcacctacttttccacaggaagccacacaagtcaagaatccaccatgattttgcaagatggctccagggaaagccctcctgggttgtgcctcaaatgcccaaagggctcctcattctgccatgcaccccacctcattctgaaggcctagccctcattgtgtgtgcacatccaacctccagggcccatcttgcctctttctatccaagtccctgcctttagtgcctgcccagggtcctggatcccccaaggctgggacccgccttgctcttgcctttcttgtcagaagctgtacttctgtccttagccccagtctgatggcaggagacccttcctgctgaccagtcttcccactatattcccagtctcccatggctgggaaatagggttggcttcagttgtccctactgggatgcaccaaaagtagcaggaaaagattcaagaaccctttaatgctcacagcttcgtcagcatccagacgtcgttcagtcccctgcctccagagcagggtgtccaccactcactcttgctggcctcctgtcaatggctgaccatgctcttctcactttgcctaaaactcagtttacccccacacctgtctatatgctctattttctctcctgatgaaagagcggagaatgtgtctatactcactcaggtatacaacacagttacaaaaccaccttccttcctcttaaatgactgcattaattaaaggtttgtaggcctggaagatgctaaggttctaggtcaaggaatttcctcttctgtgctcctagagctgacagttgtaaggaaaggaagggcagctcagggaggacatctaaagggctctcttgtctcctggttacctggcctcagcacatcgcccacaccctctgccacttcaatccctgcccagaggggacagaggggacactggaaaatcccctccctccctccctctaaccctctcctctctccaacaagccctgggcacagcaatgttcacccaagagtgatgctgaagtcagccaggttcctaagaaagggtcatggccagaggacttcgaaactgcttcaagaaatggagggagggtgcggtgacttcatatgtttaggaccaaagaacagtcctagggatgctggaggagataggggggaggacgtggtcactgctttcagaagctgctgcatgaaggctgcatgctgcaaatgttaagaaatagccatgccaggctgacatcttcctgacctcctgccaccttcagggctctcctttagcctccctgtcctagtgtaagagtagccacctgtgcctgcattgagtccactagcctgggagaggcccaaagttctggatcatgcctccctcaaaagactggggctcaagatagtcctgagggtgacagaggtgcagggcttcctcagggggcaagcagaagagtcctggttttcttccaaggacccctgccccctgctgttcagtcctctccagcccccagggcttctcaaccccctgctcgtctccacatactctgtcagccttaaggaggctcttgtggatcctcattccttcgggacaggaggccaacagctatgtcctgagcctcagctcttccctggccatgcccccgcctcacacctccagccctgattttgtgcctctgcttccaagggaggaagatgaacgacggaggaagttctgagctaaggaagggagtattgatgaaagttgtgttgacaaaagaatgtgtcaagactaagtatgattctttccagaagtacaagaaagccaaattctgggaaactcaacataacctactatattagcatgtaaaatagattaattttcccaacatgtttaatggggagactctaaaagcagtcccgttaaagttgacgtcagctctccccataaactatcaccattagtatttaatattgttctgcaattacttgacaatgcagttagatgaaaaataaaataagaggtataaatattgtaaaaagaaagcagttattatcattggatgatattactctatacttggatattccaagagaatcagctaaagaacttttagtaatatcaggaatttatcaaagtggctagtttaaaaacaagatttcctaaatacaagaaataactaataaaagaatatggaaaaacatcccattaataaggttaacaaaaacctaacataaaacacatagaaaaaatgtgcagatacatggaaatagctgtaaaagctaaatgagggacatacacatagacttgaatcgatggagaaagaccttttccttggataaaaagtcagtaatattgtaagcatgtcagtgtcaccataattaaactataaattcagcatacttctgtacaaaatatcagctgcttttgggggataatttgacaaaatgattacatacaaattcctctggaaaaataaatataaatgaatagaacattcctggaaggaaaaataagtaaactaacaaggaaagagtagcactataaaacatttttcaaaaatagtatacagctacaataattaaaatagtgtgggactggtgcctgcatacagatcaattggaaagaataaaacaattttaaataggcccaaataaacatgagaattcaattcaataaattgagatactagtcagatatttggatcaaaaataaataaatctggattcgctacatcactcctaatatggacataaattccaacaggatcaaagatttaaagaaaggaaaacattttaaaaatagtcataaaagtgccagaagaaaatatgtgtaaatgttttcgtgaacctgggatagcgattttcctagtcatagaacaaaacagaagtcataacaaagaagattaacaaatgtacctacgcagacattcaaggaaaaagctccataaacaaaatcaaaggacaaaataagagaaaagtacctgcaagatgtatgacaaagtgctaattttcctaatttaaaataagacattttttaaaacagtaagaaaaagattaaacaatccaatggcaaaatataggcaaagaatacaaacaggtcattcacaaaaaacacaactggctaatgaaaatataaacaatgttcaatctcactaatcattttaaatgcaaattaaaacaagatctaatttttcatttatcagattgacgaagatgaagaaggtgatactatacagcgttgtggaagacgtggcaacacaggcaatctcatgcaatgctaatgaaatgaaaattagtacactctgccgcaattaggcgttatgtattatattttattttagtttagtttattttttgagatagagtctcacacttgtcgtccaggctggagtgcagtggcacgatctcggctcactgcaacctctgcctcctgggttcaagcaattctcctgcctcagcctccagagtagctgggattacaggtgcctcccaccacgcccggctaatttttttgtagttttagtagcgatggggtttcaccatgttagccaggctggtcttgaactcctgacctcagatgatccgcccgcctcagcctcccaaagtgctgggattataatcgtgagccactgtgcccggcctggcgttatctcttaaattttaaatgttctggccaggtgcggtggctcatgtctgtaatactagcactttgagaggccaaggcgggcggatcatgaagtcaggagtttcagaccaacctggctaacatggtgaaacccatctctacgaaaaatacaaaaattagctggacgtggtggtgggcatttgtaatcccagctactcgggatgttgaggtaggagaatcgcttgaacccgggaggcagaggttgcagtgagccgagatcacgccactgcactccagcctggatgacagagcaagactccatcccagaaaaaataaaaataaataaataaataaataaatgttcatattctttgacccagcagtttaacttctaggatattatgcaactgcccaaagatatatgtacaaagctgttcatggcagcattgtttataatttttaaaaagggaaacaaatcacagcttcatttatagggaggtggttaggtaaataatagcacatccacagagcaaactactctgctgctattgaaaagaataaggggctgggcatggtggctcatgccttaaatcccagcactttgggaggccaaggcagaaggatcaaccacttgagaccaggagtttcaggtcagcctgggcaatataagaagaccctgtctctatttaataaataaataaaaataaaaaagaataaggaagctttatgtatataccatcatggaaggaagtctaacataagtgaaaaaacaaattgttaaccttatgtgtaacatatttttaaaataatatgttttaatcatgcctgggcccatccacttctctttggaggtccctaaggaagcttaatacataaaaacagtggtaaaggcaggcaaaatatcactttaatactcactggggtcctggcctccagtgggcaggacaaaggcccctctgacagtgcacacagaaaggatccagcggttcctggggctccctctaccttcacatcctgtcactctgcctgggcccagatcctccaccttgccgtgcatgcacacaggggccactgattgactcagaagacccccaccctctggtggctctggaatctcttccttcagggtgtgaaggccagggagagaggcaggggaaggggttgacccaccctctggggtcagaggtgctgagcctcccggatgcagggggtggaccagagccaggaattgcaacagctggccacggggtttgtgggtgagtgggcagcctgctgtggtgaggaggggaaggatttgtgggaaacacggttggcagaaatagccaggatggcatgcaccggcagcctctggggaggggacccttgccctcagccaactccctcagggtccatcctggggcattgctggccacctggccaccctacaggccttgagtcacttcctgtgtttttctttccccccaggtaggctcttgactcacagccctccttctcttcttcctgtccttctgtggctcagggggcaaggacaagacccacctgagggtcaggagaaaagttaggggaccttggcttgggataggtgccctcccacccagacctcttacctcaaaggctacctcagtcagtcagtcccctgtgtccaacccagcccaaacagggactcactgagtccctcctaactccttccctcagagagaagggctggagtgctcagacctcctgtctgcatcttcggcagcttctgccttctctcccagtcctgtaccctaacctggctctcactctctcgcattacaacaaacttcctcaggagttccatcttctcaacaaatattttctaactgaatcagagtcaaggtaaatctccagagtaggatcacagggccagctggttgagcaacacagaagcagagtcctctccactggggacactttggtactcatggttggttgtctactcagcctctgtccccacacccctttcctcctttaaaacccaaccctctccgcctcctccacagtaaggccctgtgcctcaccaaccagttagcgaagcctcattctctctaaaggaatgggtatgtggcctaatgttggctgatgagaactcaagagtaagttttctaggggcactccagggaaaagttctccttatttgaaaaacagaccttgagaaagatatggcccctcttcaacctccaggcatattatgtctggatgcgatgtctggactttgagcagccaccttacaaccatgaagggcgctatagcacctgagaagcaaatcaacacgctgaggatagcagggcagaaaaacagacagaacctggatccttgattatgtgatagatccactcaattaccctccctagacccacggtccctagggacttttctcaggaaatgaaaacttcctgtattgtctaaaccattttgaatcagggtttctgttacttgcagtcaaagagccctgaggatacagctagatatttggcaagtatggatgaagaaaccaaatgagtagttgtgagcaaggagggtgcacggcctgaggaaggagaccacatttccaaacctctggctcatgtttagcctcatgacatgagaccaggccagctggatgctgagagaagcaggaggaatttggattgtgtgtgtataaagatgtaagaaacaagagctggagtgagggtacctctgggaatcagtagctcaggtgtggtgagggagagatacagagatgttcattacagcattgtttattcatgattccaaaaagagtggaagcaacccagaggtttatttatagagaatcgatgaaacaaatgttagtatgtccatagagtgggagctgggcatcagcagaacctcaaaagaggaggcaccagccaagtgggagccctggatagggttgcgtggtccaccaactgtggacctccatcgagcaccaggtcttctcctcaccagcttggaaggaggagcctttggccaggctcctggttcagttcctgtcacatatttctttgcattatacattccattccctgactccccagtacagctctgactccccagcactgccactcccttctcaagggcagggactccctcttctgtgtctcagggctgccctgggctaagcatagtggttggggcctgattacataggatccaggaggaagacagcttctgttaaaggtaagggaggaggaagactgtctagaaaaaacaatcaggaaagtggaagggccaaggtttactgagcaggaccattgctgtggaaccaggagagggacagagatgggagaggaggagatgaagaaacagactctagatggagggcaacggagctaggatggggacaggagagccagagaggagatccagcccctacggcaccatgggagggcacccaactacaacccacggtaatgcatttcacccccaacccaatgccaacacacatgggtgtgcagaaacttgaaatgaacattgcgcaaaactacacttccccctacaacatgtaaagcactctgttttctattctattctacttcatgtttttcaaatgctggtcacaacctactgttagggttgtgaccagccagggacaaagtccgtgcggagaccaagcacaggcatttagactctttatagcaattttttctcttgaatcccacaatacaaaatcggagtttgggccgggcgcagtggctcaagcctgaaatcctagcactttgggaggctgaggcgggcagactgcctgagctcaggagttcaagaccagcctggccaacatggtaaaacttcgtctctactaaaatacaaaaaaatcagccaggcatggtcacaggtgcctgtaatctcagccactcaggaggctgaggcacaagaattgcttgagctcgggaggcggaggttgcagggagcggagatcgtgccactgcactccagcctggacaacaaagcaaaactctgtctaaaaaaaaaaaaaaaaactgtactttgtcttattttatctttctaatcatttctttgcattatacaatatggaattttctgtgagacagagtctcgctctgtcgcccaggctggggtgcagtggcgcaatctcggctcactgcaacctccacctcctgtgttcaagcaagtctcatgtctcagcgtcccgaatagctgggattacaggtgtgtgccacaacacccagataatttttgtattttttagtaaagatggggtttcaccacattggccaggctggtctcgaactcctggcctcaagtgatctgcctgactcagcctcccaaattgctgggattacaggcatgagccactgcgcccggccgacagattgggatttaaaaaaaaaaaaaactagtcgttctttcaggtagcttgaaaagcactgtgttggaggatacgggccctgcctagcagctcacagtccaagatggaaaactcctctggcctttccacactggggagcagcctgcaggcctgccttccacaaatgcccccttccctgcctatcagaatcctccaaggctctgttcaacgctatctctccaggaaaacttctgagatggcacccgcctgcactcgctgttgccctggagctctcacaatacactgcctgcacccctttaccctatttcatgttctcgtctgggtggccgtcaatggacctgcttagcatagattcaggccatgggtctgacacaagcacagttttgcacatagtaggtacatcaaaggtaagagagaaagaggagcacagacaggatgggaaaaggagggagatggagggatgggcgctatggatggtcaccagggatgggaagtctgagtccaggttcttctgataccgcaaagtcagaggagggccatgggtagaaatcctaggtgtatcctagcctaagtggttcaaggaggggagcagcgtagggtgcccactggagcaggaagaagggggttgctctgagccaggtttccccaggcaccatggagcctatcctgaggaggggaacaagaggtgggtctggggagaactgggcggggcctgggagctattaagtgtttgcctcaggggaggcaaagcggggagccctctgaaaggggtgctgcgggttcttcactgaaaggtcagagagtatgctaaacccaggcaagcccgcaagaggtcgtttcatccatcttcctgcctccatcccaaactctggtagcaacatctggactttccatcctaacatgccctggagctgggacatactgactcccttggatggtttgtttccctctgccctggaagcccctgccatccccacatcattttgacagtgtcttagctttgaaattttgctgtgtgacctcaggcaaatcagttgacctctcagagcctcagtttcctcatccgttcaatggggataatagcaccggggtgctattgcgggaacaaagtgaataatgcatgggaagtgcctggcaggtggtgggtgttggtcagtaccccctcttgccccaggctgctccctgggatggcacttagccaggaaacttggatatcatgtagtgtgtctgctgtgggtccagcagtctggcagagcaaggaggaatgggctatctgagatggagagtgggtaaccaaagaaggcctccaagaggaggtgagttgcagacaggaactgatgcctgaactatggagtaaagagagggcaatcttcccacgtgggagacctgatctctgctaagactcatgagaaagaaaaagctggggtaggaacacagggcagaacagccgggccagttcctggaatggggaaaggtgtgcggaggggacagctggcagaaagggccactgggagccacttctgagggtcagcaagcctggcatgctcctggccctgctcaagacggtgacgagtcagcaggggaggaactcccactgagccaggtgagcagccctggcctcaggagtgaggctgccagcttgcctccaggaactggcagcaaccctggcagggacaggggcaagggcctggggagtggaacaatgtgctttgtgtgcgctggccatggtggggctggctcttgaaatttccctagaataagctggagcccaggggcagagctagggctgcctctgctgagaaagcctaaccctgcagtccacccagggcgacaggagcccccaccccagccctcacccctccatcttcaaccagacccttcacagcctgccccaccttggctcaaccagtagctcctccacactcacccacgcccttcactcctgcctggggcacacgcacccccctgcaccctgtgctcagtgcatgcacccccccaccacacacacacaggcaggggtcacccagtatccagtgggtttatggagagagggggttccccttgtactagatagtatgaagaaaccatgatgtgggggccagagagcgacagacacagagaaagacaggagggcccgatgggagagttacgaccagagaacaggacaagaaagaagaaagggacaaagaaagggggggtcgaaaacagacacagaaagacagaggcagtgaggggaaggacctcagaagaagagcgggacactgtcctgggggttcctggggctctggtggtgggcagtggtgtgctctgccctcagccctacaagccccagcgcccttggtcacccactctgggcctgccaccaagatagttactaaactctctcctcttctcacagttccctcccccggccctgtgtcacgttcaggtaaaatattcagggctcacccaccacttcaagagggaggaagtcctgagctcccaggtccaggctttaagggctgggggccaggccctcggcttctgcacggtgctccacacagctgtgtagactgcagggccctctgacatctgtccatccctggtgtaagcagaccttacttgagccccaggcctattgacccccagggacagcatctctaccactcattcacaggagcccccagaatccagccaacatagcttcattttctccccaaaaggcattgcttgctttttggaggaaacactcctcccggctttccaggcctatcatgccaccccaggaccactgactgtttccgttgtcctcgcctcttctctaggagctcatttcctctgcatactcggagattttcatctcctgcctccttcagatgcccataaagagggcaggcatacccagtctggctcaggtacccagggaagctactgactggccagagaagggtctggtctccttcctcctttgtttcttgcctctcaaccagtcccctctccatgacaaaatattgtcttcagtcccaccaacagtttggaggtggacactttgcaggggaggcttaaaccctaactactacatgctcttcaccttccctcagctgggtacacagggtttcccccttagggaagcaactggattgcctctcttccagaaaattaaagccacccaggacttcagtgccaggccctttattatgaattcctccaacaggcctggaatgaaagccaggctgctgactagggccggccctccaaatcccctcagaccctaacaaggaagagagctatcttgcacaatgccacttgccaggccacctgcagccccacaagtccacctcctcattctcattcccgagcactgccaggggccatcagagagaaagagggctagggatgggaatggagactgagtcctacaggtagggagggcaagggactgaaagaaaaggagagcaagaaggagggaggggaagaccgaaccagaaaaagatgtcgggggtgggggttggggtggggtgggatctgtggagagagagtggaagagagaaagagatggggagagagacagggaaaagagaaataagagtcatggtaagaaagagacaggaacagagagcctcggcttctcctggcttctctagacctctccagtgggatttaagacctcaagcaatcctggagatcaagatggaggcttggcctgcagtttgaggatcaaactgtctcctggaaactacccccatgccctggacccagcctctgtggcccaggacagtagtggggacaggttaaggctagggagtgcctttgccaggcactgggaaaagacactgcaggccccaaattgtggttaatctccaaggacacgcaagaatgcagcaggagagactaggattagacaacagggagaactcgatgacagctagagctccgggattcattccctgcaagggcagggaggttgagggggcagaggaggaaggaatctgcaaggaggttgctgacgtcctcctggaaggctagaaatgaagcacaggcagccgagtcttctcccacctccctccacccccagcgatgagtcagggattccgcagaatgctgaattcctgtcttcctttgggcaatgatacttgacactctcctaggttttctctcctgccacagaagtaaaatcttcaaccattctcaaggacttctttctcctcagctccccagacaggcccctgctttcctgtgagtcactgtatcttcaaagccccttcctgcctcagcctaccccaatagctctcaggctcctggctttgcacgtgttgttctgtctgcctggaacactcttcccagaactagcttcttctcatccaccagaaaccagtttagatggcacctgctgaaacagatcagctcacaaaggcccggcacaacctggcccacagaagcattcctgagtgctgtaaatgaatgaactgtgaatcaatgaatgcagaagattctgaggggcagaaaccacatgccctaccctcagggagcccacgatctgatggtggagactcagcctctgccttggaacccctcagtgagcagagctgtggaactcaaagaaaggaaagccttgcctggggcctgcaaccaggttccctctgaacttcaaggcaaggaagtcttcttctatggtcagggcccagcccacacctgctacaaaggcagggcccaatgaacatttctgggagggagcagaggggaggggaggggaggggaggggaggggaggggagggaaggaagacatctcatggacctttggcttttctttgagggctgcactctggtcaagaggctccctggtgaccagggccaactggccctttccatcagagccaggcactggagagcacagtgtgggtgcttgctccatatttgagagcagaatagagctggaggactctgggcatcgagaagccaggccccagcgacaaggctacctcagtttccagacccacaatgagagcaaccagaggagggaggggagaggaggcaggctgccacagggccaggaagaggcagctaaggcagtgtgggacccacctggggtgaatggatggctgagcctccagggtggcctcaagggttgcaggggagaccagacagggctaagggttgcagtcctggtgggatctgagcctggggaaaagggagaagctggggaggaatccttccaccagcccttcaaggcgagcaaagccccctgcactcccccagccccagcgagagcagctggttagtggatcaggatcattgcctcaggaaggcaggggagtttctgtgaatgagtcttttccatgctcaaaccaaaacctaagtccctagcccagcaggcaaagctgccacttcctctccagaacagcaaagacctaaggcactgggaagagacctgccacttggggcacctcccttcaggcctccctgggggtggctgctgtggcacaagtggaggagagacaagtcaggatgggagactttctcctgagctggcctctgtgttctgctgtgatatccctgccccaggagacaaagtgccacagagggtaaatagtaggggtggaatttaaaccctgagaaagagagcaaaaagtcacagacttcctgggtctatgcagggataagagctaagtgccagggaatgagtaagtgctgaagcatgaagccaggggttagtgggtcagtgacccaccccatccacctattccttagctggccatcattagggaaatgatgtatttatttaaccaacacgtacatagtgcaaggtaaaacacaaatacctaacaaatattaattcagtgattacccagaacaaacctaggaagagagcactattgtcatccccagttgcagatagggaaactgaggcccaaggaggttacctgacttgccccacatcacacagctggaaagtggctgaaccgggattcaaacccagacatgatgctgccccagttgggtcttgctgctgccatgatttcaaggcctggaaggggtcagagaaagtcaaaagtcaggaggccagcatcagagtagggcaaggacctcccccagcaacagccagagcctgagagagagcagctgatgtaattgcaccccttgttgcgggggtggggagttggcccaggcccagggagtggccaatggcagggcccctgcctccctcagcttgccagggagaaaaggaacccctccagggtatttctattatctggaggagaaagtgaggtgggaagaaaagttggctggaaagcagactgaacttgcaacttggtttaataaccaaatcccagttctccctgtgagccagggctccctcccactgtcccctccagaaaaatccaggccaggcctgggtctgggaacaaagaagcctgtccccacaaccccccctcccccagctcccagctccctactagagccccagaagtagggtccatttctcctggaacctgccatggcccctccaggcctccagtcccactcttcccgagctcaaagagaagaggaggatcccagagatgggtgactgcattttccaccctgaatatgaggctgtgtgggttggaaaaataaacggcactggttggggaagggggagtgaactgtttgaatgagggctgtcctgagaaatgccggtcatgtggtccttggtccaaatgaaaggtcagagcacccactgcgcagtcagaatggctggggagcgggaggaaaggggaggagcagagtgggcagtcctcatacacactcacacacaaacattcacatacatcttcacacacacccacgctcacatacacacacacatattcatatacacattcacacacatccatatgcgccgtcacacacacacacatattcatatacatcttcacacacacccacgctcacatacacacacacacattcatatacacattcacacacatccatatacagcttcacacacacccacacacaaacattcatatacatcttcacacacacccacgctcacatacacacatattcatagacacattcacacacatccatatacaccttcacacacacacacaaacatatacatcttcacacacacccacgctcacacacacacacatacattcatatacacacattcatatacatcttcacacacccacgttcacatacacatattcatatacacattcacacaatccatatacaccctcacacacacacacattcatgtacatcctctcacacacacacacatatccatatacacatttacacacacccacacttatacacatttacacacatccatatacaccctcacacacacccatacacacatacacactcacatttatatacatcttcacacacacattcatatacacactcacacacattcatatacacattgccacacacccactcatagacacacacactcatatacatcttcacacacccacactcatatacacctacctacattcatatacacacactcacatacacattcacacacacattcatatacattttacacacccacacactcacacacattcatatacacattctcacacacccacacaaaacacaaaaacattcatatacatattcatagacacattcacatacatctcacacaccccacacacacacacattcaaatacagtctcatgcacacacatttatatacatattgtcatacacacactcatacacactcatatacgctcatacatttatatacacattctcacacctcgacacactcacatgcacttatctatacactcatacatggagacactcagatacttagatacacacacacatacatgcagacacacactccaacactcctacacacattcacccccctcacacacccacacatgtatatacactcacatcctgaagcacactcagacacatactaactctcagaaacacacttatccctcagagggggtaggaccagcctaggaaagagtccttctgggagaatggcatggctggtgactgccaaggggtaggcagaagcctaggactgggcagggagcccaagagtagggggtggtgctgtgggccactgtgcagaggccaggactgtgaatgaagtgggcactgctcctgccccctcccaggcctgcctctggccaggccagcctccatcccggcattgtctcaggcatcttgggcagggttcccagagctggctgaaccaggggcctggccaaacagccctcccctgccctcccattcctctcttcttgcagggagggggtgggaaaccttccccataaccctggcatttcacccccagcccacacaggtggcttttggagaagctcaagtgccagaatttgacccgaaaactccaggttccacaacgccccctgcttccttcccaggccaggaagccttggaagtccagcccccaccaacctgtcccctcaactatgacattcatttctttttttttttttttttttgagatggagtctcgctctgtcacccaggctggactgcaattgtgtgatctgggctcactgcaacctccgcctcccaggttcaagcaattctcccacctcagcctcttgagtagctgggattacaggtacctgccatcatgcccggctaatttttgtatttttgtagagacgtggtttcaccatgttggccaggctggtcttgaacgcctgacctcaggtgatccacctgcctcggcctcccaaagtgctgggattacaggtatgagccaccacgcccagcccatgacattcatttctaccacatcccaggtatcccatctgctctcctccacaggctgagtttagtgcagggcaaactgtctccctccccacatcccccacccaaagcaatgggaactactggcattttagtcttaaaggccaaatgaatcacctgtgtgcatgtggtgggggcaggaggggcaggcattagtagattgatttgaaccagttccctctttgagaactggctctctcctgccctctccaaaatgttctccaccaacccctcaacatgcagtcctggcagggtgagtcccacttctccctgttggtgccagagagctgagccaccctcacagccagccaaaggaagggaccctatgggcaagaagaccagccatcatccggaaccgggtgtcctcccttaaggggacttgggcaacaccctttacaggactttgtagggtaacagcaagaggatcaccatgctgtcctcacagggcttgcatctgggaggggctcttccctgtcttggaactgagcctggacaactcaggtgccctccaacctgttctctacctgagccaaagaggttttttccaaaacacaaatcggatcccatccagcccttgcttaaaacctttcaaacgtttcccagtgccctccggataattccttaatgcagcacaacatgcaagatctgccattgcacctcgcctcctcttcccctccccatgtcatgatcctcacccattgaaaggaatgccacccctctcccagttctgggatgctcacccccactcccagctcactcatcatcctgcagatctcagctccacctctcctggaaagtcttcctagatccacccccgggtctcaagctgaagcctcctctctgctctaggggacactgtatctcttctgtcctggcactgatcacagtgtgttgaaacagtctgtttgctcctcagccttcccatctcaaccaggagctcaggagggaagggatacatctgtcttactcatcattaagctcctagccccaagcacagcacctggcacagaggaggtgctggataaacttgaataaatgaatcgatcaatcagtcaacagcccatcactacccagggccattttgcacaccttccagggctggcctgaggcaagcatgcccacacccctctgctcatgcccctcaacccactgcttcatatggcacggtaagtctggctccccaccctctggaaagaatcctctgtatagaccccttcccctaaccaagccccaccaccttcagggaaggctgagctctaatccaggacaccactccaggaagtccctgactgcctccacaacctcacctgctccaaactcctacaaagcctttcactggggccaccctttggcttatatcacaatgtacttttttgggttcactgtccgttcccctaaggctcttggcctcccatgaaggctggggccctggcagacagaaccagcaggtgctacctgggctgcactctgaggcaggccctgtgctgggtcctctagaaagataggccagcctggccctgctgagaactcgggatggagcaggctcgggaagccaggggttctactgtttcctttctcaccctaggccctgctggggaccaggacctggaaatgaacatcagaggaggaaggcctcagtgtggaagggtatcagccagcaggcagaatccaaggagagggaagagctaagattgggccatcagaagccagactcccagtcctggggcaggaacccaggggggtcagggaacagtcccagcagaagagaaggtgaatgggaagcttccctccatctgccttggctgctgctcagctgggagaggcttctacagaggtgaaggactcactaaaagcgtagggctatgtgtatgtcttccccaaacccctgcagcagttcaccagcctcttggcagtggtgcagccaaccccctgcccaaatcaccaatgctctcggtaccaatcagcagaggttagatgcgtgctggcctagtgcgtgctggcccctggcaatgggccagaagtacagaagatttggtgctggcgtgactggaaggctctctgcacagacatccttacgaccccctccacacacaaacacattttcaagcttaaggatggggcttgagaaggtggtccatttcccctgggcagccatgagatggggacctatgtccctcactcacactgggccatccatgctgatgctggccaggagacccacgttagcttctgactttgccatcaacctgctaggtaacctcagataagccccatcctcctctctgtaaagtgggtgcaataatccctgctcaactcaccccacagtgttgccataatgatcagatgaggttgtgcccatgaaaatgctcagcgaactttagaatctacaaaatgaaatgtttctgattatcattcttgttgttattatcatctaaggaaactaactctgctgccttattgaaatcagcagtttcatctcccttcgagatccccttgctcagcaaccatcacggctcccctttgcctacaggacaaaggccacattctgtggtctagatgttcatctggcctaagcctactttccagttttatctcccttgccttttagtctcactggtccttttggagttcccccagcacattttttgtctttctgcctccatgcctttgtccatgctgttccccctcctggaacgccctcccccattgccacctatggaatttaactccatctttcaagaccaaactgtggcaccagctcttccatgaagcctctctctcagctcagccagaagtgctctctccttctctgtaagggacgtggttttcatcaaatgccatgacactttctggcacagagttagtgctcacaaaatgaaagttgcaatgaccacgccctgcactctaaacactgactcatttcatccttactacaaccccatggttgtgtactattagcatccccattttccagatagaaaaaatcaaggtgtagaaaggctaaataccttgcccaaaagagcatcagaccagggcttgaacctgatcagctgactttggaactcgtatgtgcctctaatcatgaggaactgcaccatgtctatttattcagttttgctgtcccctgcccagcccagggcctggcttggagcaggtgctcagtaaatatttgctggcttcagcactcattcctcaagcctcctgtgcacagtcatctcactgtcctgggagtctcttaaaggcaaggcccagtggctggctcagaggggtcccaggaaacgtggccaaatggctccactcacctgcatatccatacatgtcctcatgcatcagagtgccagactaaggctggaagagatagggctgcaacccttgggccagcagcacgaggctgtctggtagcacacttggtgaccaagttggctgctggacagggtcagagattaacccaccctctgtggtcatgacagggtgtcaggagagccctgagcagggtggggagggaagcaggaataactctcaaagtctgagtgcaaggagctctaggaagcacctaacccaattattcactcccatttaacagataaggaaggtgaggcactggagttggaatgacttgctggaagatgaagagcacagaaaaggcttgcaaaggtgccagcatttctgggcctttcctcctcaccctgtaggtgggcacgggccccctcctcccccttggagagcttgatagtcacccccatgtagcccaggaaccaagaggcctgagctctttggtgatctcagccccagagaaaagggtgccctcagacagctttgctaggctgctgtgcccagccagcagcagccccttcaaagagaacagggagagaggttgggagaaggccagccactaattgtggaaaataaatcagagacatctaaaccacacagttgaagaagggccagttgcacacagacatgtttccttttgtgttcttgctcaccaagtttaattgttaattgaaagctgggagttatataagttatggggataccaaagaaggagttggaacaagctgttgaaaattacccacttgctgagtggtttgtgaggcaaggaggggtctcaaaaaagcgggcagctgaccccaagagggcaaccagaacaaaaccatccgctaagaactctctccatctgcagccgcatgattcctggagcttaagagcaacgaatgtgtgttcaagctgctgatttcccacaagtgcacatggaaattcaaaagtaatgccatgatattgattatcagtttaataatcagacaaaatctcccacatatctgaccctgcgccacttgtaagcagggctgtgtctccctctctgagggggatccctggggacagggctgtgtctccccttagactggggctccctgaggacggggctgtgtctccctcagactaggactccctgaggcaggggcgtggtttctctatgaaatcaacctcacctcaccaacctgggttgaggaaccagagacctgcagccacctgtcaccattggaaaatgtcaggacacaccctcatgtcagagtgggaagggttaagacagagcttggaaactgcagttctcaggaacacctttctcatcagccagcccttcctgtcctgactgctgccaggacttagattggcctctgatgggttccagctcacagctaggcctcctgcattctgaccctcaggcagtggtgtcctgtaatgacccaccacgggtattcccagccgcctgagccagggagggctggcattaggatggagtgggatgcagggagggaatgggcagcactgccatggggaggaagcagagtacaagggaggggacgctggggcctgaggccctgggacctggggtaggaggagacggtgaggcctggggtaggaggggatgctgggacttggggtaggaggagacagtggggcctggggtaggaggggacactggggcctggggtgggaggggacggtgggggctggggtgccagagactccctctggccacctggccctgtagcctggaagcccagggtggggtgacatgggctgcccttcccacatgggctagtttcttttgctgccaccagacccagggagaggcctccttatagcctccagcctgggcagcagtccgtggctctcccgaacccctcctcagccatgagtcattcccagcagtctgcatgagccaaggcagcaaaccccatcccacagcctgcagagagcctgggacaaactgcatgactggccagatgcaggtgcccagcacaggagcatccagcctggtctggatgggaagactgaatcttggatcttcagaaatcccggctttggtttcccaaacactgtctcttccccacccccacctcccagctccctccttgcccggctcactgagattgtggtgcatttctcatttttaccttgtctctcacccagacctcctctaagcatccttgggcccttcgggactcagctcaaatatcttccaccctggaaagtcccctgttcaccttttcgcacccttggctgcataggcccacacctcttccttgttagacagggagctgcaaagagcagccgggactctatttcatccttttctgtcccctaacagtcagagcagcgcctggcccataggatgcgctcgtgatagcgtttccaaagacggatccagccaggagttagataaaaccactcagaccctaataaccaatatttgctggtcccagctgctgacaaagtcccaactattcctggacaggtcaaggaggctctctgcctagtacaatgacctgctacaatgacctggtatcacactccccaaggaccacacgcaaatggcaccactgatgtgcctgagccttcagggtgcctcaaagctgtatagtggtgtgtggtaaaaagcagagaaggcttcttactccccttctgttcctctctgagaacatccaaaacagagctgctgtgcccggcatcttttagaaggttagaagacagtgtgtggtcagtgtggggactgatttcaacatcattccaccccctgctgtgtgccttactggcctgcagagacaggaagagccaaaaaactacatttcccagtctcctcccctgctgttgggattgggatataattcaggtttagccaatcagatgcacgtgcatgaaatttggaaggctgtgcttctgcagcgccagctgctttctgggaataagaaggggtgtgtgttgttgttgttgttgttgttgttgttgttgttgttttgctgcagtacgggcagagggggtcaagaggagagacacagtgtgtctggctcctagcatggaccccagcaggtgcagtgtggagctggcagcagtggcagcctcctgatcacactgcagtgtggttctggggctggtgacctcatgattgccaaagaggcagcagctcccttggtggcccagttctgcagtgtgactttgagagctgttcctgaaagctccaccttaagcctatgtcttcgaccctgccaatagttgtgtagccatttcatactctgtgataagtccctttcacttaaaccagtcagagcagattctgttctctgcaacagaatcctgatggacacacaatgctttatatcctagtcctatacagagccacacagctcttggtagcagactgagactgggcccagggtccaagctccttgaataaggcctgactgtgcatgtgtgcacgtaccagggaggcagggggctcatccggccccatcctcccctggccccacagcgggcactcacagaattcctgaggagaagacagggagaacccaatgcctgtggaagtttaaacagcagtgtgtgggctgagcaagcatgccagggctacctggctaggcatgctaggggcttggagcagagttcaagtgccagggaatggagccgatctgtaggtttggacagaggaagtggaggctgggatggtgggcttcctgtggcctgctctctttcagacccagatatgagtccaccagggagctgggccagagcaaatccagtcacaatcatcagcctggcttaaaacggcccttgtcctacgactgtccacctgactctctcttccctttgaataagttcttttctgggagtttctttagatcttatgcatgtctgaattccatccaaggaaggtaaatagattctcatttcatctctcaactctgatcagttagtagtgacgacctggaccagtatatgagaaaaagtgtgaggctacttctggactcggaaggggaaagtgctaggattggctagtgatgcctgccgtgggtgcagaagcggatattgacaatgtgcatgctgtgtgatcgcttacatatttgagggagaaatgaacaaaggtgcttcctgcttaaggcagactgggattcatctagccatacactccccagacagcttctggccctaatgccaccccaaaggttcctgataccactcaccaatttccccaactcagcatttgttcactggcgcattttatcaactatttccagagcttcctgattccttttccccaacgtaagctctctccaactcttatagtcccctaccctgtgctccaggttcacactaactgtcacgcccaccggggttctgatctcttgggagctgacctcaggaaagagctgaagctgatagggactgattccttgaactaaagtaagtgcaaccccctccaggaacattcctgacctctcaggctctccacaggccctccctctgtggtcttgctcactgtctctggtgcccaatcagtgctgggcactcagtaagcgcttgataagcctgtggatcagtgagaggatactcagaagtttgggagtgacctcaccaaccactggcttcccttttcccatccttgcttcctgcctattcccgtactcagatacctttgttgacactgacatttggcttcccaaatctccaggaagcctgcacgcaatggggcaccctgcatcccatctgagtcaccactgaacccaaatctggcctgctgcagaagctagctgctgggtgggacagaaaattgtgccctttgaggggctctcaggctcccctttgagggaaggcagccatctcctgggcactgcagaggtcagagtgggtggtaagccatttttcagggaagaaaacaagccctgagcccaccccacgacatccctactctgggttcttgctcacccaccacactgtttctgctaaaggaaaacagatggtgtggttaattgggatgtcttagcgggctctggtcctcattaaggctgagggtggggacaatgagtgatataccaggtcataaacagtggctcgagggggcaggtgccctgatgctccccaaggactgagggagtagtggacaaggccactggtcttgggcaatgggatcaggctggagtccagcctctccctgagcccaaggcagagcccagtgacaactcctggggggtccagatgctcacagctggagaaagtgaacattgactggggtggcagtgtggggccgggtgaaggcagcaactgcggaggaggcaaagaagcccagggaagggtgggcaggagctgctggagtcagagaatgccctagaggcaaatctggggcctgcctcttcccgccagagtaccagagcctgactcagatagcccagccccagaaccccacagagggacatgaagggaaggcacagccatccctctctccagggggccccatgctagagagaggcagtggttaagagccaggctatctgggttcaagccctggttttgccaatcactagctatgtgatgctaggctactgcctcaatccctctgtgcctcagtttccctacctgtgaaatgggataacaatccccctagataattgcagtcgttaatgaactcagagcagcacctggcacatagtgctatgtgttccatttaggttattattcttaaggcaagggtctctgtgtcggtgaaatgtgggggatactcactcctccctgtcaccagcaacagcagagtctcttggaagtgtctccttgcataaccatccttcccaacctctgaatcacctccctcaccccgccagcatccccaagtgatgggagggacaaggggtccaacccaaccctgcccagaaagtgaatgcgccagatgcattcttttattttttatttttatttttatttatttatttttttgagacggagtctcgctctgtcgcccaagttggagtgcagggatgcgatcttggctcactgcaacctctgcctcccgggttcaagcaattctcctgccccagcctcctgagtagctgggactacagaagtgtgccaccacacccagttaattttttgtatttttcagtagagatggggtttcactgtgttggccatgatggcctcgatctcctgaccttgtgatctgcccgcctcggcctcccaaagtgctgggattacaggtgtgagccactgtgcccggctgagacagctgcattctgaggacagtaattattgggcacctgctgtgtgccaggcctgatgctgatgttttatctgcacttgccccatttagtcttcaaggtaggtatcgctctcccattacacagataagaaagctgaggcctagagatgagtgtccaaagtcacccagagagcaaacagagaagctcgggttggaattcaagactcccatccctcagaatctgtgatctttcctcaggagcagggtgtgctccttggccgttaatgtcacaaacactgggggggctttttcttaatgcagcatcctaagaccctccctagagctagagaagcagagtctctgggtgggatccaagagtctacccctgaataaaatagctgcctctggccttggacctcctttaacctaacacagcccctattgcagacaactggaccctgaagaaggagaaaggagatggagcccagtcaatctgcacgcttacctccaaggggatggatgcaacaccacttctgtgcccccttcatccccaggatccctcgctctctcctggtgcttgggccccaacaggcagagtgggacaaaggagggcaaggaaacatctccaatatgttttccaaagcacggtgggtgagaggagcaagagggtcaatggggcctacctcctctgtccattgagggatacaagtgaaatgcggagggactgataccctggacagtacccaggggctccatcaactgggggcggaagaccagttctgggggtgggggaggttctttcagactggccctgctgcctgcagcacgaggaagaccctctgtccactcctacatctcccccaaacccccatggatgtgattggacagccgccccaggcactctgtgctgcgggggcagcagacgcttggtcctcagtgaggagtggagagggatcagcatacatcacatcacacttggcacggcccccattggtgggcagcatgccaccgtgttggtgagctgtctccctgcagagccttcacaggcggcaagggaggggcttccaggggaatcactgcctatcaggagtggcacagccccaggaagccccccggaccatccctagttcctgccttgcctgggcccaaccagagctgggctgaggaagggaaaagggagaagggcactggggctgggagatgaattccaggctgggccatgctggggacctcaggccacaaccaagggctcgatcccagagggagaggcctcccactaatcacattcaggtgaccggaagctctgaggctctggaccctgcttcctggagatgttagggaggagagggagagaggagtcccttggctctgggccagtccacagacttctccccagaggcccaagggctgttggggggggatagaagacccactatcaactcccacgtccacccacacccaaataatgcctcagtctacaagaagccaggtcccatagagttgagggagctcacagtctgaaggaggagacacttcctgctgtctgggatctgccagtctgagggcagagacgtagccactcccttccagaacatcaacctcccagtctcctcattgtctccaaacagggctaacactcttctgtcatccctttcatcctgatctcagtccttccagactcaaatcactgccctcctcatcctcagagccttcctggatgaccacacagctccaatcctccaccctggcactcttagagcagttaatttggtggtggacagataattcctaatggcatgcaaagaactcatatttcctaggcaccacctgtaccagaggcctggtggcaggaccttgatcatgcaaacatgacatgatccaggcatgcagggagcttccagttcaggaacattaggacggaccaagaagatacagtgaactgtcagttaaacatcatcttttcccagacatttctgcgtgtgtgtgtgcgcgcgcgtgcgtgtgtgtccccagctaggctgggactttgttagagcaagacaggaactgagcttaaatatcaggccacacccccatctaaactaagtccctaggatattctcccagagccccatgtaattttccctcttggcacacattacagtttgtaattctttttggtgtgactacttgctttaagactctccttttccaggctctataagagtagctgagtccatggcttcacccgtgtatcttgagcacctggcatatttgatgactgaatgaatgatttgaatgaaagcaccacattcctattcatgcccttgcccctagcacacaacctgtaggtgctcagtgctcagatttggcaggatggcaaagtaaaaagaagcccatcttgccacagctaggaattcaaggtcaatcccagagcaatcccaaggcagttcatcaaggaagacttcctggtggaggaggacatggactggggactttcagcctcacatctgttcttccagttcatcatctgtttctggcaggaactcctgaggacagaggttacgtctgggtctcagggccatccccagcacacccccattcaagctgcgcatgacctgccccactgtcgacagccagctgtgactcacaactcctgagcctttcctcttggccagagatcgtggagtagatattacagtaacattactaaccacaagtagaggcggtgaccgtacttacgctcagagcacctccccccacccctgagaccagagcaatgacctcacactcatgttcggcagcaagcacggacagtcctgcccggaggcagggggatggcccacatggccctggtcttccagagaagcccagcgtctggcctcttcccctcagcgctggtcacattctccccaccttcccctccaagcagcccacctggggtaggtgctgagtcccctgctgctgcctcccccgggtgaaagcagagtaaacagtccccctctcccccgcctccctggggagggctggaggaaagaaagggaagtgacaaaagctgccctatccctgtccttcctcactgctgggtctaggacacttattctggggaaagtggcgtctgaggatgtggctgcagtggccagttgctggcgccagcagaaatccccaagcccgtcagtagactctgttcagacgcgttcgctgaccatggcactgagtaagtgctgaggagacacctgaggacccaggtcacgcccctgcctgccctctcctcccagacaggcccctcctagggctcagaccattccagttcctcttgtcagaccctgagaaggcccagggcatccacccctacagggaaggctcaacaggaaagaaagaaacacacaggaactgggctcagagcccagctgcgtgctcttgggcaagttacttaacctctttaggcctcaatttctcaactataaaatgggactaagactagctgcctgttgagctgttgtgagataagtgagtgcactggcctggatctgcagacggtggacaacagccaacggcagccggatgtggcattgtgctgctgcctttagcagctccaggcagtaactactgagtatcagggaagaactgagacctcagagaagggagagaaccaggattgcttgaggcagggcgttgggaaggccccacttaccctctggcagttgcaatctaaaaggaacaaagaggctttgtggcagatcctgtctcctaatatccattcctcgtttatttcccaacttttagccagacccccatggaataaagactagactacctagcttcccttgcagctaggtatggctagatgactgagttctggccaatggaatataagtgtgacttctaggaagcttccttgaagggaaggggcatgtccttcttcaggctttcttcttccttcctgctggctggggctccagcagccatcttgggcaatgaggtgaccctggaaatggaaaccacacctagcaggtcagaaagatagaaggagtctctgaccacatcccagaaatattttacatgagcaaaaaattcactatttatcttgtgtaaaccaaaatttaactgatacaagcttctcctctggtgaaataatctcgactcatgtgtggctgggcagagtaggatggatgaggtgtctagaagagaagagttaccaggggtgtgatgtccccatccaggagcacttcctcctacttgccctgtgaggtcaggaggaaccctgttgggaggacttggctccaggaggatggatggatggatggatggatggatggatggatggatggatggatagatagatggatggaaaggagggaagagcccaggtaaatgcatgagatgaggagaaatacctagaaggaggaaataccctgggaaaacacttcagatgacagagagccaggctaggggtgtggggatagcagaacaggatggcctacctgactcactgcccaagtcggactctcagttttcccacctgtgctttgggaatgggccttatcgcctcactcagggccagcgtgaagtgattcaaaaaccaaaccaaaactaaacagagaatcagtgtagcattaaatccgttgtcagcccagacaaaacccttctctgtgcctgggattcctataaagtaaggatacccgtggaccccacctcacctggctgttgtgagtattcagcgaaagggctactgtaatgtgctcatcacagtgtctggcacaaggcaagtgctcagtaagcagtcagtgctattattgctgctgttgaaatcctgccctggggtgtgaggaacaagaagctgccacttgattggtctgtggcatgagttagggaaagaaacctggactcctcactccagaataatatctccagcgctttggggacctaaaggaccaggtaatgccttgggagcaccacaccataaacacacatcaggatcctgacggcataagatggaatgggggtagtagggagacctggcagggtgggggcagccaaggcttaaattttggtaccactgcctgggacccctggagggacagctgtcaggtcaggccctgacccccaagctctcctccttggccaggccaggtccacatttggtcacaagaagctggcaagaggccagacagggccgcagatgccatggagagggcaaacacaggcccgacggaaagggggaaaaaatcgggcttgttctgcctgggcaagagcaggctcaggggtgacatcaacgccatgataagcagttagatgagttaatgcccagggatgcttttcctgaagttccccagagaaagttgggggttaaatgatgagtgtgttggcagatttgtaccctcaaaaaattacgagtgtgaccactgttaacaatgagcagggactttaagaggagaactaaggagctgtcatttctctctggagaagtgaaggagaagaaatgatcttacattaaagtaaacacgattccggatgacctaagggagaattctgactgcccatgacatgagctctctgtgtgcaaggagctgtggactgagtccagaactgaatagggcacacagcttcagtggcctgtcctgaaaccccagcacagcctccaagttctgggcttctgttcccacctgtgttaaatcagacaaggtaacgattatggatagggatttaggaatcatacagagatcagtttgaaggcactttggacaagttacctaacttctctgtcctttgtttcttcctctgtttggaagaaaaaaaaaaaacagaactgggtgcagagggttgctgggaagattaattcagtggatgccagcttagagcctggcacccaggacgagctccataaatattctccagtggggctatttttctcctgtctgggcagggattggacagtatctcttgagttcttttcaagtctagaatgccttgattccacaatcctgtgactcactgattctgcttctggggtctgaggactgggatgagttggttgcacagctctgccctgcagggcccaggcccagcacctggacatagcccagcctatagtctgcaccattttatttctaccagtggactttgccttgcccatcatgtgccctcagcctcatgggcagccttgtggccacaggtggccctgccagctgtccctgacctctgctctgcaccttcacctggagcagggcagtgcaagcccctccggctaactccttcctcacacctacattcccctgacaatgtcacatgctgtgcaagttggcagggccagaggggccacagatgccaacaaaaacaccattcctgtggagggagaagagcccatgggtgttatttttaacctgctgattagaggccacagctctgcccctgggggtcctgggactaagggctctgaggggcatgtgagttgtcaggcctcacctcaatgactcccaagggtattgggctgcagaaaccccagcccttctaccactttgatggagaagtgggaaagggagacacagatcaagacatgccccatcttgcccactggtttcaactggggctgaacccagccaggaagagcaaatgtgccacgaatcacagaacattaaacctagagatgggtcctctccagtccctgcgttatacagataaggaaactgagacctgagggaggaggcccaaagtcacactgctggtcaacactagcttcctacccccttgcccacctgttgtagacctggagtttgacaaggacatttctataactctccaaggccacatcctgggggtcaccttgctccaccctctgtccaggtgacccatcttgcctctgccctctccccagtctgccctaccccaatgggctgagcttctgacaaccccatgatgagggctccaggccctggctcaccctgcaaggacttcctaagtgcccaagcagtgccccctagaggccagtggcagcactgatcagcacagcgggcagcgccatcatggctggaggcccaggcgaagacgtgcaggccagggcgtgcctgtgtggggggaacaggaccgagcttctgccaagggcccgctgccggctgttgctgagcttgtgctcgccagaggggtgggggcggcaggcagacaatggaccccacggcccagcctcctggccttggccccttgagctgggcaggcagccgctggccaaagcagccgcctccattggtccctcacgtagcccacgtcctgcctgctgggtggcccttatcaccgggtacgtgccagagttccacatgcccacactccacagtggggaggggactgtgggcccaggaggaatgggaccagtgggaagttaggcttcctgtttccctgcatcccattcccaaggaggggcttgagcaggtcctgagtaccccttgatgagtctctcgttctcagagagatcttagccgcatctcgccaagtcccaactctcaacaactgttctccccttggaatgaaggggttgggtggaagagaagaaagaaagaggccaacagcttcatttgaatgttctaggtcaccagttcacaaataccaactgttcctcttaacaagcttatacaagaagtagtactatactatgcttattactgtctggggaaacaggcacagagaggttgagtgacttacccacaaccatacagctggtagggacagagtcaggattcaaatccgagcagaccgactccacagctaaaccactcctcaacaaagcagggtcgtgactggctggtgctcagccctctaccccacagaaatgatggctttggggtcagacagacatgggctcaggcctggaaatgcatgctctagggccagtgaaggccctctctgggccaatgtttccttacctgtgaaatgggtgcagtgatgcagtgaggaaggtacagccacatgtgcctcactggtggaagctgctgcacaaatcctcctccccttcacccagcagagctcaaagcctcctttgactgaataattagaatgtcttctgcctcgccgcctgaagcccaccatcccagcctccacttcctctgtccaaacctacagagcggctccattccctggcacttgaggtctgctgcaagcccctagcatgcccggccaggtagccccggcacgcttgctcagcccacgcactgtttaaccttccacaggcactgggttctccctgtcttccccccgaggaagaccgtgagtgcccgctgtggggccaggggaggatggggccggatgagcccctgcctccctggtatgtgcacacatgtacagtcaggccttattcaaggagcttggaccctgggcccagtctcagttggctaccagagctgtgtggctctgtacaggtcctttcacgtcacgggggctgtttcctcatatgtcaaatggacatctacatcccggctggtaaagacacagtgaagccacatctgggacacacccctcccagaaaacttcctcgtgatttctgctagcagattaggactacagcgtgtgtgggcagggaagggatctggctgggaggacaggcgaaatggacatagacgtcagagaaggcaggaagcagaggggtttccccaccatgatgaggctgcacaggcaggggaagaaaggccatgggggctgagtcactggctgtgtctaatctgctgccttcccagccactgacaatgaagtgaccacaggcggatcacaggagatcacaggagggaggtggccaaacaggacaagaaagggagctgcagggactctagaggaagtagcctgagaggcaaggctcagcccctgccctcagagggaccctgagctgatggggtagcagacacagctgctgccttcagtgagctcccagtctgacaggggagacattcttttgtctcaggagagaaaggagctctgccttcagggaactcccaatctgacagggaagttttatcactttctgccttaagggaattacaactgtgactggggactcagcctctgttcgcagggaaccccagcttgaggtgtctatgtctgagggagcaggtgcctgagtgagcgctgtgcatttgtgtgttgacacccttcctggcttccttcagaccctccaatctgatgggagagacacagctctgctcttaaggagctcctgtaagatgggggagacatagtccccacatcaggcggccactaaaatgaagggggagacttagctcctgccctctgtcctcagggagccctgtctgcccccacgggcactcaggttaagcatgcatgtgtgtgcacatgggaatgcatgcaggccctgctctagccctctcaggcaccactccccaccatgcccacctgagaactcctcaaagtaaggaaggagaatccttgttcgagcccaggctaagggggcttccacagaggggcttctgggagcctagaagacagagggtgggggagacagaagtgctaccacatctagggtggctgggctcactgtcctgaacagctgagctgcatctgccttcctcatctccaactcctgatccctgatacaccccagcctcacatgtccgctgagacgcggtacatggtatctcccacacgtatgcgcggctccagcacatgggagagggtggctggggcttggagctcaaaggagcctcttcttttcctccccgtggccctcatgttgcctttcacacacccactctgggtgatgggaggggagtgaccagtccaccccgagtcactatgactcggtctccccacctggaaccctcatactcggttcacagtctccatgaagggacagtgagcagactgggagtcagcggggaggaggcccacaacaagtcgggagctccagttcacccactcaattccttcctagggcaggaaaccttcaggagagcagaggatggggctgggtgggaaaataacatgcaagggaggaagcagggagcacagggcatttcccctcaagtgggagttccccgagggcagggctgtgtctcccctcagactggggcaccctgaggactgggttgtgtctccccttagactggggcaccctgaggactgggttgtgtctccccttagactggggcaccctgaggacggggctgtgtctcccctcagactggggctccttgagtcagggctgcgtctccctcagactgggggtccctgagtcagagctgcgtctcccctcagactggggcaccctgaggactggattgtgtctcccctcagactggggctccctgagtcagggctgtttcccgcctcagactgggggtccctgagtcacggctgtgtctcccctcagactggggctccctgagtcagagctgcatctcccctcagactgggggtccctgagtcacggctgtgtctcccctcagactgggggtccctgagtcagggctgtctcccccctcagactggggatccctgagtacagggctgtgtctccctcagactggggctccctgaggatggggctgtgtcttcctcagactggggcaccctgaggatgggactgtgtctcccctcagactggggctccctgagtcagggctgtctcccccctcagactggggctccctgagtcagggctgtctcccccctcagactggggctccctgagtcagagctgcgtcttccctcagactggggcaccctgaggaccggattgtgtctcccctcagactggggctccctgagtcagggctgtctcccgcctcagactggggctccctgagtacagggctgtgtctccctcagactggggctccctgaggatgggactgcgtctctcctcggactggggttccctgtggacagggctgtgtctccctcagactgaattccatgaagacaggcactgtgtcaatcccatcaaactaggtcagaactagatctcctttagcatctaaaacaggcaactcatccaccatccccaacatcatctgggggttttcagactgggtggggtggggcatctacttcccaccaggccaccctcctgaggaaggacaatcatgcttactggcaggggcttcctcagtgagcagcctgttcccagttcacccactcacccctctgggtggtctctcccacagtctagccccagtctctcacgttaaatcaccatgggtagctgggcaggcgagacccacaggatgtgtgggcagggcctgcctggacctggtggggggtgtatagctgagagcacaggcattttgtagcatgatctcatgcccactgccctcagctaggggctcttcaggaccatttgagcatggggagtgggcagacaagcctgggcagctataccagtggcctgaggaagccaagcttggcaggttcctgcttccatgagtccaaatcagcacaggaagtgggtcccaacaccattagctttcccttatcctatgctgtagccacctggattagcagagggagaggcctcctaccccagtgggtccctgtgagggggcagcccgaccttacagtgtatacatttggtagtgaaggaagcaggaaacagctggacaggcctgggaatccctccccactccctagtcacctttcaatacgaggagctgggctttcccagccctctatcccctactcctccctgcctcctcttgacctcctgtgcctttttcagggaaataaaacacagagccatgtggagattggggctggacttctgtgctctcctttttccgttggcaaccccatctccaggctggcaggatcagagtcggtgcctcccacctaacactgacaattgggcattgccatggctgagggcaccctaagatatcaaccccattacacagatgggcagactgaagtctgaggctgtcacagagtcaggacagatcatgtcttggaggtgatgcagccaggcttgtggtcaatacccactctgcctgagtcagggtagctcctctctcggccagactgtgagctccctgagctcagggactggtccccagcttcctgaaaggggtttgctgggtaggattgaatgagggcttgctatgtactgacctgtgctggtcctggggtggggttctgtgtccccatcagcctagccagtttagctgcagggcctcctcacctctggacccttccttgaccacaggtctccctagttagttcctggaacccagactttcggtgcctggggagggagggtctagggtggcatgggcagctgtgcatccaggccagaatgggccacctggagaagtccccagggcctggtgcaggagcccgctcccccagctggcagaaggacaggtggaagcccacctgctgtcccccgcttctgggtcacagtcagttggctgagctaggcccagcttgggcaggttctcccacatccagtgccccctccccctcaccccaccctggcctgatccctttttcaagtacagtctttgctccagccagatgtctgagcacagtcttgttcccaagaaacccatgccctgccccacaatctctactcatcctgccctctctccctcctgtccccataggagccatctccccagggccactggctcaccacacttcctgcagagctttgaccctctaggagagcaagcccctccccaggccagggaagggtctcagcagaggcagcagggaaggggcaaggatccagcttccccagtaacctagcatgcctctgtcttccagcaagtcaccaaaccactctcctatctgtccctattgtcagcctatcccatccctcaaggcagcaagttcttaggttggcttcccactgtgtgggcaaacacgcggcctcactcttactggaagccaagacttgctccaactgggctcggcaggagagagttctcaagaagcccaaccctcaaatacatactctgtaacctagatggaggctctcacagaacctgccagaggcaatcactaaccctgctttacacacctaaaggtagctttttaaactttaaaaaatttgtgataaaatacgcagaacatttaccattttaaccacatttaagtgtacatttcagtggcattaaatacattcacattacatacgttcacattacatatgttcacattgttgtgcaaccatcaacaccatccatctccagaattcttttcattttacaaaacagaaactctgctcattgaacactaactccccatctctccagcccctggcaaccaccattctactttctgtctctatgaatctaactaccttagttacctcattaaagtggaattatacaatatttgtccttttgtgatttgctgatttcacttagcacaatgtccttaaagttcatccctgttacagcatgtgtcacaattttcttcctttttaaggcttaataatattccattgtatgtatgtaccacattttctttctccatttgggtagctttttttatttattaactacttttttttttttttttttgagacggagtctcgctctgtcacccgggctggagcacagtggcttgatcccggcttactgcaacctccgctacccaggttcaagcgattctcctgcctcagtctccagagttaactactttttaaaaaaaccaaagtaatatattctcgtggcaaaaagtctgaacagttcagaaacacataaagtgaaaagtggacttttccatcccttctcactctggtcatggaaagccctttctggtgactctgaaattttagaggcagaagggctaactggtttttatccattttttacacatatagtgacatactcctcatcagtacttctcaaacacgagtatgcatcagaatcatacagagaacatgttaaaaccacagactgctgggctccagccctagtgtttctgatcccgtagttctacggtggcccaagattccaggtttcttttttgtttgttttttcagacagggtctctctctgtcacctgggctggagtgcagtggcaccatcttggctccctgaaacctccacctctcaggctcaagcgatcctcctgcctcagcatccctagtagctgggactacaggctaattttttgtagagaggttttgccatgctgcccaggctggtcttgaactcctgggctcaagcaatccttctgccttggcctcccaaagtgctgggattacaggcatgagccactgcaactggctgaagattctggatttctaataggctccatgcccatgctggcagagggcacacccttcatggagtagcaccacccaaggaatgtcttgccacttgcttttctacttagtgaatatcaacacacaacctcaacctcactcttttcaaccactgcatactattggtgtttggaggcatcataacatatccaatccgtgccctattaatggacttaatgttgcttccagtttttcaggtttggaagcaaaactgcaatgaacacacttgtatgtatactttgaacacttgtgacatttataacagtgcatctgataaattcctagatatggaaccctcgagtccatggtttgtgaattaattcttctcatgtatactgccaatccccttcacaggtgcaactgtcctcccccccagctctgaggatgtctgtgtccacacagtgaggggttgcccattttagttgttgtcaatcaaattggcgaaaagagaatcttctcatgtcttcattttgatttcttctattttgactgagggtgagcattttcacctgcttgttaaccattagtatccccttaccggtttatgtgctttgcccatttttctattcgtttttattttccttattgacttgtaaaaactcatcggtcatctatgttaaaaatattttttccagacggttgtctttagaattcaggatattacattaaaaacacatttttttttcagagatggagtctcactgtggtgcccaggctggcctcaaattcctgggctcaagttatcctcccacctcagcctcccaaggagctgggactacaggcatgtaacacaacaccctacgtcatattttaatacagccaattttaaaaaattctttccctttgtgactcctaggttttgtgtcaaactttccccaatccaagaacatacacttttagactttcagatgttttcttctagtaattttatggtttcctttttacatttaaatcttcactccatcgggatttatttcagaataagagatgaagtggggagctggatttcttttttttcccccttaacagctaaccagttgtccaatttgattgaataattcatcttttctcctctgatctaaaatgtcattttatcatatatttaatttccatttgttcacgggtgtgtgtctggcctctactctgctcctttgatctgcctgtctgttcttgtgccagtacccaactattttattattggagctttctacaacattttagtagcactagtcgtcccttataatacttctttttcaggattttccaagctctttttgcatgtttatttctccagatgaactttaatataatttgtcaagttcaaaagatctcgttgtttttcacatcttccaacagatgtgattttcggacatctcagcccacagccaaacagaaacaagttgagaatagggtgggtttggtggtctgccctggaggcaggcaaagtgatggtaacagaagtgatagtttatacggagagagttgatgaagtgataaagtactataaaagtagacacaagaactacgaaaatgtagccttcatggaatgagccgttggtgtggggccaaaaaaggccttggattttcactgtattacaaccaggatactgatggacccttgtaaccacaaccctgagtcatgaagactcacatgttctgtaacctctgattaaaagcccggaaagcgtgtaatatccactagtgattcctatccaaaatatctctttttaaggtttcagatattaatgtctggaaaactagtatgaaatggttcattcttggatggtgacataaacatgacatgttactggcctctttacagttttctcaaagcccaccttcaaattccaaggagctgccagctccgggatttgaattcactctatccatggaaacaaagctgagggaaatgtccccagactttcagccagttcaaacacaataataaaaaaaggtttacctcatacatgcctccaacatatgaggcatgttataggcagattatattttaatcctcaacagccccgctgggtgaatgctgtactcccattacacagaaaactgaggctcagaggggtcaaacaactggggccagtttaagttagtacgtgacaaagagctctcagctacctccacctgcacattccacagaccagtccccttcagttcactcccacagggaggttcaaaacaccaccgaccctattcagacatccctttgcaaggccctgtcacctgtcttgcccaatgcccacctagccaggagagccaggatgcacagtgaggaaggtggaatgaggtgccaacgtagcccatccagggaaggaagacagccccccccccccggccacccacttgccagtggcccaggtggcaggccagccacttgccaatccccttcctgatcagggattcaggaagtgaagagagtgcccctggaagtcaggagacacctccaagatgaaggccctgcctgccatagcctgacacagcctccctgtactccctgggttgtcccaggacgcagactctgtgcttaccataccacacctttgtcagtggtgtgggcagggcccagcagagtcctggacaccccagggagtaggagctgtgcaggtaacataggagggggtgaaagggaaatgaactcccttgggagttccccatcccagaggaaataaaagtcaaagcactcctttgttttttcttcccaagcccttataaggggctttatggggcttgcctaggtttgaggtgcagcagaggcaggcgggtgagggcctccaggctgagagatcctggggcaaaagtgaaactatatggtcatgaacacgggcatgttctgaactctgtgaaaccctagcccaggacctggctgactgtacaatccgtcacccggcacaccgtaacagaagaccctactacgcgcagaggacagtactattggggtggcaactgaaaagggtcctggctggaggcggggtttgctggaggggtaacagagcgtgcgcggagtggagagggtacggaggctcaccgcccagcatccccaaccccggcgctcagaagagcagcgcgctccggagctcggcgcgcgcgatcaaagccggcgccgcacgcgcacgcgcgcccgcagccgctcccccgcccgcgccgctccggctcccgcgcgcgcgcacttgaggcctcccttgtgcgtctcctccattcgctacgtgcagaatggtccgtcggcagcagctgcagcgctgggtgggagggggaggaggaggggagggggaggcggcgcccaggtctcggggaggggccgcggcggccctggagatagaggggtgggggcgaaggggtgggcccccgcagcggggaggacagagggagagtccgggtgggctcgatgctcagccttccccctcccccgctcccgcttctttctgcgaggccattacggccatctcccggcctgagcctcctggaaccaagccgaccaagaggggtttcctccgtgttgtctcgtccccaaaacccagaatccagacccaagaaagaaccactcctgctgacccctcctcccgctacccgtcccaaccgcattcccaagctttcgtggaggtgacccaacagcaagcacttccccactccgcctttcatggggtggggtccctaagaggtactgcagactaactcctcttttcatctcttaccccacctggaggaagaggcatggccaggatggacaccagagcacatttcccagcatttccaaggggaaagggcagcatctcagcatgcagactccaacatggccacagaaaggtcgagtggcgcagaggagcaggctgctgcccaggcccctagggccacttccaaaggagtgtgaccacgactaggttgctgtggactcactcgcattacagggctgcgccctatacacctgtttgtaaagggtcctcctagaatgtaatggtgagggaccaccaagcggtggaccaagaattccaaacagaccagctccctgccttgccaggaaaccagatgtggcccagatgtccatagcagttcctcccacagggtgggacaccagctattctgtgcaacccctcccaacccttcttccagggtcagggaggaaagctggcaacctccgttgtcccttcccatttgggttgctagaagggagcaactcactcatcctcctcttcctgccaagagccacctgggcttacctctccagcagccacctaggttcaacctgtggtctaacctcaagccctctgctgacaggttaagtcaagatcgccgggaaggaaggcgtccagtttcattacacacacagacgtacacacacacccgacaccgacccacgcgcctgggctctgcacagtggctagaccccaaaaagccgattctcctgttccctccgtggtggcctcagtcttttggcggcgccctctgctggccactaggaagtgcaggaaaaaacagtctgcccatagacgcttggtggatctgggaaaggggacaagaggcagagaaacaagtgaaaagtgggagctgagagcagcgctgggctggccacaaacaagcgaggcatggtgacgccttcctggaggtggggagttttgagccagctttccatgggcctagggagacaagccgagctggcagataggggctcaggacaccccaggagtggcccttcctgtgtgctgagccctacccctgtcctggatggctcatacacccactaactcatatggctgctgtgccctgcttgggagtccttcctgtcagcctctattggggtggtgggtggggaggagcagccatggaaaccctgatccttctagtcatagtctggctccctggggctgtgagaggtgtccccaaagagaagcctccaattgacaaacctctgctccaccccaccccacatacacagaggatggcccaagcccaggtccctggcatggtggggcaggggcctgagtcacagcctggcgtgaccctgcccagtccccaggaatggccagctcgtccagaggtgagacccaggtcaacaatccatcagtctgcctcctgccaccaggtatcctccccatcacgtcctacacgtggggtgggccaggacagtgctgggcagagctagtgttgggcctgtgcctgggggccaccaagggggcccggagaaaagaatggaggggttttcacttcctgagcagcaggaggagccagctggggttaaagacaggagggactggttgggcctacaggcatttggagtctctccctgcctgctgggtgagggaggcagcaggtgccaagaactgctagcttctaggacctgaccctcaagttgcttctcctgctgaggggcttctagggtcaccctcagggccttgacatctgcacacatctgcacaggcccttcaccagggacttaacctccaaaggcagctcctgctcccagccttcacaggcccccctagggcccaagtccccagacccaacctcagtctgcaagctggccaagtcagaggtcctggctgcctggaccactcccaagcagtaaatggcactgtgggcttcctccatcctgtcttccccgccccacttcattgattcactgacttccaacttactggtcaggcccccttccagaccctgcctggatgaagaggactcccagaagcagtgattgaaggcctaggaggatacagagagccaggtgctttaattggaggtaattagttaatttactctgaaagcaatggggcagggcggggacagggggaggagaggggaggggaggaggtagggggctgtgacctaactgggctca

SEQ ID NO: 343 - DNA, 7478 bp, Homo sapiens
tgccggcgccgagtggcccgggcgccaccgagccgcattccggccgcggcccgcgtggcggaacctggcaccaccgcagagcgctgggcctccactgcccgccgccctaggcttggaggactagagcgcaaggaggggtatttgctgctttccccgccctctaagaaacccgcgggagaaagaagcaggtggcgccggcacctgtcaattgtgacaagacgctgccctccgccagggtggctcttgtaacttccctcacctgccaagccgttgaacgaactgttgagaatactcaccttggcaaggccttttctcttccttatcagagatgcgtgcgaccttcttaagcaaattcaacccaacctcgtacaaaacgtccgctcacctcccagccatgttttaattcccttgcctcctcctggagcaaaattatcagaattcggtgctctgcttcaagcagtaatatggcctgtgacccggtttatgatttatttgcaaggctgattcagaaaaaaacttttaaaagttaacttcttttcttttctttgttttgtttttcttttcgttctcgcagtgatagtagttttgttgccaatgggccaaatttggagtcagccagcctgtttccagatctcccctctgcccttctttagatctatacccctgtgcaagttacttgatctaagcctttcgttcttaagctgtgagaaagagattaaaatctgccaagtagttatgatgaagatttagtgcatacaaagtgcctaacgtatagtggggatccatagtagccattataattccaaaattctaaattgaagatccaatcggtttctcgaaaagtactctgtcgattcctcctaaattttcctaggaaggcttctagacttccagatttttagggcttcccctcatacatagggtgttgaatcttcaagcaacttgtaaggaattagacagcaaaaaacagtaatttcttcactttcatagaactgtaattccagtactttgggaagccaaggcaggcagattacttgaggccaggagtccgagaccagcctgaccaacatagcgaaaccctgtctataccaaaaatacaaaaaaatgagctgggcagggtggcgcacgcctgtaatcccagccacttgggaggtggaggcaggagaatcgcttgaacccgggaggcggaggttgcagtgagacgagatcgtgccactgcactccagcctgggtgacaaagcaggaccctttgtccctattatccattgcttcagtttgcctcattcagactaactgtatgtctagaataattgcaggcttagtacaagacttttagatttaacagagcagtctgtgtcccccatctgagatatgtatccatttggagatattttaaatgccaggaccaaatttggctcttgcaggttccgacccctttctgacctactttctcccttcacaagttagctttgtatataccaaaattccaatctccagtaatcttcatttcttggcctcattttaatgcattaaaaacgatttgtcactgtgagtctggtttaaggtgggagaaaactcttaggtcatccacctcctggattttccttccaccttgaaattattttcaggaaaggtactcaaagtagttggattcccatttcagtgcttactgggtaatttctcccaacaagaaaactggtatataagcaataggcaccaatatggagacagaagcaaattttaacaagggcaggcaagcagtgataagaaaaaaatgtggtttagaacaagtgtttctggctgggtgcagtggctcatgcctgtaattcagcactttgggaggccaagacgggcagatcacctgaggtcaggagtttgaacccagcctggccaacatggcaaaaccccatctctactaaaaatacaaaaattaggcagtgtgggggcacgagcctgtaggcccagctactcaggaggctgaggcaggagaatcacttgaacttgggaggtggaggttgcagtgagccgagatatcgcgccactgcactgcagtctgggtgacagagggagactcttgtctcaaggaaaaaaaaaagtgtttttcaaaagccttttatattttttttatttttgagacagggtctcgctttgttgctcaggctggagtacggtatggacacaatcatagctcactgcaggttcaacctccatgggctaaggtgatcatgccacctcagcctcccagtagctgggaccacaagtgagcaccaccctacgcttggctactttttgcattttttttgtagagatggggcttcaccatattgtccaagctggtctcgaactcctgagctcaagccatccgcccacttcagcctcccaaaatgctgggattacaggtgtgagccaccacacctggctgtaagagtctgtttcttgaggcattatacattaccttttccagatttcatgagtagaagctctttattgactgactacacaaaaaggaaagatcttgttgcagaactaaagtttcagctcatgctggggaacagcagtggtgaataattgtttaattaaagggatagtaggcataagcattgctatttacttcttcattctggcaacagtagttcctctttcaaaagggaaaacataaaaaaaaaaacccatccgcccaaaagtttcaggggctaatttatgatgtaactacctttaatggttcccatgatttaagatccaattcagtagtgacaaccagttgatttttttcaaatcatgtagtgccattaacattttatactttgtttcaaaggtcacatattgatgttctcccccagttcaaggcactgtgcattatgtatgccaagggttatgtaactacaatttctggaaatggtaaacagctgagactaaccctaaaaataaattcctctgggattttttttgtgcgaaaatccatctgccctcactgcaggttcatcattacaaaaatcactgtttagctcaaaccaagagacagagaagtcatcatgatctctcctttctgtctccttcctgtagcagctgtgcttcccctctctggtatgtacacacgcacacaccttctttatgccaggagcttttccagatcttcactacaaaatgggaagtctggagaagggaagctcatgcctatcagatgttgggagaggaagcagatgagacttatatttacttatttatatctagtacgcactccagtgatccacaaagtcatctttgggcctaaatcccttgttattctaccaataggttaagcagatttggatattcctaattttggttccaaataaacaggcagtgtttacctagcttcaaagtttggagaatttttctgtgaacattttgatatttttcaaatatggggacaattgaattgacaattgaagacataggatagaaaacccttaaaagtgataaaaattaatttggtgcttctgaattgaaattcagatctgaatactatttgttgtattgttaaatgtctattactggctaaacttttctattttcctctaattacatgaaggtgccaactaaatttaatattagaaacaactatgaattttaactaactcatacataagattatagaaatgttgcttatcaaacagtaccaaagggcacttctgcataaactagataactgccagggcctacacccttccccttttcaatcgggactatcacactctcccctttctcaatcaagggactgtcagggatcatcagaataacagaaaacctaaagctaccaacctccaaaacacagagttgacagccaggcacagtgactcacgcctgtaatcccagaactttgggaggcagaggctagtggatcacttgagcccaggagtttgagactagcttgggcaacatagtgagaccctgtctctaccaaaggaaaaaaaaaaatacaaaaattagccaggcatggtggtgcatgccagtagtcccagctactagaacggctgaggtgggaggactgcctgaaccagggcagtcaaagctgaagtgatcagtgaccgcaccactgcactccagctgggtgacacagcgagactctgtcttaaaaaaagacaagccaggtgcggtggcttacgcctgtaatccccgcactttgggaagttgaggcaagaggattgcttgaggccaagagttcaagaccagcctaggcaacatagcaagaccacatccctacaaaagttaatatatacaaaatacacagttcatataaaatagaccatgaaatataactcattttgactggtcaagccttcctctgcccagtcacagatacacttgaaaaattcacaaaaagcagcttataaagaaaacccataaccacccttaatatacatttcatcttggtttctctgccttgagaattgacctatggagattaagcatgaaattaatcatattatagttaaaatgtccaattgcacttaggacttttttactgtctataacacaagtttgttgttgttgttgtttttgagatgaagtttcactcttgtcaccccaggctggagtgcaatggcgtgatctcggctcactgtaacctccgcttcctgtggtcaagcaattctcctgcctcagcctcccgagtagctgggattacaggcatgcgccaccacacgtggctgattttgtatttttagtagagacagggattctccatgttggtcaggctggtctctaactcccaacctcaggtgatccgcccacctcggcctcccaaagtgctgggattacaggcgtgagccaccgcgcctggctacaagtttttaagtgattcaaattcctctcttggtgagacttatgtgtgaaaggaatactaacaggtcagtaagttagctcaacctctggaataagaattcatctaagtcttctaatccaattgtaagaagcaaggaagcaaattttaaatcattgggtattgactttttattattagtcactgttcataatttgtttcaaccaaaagacagtacacacagcagaattctaatgcatcccatgtaaatgtttacatccattttattcctcactcgcctctaagacttatcatttaactttaaatttttttttttacatctcaaaaatatgtctgcaataattagagcttcattagctgtcccacttggaaacagctttttaatatttttacagtaaagaagatgtgatggggcataatgaaaatgtaacttacaacactaagaaagaaaagggcctttataggaacacagtgggagttcataaaggaaagagttcagaagctctttcccatggggcccccaaatggaaaacaaaaacaaaacacacaaagcgcaaccgcaggttctttgagggaagaaaaaaaaaaaaaaaaaaaccaactccaaggctccatcttgaagccagaatcagcctcttggaagtctgtaaagcaactgtgcaagctgcttcggcatttccttctgttaaagtgttccaggtcctggaaccctgtcgatgggacccactcactgatattgcttgaaaaagttattcacttccagttctacaagcagccccactctcccgagccaaagctggtcaaaagtgttttaaacttcaggactttctgtgcaattctctctccaatgatcctacccactcccaaagtcatgaatacacagacatgtaaaaccactctcccaactacaaagttcatgaacacccactttttcctctctagttttctcagtttaggacactgtggttaaaatacattcactagaaaaaaatagacacattcaaactcctttcccctagttctcatggcccaaatattttccaatgcagaagataatgaagttgaaccttgaaagcagtactccctaacttccaatttctacgacataaaaaaaatgggaagcatgttatataaaccattagtgttggacagttttaaaagtctattttcatatatgaatgggacaaacaaggagtacaaatcacacctttaaactagcaagaggaaagaatcccctcccaaatgttacactgaggaatgtttctttaaatgataaagaccttaaaattaacagatgatcactatgcacagcctaaaacttccgtgactgtccaaaccacctcaaggtaacagcaccaaagcactgtgggagaagcttctcagggagagcacccttcctacagttttttgagattacttagatgaattaattctcctttaggattccccgggatggggcagaaactagaatagaaacgactcttgaagagggaaataatgaagtacaagtgcatgtgaaattgtcaaagtaagtgtgtgagggctcactgcttatcaccccagggttatcaaaacagccttggaaaatgctctttcctcacaatgcctgtgaagtcgtaaatccatccaaatttgctcccccttgagtggttatactcgggaaaggaattattgaaatgtgcaagtattcaaagaaattgaaacatttctccatttagctgcaaggccaagtgagaggaaaactaattctgatcctagaaactaaggcacgctgaagctttcaaagatccaatcatttgaaacagtcttcacaaccatcagtatcctaggcagttatttggctgctagtccttcagtatggtgcttgtgttctgattccaaaatcaattcatattctacgcagcaccctttgtgttaaggccatgatattttactccttctagacaaagctatgaatgatcataaactctacctcgaaactatgatcacccaaggaaatgctctgtcagcagagtagacccttcccagctccattagctgacagtgtcttatagcatggtcttgaacagatttcttcagagattcaacccagttcaaataaaaaaacctgagctggttagctacaaatataagagagaaaataaagcctctacacaaagaggaatgttaagacaaattctattcaagaaatccaccaacattatgttaatcctatcatgtttcacagcattaagtatccatccaatgaaatcagtctgcaaagaaacccttaaaggctatttttcattgcacaggcagagcagttgtctgaaatatgcactagtccacacttacattactgaaaactatgcaggagatattatcctgttcttgactcagtcaaccatttacccagtggagtaagttttagcagatcttgctcatacacactagtaagaccagaaactttcccgtggagcctttagttcaactccagtttgtcaaatgttaggaatattccagcatctgatacagagctagatttgacaagacactgaagattttaagtaaaggcttggtgaaatgaaggggaaaaaaagggatatttgtttccaggtttaagattgaagccatagtagtcattatactgtattcaatacagtaacaattgcaaaca

SEQ ID NO: 344 - DNA, 4576 bp, Homo sapiens
aaagttgagaattggctaggattttcttcaattcaccaggaacagaaatatctctgttaatcaaagctaactcttatggaggtcttagtatgcactatgtactaagcagtgttttgcttaagctgccatatttaattttgaaaagcaccccattttacaaatgaaggaaccagatttaaaaaaaaaaaaaaagaagtcacgcagctttaatacatgatgaagtagcaagttgaagccagaagcatcagactctatgagatttggttatgaagtattttgctgtgctgacagatacagataaacatactctgtcctctgtctcctttcttttgtcctcccactgccactgttgttttcataggttatgagggttttgtttttgttttttcttgagaaggagtctcactctgtcgcccaggctggagtgcagtggcacaatctcggctcactgcaacctccgcttcctgggttcaagtgattctcgtgcctcagcctcctgagtagctgggattacagatgcccaccactatgcccagctaattttttgtgtttttagtagagatgggatttcaccatgttggccaggctggtctcaaactcctgacctcatgattcacccaccttggcctcccaaagtgctgggattataggcatgagccaccacgcctagcccacaggttatgagttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaggttatgagttttaaacaacctacaaatcggacatttgtaaactgggaatgtttatgaatttataattgtgctaagcaaaaatatgaaatcattccatgtataaataaaatcacatatatcctccaaaattgtcgacaaaaatgatatgttcttcatctcaggccaggatgacaaatgctttttgaacttaaatgcaaactccagtcaattgttagtggctcctagggtactgtgttgaaaatgattctaaagcctgaatgtttttaaaaattatcacatcaaggccacacattgccccactgtctggtcccactgacccacaagccaccaccccacagattggctcggctctggcctgagtcatatctggttcccccagccttgctgctataaagaaagggcttcaacagctctggctgaaggctgggctcaacttcatcaaagtatcccagggatcttcaaacttgaaacaattctgtctgcagaatgttccacatgacttcctgctgactggggtatcttcgagtacaaaactctccagactccagaacgtctgttcccttttgtggtcaaatggacctttcaaaggtttcccaaaccacttctcatgaaccagtgaatattcaaaagagagctagaaatttgaagcctgtacaaaaacttatccctataacatatgtgccataatatacaaacttacaccttttcagtccttcacatctacctctctgaattttcatgaatttctatttcacaagggtaattattttaggtacactggcagcagcatacaagcaaatatgtagtatgaaaacaattctcacaataaagtgagggcagcagaatttggttatgtgtatgttcttttttaatgacttttttttcgtagatatgaccacttgctttttcactttaaaaaataagattctgagaccaggcgtggtgtagctcacccctgtaatcccagcattttgggagaccgaggtgggggtatcacttgagctcgggagttcgagaccagcctgggcaatgtagcaaaaccccatctctactaaaacaaataaaaataaataacttttttttgaaagttgagtgtggtggtgcatgcctatagtccctgtagtcctgactacttgggagactaaggcaggagaatcccttgagcctgagagattggagctgcagtgagctatgatcgtgccactgcacaataatattaaaaaataagatcctgggctgggcatagcaacctttaacacctggagtagtagccactctggaggctgaggcagggagattgcttgagcccagcctgggcaacatagtgagacagcatctctaaaaaaaaacaaataataataataagattttattgatgcctcatttgggtcatattatagttaaataaggagaggcaacagaaaatcaagggttggaaatgccctcactttactgtgagaattgttatattagataagaattacttaaatagttgagtaacttcaatcttgataagagtgactaatgtagaggaaaattttttgggcatagcttggtaaccaaaggagttcatgagctagtatagtaattatattttccaaattcaaattggaacatacgacctcataataatttttaaaatgtataaatttattggtagaaaggtacttggcaaagatattaaaattaaatagcattcaaggatgttttaaataaatcacctttatagataaaatatagaactacagtatatttgctgataattctggaaaatacagtgttgttgatttaaataacaataaaaaagaatttggagttgctggtctctgatttctccaaagaaaagcttttatagctttccagacccaacatccttcctgaaattcactcacctccttctgcttctgtctgaaatccatataggagaggaaacacacatttctctccagattgaggtaatgttcttaagagcagactgtcagtcaggttctgagagttcaatttctagaggtacaaggaagccacttcctatattacctgtaattttagggtcattcacatggagattctgggctctcacccttttgcttgcctgaaatctacccttctaatcatttgcttaccctccaggggctgcttagtttcagcttgagtattctctggtgagtaggcaatctgctattttcatgaggggtctggaaattcttcactggagtatgaattcctccaaattccaggttcattgtccttgcttacgacctttagccccagttgaagacatttcccgcagttttctgcatttagcttcaggaccctctgccaagcccagtgctacaaagtctttttgacttgggcatccctagtcagctctatccctggattagtgtttttctctttttcctacaataaacatagaaatgggagccagtatattagctcagtgaaatctcaaggtaaacctactacgcttcctttattgcccatcaataatcctttcattttgtcatgttttcttgccttttcataccctgatagttatctgtacttaaaggttaaatcgagcttttccactcctcattttttccccttctattctttgatcctacattgaaatcataatgctggacttgtgacgtcactctcaattgtttccagatggcttatcagactgatcaaaaagaaggtgaagccaatatgttagttaaaaagtagatcttcaaacagggagatggttcagaaaaaaaaaattgtgtaataataatgttgagaacacaaaacaactataggtaaagtaaattgccttttctctctgtcctaaaataaaatctttgatcaattgttccagtgtatgaaaatttgaactctaaagagaccaggcagctttctaaacccaaacatcaaaagctttgcttccattagaaaaatttaaacccatgatactttgaatggatttgaaattctctaaaatgagctctaataataaccttcccaaacagaaagaaaaagaacagtaggttatatggcttcgtgctaccattttctctggaacattagttttccaaagatgccattttggctcgtaccaaataaaagggcaaaggttaccaaatgcaagcctagggaagccaggagacagaacagctattacaatggagggggaaatccaagctgtcagctctgaatggatagaaattgcatgtgtgaaattgacaaccagcaacagcatggtaccgtcagaggggccaggaaatgagctcgaccgggatttctgtttactgtattagagctgcggttttgtagagttttatttaagattcacagatacaaatcttcaggtttttgacaactttagtaatgttcagtggctgtttggaaaataatctaaacaaataaaatatcagaatgagaatggtagaactgatacaggaaaaaacataaataaagggaaaaaaatcaaccatcatccaacctcccaagagtctctgttaacaaactgttgcatttgcttcctcatacacacattgttatacaacattgaaaccaatttgtatatataactttgatttctgtttatttagtattatgt

SEQ ID NO: 345 - DNA, 56626 bp, Homo sapiens
gcggcagcagggttgggctctcgccgtgagtcgacgaagggagcgcgggcgcgcgcccgcgtccgcgcactgagagtcgcctcggccgctcgctttctcgactcccgcctcgcgcctcgatcctgttccgcctccctcggccctcctgcccgcccccactcgtcggccctcaggtaggaggcggcgcgccccggggtcgggagtggaatcgctggaggctgcgagtcgcctgcccgcctgtgggcgcgcccgttgggaggggagcgccccccagcgggcgcgggcgcgagggcagccggcgcgctgggcgagcctggctcagggtcccggcggccggggtgcagggcgcgtgcgcgcgcggcggggcggggcctgcgcggctctggcgggcgcacgtggtgcccgggagctgctgggcgggcactcaccgcggggactcggtgcggagccggggcgccgagtgtctccgtgtccctctgccccagccggcggccgcgatggtggagcttggcctctcgctctctcccgcctctccagcgactgctctgccggccgcggaggtcggatcgagcggtcattcattcatttgttaattcgttcacttattcaggggagatcattgaacccctacggagtaccgggtactgggccgggcgctgaggacgcggggctgagcaaaagcagccgaggcccaccttcgtgccccttaaaacccagcgtgcggggcggcaacgagtactgcttttctgttttgcacttaaaatttacattttgcatccgtactttttatttactgtgcacccttacggcatgctttacgcacccgtacctgcacctcctagccttgagtgtagacaccagatcctgagatgggcgatttttcgagaataatttttaccctaagtggattttcgtgccacgcatggacttggaactacacacacgtagtccaaaacgtgaaagtcaaaatgcagctttgccaagtggcagggagaaaggagagctgagaagatgaggagaggaagggcgcgctccaggctttccagcccgggtgcggtagacgtagccctgaaggatgaacccaggctggtagtagggcggcgggagggcggggggacctgtcagtcaagtccaaagcagaaacgcggcgccggatcccagtcagaggccggctggaacgcttcccacaggctcctggcgctccggtccccaccaggcgaccttgatcctggcgtgctcagcggagccagcgcagcgtcgggagctggagagacgcggggcgccggctgagcgctcctgccctctgcctctgggctagcctctggcccggcctcccggcctcccccagggtacgctctcccccaagagcgaacaccagctttgggatcgccagcagccacgtctctgcttctagatctcttttttttttctttgagacttagttgatagctgtttaaggaattatgtggaggaaatctcacctccgacccccgcccccgttgagcacggccggccagggtcgctgggtgggccaggaggaaagaaaggggcggggaagaagcagcaattttactttaaattaaaatgacacaaaaatattttttcaactcagatctttctgagacatccccagaaagcgttgcaagctgtgattacacctaatgtgagagcatgaactaatttaagaggtgagagctgcataatgaggctgcctcccgtgtagcagccaagactggcagctctggcggcgcgctggaggggaccgggaggggcacccttgtagaaccagtccctggcgccctgggatcttctcagtgccctggcgctgtgttgtcggtcactccacagatattacagggtgcctcctgaatgccgggttgcaatcaagagcaagagatggggcgagtgaaagagcctgttttcaggagctcagcatcaggatgacgattacctagagggaggtggtggccagcctccccctcttctcttcatgctgaggctctggtgggcagtgcccaagcctgaactgccatctgtatgccagtggttacccaacttgtattttcagtcttagcctctctctggtccagacttgtcattctaagggccctttttcactgactcacattgtctcctccctccctgccttccaaactcagccttttcctttttccctttcccactgacaacagctgcacgacccccccgcccccccacgaggtgaaaattcccaagaaccccatgtctaacctaactccctctctatgtcctgttgcttgagccattctcattaggctgcctgttcggagttcattatctcctaatttttcatccaggaattgatgaagaatcacctactgcctctcccacacactgtttattctttcatttgatgatatctgttaagtgccctgagatatgtaacctccacttccctcccatataagtgagatttcacgttgattacttccttggctttcctcatcccttatccacatagcatgtgttcaaaataatgaatattaatttaatgttaatagatatgtgctttcctgaattgtgaggattaaatgaaatcatgtatatagggaggaaaatccattagaaacctcaaaagcagttatgtttatttttgctattgtcacattgttagagtcagaattcttttagctgcaagtgacaaaaccaactcaaactggcttaaggactttattggttgatgcaaaaagcctcgggttaggtcttgccatttaaggtagggctggatccatcaatccgggttaccaggatctgttttctagttgtggcttcattttcagacaagttgtttccatatgatagcctcatagaaggtactaccagcttagtcctagcaagaaaaaagagtacttactcttcaatatttgcagcagaagtcccaggtctgttcttatgagggcagtttgagtcacttgctcttctctgaacgtggagaaggcactgtttagatgatggaggttggattcaggtgcatcccctggaatggggtttggcattagcttcacgtggtctagaataaaggggttctccaaaggaaaattagggtaggaatgctgagtaagcagaacaaacagatgtctactttagtccttcccaaagggtgagctgcaatacattgcagactatcagaatggtgatgaacacggatgcagtagccaagaaaatagatgtgtgtttgtcgtggtctttttcagtcttcaagatctcagttaaacatgaagtcaaccactcactatgatgttatttgaggtttagctttgaagtggaaatgtaccacaaatagtagagccagataaatacaaataaataattttaacagtccattctaaaagatttctttggtaatattctgttggaattgatttctatcttttcatttgttaggttcctggaaagtgaaaatttcatttctttgtggacaggtacctaaaatgtctcattattcatcaattaatgaaaaacaaatgaaaatttgagagagatattctgaagaataaaaggatcaagttgggtcatttctaaaatgtaagattataaggtttaacttgctaagacttttgaggggttgaattattggtaaattattatagaaccacttatctgaggcttttaaaagtgatgtgttacagagatttagggaactgcaagattgcagataaagaatttatactgtcaactgttctatactttaccttctgctttaaatgcggccttatattttgaagtcaaacatttattttctctcactgcgttctgaatttcctaccacagtgcattttgagaaatgaatataacagcagtcttcatagatgccatattcatggcaactctgtcccccgccaacaccacaccctggaaaaaaaccaactttctattgttggaatgaggtaacattttcaggaaaagggaaccattttctcacaggatatagaacaaattcaaccttttattaaatcaaaatggattctctaatgtttatacatatcatataggatttcatctctttcaatcttggttcaaaggcccagacagtaccattccctagtatttagtccatttgctcataaagcagaagagaaaagctactttgttccgaagggtgttagatttaggattccaaggttatttcaaattaatgcctggaactagactataaaatgcaggaaagattctaagttgttcaaagatgaaatatcttaactttcaccaaaaactctgtcttctgggtattttttgtttttctgcctttccagatttattttaaatacaacatttttgctgtttacatttttaaaagttacatttcaaaattgttcataattggacactttcataaaatgtaggcaaatgcagttttactttttaatgaaggacaagtctgttgataacattttgattcttaaaattttttttatcttataaaaatgaaacaatgcatttaaagtgtcttcagctcttatgttaataccaaattatacattttcttagcccatgttcaggagagacaatatatcttccaaattaagagaagctggcaccatttttaaaacaaggccttgaatctgctgtggtatgtgctggtaggaattttgtatgaagctgttattgaagtagatgacattaaggtcaaaggaaaaaaaaaacagaaaataatgtaatcctacagagctgctcttaagatcttgagagaaaaaccacgtaggtaacatcaaacactagttggaatctttccaagaagtaattatctgtgtgctgtttgtggtggttgattatgggaacaaaccaaggtttagccaattcagcaaacatttatggagtgcctgcaatgtgcatgtcactgttttaaggcctgtgcctactgtaaaggtgacccacacatgatgcctgccttgcaggacttggagttcagcgataataagagatgcatacctgaaaagcctatttaagactcttccggttctacaaagaaggcttcttgaaagtggtagctttgattactctttggatttatttacatttatcctataatcagaaggtatacaaaacagactcacacatatataaaattaatagattagatagcatttaaacaaatatttcaggtaggtacttcaaatgcatttgacatttatcaaagaaatggtaagtgctgtcatccgtgggtggctggattaacatgtgggactacttatcaccaattttgttagggatcttagggaaattcctggatcttatattcacaagcaattgtataaatacttcccacagctcagagacctaataggatggggtcttagagaaacatcttttgagccacagacttctttgttaccagaaggaaaatgaaagaagaaatttaaataccacttgaagagaggtaaataaatgagaaatggggctgagagggcgggtatttttttaaaaattcattaaatggaaaaatccacaaatgttaattctggtagatttcttagaaattacatcagaggagcatgcttggtcttcccaccctcattaggcctcagtgacaggtacttgaacaactgagcccctaatgtgcatgctcccccacccctgaagccagtctctgccctcctcttccctcctcttgcccctggaagctgatcgccaccaactggcctctgggtggatttggccaatggaagcacctgtagagggaagagagtgaggttaggatatttcttcctgctgtctccgtgcttccctgcagagagtgtgaagaaatgaccctgaaaagcctctggcagaggattcttctttcaggatggtgtcgcctcctcagcagcccatcctcctcccctggactcaagctctcattccagtaacactccttcctccttctccatcttcagggggaggtttgccagtcggtgggttctaagcatatctcgctgattccccccaaccctgccgacacctctgtaggtcgtcccttcattaaaatctctccatttgaactatctgagtttaattccatttcctcctggtatctcagtgatacacggtatcagtacaaaaatctcgcttcaccttcagaaccaacagatttgagacattttatcctctgtggaaccattagttattttgtcattggttgtatcagaaaaaaaaatcaggaatgcaaatccttctttattacagattcagatttgcatattaccaatgttatatattttaaacaaaactattcatcataagttttaaaaattaactactggagtagttaatgaatctgaatgtaattatgtagctttcataatattaaagtaaaaatactaaaagaagtatttcttaaagaagcaaatgctcaatctccaagtaaattttattctatgctcttccggtataagaatatgttaatatcttgaaaaatatcatattattttgtgaactcataaagctattttgagtttttgtaaaatgaaaaccttaccaaaatgtattttattgttggaaagcttgaccgttactgctgtttaattttttgagcttgtaaactttatttgtgcatgttttcaacaaagaaggattttattgttattacataaaacaggtgatttctagattttaaaatcacaaattgaaagcaaggcacaataatatatatttcaagatataggtacttaggaggcatccttttagtcatctgttcaatgtagccatctattttacacctactgtctactattgtttgaggtccttgccaaagtattgcaggctagttaggaaacataaaacaattagaaagtaatctatgacaagtaagctatctataaatggcaatgaagggtagaacaaattcaatgaaaatatctatttaatcctagtgtttactggtctagaagaataggctgagtaaattagtatttctctggctgttgtggtaacacattgcatgctataacagttttaagtaattacaggtgcattgaaatttatctatggctttgtcatcatattctaaaatgtcatgagtacttttttctgacctcaattactatgaaattggtttccaatatttaattaaccaagaatatcaagtctatagggtattattaaggtgagacttctgtagccttttcaataaagaccagaattttggagtgccttgaaccttaatcattgatctttaattcttattaagtcaactgcccaccttttaaagactgaggcccaggaagagtaagtttctctgagacaatgcatacagtacagtgcttcttgggtattggctctaagaccagatgcaaagaaaggctaaaatcccatttcattgttcattaggtgagaaccctttgttaagctgtgtaacctctgtgcatagtttcctcatcagcaaagtcagaaaaagtatgtacctgaaggactgattgtaaggctgggatgagagaatccatgtgatcagccctcaccaacaggtgctgcccagttcatgagtgctgctgctgtcctgcccaagtacccagcttgcagagtgccagagttagagtcccaggggtgttctccacagctgcatgcttgatccaggcctatcaggtgagttggctcttggctagtggtttttcttctcttgctgtacaaaagtccagacagtaatgtctttttttcatttttatagatatattccattgaaagtcctcattctcaaatttaaaacaaagactttttgtgtacctcaatagcaatgcacacacagttggcttcacaaacatattgtacatttctttttttcatatttattcaacaaatgtatattgactacccaccgtgtgacaggtgttatttgttgacggaaccaggcatcatcagcaaacaaaactgacaaagcttcctgccctctgtggaaggcatctgaggaagagactggattttgtagcaacatgttattctcattataaactttatcattggaatactaaagccaaatcatcccccatctccttgatcaggatacccacttaatctaggcagctacacaattgtgagagcctttgtttttttctgctgaaacatccttaaaaagatacctcacaacccaagatttggcttttcttaaatacgatttttaatttttttcatttctatctagagatttaattggaaatggaaaatcatcaattttccaattaaatgtctgttccaatcaacattataccttttaggttgtcattgtcatttttaagtttaagcaactttaaggattttgaatctggctgcctgtaaattaaaggtgaaagtaatcattgtgttggattggaacattttgtcaattgagagtggtttccttgttcttagtgtatgaaaagtttatttttctaatgtagattaataaaggagataaagaaaaacaaaatgagtgatttatgtgtgtgagaaaagaaccatttcctcaaggattaaataaaattcataccttttgtttcttttgaaaagtttttaaaataaattttaatgaatgtgtcctttaaatattcctttaaaaatgtatcctattttaaaatggactctctgagagaaggaattgatacctgtgtttaaaatcaaaaatagcatgcatagagactgtttttctagttggttgaagcttttttccctctcctttacatcagtgaaccagcatcttgcccttcagaccctacagcacactcttgggctcatgaagtgtatgacacatcctccttgggggatcggccatgtcctcgctctcatgaccacatgaattcttctgtatgtcttttctcacagctgagtactctcttcctgacccccttgtggaatggggaaaggaggctgtgacattgtgcttgtgcaaacaataattgagagctttccgagtctcctgcatcttcataaatgattttttgttttatgctgggacagtagttctttaaatagaatattctcccatggaaatcgcccacaatgctgagagtacaccttgcaaaaggtaagtctagaatatagggtgcctcctcagcattgcccagaagctgaagttaggactctctagaataccaaaaacaaatttatagcagttcattaatgtaaggaattatgaaaactgtgtgccaccattatccatagatgaaacaagagccaccacgcaagcacagacacaaagccctgaagatgaagccattgacagggctctcatttattctgtagaaacccacttgcctgtttttgaaccagttttctttggagcatatgtctcactgtgcaaccaaagtggtgtttatatcctagtcacttggcaaaaattctgtcattgcttcagggagatccattttaggcctgaagcatggagctggtaatagatgggatttggtacttctgaagaaaagaccctactgcaaatttagagagttaattttttcttttgttccccataatattgttgctagatagaactaccttttttgactagaagttaaatatagaggcctaaatcaattaggtaactcccactcattctaaatgagaacatgtttgtttttctccaacgagatgagaaatatttgaggcgcttcctgatatctctatcacccactgcattttttcacttgatgtatatttccccatgtatttgggataattttcaaataattgccctttagaaatctacttgatattaaatgtaaaaaaaaagcaagatgcaaaattattataggatgcatttacagaaattacaaaatttctataaactatttatggaggaagacttatagagtatatgtcaacacattgctttattattgtccttggttatgagtatggtttttttgaaacctgctttgtactttgggtgttttctcaccattggtacaattgaggcatttttccctcttcttcaaccttgcaaatcacacgtgaggatgctcatagaagtgcctctcagacaggctgttgttttgctttcaccaataaatcatttataattagaagtagaaaactattctttccagtgcaaatacatccctttcaaaagcagttctctttttgtgaatgatgtctagtgtctaagaaacgagggtaacctttattatatgcattgctctaatcgaagcattgttttttgcggtgaactcaaggttacatgtttaagaaaagcatcgggttaattccattaggaaaagtgtcttattcataaacctttagccactggaaaaacaccattaggaggccacacaagtgtgtatagctggatagaatttgacaactggcaaaacaaaacaatagcctacaattgcagagtgctgtctgtttaaaaaccaacatatctttcaccaacaaatacatattcacctcaacacgagactttcatgtggttattaatatcaaatttttgaatgtccaaattttggagtgtagtctagcagaggtaaactgatttgcctaaggtccttcaactgtcagaggtagaattattttctctctcctggctctaaaacctgtccagattctcctgcaacactgtccttcaaaaacacacttccgctgactccagtgctggtgatgtcatgctttagctagtagttagaggtgacttaactttaaatatggaatctttttttcctattaagcaatgaggtttagtttgaaaattcttagagatgataaacccctctcctttttttcttccttctcctcttttgtcctgaacaatgttccatatatattactgccagaaacagattcttgacattcctgttatgcttttccacatcttgtaatcatttctacagctgttagcattgccaacaattatatttccacttttaaaaaattgttacaaagatgcagagagaaaagaggaaagccaaggaataaactacaggcaattatgggatatttttgtgatgtgacattttgggaactgaggcagcatcactgatactgcactactttttaatatctagattttaatcttttgtatgaagataaaattcacatgccttaaacctgaccacaacataatagggcatttatttttctaattttgataccatccacatttcttaactataagaagaatgcttatgttgtaccaggttatatgatgttgccaagaagtagatgtgtaccatttactaatacatccttttggaaaatgcgtattaataacatattaaggagtaaattgacgttgtgcaaagtgagcctgtgagtttaaatgtatggattgtacaccttgctcttcctaattgcagatttaacaggatttgatgacctaatgagtttatttctgaatgatttatatttctttgtcagttcaatgatttagtattttaaatttttttaaatcacattttattgagataatgctattagtgtttctttcccatcacttaacaaagttaagtcactcctctcccaccccacttttgtacctaccaatgtttttttcacagttacaggctgattggcttgacgtgtcttaggataccacccaaagagagcttcattttataaataccaagctcattttcctaaatattttcaaaaagatagatttatcctcatatagtaaattcagattaataattttggaaagggtcatgtgaccatggtattacatggctgtggaagaccctccaagatcttgttttgggatagaaggactcagacatccaaacttttaaattaatgaacttattaaattctaaaactttgtaacagtgttaatttgagaagtataatattttgcttaaggtctgttttgctttgcaaaatgcatctccttcattttcatattatgttggaagcttagcatgaaagaacgtgcctcagaggaaaccataggtaagcatactttaacaaaagttagtgtcatcatgtttgtgtctttgcctgtggttttttaaatgtataatgtttaacgttgatttggctatcaaattacattttcttttgttaaaaaattctgtaaattagaaatgtactgaatcatttatttagcagactgaaggtgggtaatgttggctgaacaggtttaagccacagtaatttgaaaatgtaaatacataaaataatgtcatttctcttccactcaatgtttcttcaccaaataaagtccagcctgctctgaatttgttgccagtaggaacaatgttacagtgaatcatggtttaatataccttgaaaatggcacatctgttctgtgatagcttaccaattttagcctctttataaaatacgaagagtttgtcaaccagaataatctagaacctggcaattcaaataccattcaaagcaaatgttttatctaataactggaactaaatgttaggcctcatgacagttcaatatttactaaataagtttaataacagggtaagccctcagtatccagagcagagacaagcacaccatatttacacatacaaattctgcctttagccatctgaaagggccccgaactattgcagcaagcaaagagtctttgcattgtcctaaaatccatacaatactttatattttacacattttaatagctagtttaacaaataacaagtaccatgcttaattctctgcatgcattatttcaactaattattggaataatcttataaagtgggtactttcgtctcagcttacaggtgagaaaacaaaagttaaatagatcgcccagggctctgctggaacgtgttaagcagggatttcagcctgtccagtcagaccccagaagttgtgttcttaaccattagcaacacatcatcccaggcaggccctacatgagcctcataaccaattttatgctggatagtattatccctatttcacagatggcaaaactgaggtccagagactttaagtgacctacccaaaattacagtcatgagcagaggcactggaatgtagggccttgacactctacctcacgtggtcctctttcctgttttgggtagttctccactaccactactcatttctgatgctggaaaggctgtgttttatacatttctgtttctggcttggaacgaaacactctgggtctctgcttgatcagtgtcccctctaaactgcacctcactacagtagggatggcataagatacttctttacacagcatctttttgttcccacctcacccccagagctgtaataggtagagccagccaaatgtcaaagggatgatttgtcttgtcaccactagtttcccttttctctgccttgtatgtaacaggaatattctttagttcctccttatgttctaaagcacctccccaacctaaaaatagaagaggagttgtgggtcatttacactttagtgtgaatttgcccttgtgactttgccaaggctgttgtgcctaaccctttcaatctaacagcagaatgagagtctctggactatcctggctccttccctgagaagaatgaactgggaattgttggtctagacatcaagactaccagagacctattgctcagagatgtttgggctgtacaatttctgtagatatggcatctggagcagccttttctaagcaatggcattatcattccaggctctctcgctctttccatctctccaccaggtggactcttgccctccaccccttccaatttgtcagtgattcagagaacattctccatccttccaatgattacattccttcatcttgctggggcgccaattcagtgatggagcggctcttgggagcagccttggcttatagtgcagctctctgctaccttcaacaggctggtattcggggtgcttagatgtgactggttgtacgcacgtgtgtgtatgtgcatgtgtgtacagcagtaagagctttcgaggtagatacttgaggaagcctcagacatctagccccattactggggcaatgtcttacttgggtttttccagaaacagacctggagaccaggattcaagtgccagtggtatatttgggatgtgaaccctgcaatgctggtaggagagtggagaagtgaggcaaggaaaggaaggccgtcaaggggcgtgttaggaggtcattcaccaccgcaggtagcccgctggggacctctgggagcaagtgtggcgcacaagcctcagcattactgccctgtgccttgaggagtaagggataaggattttccccaccagttccctgtagtccttggtgagagcttctggggtggaggttaaggtctttaggtcagagaaattttctttagtttcggaaaaatctttcaggccgaggtccagacactcactggaacacactgaagtggttaggtccaagggctgtaggcagagctcccatatccatctgcagaggtgtttcaggtggaaggagtggagacagccttctctgctccacactgtcttcagcaagggtttctgtatctgtgcattgaggattaaattattcacatggtcagagaagcccatcaccactgatagttattgtaggtatggaaaactaacgactaagaagggagaaaaatataccaagcagttggcttggctgaacacaagtaaagactcttacagtcactggtgtgaactgcttattatcaatgtctgattacagtgctgcatactaatgattatgcatgtcattaaatgtgtcagattaactttgttataaaatttatgacaacattaaattttattcacatgctcagccttcataatttattgcttatgtagcatggttttaacttcagaaaaacctccaagacagtgttgtcttgatgactacactgcttatccgtgagtctagttttcctgttcatttgaaatgttcacattacattcagctctgtctcaagcactgagacagagctggaatcagtgcccagcgattccacttgccgagtgattgaggctgggggattactcccctctctttgtgaattctcttgctgtgtgttattgattaattcaaccaactcttagttgaccctaaccatgcaacatgtattgtgccaggtggtgtggatttagaatatggattagaccctcattctgtcctcaaggagttcctggtctagtagagaatcacatcactttatagttgattgttcaagaaggaagcttgttcaaacatgaataaaagactgtgcatcttctgactttgtaggtgtggaataacaaagatctgttcctttattgggtttccagaaaacatctccaaagctataccagtcatcattttgtgctttcagaaatgagtaacattgtaggatagtacttattgcttgtacttagctttgtgtgctagctgagcatttgtaaatagaaggcattcacgggtaaaatgtgtttcctttagccaaatgcacaatggtagtgcctttctagaatccaagctaaagatgtcgtcacatgccacatccacacacttcttagcaaaaatccaactagaagaactttgctatttacaacaaaggcaaatgctgtcaagaagtaggcttagtaccacaggaagcggagccaaatgtgttcttgaaatttataagttgacctgaaaataatgttttgggaagccatggcttgccgttgtcagctgtcaaaattgagcttggcaggagaaatcagggtcaggaacagaatagagatagtcaaaaagagacagaacagagagagggctactgttgtttctggagtccagtgaccacccgggttctagtgtggtactggcagtggactaaataagtggatccaccctaaggtggagagaaggttcatatggagataatttaaagagctgacttttagcccttccaaagaattacatgttcctaactgccaacctaggaacatcctggattaacttgcaatttaaggctgtggtatacctgtttcaaataaaatagccctgtgaatagcatggaagtcaaatgatatcaactaggtttgaaacaacctccttctctcttttgaatggagcagtgattaaacgcaagacatcagcttagaaaatgcatgtattagcaaacgcctaagatgaggaaagatctgggcatgccctgaagccaatgcaatttttctttctccaccccaaacctgtgctacgtgatgaatttacagtattaaaaacattgctgccgcctacttcttccagctgggacttcaggaccatctttgaatcctcctcggctctccacacccagcagtgcagcaactcctcatctctctctctctttctctcttttttttttttttattttttttgagacagagtcttgctctgttgcctaggctagggtgcagtggcacaatctcggctcactgcaacctccgcctcccaggttcaagcgattctcctgcctcagcctcctgagtagctgggactacaggcacgtgccaccacacctgactaattttttgtattgttagtagagatggggttttaccatgttaggatggtcttgatctcctgacctcgtggatctgcccacctcggcctcccaaagtgctgggactacaggcatgagccactgtgcctgtcctacccctcacatctctttaaatatttttcaaatatctgccttccttttcaatctcatggacttggttgtggttatggcctcttgtgagagggtttcttgcttccatttttctccggcttcagtccatcttccaaacccatgtcagcggcttctcctgcttgcacagaaaatgaagttcagacagtttgcatttgagccttggctcactttcccagcctcacctccagtgacccccttctctgccctaccccagtccttcttagcccatctttcttctcaggacacaccaggcaacttcatgccaccattccttgcgtatgctcttctcttggcccagctcactacctctctgaaatgttccaaaacgcttccaggcagaattaatcattttgtgtctgtattccaaaaaccagggttccattctctgtttatcatggtgatgatagttatttacttgtcactcttagttagctttgtaacacctagcacagtaactgaaacagtagatgctcaaacatggatttatttttaacttaaaatgagatgggtattttaggatgccagaatctttgggtcaaaaagatgtggcttagttttcatgtcaggaacggctcttagttcaagcagtgaaacaaccctggctcattcaaacaggaagggaaaaaattcaaggctgttgagttgctcacaggctctgaggggttcatggaggcagatgctggtggcctcagcggaaggagcaatacacagactctccacagagaacccattctgccactgctgctgggtgcagagtctggttgcacctaccacgccccaagcctgatgccagattctgctgctccctctggaaactgatgtcgctcccagtgcagctgccaccccagcccaaatggattccctgcagcccctccttagcccatgtcatgccaagagtcagtgccatctgattggctgagcctggatcacatgcccaagccctagctgcaagagaggctgggaaagcaagcatctggcttctgtggagttgttggtctctgccccccatcaagactcatgaggtggctgggcacgggcatggtggctcacacctgtaatcccagcactttgcggggctgaaacaaggggatcacttgaggccaggagtttaagaccagcctgggcaacaaagtgagacccccatctctatagaaagaataaaaagaaaaaaaacttaggcatggtggtgtgcacctgtggtcccagctactggggaggctgaagcaggaggatcacttgagcccaggatgttgaggctgcagtgagctgtgatggtgccactgcactccagcctgggcaacagagtgagatcctgttcccaccccaccaataaattcatgcatacatacatatactcttgaggcgggaaatccccagattcagctcagatgctggggtgacagaaggtgcaaaaagagtgacagatgtccactagaactttctttcagaacaccagaaccctggttaagagcttcctttgatggtatgtccgagacttagcaggaaaagcatggcatgctcaaattgagtaacttgagaattgaataaagggaacatttacaaaggatgggcaggatgcagggaagccaccaggaacagctgcactccaaggccagtaacactggggagcttttaccaccccaggcctgaaggggcaaggagtggggcagttaccagacctggagacagacacagggttgtgtgtgtggagaggtccctggcaggagccaagactgcattagaaagacacagccagccctgggcaattcctcggtagggagtaagtgctccaattcccccttccttccctatggtcccctgctgaggcttcccacaagccccatgcggaagccagagggccagggagccccacttctcaaaatgagcagagtatgttgaagaagggcagagagtggatccggaggaacaagtagaagacaggctgcccatgaggcttcatcatatgtcaccaacatttttctattcattttattcaatatctactttggggatgtcacttcacattttaagtacctgagcccacaagatcgatgtgatcttaaagtgtccttctcctattgaatttaacaagctgctattttcccctcgtttgctattcagaatgctctatcatatggttcaacaatttgtactattaaaggttagcaaatgccagccaaaaattcatttttttccttcctgggcttgggaaaagaggatgtgacatgtgacctgcacaaacacaatgtcaagaatctccctttacaagtctccatgtagaaatcctctctaggatttgtgtcagcacacgagatctcctgctgctcatctctgcctcctcttcattaatatctagcctcctaaataacgcagatagaagaatggtcataaaattgagccctacacaattaccagtagctataggcctccccaaggattcaggcactgtaaccctgattctttcaaagcatctggtaacttgtgctagaataaccatttactttggaaaagcataccaaggagaaagcttcatcctttgtctttgcatagatggtgggttcctttacagaatatggaaactgattgttttcccataaacctcaactaggagaatgaggtaatcatgtgttatttagataaaagaatgttcacctttcttttttacaaaaattatggtaatagaattattttttaaatgcaaatgatggagaagtacacagcaaagggcaaaagtcaccctttctgtgtgcccacttcccttggtcccccctcaatattaacaatatgccagaaaaagcaagattgttctaaccacatgattacaagctgtgtcctcagggactgctgaggatgtggtcttggaacagtatgtactctacttctccttcaaggtccaggcagcccttgggtcttcaagcccaagacagaaagttcactttgtatctcactctgggagaacaacacccatttgcaaagctgtaaacttgggtggtgtatcatgacagccactcgcaggggactctagaggcacttctatctatttacttaagtgttaattgtacatttctgatttaccactgtcctaccaaaacaggaatttgctttcttattttttttaaaaaaaaggatggaggaatcaactaacaataaatatctgaaattcctaggtatgatttttggcatttgtagccatcaattgtttgccaggagcagaatgtgtatgcttttgttagagtgtcatgaaatgaatataactgatatttaatgtgaacataagaaatacttgtttccctggctaacacggtgaaaccccgtctctactaaaaatacaaaaaaattagccaggcgtggtggtgtgtgcctgtagtctcagctacttgggaggctgaggcaggagaatggcatgaactcaggaggcggagcttgcggtgaaccgagatcgcgccactggactccagcctgggcgacagagtgagactccatttcaaaaaaaaaaaaaaagaaatgcttgtttccagtattacaccaaacacatagagttttctatatggattttagggatgtgttgcaaggattttgaaagctgcctctctgtgctttgtccttcaggaagaaatccctgacctggctcaccctggctcttctcctctcttgactcctagatcacatggtgtcagtatccctcataatagcctgtactcatctgatcccaagtactgtaaatgagctggcttttgcgtaccaggctcatcttagcagattccaagttcctggagggcaaggaatttgttccaggatgacacatagccatttgactgagttcttccatccttcttttccatagctttcctacaagaccctaaacctttgtctccattacaactatggcaaatatccatgctggatgaatacaaatgcctacccttggcagctgtctccttcacccatagcctattcaccacagatgttacctccttaaaaaacacatgcacacacatacactatggaatgaatccatctacttctttatatcttcattgccacaactttatccaaccactgtcatctctcctaggtcactgtagtagccttccagttggtttcccatcatccattctgaagggcttccatcagttctttacacagcagagttacatttttaaaatgcaaacctgatcgtatcactccttacttaaaattgttcaatagcttcctatttaccattcaggaaagacaacacttttcctacagcatagaaggtcttgcatgggctgaccccacttgcctctccagctcgtcttatttataagctcccctttgtctctgacccccagtccaatcggccttcttccaattcttcgctactttcccctgtccctgagctcttgcacatgctaagtctctgcctggaaggctcttccaatccccttcacttagtagaatctcctattcatcattctctgttaaatcaacactttatgagtgaaaccttccttaaggtcccttgtgtgtggataactttgccatgcacctgtccttaagatttccacagttggtaattaagcaattattttttgagcatttgtttaatgtctatcctagaagactgaggtctgtgagggcatatgtcaaatccattgtattcagatccagtttttattcatcattatgtctgccgtaccacatctggcatatagtaaactctttcataaatactctcttaaaatacagaaagaggtcaggtgtggtggctcatgcctttaatcccagcactttgggaggccaaggcaggaggataacttgaggccagtagttcaggaccagcctaggcaaaatagcgagaccctgtttctacagaaaatacaaaaattagcctgtcgtggtcccagctacttgggaggctgaggcgggaggatcacttgaacccaggagtacttggctgcagggagctatgatcaagacactgcactccagcctgggtaacagagcgatacttcatctcttaaaaataaaatcataaataaaatataaaaaaataaaatacataaagaggggaaagaaggaaaggagggaacagaaagtaggaacagagtaaagaaggtgggaaggaagttgaaagattgttaaaacaccagttcaggtgcctacttttaaaactactcaagtgcttccacacttactacttaaaattgcttctttgttgttgccgttttgctgtggaatttgctaaaatcagtttcttttaatatcttcctttggactacatgctgtgtataaaaataaatgtttgtcatgtagatcctcttattcagcctgattcaaatacccagctgcctgctggatacctccacctggatttcccaccaaccaacatgtgcaatacttaactcattgtatccctttccctcaaaactctgatctccttctcattgcaatatcctcgttaatgacgttaatgactttacatcccaccaggagctagattccttgcttgctgactggacatccagtcaatcaccaaatcccactgatttgcccaacaaataccttgcctacctctgtattcctgctgccatcttgctagtgcagtcacttattttgtctcacctgaaggattgcagtaatctaattggcctctgagttccaaattcaggaacctccagcccaacctcccctgaattgcccccagagttctttcttgaatgtgcaaatcttatcatgtcagtttctatagataattcctcaatgactggctattgcccttggattaacagggaaacataacatggcattcaaggcattttgtccctcatcctgtgtcttgctctccagccttgtatctcattgcttcttgaactccagtcacatggagctgcttgccctctctgcaccaaccacatggtgctgatagacaccaccatgcatttatacatcatgctcgcctggcctggaatgcctccaccccagccgatctggcagacttctcatccttcaagttcaaatgaagttactctctttgtacttgctttgttccttgtgacaggaatggggcaggaagtctggttagaggttactgatacgatccagctgagactagggtagtagctggggaaagggagtggagaaggcctgagacatgctctaaatgtagagttttcaggacctgccgatggattggatgtgggggtgagaggaggggagggatccaggaggaatcctaatcagagtaggcagctaccacagcaggaacaaaattataaggaaaaagaattacatacccgttatccacttcaacagctatcaactcctgaatcaatttttttccctttataatcttacctgcctctttgccctgcccacctttacacacataatagattatttggaaacaaatcccagacatttcataatttcatctgtaaatattccaaccgcatctcagaaataaaaaggctctttcaaaaacataaccataggctgggcatggtggctcaagcctgtaattccagcactttgggaggccgaggcaggtggatcacctgaggtcaggagttcgaggccagcctgaccaacatggtgaaaccttgtctctactaaaaaatataaaatgttagctgggcatggtggtaggcgcctgtaatcccagctactcaggaggctgaggcaggaaaatcgcttgaacccgggaggcagaggttgtggtgagccaagatcgcaccactgcactccagcctgggagacaaagctagacactgactcaaaaaaaaaaaaaaaaaaaaccacacacacacacacacacacacacacaaaacaaaacatagcccaaacataaccatataatatcactcctaaaaacattaatgaagaaagaacaaatgaaaaattaatattaggacttcatatcaccaggtatacatttagtgtttacagtttcctgtttgtcttatttttttcaactattttatctctttgttgtttgtttgaattgggatctaaattgtccttgtatattgattcattgctgtgttccttaagtctcttttaacctcccatcatgtctctcttctctcccttcccttcccttcctgcccctcccttcctctccctgtttctcccctcccctcacctcccccttcccccctcccctcccctcccctcctctcctctcccctctcctccttcccttcccttcttttttctcccccactttttttcctattttgttgttttcattggcattgttgctgtgttaaagaaacctggatgtttgttttataaaatatcagaaattctctgattgcttctttatggtgctgtttaacctgtccctgtgtctcctctatttcctatgaattggctttataagacacaggggttttattgttttgttgcctttagaaggggacagcaagattgtttcattgattatgttttatacctccatcagcaagttcataatgtcttgtaatctctatttttgtggcattaacagctattgatgattattgcctatatctgttcatttattacaggttgcaaaaatggcaatctgtaataaatattctcattctattatttttctcttcatgtgtcaacttaaatattctgtaaagagaaaattttccccttcccccatttggctaccatggggtaaagtttatacggaataggtaggatatgtgctttattcttccctgtgcataccagttttcaaataatgaggtgtttcctggcatcttccaaaggtgtgcttgttactgttataattaatgttattaagagtttatgtgttaaatatgttttatatggtgattgcagttattgtattttacaatatttaaattgttcaatctttgaccagtggaagcctgatcaagtcagctctggactacttttgacatggccctaattgtctttgatagcttccttgctttctggtatgttccaggttcaacttatatatatcctaccctatacctggaatcagccatttctcttaggattcctggttccttttaatgggaaatattatttacagaccacattctgagcagtaagtgtgctcattgcttctgggctggttattatttacagtggacaaagatagaaaacacaagtttttaaacaaaaatgattaatccattctgatatgttcaattcaaattcaggacaatcatgtttttactttacttcatggacctcatacccacattctcccttctcctatgctgaaaatcccaattctaaataattccaatgtaattactaatttgctatatcccacacaacacacaatcagcctcagagtaattatacaaaaactgtgataacaatatggctaatgaaaacatttcaattttttttctctttgtccttcagatatatcccactaaggatgtacagtcaaattattgtgttatagaattacttggaatcattcctctgtgtgtacctatactaccaactgtttatatagttaggttcacttgctttattttgctttaaatttttaataattcatctttaaattaaatttaatttatcgttataaaaatatttgcatgattgcaaagtcaaaatgacaaaacaagagctattcaaagtccagcatcccctcatttccctctcttttcctataaataaccatttaaatatatgatttatcctttccctttttatataagaaaatgggttgacatatttttctccactgtgtcattcttacttggtatatcctgcccggtgatgacctcatggtgacaaatacaagtctctgtattgggcttctggctctaagtaccaaataaggacagccaacgagtgtttaataggaacctgcagattctcactcctctctctcatatgccacagctggtctgtcaggatataacttcaactccaaattctgaccccttcttaccacctcactgccaccatcatggcccagggacatcacctgctgctgggattatcacagtggcctcctcactgttgtccctgtgtcccccgctctgtgccctgtgttttgttctcaatacagcagccatcaggcccaggagaacaaggattttctcatggtgaccagagcattccttcttcctccaccatgtcccgatggctctggaagtaagagatgacaagggccatgtggtacttcctttcatcaggtagacagccgacagatataataagcgcttgcagtttatataatgtttattatgttaatataagctttgcatatatcaattaagtcctttaatccctacagcaacccagtgaggatggcttcacaattttcctattattagagacgaagccattgagacacagatggatttcaaaattgcttacaaccaggtagttcacaagtggtagggttgggatcaggatccagggagtctggctctagagtccatgctttaagccaatgctgtccaatagaactttcagtgatgaaggaaatattccatatctgtgctgtccaatctggtaatctctagccacaaatggctattgaggacttgacatgtggctagtttgactgaggaactgaggaacttttttttttgaaacagagttttgctctgttgcccaggctggagtgcagtggtgctatctcggctgactgcaacctctgcctcccgggctcaagtgattctcatgcctcagcctcccaagtagctgagattacaggtgtgcgccaccatccctggctacttttttattttattttattttattttattttattttattttattttattttattttattttttgtatttttagtagagacagggttgcaccctgttggccaggctggtcttgagctcccagcctcaagtttatctgcctgccttggcctcccaaagtgctgggattataggtgtgagccactgcacctgaccaggaactcagtttttaattgtatttagttttaattcatttttatttaaatgagaacacattgttacatgtattagacagctcagctctaaaccactatactattgtgctttttatatatgaccagaagagtggcacagagttatttaactcttatttgcaactgttatttaaaaccaaagatacaacatctttatgggattccagctgccacctgtgaatttgaagtcttctaaacaatgtcatccataatctatgaaacatatgcctctgtaatgtcaaagctctgttagaccaaaaacagttatccaaatacattatgttcctttttattgaaggaaatggaggaccaaagtgttctgactctcatttgtccttacttaagagcataattgtgtaagataaaaataaagaaaagctaatcacaagaggtagatcatgacattgcagatttagttgaaatttacaagttatatttctattgattttttcattgtatttttttattttggaaaattgaaaatgtataaaactattttaaaaaagaagaggaaagaaaaatccaagaaatcttcaccaacaggaattaatcactggcatatttgagtcagtcttttttcctatgtatataatatttttaaaactgtatggattaattcttccctttttctaaaagaaaaagcacattattgacttaaccctcccccaccttgtctatcacattaatcacagtaactctccttagtctccagaaatagacactgttctgaacttggtgtgtatgctttcagcccattttgtaaacttttacatgtatattcacatatccttagaaacacataatattgttgatgtgggaatttttaaaaaacatttatataaatgatatcacactgtatgttgttctgcaacttctttccactcgtcatttttgagctgtgcgcattttgataatttacatctagagtcattctataactattatatcctaggaacacaccacagattattcatttcttgctggtggatatttaggttttgtcagtttttcattatttcaaattatgttgcagtgaacgtccttgtacatatcccccagtgcatctgtgcaaatatttctctgtgcagataattttaagattatagaattcactcatcttcaatattactaggtccttccaaagtacctccaacttggctatgatgtagactcccaccagcagcatatgaaagcactcatttccccatacttacaccaacatctgataccgaccaacttaaacattttgcacatttgaagtaagtagcttattgtggttctattttgagtttctgtaattgctagtgacgttcaacatccttccatgttgattggccatttgaatttccttttctgtgaaatccttgaacctattatttatgcttctttgttttgagttgcttatcttactgacttgtaggagttgttcatcatttctggttaacagtcttctcttactaggcatgttgcaaatatttactccctatgtatagcttgtcttttaacctttttatgatgtattttgtcatgcagaagttttaagttttagatttaatgatggcttctaacaggcttctctcattcttgttgaactggttacaagccttgttaaatcttcatgtgttaaattctaggaaaagagaggagattcgtgtgtgacttgctgatttattggctgattgccatttctcagagaaaaatattttcttgtgcatatttatagcatttccttaaggagcaaagtccatttttatatcattgtgaatgttttgttttggtggtaatgattttttgatatctaataataaaatgttgacagtggtaaaatccttgtgatagcttataaagcaagaattgattttgctcttcattgcacactctttgaaagtgtatattcatggctctttttcctggatttttctagttattttgatctgctatctataattatactgaaaatgaatttcatatgtttaaaaattattttagatatcatctgtcttcaggcagaagtcatagcagactggaggcagtctaccagctttaaatcccagctctcccacctattatctggaaaccttaggcaaaccactttaattttttgcttctcagtttcttaatctgcaaaatggggtacctgtaaaataacagtgcaagtgtcatgggacttctgtgaagattaactgagtggtaacacttcagagggtcctggagcagtgcttggcatagagaaaacattctacagggcccagcagtcattgtccctcaactaccttaagattcatacaaatgaggagaaacactgtagatttagtgctctctggaaagtatattcaagtcaaagagcagctgacgtctctaattgtcatttcatatgccgttagtgacaccgaaaaatagaccaatacagacaatgacgagcacaactgatctatatgaaactatcatttatagattctccatcacacactttcagccacccaagctcagtgctttcttactccaaacacttaaaaaacaagttaaaaacagacaaaaaaactcacaaaagatatgtccttgaaccacagctccaaaagtctggcccatcacaagtgtgatggtagagttatcagggtcagaatgtgtttggccccacctgccccaggagtccgcgaagctccgtgaaggcaaaggccatgtccatgccaaccacatgttggtggaattcagtcatttctaggtgcttagcgtcaggtgggtgccgccttcattctttgttttaactgacaaataattgtgtatttgtggggcacaatgtgatgttttgatgtatgtgtgcaatgtggaatgattgatcaaatcatgctaacaaatccatcacctcacatacttatctttttttgtggtgacaacacttgaagtctccccttttaacaatttggaaatatacaatgcattattacttattctagtcaccattctgtgcaatagctcagtaaagtttattcctcctgtctaactaaaattttgcaccctcatctctcacctttttccctccaaccccctttcccagcctctgggaaccaccattgtaccctctgcttctgtgagcttgatgtttcagattccacatgtgagaatcacaagttagatcatgtggcatttgtcctgtgccaggcttatttcatttagtgtaatgtcctccaagttcatctctgttgtcaaaaataacagaatttccttctttttaaaggctgaatagtactccgtcttgtacacgcacgttttctttatacattcatccaatgacgaacacctcggttgcttccataactcagcactgtgaattctgcagtgaacacggaagtgcaaatatctctgtggcacactgagttcagctcctttggatctctacccagaagtgggattgctgggccccatggtagttctatttttagttttctgagaaacttccatgttgttttccatcacggctgtgctaatttaccttcctaccaacagtgcacaagggttcccttttctccacagccatgctaacacttgtcttccatctttttttataatagccattttaacaggtatgaaagaaaggggcccctttgttctttccaaacgtttttcatgtgctctgtccccagcccctggctggctggatgccgggatcagggtgtgtgaatgcccttccacagcttcccaggagtgctgggctcagggtgggaagagctgagtttgaggcccggtcccttactaacgaacaataattaatataacctctctggctttagggagtctaggggacatgtggtcatcaaagattgagtgaaattaacatgtgaaatgatgtaacaatgtgggactttaaatagtgaaagcggaatttcaccagaaattactttgatggccacaactagatgttaaaatgaaagctgacgcatacttatgacagaacatgagccacattattttatttctgcatttctgcactctctccttactttggtaaatcattttgaaacaagcaccccccaccctgcagctcttccattcatgaatgatgcaatattgagctgtgatattttcagaagtgtttgctaagcattggcagcttaactaaaagcatcctctctattttgctcttggatcactgctctcacctgttaacccccagcagaaaatctgcctgctgaacaatagcttgcaaacgcagcgtggcactcggtgccggtgccggcataaaggagtcagcgagcagggcgttgggtcagcttgctgttgagggcaggctgtttttgttggcacatcccttttgtgaaggatgtagtccttgttctaccatctgtaccaggctgcacaccatctatttatttgctatccttgaactaacggggtattttcccccagccataaatgggttggtgtgagagaagcttctcctgctgagggactcacttctgcaccgcatcctctttgttaatcttctgcaaaataaggcagttttctgttgaagagaaagcaatcatcaatttttcataagagcagcaaagttgtgaatatcagaggacctcttgaataaagagcttagaggttccagtgagagacgaataacaaagccctggggggaagaaaaaagtatatccttttttatactatttatcatcaactcccccctccacgcccctgcccccccatcatccgcagttaggaaggaagaagccatttatgcaagctaacagtccttcaaacctcatgaaccttaattttaatccttatcagtgcctttttaaatgaataatacagtgaccttcagctttgtcctatattatgtgaggttgattcgtaaagactgctttagttttttaaattaaggcagaagctatatgtattctactcaattctagcattagtgctgtcccaagagtggcatttatgttcttttgcttctttggtataaataaatatcaaagtaggaagaccagtgtgaattctacaaggaataataaactaaaataatatggcattgattttgttcaggatgtctaagtgtgtttttatgattgtgtatttttatagctttttcacacaagtgacatgaattctgggcaattaaaaaggacatgaatttcaaggcatttaggaagagaatctgttttctaatagctgtgtcttttaccaagttgtggtttttgagaaaagcattgtcgatttcagacctccaccttcagaaactggccagttattgccattttgtattgttttacaatattattgccatgagactacattagagaactttgttttggctgctaaagtgcaatatgtggatataacaatctaataaagaagcagagaaagattcctttacactgcatgtgtattatctttttgagtttcttctgaccaagggttcttagactgtagctttgagtcttattagtgaggtctcaacccttcctactgttgagggaggcatgggccccaggagcgtgtgagccttggacagtcacagagacaattcgtttacaaatgggaggggagcccaacgtggatggctttccacatgatgaatttatgacaactcatgttgtcacaaatttcagtaaactaacagtagcagatcctatgctgctgggctaacttctctatccccttctctcagtccttcttagatcattagtgttatttttttatcaactttttgttgcattatataaattactcaagtattacttaaattactcaagtaatacataaatatcagcaacttgaaaaaattaaaacattatagataagttaaaaatcaccttggacctctaccaccatacaagttcctattccccctcctctcctcaataccctccaccttcccagtaacaattaccagtttagtctgaatcctctgaaatattttttgtatatttaagcacagtgctgtgaatctatagcactaagcaactagatagcattgttttttaaaggctttttcccctatataggcataacattgaatgtgtctgcagctggctttttactaatatttctttaagatctttccatgttaattcatatagatctacctcattgtttcataatatttcatgttgtgcctatgctgtaatttatgtagcttttctcctattcaggggcatttgtgttccaatttttctctattaaaaatgccactgtggtgcgtgacttcttatgcacatgagtgcctctctaggtttatacctacagatggaatttctgggttacagaatgtgcacattttagatagggtcaaatcgctctccaaaatggagttaatgtacatttctcttattactaatgagatcgaaccacttgtcatatgtttattggctattggtatttcctccctattatttgcttattcaaacactttgaccatttttctattgggttattaatttgtctaattactttgtaggagttatgtgtgtatgcatgtgtatatatacatacacacatatatatatacacatatacacactgtattgtgatcctgtatctgttacatatgtcagtctcccagactttggcctgtcttttcaatttgtttatggtgtcttttgtcaccattgtttttgacctagatttatatttttcaatcttattctttttttctccgaatttccttgtaaatatgctgtaattatcattgtaaacttattatacattgcttattagagaaataaccagattcatttggggtttgaagctgagactctgtgctgactccttgctgtccatccctcagttgtaggggagcctcatgtggggagggtgtggtcatagctactgaaatccatttccagcaaactaggatgataaagcagctttggtgtgaatgttttctttcacaaatgtatgtggattgaaggtttgaagtttgaggcaacatatatgtggagagggtgagcgcattcattatatgtgggagggttttttcatttttattttttgggtttttttttttttctggtgtaattgggaaggaaaagaaacagctcagcactttccctgccatctacttttcagaaactatgggcccacaactcccaaggctgtattctaggttttattgtatacttcaaattgggatatatctcaaaacagttgcatttaattgggagattattaaaaagcatgagcaaattcagagtttcttgcccagaaaatgctgccaatgtccaacctaaatgaggacattcttcccttcctgtttcacagtcctgccaggagccatatgaagaaggcaagccagtacagatgatgggtacaccggggctcagacttcaccactatgcaatatacacacataagcaatctgcacttgcaccccctaaatatacacatataaaataaataaaaacaaattttgataaaggtaaaccaggtcagggcttttaccagactgctgttccccaaacttcagttatttgcaaaccatcttgacaaatgttgccataacaactttcctcctattaatatgcttaatattcttctaatattaatatcctcctaagaatatgcttaatattcttcttaaactacctacttattgtttgtaaatttatttaaaaggataaatttaacctttgtcactggccacagatggaaaaccagtttcacttttcatatataaaatagacagtaaccatgaaaacaaacacaaatacaacaatcaaatattagtgaaatactctgagccggaggtctgagaatgaaatcttttaacaagagttcttgtttaaaaggctaccaaaccaacatttttctccttgacataaataggattgaaagagaattgaaaaaggaacaacttttcccacgagacttggggtcataccgattaaaatcttgcatcaacttagaatgaatcaatcatacagaattttgggtgtctgcatgttcttgttggtgtgaggtcatcatctgtgtatccagagcacatactttgcccgactaccttgtccccacaccatttggcttcacacataagcattgttccgtcagagtcaaagagcaacaaggctctttgtcaccatgagagacagagagagacagggcgaggtggggggcaggagggagagagcacaataaattcagtcgaattgaagcttatattgggaagaaaacagccggctactagctgtaatatagacgttcatggccatatgtaaagtgcagccatgttactcaaggatccatttaatttgttctgggctctgatgtcaccatgcacccactgaggtgtttttaaaacacattgagatcatacatatagttaaaaacaatcaagtaataccaatagggttattaaatgattccctattaaatttatttcctaccccatctttttcttctctcatcgtacttccaaaggcagccagttttaacccattctattgataggccttctggtggttagctccacatttataaataatatgcttacacctttatttagtagtttgccaccttaaaccaatatctatcaaatttttgctatgtcagatgagaatttaattaatattattatcctaaccttttcctctaacttcattatgttttgaccattgagaaggctcttgtcagtctgattcttagttctttataggtgatctgtttactcccgtggaaattttcaggatttttatttttgtgcttctgaaatttcacaataatacataagattttatgcccaagtattttggatttctaaaaagatgccaactcagttattttctgtagtttcttagtatttcatatattttgatactgttgtaaatggtatcttttttcaaatatcattttctgattattcattttagcatagagaaatgcaactcatctttgtagaacgatcttgtattctacaccttgatcaactcacttattacagcatttttgtacacttcattggattttctagttgacaatcatgtcatatgtaaataaacaaaactttacttcttcttttacaatctggtcttttatttattttacttaacttattccactggctaggaattctggtgcaatattgaatagaagtggtgagagcagacatccttgtcttatttctgtcttattctagggagggaaattcaggtttaagtaataaatattcagtcttgaatattacaccattaagtgtgatattagctgtatggttttttgtatatgccctttataatattgaggatgttccctttaattcctactttattgagagcctttccaggaagatatgttagattttttctgatgccttttctgcatctattaagatgatcatatggtttttctttatagtttagcaatatagtggattatattgatcattgattgatttttgagtgttaaacctattttgcattcctgagataaactctgctttaccatgatattctttttggcgtattgctggattcaatttgctaaaattttgtttagaatttttctaggttcatgaggatattggtctgtcttctttgcttgtaatgtctttgtccagttttagtattaaggcattgctgacctcatagaataaattggaaaatatttcttcctttccaatttcatggaagagttgtgtagagttggtattatttcttctttaatacttgatataattcacctctgaagccatttggcccagagttttctttgtgaaagagttttttttaaattacaaattcaatttcttttatagataaagggctacaaggttatctaattcttcttgagtaagctttggtaatttatgtctttcaaggaatttgttcatttgagttgttgaatttgtcggcataaagttcttcacaacatcctcgtttttatattttcagcatctggggactgaacagtcatgccacttctctcaattctcctgtcagcaatttccgtcttctttttttttcctaataagtctggctaaaggtttatcagttttattgatcttctcaaagaaccagctttttgtttcattaacttttttctattgtttttcttttttctatgtcattgttttctgttcctttgttatttccttctacttaaagtttgatttgctctttttttttttttagttttttaagggaaaaactaatactttttttcttttctaatataagctggtactataaaattttccctaaaaactgttttaatggcatcctccaaattctgatatattgtattttaattttcattcagttaaaaatactttctaaattcccttttgagttcatctttgacccatgagttatctaaaagtatgttgttttgtttccaaatatttgaagatttcccagagatctttctgttgccatttttttatttaattccactgtggtcagataatgtactttgtgtgactttaattattttcagtttaataagacttatggaccactgtatgatctattgttatagctgtccatgtgttattgaaaagaatgtgtattctgctgttttgggagtgaaatgttctataaatgttcattttaaaagttacttgataatgttggtcagatcttctattttcttatggattttcattctgtttgttctatatattattgagacagaagtattaaaatgtctgactatatttttggatttgcatgtttcttcttgcagttataccagtttctatttcgtgtctactgaagctttgttagtaggtgcatagacatgatttgtgattatttatgtctttttgatgaaatgactccttatcattatgaaatgacatttttcatcccaggtaatactctttgatctgaaacatcttttgcttgatattactgtagctttccttgattggtgtcacacatgatatttttttttatccttttacttttaacctgtttgtgccatcacacttgaaatgtgtttcgtgtaggcaacgtgtggttgggtcttcttttttaatctaatttgacaatctcttctttttaattggggcatttagaccatttatatttaatgtgatatgtgatgtgataaggtttatatgctaattttgtgggagggttttgtcccatctcttctttttttttttctcttttcctgcctgattttagattaaatgaataatttttacaatttctttttgtgtcctttgttggcttataagttataatttttgttttgttattttaattgttactttaggacttatagtacatacatttagtttatcacagtttaccttcaagtgattttatgctcacatatagtgtaataatcttggaatagtatattttgatttttcccctcccaatcttttttgaaattattggaaaacatttaacctctacagattttataaactctacattatgttattatttttatttaaatagttaattgtgttttaaagagatttttaagttagaagtaaaacatgcacacacatatgtgtatatatatatgtatatgtgtatacatacacataagtacacacacacccatttccaatactcttcatcctttgtagagattcctgttaccatctggtgttattttcataacccttaaaggactttttttaaattttgtggtgaaatctgccagtgatgaattcttctaagttttgtgtgtctgaaaaagtctttgtttcctcttcacttttaaaagctattttactaaatataaaattctagtttgacagtttttttccttttagtactttaaaaatgttgcatcactatcttctcacatgcattatttctgtctagaaatatattatacaataatccctgccttgattctctccatataacgtgccttcttatctgaagctgcttttaagattttttgttcgtcacttcttttgagaaagttgattatgatgtaccttgctgtaattttcttcgtatttctttcgcttggggtttattgaatttcatggatctctggttttattttttctatcacatttggacattttatatccattatatcttctaatttttttctatcctgtcctctttttatttcagggactccagtttcttaagtacaggctacttgaagttagcccacaactcactgatgctctactcattttataaattatcttttcctttgtcttccattttaaatatttttgtagctatgtcttcaagttcactaatcttttcttctgcagtctctaattttccattattcccatccaatgtaattcttatcttagacattgttttttatctgtagaaatttgattttggcctttaaaaaatatcttccatgtatctacttaactttttaagcatttgaaatgcagttatagcaaccgctaattctgtgttaatttggggtctattttgattgattgatttgatatcctcttatggtcctattttcctgctttttgtgtgctggttaattgttgactgggtaccagatattgtatattttactgtattggtactggacatttttttattcctatcaatattcttaagctttaatctgagacacagtttcattgcttagaagcagttttatcctttgtcctcacttttaaggtttgttaggtgataccaaagcagtggttggtttaggtgttgctattccctacaatagaggcaaactgctctatgtcagagaatcttaaggtttcccagtctgactagcaggaatagactctatttccaggtctgtgtaagtagcgggcactgttcttcaatctttttgtgtggatttccacctaaccttaggtagtttcctcacatgcatacacttctcagcagtcagctgaatactcaagaaggactatccttatttttttaaattgttatttatttatttatttatttatttattttgagatggagtctcactctgtcacccaggctggagtgcagtggtatgatctcaactcactgcaacctcctcctcccaggttcaagcaattcttctgcctcagcctcccaagtagctgggctataggtgcaagccaccatgcctagctaatttttggtattttttaaatagaggtttctccatgttggcccaggctgatcttgaactcctgacctcaagtgatccacctgcctcggcctcccaaagtgctgagattacagttgtgagccaccatgcccagccagaaggactatctttagatctttggcattttctctatgtgaagccttctctccagtactcttctctgtaaactctagctgcctaggtgtcctcagactcagcttcatctactcaatgtgaggagcccaccaggctctgcctggatttgccctctcatgctgtagcctggaacttctctccaggcagtaagcttaaaaatcactgggcccgtgtcatttgcttcccttctctcaaggatcactgattgttggctgaagtccagtgtcttgcatattatttaatatattttgtactgggatggggggagtgaggttaggtgggaggataaagcaagttcctattactccattttggctagaagtggaaatttgggatttactctcattttagtggggttttagttaggacaagaaataatgcatgtgcttattccaccatattgagccaggagcacattgcacatttttaaaaagatcttgctgcttgtgttattggagcctctataacacttagctcatggttttgttaattaattgtccaagttcatattctctaaatggacttgttgagaagtggaaactgtgtctcattcactttgggatagtctcagtgctaaattggagctccataaatgcttgttgaatgaattagtgaattaatactgttgtcttattggtaaaattgcaagtttaaagagtcaggactgaaggtaagagtgctttttaattaaaacctttgtagggaaatgcaatttacctttcaggacattattcttttcaggctacagctttttaagagctgttaacattagcacccacttctgcctttgtggcaggaaacacttcttaaaaatgttgtcacatattttctggtagaatgtatacgcaacacttgggggaattttattcttggccatttatcctggtcattttctaatctgatctcaatgtaaaagttattgtggaataacagaaaaatacatctttccaatccatctagtctcttttgtgtgtgtttgtatgaaataccaatttactcttttaaagaattcttaaggttccatgtataattttaaagacaaatggatatattttaagatcaaatttcctcaaattttttcctgttctaaagagtgtagaattgtattatatattcacttaatctttcaaaggttcagaagctaagaaattagagcaagatcatcaaaatatgtcactttttaattcctctgcttgtaaaggcaacatagcttagtgattgcaagtactgtagagcccggtggcctgtgtacagctccacctttttttttttttaaatgcagagtctcgctctgtcacccaggctggagtgcagaggtgtaatctcgactcactgcaagctccccctcccgggttcaagcgattctcctgcctcagcctcctgtgtagctgggattcaggcatctgccaccacacctggctaatttttgtatttttagtacagacggggtttcaccatattggccagactggtctcaaactcctgaccttgtgatccacccacctcggcatcccaaagtgctgggattacaggcgtgagctaccgcacacggccacagctccaccttttactagctgtgtggccttgggcaagtcactgaatctctccaagcctgttttctcacgtgtaaaagggtttaataatagtacattctagggttgttaagaagattaaatcggttaatgtttacaaagtattttaaatggtgcctgatatacacagtaagtgtaatataagcattagtttaagcaaaataaaatagtgaaattaaagtaaaaataaaactttattttataaatatttctgcattttattcttctgactttcccaagaagtaaaaattaccctcttttatgaagttatgtcatactttaatagcttgcatttttggaaatcagttgaatattgaggggacaaagaacccttctaattttccttcaacatcttctatataacagtgatgcctatctccctatttatctcacagtgttgtatttagcaaggttttgcgcttggtacctctgtttttcttttagtctaaaccttcggttgtccatgattcaactttaaattatatctctgaacggccccctcctcaccacgaagttgattctagagattttcccatcataatatttaagatctcctttttttttttttttttttttttttttttttttgagacagagtcttgctctgtcacccaggctgggctgcagcggtgcgatctcggctcactgcaacctccacctcccaggttcaaatgattctcctgcctcaacctcccaagtagatgggattacaggcacccaccaccatgcccagctaatttttgtatttttttagtagagacgtgatttgtccatgttggccaggctggtcacgaactcctgagcgcaggtgatccacctgcctcggcctcccaaagtgctgggattacaggcacgagccaccatgcccagcccaagatctcctcttctctctgttatgttgctattacccgggacactttaataccataaatatgttttctaaccttactgagttatttgctaatttaacatccttattttatttagtgttccaattatgagcatctgtggcttgcagaattgtgtcaacttgctagagacagacttttgatttagcattcgtttccatttttatgcttatctgtcttttttatttgtgtttgcagaattttcaatttctcatcaatctctctgggtcattattattgtcttagcatctcattgtccagattttcaagaagttaagaaagcttagtcagatggttgactatattttgtaaatatatgactcagctaatggctctttgaaatttacatggactttttttacttagtagtcttagtctgtgtaatgccatctttgagggacttccatgcacaatctcatatcatctccgtatatttgtttctagctgggtatttgaggctagatagactcacaagatgtttacagaaacaaagatgagtcaaaaatccaaatctcctaattagtgtaattttcaatatagcccagtcctgtccagcatcaggagacttgacagcccccaaaccaaaagggcatctgaaatacatattgctcatccctccgcctgcctcccccatgccgagacaggagctgtggtgagcgtgtggatggcacaggctctgcgggtgtctgactagagagcctcagttacgcgctctccacctcatcacacagcagccccgtgtaatagaaatcgcttattatgagggttggctaaataaaggcacattgtgaccagtcacaatttctaaatgaatcctcctgactgatctggtcctgacactttcaaagctgccgttattactgaacctgaacatgtggaaaggacaagtcaagacagaatgataaaattcttgaatgcttttgcttaaaattattcattctcttgtgtgtgtgtaaatggggacacacacacacacatacacacactccatagacactctcgcatacttaaacggttccctaggtgcacttttatcattttatctcatctcactttggtagtttccattgtagtccttctgtagactaattctctaaatatttagaaaaataagagggtcttttatctgtgtgtagtcgtggattttgctgcctcttaaagcattatcttttctaagtccttaagtgttagaagtgggaaaaccatctttcttttaaatttagcaaatggcacttatgtgcatatgtactgatgccatatacacacttacactgtaatagaaacatcgtggaaaagcaaaccataggcttttatcataggcatgagctttttccctctcatctccgcctggaaagatggttaggagaatgagaggcctctctggatctgtatttataagccttactggaaaaaaaaagtcaattattttttagactcagctcacaccataataaatgtgaatctaaacaatcgctcaagtgctttctaagcaatggttctatctatgatcactcagacttccttcttttatttagtaaaaaggtaacaaataagaatggagtgccatttgcatgtttcttatttttactcaatatggagtccagtggttgagtaggctcatccagtagcaaagagaagcaaacaaaattgatttcctgtagcccacagtgattttccctagatttagagagcatgtgattccaagatgggtgtggggtaaaactctcaaggctttcctggcgagagacccgggcatgctggtggagaaaccagacatcatgcttgggaggttggggcctctctcctccttgaatgagctctgttttaggatgttgttcatgtgaaagtattgcacttacctcagcataaaatgtcaagccatcacatccttgggatagaaacaattaaggaaggatttatgtttgtaaaaacatgtgcctattaaggtaagtaattagggcacatgaaagaaagataatatggagatgtaaaaattgggggttctgcagtcagaccccctggatttaaatcctagctccacttgctgagtgaccttgggctagtcattgaacctctctgagcctcagcttctttccctgtgaaatggggaaactaatgggtttattgtgagtattaaatgagttaatacatgcaaaacaattcacacatagtaagcatgaaataaatactaattattatcattgttacgcactaagaaaggatttttgcaactaaagtgtcaaaagaaatggagatgctaaagaattatttggctttaaaagatgaattccagtacaaaatgaggctgtttaacaaccagattccatattacaatcagaaagttccagcagagtacctcaggcttcatctggggaacatgtttaaaggtaccaataatttttgggtttttttttccaattttaataaatgaaattctcattcctttctgtctgtctctctgttagcgctattgctttatcttactctgtagtctgtatttctcttcctagtttcttttttttttagaactagttgtgaattctttattctctcacatagacatatgacagtggggaaggagggcatgtgtgtttcctaaatgttagcaagaagtctgtcttgccatctccatagagtggaaaattcagcaagtagagtctgttaatgtcattccccttcaaatcacattcaaaagtgtgcttaatgcactgtgtacattaatcagacattttgatcatgagtaatggtgatgccttcagaagtttggggtgggggtgtgggttttgtatatcttggaaggaatcctaagtccttgggtgacttcgaagcagtctgtatgggcgctcctcccacatccattgcatctttgtcagacacatggcccctaggctccactttgtccataggcatggaaaggtgaaagtgcctgggaattaatatctctggggacactctgaagcaatgactgctggttatatgggtataaatactccagctccctcaccccttggctaaagtaattccaaggcacgtactttgcagttttccagagttaccctgtgagattcaactgccatcacccactgtggtagctgacttaataatgcatcctatattgtgtggccgccttcccttccctgtctaacttctccctcactacccagactctctgtatctcccaatacaccactcacttgttcggggtcacttctggagtttccaaccccagatgatgtgcacactttcagaggtagaagtgaatctactaagcctagactaggtatcatcaaaaccactctgggctgcaaactggcagggtgcaggccgcaaatttggcagagctctgctttccctgggtttggaattccactgactcagagcctgaataatcgtggaggcagacctgtcaaggtgttatctgaagagctgttggggaagtggaccaagaccacagctgcccattctctcaccccaccttctttctgcagagtggcccatttgtgattcaggagaaagagtgcaggagcagtggtcagcatgctgtgatcgatgatttctgagcgtgggtgggccttgacaaatgctcctatccacttcattccctcttaatagacccatcagacaggtgcttgttgttttccagtgccaacctgggtaaaccagtcatcatgtgccccagtgtgtcaaagaaaatgcctgcttcccagaaggtttcccactaatggggaaaagaaggttgattcacacagccttttattgcaaaccaattcattctttggcaatctgaaaccaaaactgcacatttagccaggcaggtcttttaaaagcatgtcctttaccgtactgtccattgcagactcccatccatatcttctttcttgttttgtgttatcatttttgtgatgctttaatactcaatacatgaactgaagctatgtggcttctgtatcgcagtgtattaggattccagaaagacatgcaatccctgagcagacaataaatttgattttgcacaagtggcatcctttatactttgctcataaggcgatctctcaagtgtatttttttttctgaaacacaacacaaatagtctgatgaagtaaaaatgggttgcatgatgggttttgtgctcagcaaaaagaacttggacaaagcagccatgctgatgttcttatttacaaaggttgccgtctgggaaattaatctctgctgttgctcagtaattaggaaaatttaggacccctagtgctccagcatcttgcattaaaggttgtatgtcattggtgttttcatgagagtttgctggatttctgtcattaataacaggcataagcccagcaagcagtagaatatgcattgcatttaatcaatttgctatttgtattcattatgcatgtcatccgttttgagtcatgaaaaattgaaaggccattacgaatagaaagagcatcatggattacaaatgatgtaacaagagcataagcgctattaattggtcaattgtgcttgtcggtacatttaaagtgattaaggcagaaagattagaaaggacacgaatgtgcttgggaaacagaagcatagcaacacaagggctctcccaagtcctttgtgcccaaataaatgcagcaaaatccaatggcatttattccaactaattcattaaacagatattagttgagcacttaccatgtgctgagtacaaggattgtactgagtacagcagaaaacaaaataagtgaagcccttgacctcagggatttaccttccagaggggagggggaagtatgaaatgaacaaatagatatacaatataatatattgtagtagcagagaccatgaagaccaccagaagcagagaggaagccctctttggggaaatgacatttgaacagaggtttaaatgaagaaaataaaaagacagggggtccgagcacagtggctcatgcctgtaatcccagcactttgggaggctgaggtgggaaaatcacttgagcccaggagtttgagacctgggcaacatggtgaaactatctctacaaaaatacaaaaattagccaggcgtggcagtgcacacctgtagtcccagctactcaggagactgaggtgggaggatcgcttgagtccaggaagtcgaggctgcagtgagtccagatcacgccactgcactccagcctaggtgatagagcgaaaccctgtctaataaaagaaaaataaaattaaaaggctacatggatatctgggggaagaatagactcaatatcccccactcccattccaacactcaagaagaaaagaaaattcttgcaattatttttttactcaagtgattttgtgaggcttgacccaataatggaatggctttgccaaggctagagaactcactcagccggttttcccattacagacctcttgggtgatagcaattctgttaaagtggaaactgatggcatcatttgccatttttactgtccccatacatagtccttaccatggcatgcagacccctacgctatccagctcctgcctcccatttcataccactcctccttctcctgccaagttctagcccctggactttctgttgctcacatttccagttcgttcctgcctctgcacccatgcatttgctgtctcctgccctcagaaatccagacctgagctcccaggccacatcctcagagacaccctccatgaccaccagggttgcacctgctccctggcccctgtgatttgatcccactacactcattactgcctgagttctgtgctatctgcttactcgtttcttacctacctcccatgtttgatataagttccatgagactaggcccaggtcacttgagttcactgcggtatcccatcacctggaacagtgcccggtacaaagaggctcagtacgcccaaatcaaatgaatgaatgagtggatcaatcaatcagccaaccagccaaaaataaaatgaaaaattgacagttgggtttctgcttttgtattcggtaactattttaaaattttgtatttaggtagctatttttttaaaccacatgaaagaaagggatgtttgttctgcacagcattctctggagtgattaggtagcattggtatttgtgcttcatgtgtctacaatctattgccatgcatttctaataacataatattccttttcaatatactgacttgtttttctttttcttttcttttttgtttttactggctaaatgctatagcattgtctttgaatattagcaaataatggaacatgggccaagggtgaaccatgacgaatttgtgttccagcagccctgcttctttagaattgacagtctggcttcgtggttaattcacagcatctgaggaatacatccaaagagggtgatactgtggcatgatggtaccaggattccaagttcattccaggtacagtcgatgcatcattcacagcagactcgtgagtgtccatcctgtgccagactccatcgcaggtgctggggataccaggcagaggatgcagtgttgccagctatcaggaagacctgacggtcaacaatcgtgcttccaaagccacctgcatattatactcccttgggggtcagctgtaatatacctgtgcctaggccccatcctaggccaatggaatcagaatctctgggcctagggctggcacacccatcttttttaagcctcaagtgctgttcatgggcagtcagggctgagaccccctgctggagtagaaggatggtgcataggtagcaaaaccacaaagcaatgggcaaaggccaagtcgcagatggcagttgcgtaagctggaagtggtgacatttctcttcagtgcataaccacagctcagaatgaatatttgtatggatcaggaggccaagtgacctggtattgagcagtagataaacgttgcatctatttatcaccacccccaaaaaacctttttaaaatggcaaataccattcattaaatgtttatttttcctgcatgaggtcaaacaaataatctcaattttctgggtgttggggattcaaacaacacccaaaatgggatgttgtatactaagtcaaataaagaattttaatagagacataatgtctttcctaaccagcaggtatgagagaagggaaaataagagaatctgcctggtaaccatcagggggaatgaattaacatgttctctaagactatgttagaaggtcagagcccagcacagtggtacatgctgtaatcctagcactttgggaggctgaggcaggaggatcacttgagcccaggagatcaaggctgcagtgagacatgatcacgccactgtactccagcctgagcaacagagcgagaccctttctgaaaaataaataaaaaataaataaataaaaggtcagaatttcatgaagtgggatggtaaagttgttgtgaaattctctccctcagataccctctgcctttgatggtgggcattaaaatgcttagactggaaaaaaaaaaagcaaatctttctgggtaattaagtaaagtttatgttattcatttgaagatcaagctttgcttctccccttgaacacaggtgaaaataacaggaaaatgataataactttataagggccaaattaccactcacagtggtacttctgagtgtgtgttggaaaattacatcttttgtcaagtgataaactctgattttttttaaaaaaaaagcaatgttcgtgatctagtaagcactttacaaaagctaacatgctttatgaaggtgtgtacacagactgcctaacctcacactgcagcctcacttactctaacacactctatggccctccatggaggagcagaagcttccacccacgggatgacttcagatgaacgcttttgatgctgggagcagcagccacccatgtctccagatacctgttcctctgactctgcctccttggattttacagttaccaacagttcatgatgatcttcagaaatgttcacagtttcagaggagccacatatttgaatgtttaaagaaagcaatattttgcaaaacgcaaggatgatccaagagagccacaggaggatctagcagccctttgtcgggaaatgaaagtaaccaacaagatcaggcctggaaagaccttcctggatcccccaggacatgctcccttctgtgaagcagcggttctcagcccttgctgctcattgaagtcaactggggtgctagaataatactgatgcctgatgtgcccaggctggagtacagtggtgtggtcatggctcactgcagccttgatctcctgggctcaagtgatccttctgcttcagcctccaaagcgctaggattacaagcatgcaccactgtggtgggctctgaccttttaacatagttttagataatatgttaattccttgcctctgatggttaccaggcagattctcttattttcctttctctcatacctgccaggatctcatacctgtgccagagattcctgaggaaggaggggcagtgtattttggaaaagctcccaggtgaatctgaagtgcagcctgggttgggaaccactgatgtagtcccagattagtgactgaaatgggtaataagggaagcagtgttggcagcacattctaccaagctcaaagtcttgacatgtcctggagccagcagagggcaaagacttcattgctaagagagaagctttagtgggagaagataaataagtctgtttccaggcaaatgtcccctttctgctgtcagcttcctggctatttctgccctgcctgagcctgaggatttagacatcactttcacgtaaatgccataaatgccagcttccaggtctctccacacattaatgacattgtggtgagaaaagccacttgcaaatgaagtaaatccttgaaagagtcagacaatagtgggctttgtaagctctgccttacaggagagcctgcagggggattttcggtgatctatgcagggatcaagctgccatggccaaggctctcaggacaaaggcctcatggagtcttttgtttgccaccgcatgtgactttactcctgcatctcctgcagagctctcccaggacagttgagtaagagtggagaagcaattggggtgaaccccaagactcagcctgatccgttgaggggctttgcagcataaattacacctcagagcctggggcaaaggagctgtgaggcatttttctctacatgggttagtcattggctacctgggctctcggtaagagtgatgtggctccagagcccaagaaaagcggcccctgcggtcctggggtggggagctcttagcagcacagcactcagaagctgcgagatgggtgcgcagagctgtgctagggatcctggagtctgggcaaacagcactgcatgtgctccacaggtgaagccttgcctcctccatccgtcagctcagcaccctgtatggaaatgcaaactgtgacgtgtgcttctgcgtttcccacctctgatatgatagatggcaccgcaatgcttttctcttcctcagggcccatttccaggctggactgcagtggtgtgatctcccctcactgcagcctccacctaaagtaatcctcccaggctaaagcgatcctcccacttcccacctcagcctcccaagtagctaggactacaggtgcatgccaccacactggctaatttttatattttttgtagacagttttgacatgttgcgcaggctggtcttgaactcctggactcaagcgatccgatctgcccgccttggcctcccaaagtgctggtattacaggcatgtgccaccatgtctggctcccatttccttgtcttcattgttgttggtttttttcttgttactatcacagtagaaaatctagcatgttggggaaagggtgtgactaagggaaaagagaccgggaggtcacttcgactatgacctgtgcatcagttaagatgttagtggcagcaagagacaagatgcccaaccacaagggaaccccaacactggagactttttctcatgtgttgggaagtctggcagcaggtggtccagactgtgttgctcaacaatgtcagggctcttggtggctgctctgccatcctcttggtggcagggtggctgccgcagctcctggcatcatatcctcacacaataatatccaaaatcagggaaggagggacagcttcttgtcactcattgttctctagttagaaaggaaaagacttcccagctccagccacagactttactttgcaggagaaagttcggccaggtttgcatctggaggctgggaaaatgattatctggcatttgagcttctgtctgccatgccctgcaaaagaagaggtgctggtttttctccagtcatccctttgggtccattctctgtcccactctatcctcttcctggctccgtgcccttggaggccaatcctggatttcatcactaggctctgcccttggacttatcatttacttcagcctaaggaaggcaccaggaggagataggaaagccagggagagaggctgggtgtttcctccctaccaaatgccacctttacccaaggccatgaagatactgccctttgtcaccttctgaggcattgttttccctccctatttacacctgctgtccacctggaaatgatttcccctctgatttttattatgaaagttttcaagtctaccgaaacattaaaaatagcttaatgaacactaatatccttccactaaattcaccaatagttaatgttttgccacattttttcaaaatatagatgtaaataggtagacagatcgtacattgagctgtacaattttgttttattccgaaccatgtgaatgttttaaacattttgacatttccctcctaaatatttcagtgtgcttctcctaaggataaagacattatcctaacaatgcaaaataacatcaattcaataatatcacccaattacacttttttgcttaaaatatactttcttaataatctccaatatttgatatttctttgcagctgacaaagcactttctctatcattatttccttttatttccacagtagcctctgaagcaactgtgatcagctcccttttctagatgaggaaaagaatcagagaggctaagtgaccagccaaggtcacacagctaatgtatagcagtctgggattcaaaggcaggccttccaaatccaaatgccacacactttctgtggcattatagccccttctcacaagtgtgttagttttcctagaacttagacccctaagcaattcttatatttgctccccaccaaccttcccatccaccaaaattgaggatcccctttccagcttcaaataacaatactctagtgatgctggtgattcacctgggcctctgtttgatgtgggaaaatgctaggcaatgcgtttggacattgcattttatttaagctagtgtgattgattacatagtatttcttaactgcattatgcctgattctcctctcattctctgggctcagagtgaaagaaagcgtccctctgcaaacccttgggtttatcctccttgatggggaggacctggtttatacttttcagtaagcaggtgagaacgagtgtccttgaagccaacaagggcaggatctctgactctccttcgcttaccagatctgcctcccagcatctctcgaatcagcccatgcctctccttcaccgttgccgctgcaccagttcaagccaccttgactcttgctgggaaaacacagcagcccctcacctggtcccacgtggctgagcatctcctccaattgacagctgaatctcatcaggctgccattccacccagatcccttctgtggggcccactacatgtagtaaattacagtgccaggtgtgatgtgtgcacctgtgtagtcccagcacctcgggaggcagaggtgagaggatcactggaacccaggagttcaaggctgcagtgagctaggatcgtgccactgcacttcagcctgcgtaacagagcaagaccttatctaaaacataaaataaaataataaaataaattaaattaaatataagaaaataaaacacacagtagaaggtgtgctgtggcctccgcagcctccttggtctggcctcagctggcctcactgcctcctctcataccatgcccccctccttaccccaagcttaggcctcattttcctcaaagaagcctgggtcctgtctcagagcctcggggcatgctttcttccctgcccctcgtttccaccccagtcacctcctgatccctgtgcatccttcagatctcagcttgagcaccaaccctgaagcctgcagctggatcccataagtatttccacaacaccctgtacttttcctacatgcaccccagcatcttcatacaataggtgcttaataaattgtccaatgactgaatcctcacaatatctctagagaagatggcaagatgcagagaggaggagtcacgcctgaagccacacagctgacatcagagccaaagcatgagcctcagtctctctgacccagagctaccacccttgctgccttgggaagaaggaagccccctcctattctatccttgagctgccttggcaaggaggggccccttgctgccgccatcctcacaggacaccatccacatgaggggatggtgagctccacttccaccttttctacatgtctgctctttaaactgcacacgttgattcattcattcattcattcattcattcccttgatattaccattcatttattcatcaagtatttattgagcatatttatctgcatggcattgtgctaatcgtaatcatcatattcaccactgctgagcagaacagtcagggtgctgccctcagggagttaccatgtagtaaaggagacagatggaatcacacagaggaatgcacgtctgattgtagcctgactggagtgccatgaaggagaccaagagggcagggtgatggagaaagcacaggatgaagttctcgtcttccttccaacagaatctcagttgcactcagttgttgcccccctcgaacctcccttgagcctcaggagaaaccaccctgattcagaggtccagagaagacctgactagcccaaggtaattccgtccccttgccagagtggcttgggcagggacacgggacctatttcaatgaggccaatgagacaaaggtatttctgctggggaggcaggggcttcaagcaaagggtcttgcttgaaagagccaccggaagagggctctctccttccttagggtgtcaccgtgtctggatgcgatgcctggaagtgctacagccactcgcgcccagcctgaagatgaaaccaaccccaaacacagccaagcagagagatggaaagaactaggaccctaattacaccactgagcagctatagcaaccagttccagagccctctgacttcccgccaaagtgagatgataagatactgtttaatttctctcttttatagccaaacacaccaaaattgacacagagatgtgagccatacctactactgttactgctccatccctagctccaaccacagtgcatggtacatggtagagagccaacaaacacttgaagaatgaatggtgcatattgagtgggattttccagaggcagacctggagacaaggcttcaagtgcgtgtgttgtattaaggaaatgctcccaggggacaatagcagagtggcagaaatgggacaagggggccagggagccaagaacagagaatcaatcgtctaaacagagccccctgttttttgtttcacctgggagtagcttctacctgatccccaggggaactctgggatgtcagtgacggctcagcattgcccctgaggcaagggagctgggctttcctaatcccccactcctcagtctctggctaagcgctgtccccaggggacttaatcacccaaacacttccccaagagtggcatctgctgaccactggaggcactggtacagtgaagcgacagaagggatcagagagggtccaggtggagcacagcaatgtggctgaataataactatattaattcatatagttaattctcaagcaatggcaaagtgtaggcagcttcttgtctgcaaacgtttccatgatatctctcctgcagccagacgggtcttttcctgccgcctacacagaatggccatggagcatccccaactcttattaaaatggaaaaaaaaaaagcctttgcatttcaatctattattgcactttatgactcatcttcaggttctctctgcaaaacattgaaagccagatcataatttgatgatgaaatattgattatgcatttgtatgcagaggtctatactatatagatagaattcccaccctgtagtatcttctattttaagtcagtatgaagatggatgttccccccaggcaaattttgataagatacttgtgtcaatacaaaaagagattaatgcc

SEQ ID NO: 346 - DNA, 18915 bp, Homo sapiens
caaaacataatatttttcacttaataatgactgtttcatatcagtgaaagggatgatgttttctgtaacttttttccaagataaagagcccaatgcagtccatttctttcctgactctatttctgctgaaatagccctaatcataattattggtcatcgggattggtagaattgttcaggacctctgtctgatcattctaaatatatcatttaaacatgtacccagaaagcatagtatttctttctcagcagtaagtcaggtactagaggggaaaacatcacacttaataactggaatgtcctctgttatagcctcagagttgatgatgaatgcagtcctgctccactttgattccatctggctctggaaggtgtttctgaagatttgtgaacagcatttgaatttgtttgtttttatttatattgtctttttactatgatgtataaatatgtcctgtaatgtcattgatctatatgatgagtgagacaatcaagtgttaaaatggaacttgttgattaggatatttataccatagtttagttttcttaagaaactctgacagacacgatatttaaaatgactaaatttacactttgacataaggctactaaaaggtagaatataccattgagatatgccacttgaaaaaactacttttaaaaaaatggcattactggtgtcatgaagaaaagaaatgcttttatctcaaccctggtttcaaaaatttgtgtaaaaattttcacctcaataaatagtttacttctgtgtagaaaaggagacttatgcttgctgccaatttcttcacaaagcatgcttaaaagataaacacttggggccacagtttgaatgtattaactacttcaccaactattttctggggacaaagcaatgcataaaggacattcatctttatccatgtaaatattttcttgttgagcacatactgctgttcatgtctttctagcctaaatcatagttcacagaataattgttaaccacatggaaaacctcccctagcatggggttggagccataaactagccaataagtcattgagcacttttctttcatatatttctgcatatttctgtcaagcgctgattgatactctgcacacctgattctttccaaatgtaagccaagtatctgctagcatgtactcctgataagacattgttcttctgtgctgtatgccattaatattatatgatgtacagtagttcacttggattatgaaattgccagtagctaattaaagtttcttcctgagcatggtaatgatcattaaccttagagctggtttcagaaatttcttagtgataatgtgacttctatatttctttttttgatgtgtaactttgaataatgtttatttagttttagtctcttctccatctttaaatgacaaaatttatcaatttcatattagaaagcattattttgtgcttgttcaggaaaaattcaattggtttatcagaaaggtcacggaactatgaaagcaatgcaaaagctcctgtggcttcttgccattctttaacaaagttttgtaacagacaatgcaatagaaactagaggcaaattgattgctggtctgataaaatccaattttcacatattcatcaagattcacttgttttagcaaatacagcttcatatttgatatttgcattgaattcctgttccctgtttacatttacagtgttgttctatttatattacaattttcgtcactacttttatactttacttttaaataactgatttatttctgtgaattggctatcatgacacaataaaaagtctaaagctgacagatgtaaatgacatttaaatgtgcaaaatccaatagtcaaggcaaagtgcaccattaactattagctgaaatgagcaacttttaggaagaagcacagtgattattaagcatgtgactagctttctataaaacataataagttaatcttaactctcaagtttacagaataaacatgaactaaatcgtttccttgctgtttcctcctatagctagcctgggaaacaccaatgacccatagtctacctgggatcagcatttccccatatggtatgattttggggtattgggatggctgcctgtcctccaaaatagctcattatttaaagccatcaagttatttttttcttcctgtgactgcaagatagatctggctcataaaactcaaggcatgtaagtactgtgtgaaccaattgcataacatgtccccactactccggagattgaagcaggaggatcagttgagcccaggagttcaaggctgcagcgagctgtgattgtgactatgaatagccactgccctccagactgagtgacatagcaaaactctgtcttaaaaaaaatactcaaggcaatttttatgaatatcatggagcctataccattaaaggcagcctatagacatgagctgcatataaaatagacatagtccctgccttcccagagcatgattcagatcttaaataaataagcatgaataaactgcaaactaccaactgtagtaagtgctgaaggaaaagaaagttaagagagaataataaagtgaagaagggtgtctaatttaaattgttgggtcaaaggcaagcactgtgtgagctctttcctttgagctcctccgtcggaggaataatccacaagtactaaatacaggtacttagtatatgccatttttctaataacatttgtgtagtataggaatgcctgcaaataaaagatgctttttctatcattcatttacttttttttagtgcttacaatattaagacatttttctagacttgggggcagggcggtgcagatagggcacagggtgagtaagacagacaagttttctgtgcttatgtagtttttgttctagaggtgagatgttcctcttcagaatatggaaagagaaaaatataactaaactctggagtaaactacttaaaaagtttatgaagttcaccatggggataagaaatacactcgtgcccaacaacccttgactgtagccagactgaatatttaataatctgttttttaaaagggcatatatcaatcagaagtagtgattagcaatgtagaatataaatgctcacatggagctggtgtagtaggtattacagattgttgacactagccattactatcaccttactcctcttctgattgaaatttggcctcaaatagaaatttgcctgtggagagaattattaataagaactggatatgctgttggcattttggtcacatgtattagtgtttgggaaagtatctccatgaatctttacctgaggagactataaattaagctttgagcctgctaggccagggactggctctggattgagtgcggggccatcatccccaagtagtgcccccagggcctgtattgggctggccaggcagctttccccttgagactactggctttagggttagtttttttttttttccaatcagcaatttgaattaatcaattatcaggagatatttttgagatatttcatcaactatccctagaaagacaataatgatttaaaatgtcagacaggaatggttatttcaaggcttcataaaaaaaccatctttaaaagattggctgatattcccaagtgctatcaaaataggctagaaaatgttggagcaattgaacccacaattttttatccttttataaatgcagttgctgttctctaaggaagaagacaggctaacgcagccaacagggttttttttttttcaaataaattaataaattaagtaaacagacatttcttttattctgtcagctgaaatagtgcataagatcaaaaagaaacattcagcattcagtcttgtctccctttcttatgaaactgaaaagaaacaaaataagcacatttgaatttggtgtaaagaagactatttatcatagacagttgaatattactcatctgagaccaaatctactcatttccagttcagcaaaaatacacaaagaatttgataaatattgaattacgcttcagggcaactgctcatgcttttaatataatctttttttaaaaaaattctttccttctactttgaaattaaagtccattaccaaatatcattttaaaaatacattgtatttctttttgtctcatcctagggaagagctgttgcttgcttttacaccactacctttagttatttttctcctgaatgagaggaaagaaagcttgaacatttgtagaaaaaacgcagcaaaaagaagaaaaataggcagactgtaaaatgatgtggtcacgttagctatattgcatatactattgttaagatcatgtgtttagagacattaacttagattttggtaattattttggaaatttatagtattcagtttatggagctttgtgtaaaatggagcatacttaagcaactgaaaacaatgattagcttttctaaactttgcacattaagatcatggggcatttttaaatgttagtttttttcataacaattaaaagtcctctttgcatatttaactaaaatatgaaagtgggagacagacactgctaacatgttgtgcatttcctccagcatctaaataaataaagatagatgtagatctaggaatcacacattactagatttgataatgcaagcagaaaaccctcaaatcttctgtctttcctattttctaccaaggcacctgaaaagagatgcctctgtcacaatcccagcttcatgtcatgcctttgctgtcatttcctcacctaatcaaccaattttccctagactattaatgaaataatgcttcctttctccatttatttaggacaccatctttctcataattttttgtggttggtattctgaatcaagcattctttttttttttttttttttgagatggagtttcgctcttgtcactcaggctggagtgcaatggcgcaatcttggctcactgcaacctccgcctcccaggttcaagcgattctcctgcctcagtctcccaagtagctgggattacaggcatgtgccaccacgcctggctaagtttgttatttttttgtttttgtttttgtttttgagatggaatctggctctgttgcccaggctggagtgcagtggtgcaatctcagctcactgcaagtgccacctcccaggttcacgccattctcctgcctcagcctcctgagtagctgggactacagacgcctgccaccgtgcccggctaattttttgtatttttagtagaaacggggtttcactgtggtctcgatctcctgacctcgtgatccgtccacctcggcctcccaaagttctgggattacaggtgtgagccactgcgcctggccctaagttttgtattattagtagagacaaggtttcactatcctggccaggctggtcttgaactcctgacctcaagtgatcctgcctgcctcagcctttaccctttatttcctattacatatcagaccctccctttcaaatcacttttcttcagttcaaattacatcttttatcatttcttctttgagttttgcactgctggtaaactctctttttttgttgtttttttgtttgtttgtttgtttgtttttggtctgaaaatgtctctaccctcattcttaaaaaacgattttattgaatataagattttaaatggcagttattttctttcaacatattaaagatatttcaccagctcctggcttccagtgtttattgttggtctaagtgaggttcctttgaaaataatcagtcttctcttttcctacggcttctttttaagtgttaagtccttgcttttctgcaattcagtatgtgtcaagatgtatatttatttttggtttctttcattagtcctggaaaattctcagctattatctctgttccatatctttctttctcttcaactggaactcttatcagatgtataatagatcttcttaacctaagaaactcttaaatgaagaagctctaagctctgtgttacataaactctggtttatacttcctacttctttttgtctctgtattctgaatagttcttaccaatcttcaaattcactaattctcttttcaacttcttcttgtgtgttgttaattctatccattgagttttatatttcaattgttatattttttatttctagaagtttgcttagttctcttttaaatatgctaggtttttaaaaaaatagtttcctattccctgaaaatacttggtttttcattttcaaagcatagtcattttatttcctgtaactggaatattacaatatctaaattaattgtatatttgtttctgctctttgttgttttttgctgggtcttgtgcatagtgacttatttccttgtggttcttggttacgtttgtctgtgagttgctttttgtttttccttggaaaattatttttgagttgtcttagaggcctaaagtcaagatgcctttgcctctgactagtgcatagaaacaccatcagtttggaaacaacttaaaattatggtttaaagttttttggactaccttggtgttgtaaatactgtgtgaaaaagcctgatgcattcatatgctcacaacttttcaggggtggttattttccagccctgctctgcttagagccaagttaaccttcctggcagaggtggagcaggttcatttctggtttatcttttttcctgagggaatatcgttttggtatcttggctttatggcagaagggcctccttttagatcttcacattgttcatctcaagtacacactaggctttgagttctgttttccgtgctctacaaggccactgaaaccaaattcgcttggtttagcaaatgcttttagggcaaaagcagtttcaatgctgtgctcctaccttgggtctttcctctttttaggttttgccctggaaatgtcttactaccttatcatatctttattgcttaaaaggattcacttttcatgtgctatacagcattttaagttattctttccttcagccgggaatgttggtctgaataacccagcctgccatacagctggaagtggaaatcttcttttgtaattataaaagcatatccaagtgtttctatcccccttttcattcctaatgtattaggtatttgtggtgtgtgtgtgtgtgtgtgtgtatttgtggtgtgtgtgtgtttgtgggtctgtgtctctgcgtgtgtgtgtttcttaattagaaatctccagggcatttatctttttttgagacagggtctcactctgtcatccaggctggagtgcagtggcacaatcatggctcactgcagcctcatcctcccaggcccaagcaatcctcccacctcagcctcccaagtagctgggggaccacaggtgcatgccatcatacctggctaatttatttttattctttttgtagagacagggtctcactattttgcctaggctgatctctaactcctcggctcaagcaacttcccacttcagcttcccaaagtgctgggattacaggcatgagtcaccgccctctgtcttcagggcatttttgtattattttttccttcaaagacacaacttttggtatacttataactgtaatggcttttatttaataattctttaatttttgtctttatttttctaatttccttttccttaaataatatattttgtttgagttcatcttcacatgcatcccatttgttttgtaattttatatacttcttttctaaaggagcaataattattgtttttatttcctttttgtcatataacttatttgggataatctccttcccaaatttctaaatgattgcttttttccccttgtttaatcatttgttattcatttttattgtattttattacttttagagaatgtgatctaagttttagattattttctaaatactgagtttttaatggcctaatgttatcaattttagcatatattctacagatctttgtcaaaaagaaataatcatatttagggtctaacattcaagatatacatgaacataaataggtagatagatattaatcttttaaattataatcttggaatttttttgactacttgatttgtcaggtcattaattcaaatgacacagttataaaatgagaatctttcttaggggtaacatgtctaagcaagttgttatctacacataaagatattttcccttatattacttcagaatatttaatattttcattaactaacaatacttggcaaagcatgtgattagtgtctataacaagattgttttttctcactgtcagattttaatcccctacttccctttcaacattgaatacatataaactacgccagaatggtctttctatgtcttctttctccagtaagcaacatgatgaccgtggggttttttggtgtatgtggaaggggaaggtgggttatgttgtggactggcatctgtgtcatattttgttcttaccaaccatacagttagaacaaaatgggcaagagtgtaacctctgagtaggactttggaaagtacccccccccccaacatccttaatcattataagacttatttataggagtaaaatagtttctcatataaaatttgaaaacagcatctgcaatataatcaggcaggaggaaaatggtatatttaatcacatcactccaaggcaaccattaataactagttttgcttctttccttctaatatttcttctagaattgttttacataattgagactcttctgctattatataataggcattttccattattaaaaattatttaacagaatcatgtttaaatgccttgacaatatactattatttacttaatatttctttaatattaaactggcatttccaatatctttgtattattaattatgctttggtgaatttgttttctttctatccttttttttgttttgttttgagatagagtcttgctcaggctggagtgcagtggcgcgatctcagctcactgcaacctccgcctcccaggttaatgtgattcttctgcctcagccttccaagtagctgcgattacaggtgcccaccagcatgcctcgctaatttttgtatttttggtagagacagtgtttcaccatgttggccaggttggtctcgaactcctgacttcacgtgatctgcctgcctcagcctcccaaagtgctgggattacaggcgtgggccataagtaacacagtggatccctaacttttgggtgcatccaaaagccctgaaaggcctcattccccaagtttcaggttcagtaaaagtctgagcgtggccaaataatttgtatttctaacatttcaggtgatgtcaatgctgctggtccagggaccaaacttggagaatcactgtaataatgacatgtaaggatttgtttcaataatttctgaaaagcaatgcttcttccttctattgttgtttccatctttgataatgcagggaaaaataatacttattttagattagaaaaggaagtagtaatgtctattaaaggtttttaaaaatcttttagtcattggcttttgctaactcgtttgcactgattgtggaatcttactggaaccatttgaccctggagctacatcactatacagctggtctcattttttttaagtcacctgccctcatttaattcatttcctttggtgttttccttcctgtggaaagtctctgacatctgtcctacatacttccttatgaatacaaaagctcatcttttttatttttaagttttatgagtcaattactcttaccctttttgtatttgtgatgttttcattccttatgttttcaaaagacactctagtctataattatttatgattgctctttaaaaaaatttttaaacatcttttactacattctgttgacatatttaggtctgagcctaatgtcaaatactagcagcagatgacttctcacttcactggcaccatcatgtggtgaaattgtgcgctacatcgaaacatttgccaacatggtgccatttcatcacatcttatgtatagataacactgaaattggaactatcataataagttagggaatctgaaataatcctgttactttagtaaattcacagaaaagtaagcaccaatgattaagtatgtggacactgaagtcaattacatgagctcaaagccagacttttatactatcatgtaacatttgggcacattggttaatctccctgagtctcagtttccctgtatgtaaaatgggataacagtagcatctatctcacagggatgttgacaatagccataaaatagtttaataatatcagctgcgattagttgttaccatgccatcacatttgattttccctttatgttcataccaagaaaagaaaatcagacttcccctgtgagtttagaaaattataccaaaatggaataattgttttcagaattattagaagtaacatgaagttaaaaactgtaaaagataaaggttgaaaaaacatttaaataaaagtcatttttttaaaaaggcaacttctggaaagaaaggtctatgaactctatttaccaagtgaaatttgaaaattaatctcattatattaagcataatcgacagtcaaaataaacaattgtgaagatgagtaacttaaaacctttttaagggtcaaaaatactttttaaaattaaaagtgatttatagtccccaatcctctcaatgatctattgaaagagaaatgtttaattttataaatccttgaaagagatacatgtgggacagatctgtatgttggaaatctttctattaaaaaataaattattttatcacgataatagtgagagtagaagaaagcatgcagggttgctgtgatttgaatgtgttccccaaagttaatgtgttggaggcttcatttccaatgcaatggtgttgagaagtgaaacttttgagaggtgactgggtcctgagggctctactctcattaagggatgaatggagccattattgcaggagtgcataattgtcatgggagtggagttcctgataaaaggataagttcagcccccttccctactcttttcccttgcctactctttccctctcttgccctccaagccttccaccatggaatgatggagcaagaaggcctcaccaggtgtgggacccttgattctggacttcccagcctccagaactgtaaggaataatttctcttctttataaattacctagtctgtggcattctgttatagaagcacaaaacagactaagacataaaattggtgttgaggagtggggctgttgctacaacaaatacctgaaaatgtagatgtggctttggaactgggtaacaaatagaggctggaagaatttggaggagcaaatagaaaagcctcgactgctgtgaatggagcactgggcaattctggtgagaagacaagaactgtgaggagagcctaatcttcttaaggattacttaagtggtcatgaccagaaggctggtagaaatatggacagtagaggccattctgatgaagtctcagatggaaataagaaacaatgcattggaaactggattaaaagctatccgtgttttgcagaaaattgtgatggaactgtgtccatttcctaggactttgtggaaggcagaacttaaaagagatgaactaaaatatctggtggaagaagtttctaagcagcaaattattgaaggagttgcatggatatgtttaactgtatacagcaaaataagataaaatgtaagatatgaaagctacacacacacacacacacacagagagagagagagagagagagagagggagagagagagaggtgatttagaatttataccgaaagggaagcagagcagaaagattaggaaaatttgcagcctgggcatggagagtgtgttgtccaaaacaccaccagaatgcctaaatggtagaaaggagagctttattggcaatatcagtttgcaaactgagaagaatcaatggcatgtgctgaaggtgctcttttttgaagatgaaaagggcaggttggcccttatgcctcaaagggcttgtgcagtcatacatattcggcaggtttggggaaaagctatacatatttatgtggagagttgagtgcatgtgcaataggcaggcatatataatgtataacccatgttcactttggggtggggttttggcattaaaatggggtgaaatttggctccatgttaaaaggtgaactgtaggatacgaagactgtgcacagtctctataagcttgctgaaacttgcttaaggtctatacttactcattaggaaagtgtgtttataaggtaggtcttctgtccaatcagagttgaagtggtctgagttgtaaatcagagtttatgagggctcttgataatttacatgaaagctcctattgttagggagtttaataagagtgtgtttattcttatagccataggaatttagaagttatcatgtcagctgagcactgaaccctcaaagaaaagtatctgtttctttaaacttggggtctgtcttagttgataaaggggcatctcttttggtttctcaggtcacaagtaaaatagtgtctttaggacagcaaaccgaggatatggccaagccactatttgctaaagaggttagtatggctagcaggaaaccaggtgatattcatcaagaccatggagaatgacctgaaaggaatttcagacatctttgaggctcccttccatcacaggcccagagctctagaacagaatggtttggggggacaacccacagtgccctccgtgggcttgctgcccagggcgacttccagactctgctccctgtatgccagtgctgtaatcctgtcaccccagcagtggttcaagcaggcctggctgtggctcaggttgccattccagaggacacaagcggtaagccttggtggcatcatgtggtgctgattctgcagatgtgtagaatccaagagctgtggggacatggtgacttccacctagatttcaaagaatgtggacagcccagtaggtcaatgcctagtggtcttgagagtggggcagctcccaagaccacaaaactgtagggctaccagcatgcaactccaacctgggaaagctggaggcatgaaatttctatctgagcactgctgggtagacagtccaccaaagcggtaggaatggagctgcccgaggccttagggaccctgccccatcctggtgtgcccaggatgtgggatatggagtcaaaagagattattctccagctttaaaactcatttttcttattggattttagacttgcttgggtcctgttactttcttcttgcctatttttcccttttggaatgggaatgtctatcctatgctgtcacaacatatatatatatttggaagtagataacttgttaaatttcacaggttcacaactggaaaggaatttgcctcagggtgaattgtgccttgaatctcacccatacatgatttacatgagacttcggtctttggacttttggactgatgtagaacaagacttttgggacaattgggatagaatgaatgtattttgcatggtgagaagtcataaagtttgaagactaggggtggaatgctgtggtttgaatgtgtcctctgaaattcacgttagaggcttgatccccaatgcaacagtgttgagaggtgattaggtaatgaggcctctgcccacataaactgattaatgccacttcacaggaatgagttggttgtcacaggagtgagttccgcataaaaggatgaagccagtcccctccccacccacccctcttcccctctcttgcccttccgttttctgccatggaatgacacagcattaagtccctcaccagaagtgagcccctcaaccttgcacttctcagcccccagaactctaagaagtaaatgtttattttaatctttataaattacgccgtctcaggtattctgttacagcagcacaaaatggactatttcccccaaccccttcaacaccatgtataatcattaaatagaatgagtaatcttgccagaaccacaatcttacattcagtttccaaactgtagtttcccccagatagttagcattgttcaatgaatttttgttatgccattatgcaaatgtagtctatgttcattatctctgtacttattaaattcatcaaaagctgtccaggaacagattttctgttttgtcaactacacccataatcttgttcccagatttttcatcagtattttcagactgtgagggaaggaaagcaagaaatgggaacaatttcatgaattttaaatatgctgtaactctgttttagtacaataaaatatataaccgccgtctgcagttgcttccagcataccccaatctcagggcagtgccaggttagtgcagttggttagaatgtggcaatatgtccataattatttcccatgtgaatcaattggcttggctgtgcagagaagaatgtcttcagtgtcaatctgaacttttgaggccagcagtctggaaaatctgtgcctttgattattgagatttggagatttccaaagaactattattgactgctaattccattgtggttggagaacaatactttgtatgattttcatccttataaattgagacttataacccagaatatggtctttcttggcacatgttcagtatgcataaatatggcacatctctccatttatttagctctttcatttaagcaatgttttgtcactttagggtacagctcttgcatgtctttcattaaacgtattcctaggtatttataatacagatgctcctcaacttatgatgaggttatgtctgaataaacccatcctaaatggaaaatactgtaaattgtaggggggttttcaacttaatattttcaacttatgatgggtttatctgaatgtaaccccattgtaacctgaggagcattctgaatgtctatcactttcacatcattataaagtaaaaaaaaatcgtaagtgaaaccctcataagtcagggatcatctgtactattataaatggcatattttaacatgtcattttccaattgctgcttactagtatataaagtatttttttaatatatactgagcttttaccccatgacttcaacatccagtagacgttgaagattttccacatgtacagtctacaaaaacaatttatttagtagctttgaaaaacagattttctacatagaccactgtgaatagacagttttgcacttttgtaatatttatcttttattattttaattatttattgtactgtctagaatttctgatacaaagctgaatagaagtgatgagagccgacagctttaccttgttcccaatcttaggattggatatttcaccattaagcataatagctattgatctttcatagatgtcctttataaagttctcttttatttctagttttgtgattgttgtcatcatgagttagcaataaaatatgtcaaatgctttttccgccattattaagattttctcctttattaatgttgtaaattattgttgattaatgttgggcaaatcttgcattctggataaactgcaattggcgattttattttatttttttctgggttcaatttgccagtattttctataggaattttgcatctgtattagtgagtaatattaatttgtgttttttttccctctaatgtctgttagatttttccgaaggttctgctgttattccttcctcctctattctctgagtttacataaaattgacattgtgtgttctttaaatgctggatagaattcactaacgtggatggttttctttgtatttttaaattgcgaattcaaattctgtaccagatgtacaaatactcagattttctatttattcttcagtgttttgataagttttttttttttttttcaaaaaactttttttcttgagacagagtctcgctgtcatccaggctggagtgcagtggtgcaatctcaactcactacaacttctgcctcctaggttcaagtgattctcctgcctctgcctaccaagtagctgggattacaggtgcgtgccatcatgcccagctaatttttgtatttttggagagacggggtttctccaagttgacatggctggcctcaaactcctgacctcaagtgatccacccgcctcggcctcccaaagtgctgggattacaggcgtgagccaccatgcccggcccccaaaactttttattctaagttatcagattttattggtataaatttgtttataatattattcttttgtgattttaattagaatttttcaatctcagcactactgacattggaggccagcaaaatagctgtgggggactgtcctgtgcattgcagaatattcagctgtttccctgacctctgccttctgatagcagactctccaactgtgacaaccaaaaatgtctctggacattgccaaatgttccctgggggcaaaaaaccctctggttgagacccatgttttaatgtctgtagaatctttagtgttctttcattccagatactggtaatttctctatttttaaaatgagtttttctagagttttgcaggctgtacaaaagaagactatgcactggacttggcctgtagaccacagtttgctgatcctgacttagatcactgattttttttcttcttctctaataaaggtatgaaaaaactacaaatttccctctgagaatactttagttgtatttcataaactttgaaatgttgtattgatggttattagccaattaatggttatggtgagtgtttatgaaggtaacatgagcttgactgttattccaacaaaagagcttacaaacagacttttggttctgtgtgagatgagcaatgaagaacagtaagtactttcccaactagttgataaattaacataaacatccataatctggcaacaatattcttttggctcctatccctaaaaaaagccagtctgcaacatccaaaacatttaccaagacgaggaaattgcaatgattttcttgtacgttatggagtattaatttgctgccacctgctgggaggcagaaatgggtttccagcattgctagctacaatttgtcctcaactatttattttgaaaattttcaaatctatagatgagttaaaagaacattcatatactattcacctgaaactaccaacttttttgttgttgttgttgttttgtttttttgagactggagtctctgtcgccaggctggagtgcagtcgcgcaatctcggctcactgcaacctctgcctcccgggttcaagcgattctcctgcctcagcctccggagtagctaggactacaggcacgtgccaccacacccagctcatttttgtatttttagtagacatagggtttcaccatgttggccaggatggtttcgatctcttgacctggtgatccacccgcctcggcctcccaaagtgctgggattacaggcgtgaaccactgcgcccagcccaggttcaaattttttaaatccttaaggctatctagttgacagctgtctttaatgtagatcagtcctcctgcctttttttattgtcttccttattaaccttattgaaaagtccgaacaaatcacattcagaatttatctcagtgtttcctcacaatcagattcaggttaaacatttttggcaagagctctacaaaagtgtatttcccatagcctcataatgacaggttcatattttcgccagtattggtgatgctagcaatttttttcccatgaagaatctattaacattttgcaaaacactaatgttccatggaaatgtgttccctaagctgtactgtttagaaaacttctgaataaaaaagtgacatgcatgaaagtgtttgagtttgtagaacgaaaagcaggtaaggataaactcaattttaaaattaacaaacttcttcacttctaaggtagcacaaactgagctttcatcaaacgtaacccttaccgaaacaattgttcagatgagcaacgccaagtttaaagaaaggaagtaaaccgtctcaagaactgtcaatctgtttgtgttcgataggctgagatttgaaaggtttgattctgtgttctttctactagatcctcggcttcatttagacttgtgcttaattttctgtcattggctattgagtctacaatcaatctttggagtaaaagtggtagtcttttggtccaaatagtaataatgaaaatggtgagaccagtaattcattttttattattctgtattcagtaagaatcaacctgtatcaaatagctgaaaaggcctgaagcctcccaaatgcatatcattacacaaattctgtgtgaggactgacatcttggtttcatatactaattatactgcatgggccccatttataaccatatctactcgtcatttgatcctggctactgccgatggatgctatcttcatcacattatagcaaacatttgggtgattaagtttttctcaaaaattctagattagcatacaacggctttactacttatatgtcatctaagacgttttttaagaattagttactactacgcccaacgcagtgaggtagcaaatattatgcctgtttattttcatctccatttcaggcttgcgcgcctttcccccctcgggacttcccgaggacacccctgcagcagtgagcccgagtcctggctttggctgcatgttaagaaatattaatcaaaatgaatgcgtgccctttaagagaaaaaaactgtgggtccttcagcctttaaaaaccatgccgtggtttaaaaacttaaaactatatttcggcagaacgctgagcatttcttcaaatcactctgagaagcttgagtgtctttaatttcaccggtctgtcaaacgtaacgcgtctctccctcaccccacattttaagtttccaaggagcggaagaagggcctccgggggtcccggccgccgcaggctg

SEQ ID NO: 347 - DNA, 4796 bp, Homo sapiens
ttggacagagaacagaggaggaggtgtgagggtagagactgtgactcactctctggccaggaagctttgctaactcactttaaaaattgacagccctggtcagtaagggtgaggatggctgactgcagacgtgggtggcatgtctgtccttaggaaggctgttccttagttggaggtcacagccagggaccacaactgaaagcctcagctctgaagggcagagaagaaggcccccaacagggcttctgagcccaggtgccagatccagagtcagggcaacctgaggctttctcggcaggtacctctccagttctcatggttttcagagccagtggcctgtacaatggagatttcctcctttgctttgtgttcttcttgcatttttaaacagcagtttctcagaacagatgctctcttctctccttccctatgccccttctgcacaaacagcagattgcctgcttctgtcatctttatagagggaaggagagaaacatgctaatcatgttctttttccgcttcctcctgcttgcaattagctatgcgagccaagggctctctctcctctcttactctcttccctgaggaacaaaccctccaaggagattttcctgggcacttcccactaagcctgcttcccttaacagacaccttgggttttggctgttgttgttttggatatttacgtcctttgacctcctaagagccagatgtcatgcagtcacataacttcttgatttctagttcccctgtatattaaagacccaagagcatattgaaatgtatggaagccaccagcatcaaaattattctcatgcctccttctcccagggctgctgcatcacacaaccacaggggcattagtcacatagggctgtgtgtctatccgatagtcatgcaacactgtgcacagatgtcatgtaaaacaagcacaaccccaagccataaaataagtttgttttatgacaaagcacaagtcataaaacttgtgatgaaatgcaacaaaattctgtggcatttttttctcatgactgtgttaatgctagttttgaaatatcaaacataagttcccctccaacgctttttcgtttggtgcaataaactcctgagtagcccacccatccaagtaatccagcactgagcaaacccactagaaagctcctttgcagctccctattttgcagatgcaccatgtagcagacagctagaatgggcccttttaatcctgagaaggaaaagactagaacattgagacttgcccaagcatgagtcaccatagaacagtatctgagagaatttgaaatcaaacaggctggattcaaacactttccagaccttgaggagtggttcaatgatgccatgcataatgataatggggattctctgcctcctataggttcttaatttatatcgtttatatatattcagacctatatttcaggctgctgtgaggaacagtggcctggcaggactccttctccttcctagcaaggtagaaaggtagggctatggcagggatccgtgtcacagtggagaggcagcagttggagtctaaacaggaaaatagaaactatacaagtacaaaagtagagaagatttaatgcaggaaatagattacacagatatttcagtttgcattccccaggagatccagagagaaggattcgagtgcaagtatttttgcagggaggtgatgcaaaaatttataataaatgtgcatacatatatattgcatattttatttttttcttggagaactggttgttaagcctttaccagcacacatttggtgaaatgcattaatttaaagatgattctttcctacaggttataccatatcaggaccctgaagatgtcatctgatccagctacctttacaattaggaaagtattgtctatagtctgagttatattgcaacatttctttccattcaattcatcacacgtttaatgatcatttactgtgtattagaaaggtgtcattaaatcaccgagtcttagagctttaagaaatctttgagacatttaagtttaaacttctcgttttcttaatggagataaaagtcatataacataaaattcaccatttaaccattttaaagtgtattaatacaattaagtggtttttagtctattcataatattgtcaaccatcactactacctagcagctccagaacgttttatcactcccaaaagaaaccctgggcccatttagcaggcacttcccatttctctctcccccacagcccctgtcaaatgataatctattttttgctatggatttgcctgttctagacatttcatatacatggaatcctgtaagatgtggccttttgtgtctgatttctttcacttcattttcaaggttttcaaggttcacccatgttgtaacatgtgttagtatgtctccctttttatggatgaatactattccattgtatggatataccacttttaaaaattcattcatcagttgatgaacattgggtcatttccacttctttggctaccatgaatagaattcatgaacgttcatgtgtaagcttttgtttgaacatctttctagttcccttgggtgtggaattgctggattatgtgatcattctgtttaacttttgagaaactaccagactgtttccacagaggctgcaccattttacattccctctagcatggtctgaggaaaacacctcacttttgaaaggaggattctaaggcccaggaaggttcagtgacttgcacaaagccatgacagaactgggaccaaaatccaacctcccagcttccactctgctcctttgttagcccatggccccactcaaaggccaatgcaacatgttctttctgttgtataacttaaggcaggaaaatagttactgcaggaaaaaaaatgtaatattggtgaaaacaaaaaggatgaattttccaatactctgagttcaccagaaaattcgattaatcagaacgcaccccctatccccatctcaatccccatccgtattgacccaacttcacaaatgtctgtttactaaagcaaatgcttccaataacacactggccttagtataaacactcaaacaataagatcactgtttaggctgttttgaaggcacttttctaagagacaagcatggactcttttcccttcctcttcttcctagctctgcttcaggcctctgtcattctttatgcaggcttttaggatcgcagcttctctggcctccctggttcctgtttttctcactgcccatccctcattcctctgtctccagccaattatccaaacaaagatcttgtaacatcatccccctgctgtaaataacattagtgatttctgagagttcaaactctttagtggagcacttaaggcccttcccaacttaggctttagctacctttgcagtgtttatctgcatcccctcactcattttgtgctgaaaccagatcaaaagaactgcacatctctcaacatgtgcagcaccttcatgctttccattttttttcaaattatagttcattcaaaaagcaatacttaaagctttctatgtgccattctgaggattcaaatcaacatatttcctgccttcaataaatagacttacaaccaccattgcagataaaccgcccactaagcaaataatagaacctgatctataaagtaatagatatgcaaagtgccgaaatagaccaaagtcggagatgattaactttctttaggagtcattcatgaaaggcctcactgaggatgtaatgctagagcagagctttgaaggatgaagagaagttcaccaagtgaacgtggaggaaaagcagtccaggcagaaggaacagctgctgaaaaggtcaggtgcccaaaccagaaaggcatgtgagggaattcatgggcagttctggagaaccagagcagaaggagacaggctagagaatggcaggagatagccctagaaagctctatgtgtgccaggtgcaaaaggcttgtgcgccagctaaggagtctgcactttcccctgtaagcaattaaaagttttaagcagaggagggattggtttgtattgatctagataattcagggaacaatgaagggaggatatttgaggaatcccaaagagcaggggcagagactctcatcacagttcaggcctgaccgaaggccatagggagatagcagtaaagcagggaaacctactgtcccttcttcacctggaaaactatcaccttccagagttcctgtcaccccagtgaaggcaaccactgtctcttctgttacctaacacgtggtacaaacagctaccatagcatgcccctcgtggaaggagttttcttttaacacattcccaaccttcatcgcagctctgggaaagcagaggccaggatgctttatatctccagcgttcagtaccctgttgctttctaaagtacttctcaaacttggattaaaatgcagactttggttcagtaggtttgggatagaggcgagattctgcatttctaacaagcatccacgtgcatgccacagacaactctttgggtagcaaggacttggcatagagtcaacaaaaacttgtttgttgagagccgtgcttctctccagtcaaagacttgttgactggacaagaactgctcctgggatgcaggcttacacagcacaaccccgtccgcttcctggtcctcacaaaaggactccacatcacgtggcattgggtcctcagttatggggagagacattctggggaaaattctccttaatgaagcctcttatctttaatggaaatgcacacaattgttcagtaagaa

SEQ ID NO: 348 - DNA, 4822 bp, Homo sapiens
tcggggctgctgctgctctcggggcgccgccgccgctctttctcctctgctgccgccgccgtctcccggcagccgccgccgccgccgctgtccgaacttgaagttgccggcgcgcccgttgcagccgccgccgccgccgcggaggtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggggcaggttggaggagtaggagtatgtcattgggcgcgaagacggggtctggggcagaaaagaagggaggctggagaaatctggacccgagacgtagtaagtacaacttggcaaatacatgttagaggagcagggaccacgctcatcaaaatccattattgggctaccttgggctctccgcagtagccgagcttaacatgattctccactgcagctgcctctttgaagcggatccgtgaagtagaaatttggagacgtaagctgacgtggaaatctatccccatccttagcagggaggtgctggtcatgtgacccgatgttgaaattgacaagctgctagctagtccgggccttttccccccccctttccttttttttttttcctcctctcccctccctcccggcttcctttctttgtagccacctcaggggaagcaacagatcgtcactcggtgttctcaccgaaagcacgtaatcgccggtgtaactcatgttggctggggggcctcccggcgcgcgcggagaggctggggtgcgcccccatgcagcatgcttgtgctcaattgcagggtcctcgttctcgagtgtgcagagggcggtgagagctcaactctcgtccccacctcccacccgcagctccccgggtgggtgagggatgccctggactggggatagccaggtgggagtccgtcgctgtgtggcctgtggtctcggagtctgttctcctggagtctcgcatttgcacccccttcttcgcagtccccctcccatagacttgctctgggaagcgcctctgcctccgaccctagccggaaccccttcggggccagagtttgaagccgtggatgtgcctgcctggtggcttgtccgatttgcacggtgacttgattacactctctcattcatggtcacttccgaagcgctttagtgccttccgtccctaaaccgccaacagccagaacggcttctccccgcggtttgtcactgatccgcagggcccggaagggccttcgtcttacccgggatccacctctcccctcatcttccctgcctacctcttcatcccaccttctgtccttggagaaactccctcctcctcgctgcctgccgggcttcggagtgactcggcagagacagaggcacaggggctgccctgctgctcaccggtccacccatctgcctggtcttctggagctgaggactcgggaaaccatgcaattgaggcaagccttgggctgctttagaggcgctgacatccgaggagacttctcctgggtatgctgcatcttcgtggggggcccatcaggctgcttacagagctccaggggtgtggggagaatggaggtggaaaggacgggctgagggccaaggagaggtggctgagaaaggggtaacccacctactctcctactctccttccttgcaatgtgtgagagtgaaagcaagggatgtgcagggcaaaaactcagagagctctgtgcctttcctactgctcattccacaggaggaatacaataccagagaaaggagaggtgcttcccgaactccctgcacctggggaaacagggatgtctttaaaaagctaggtttgtgctaaggatagagagaggccatagcaatactctgagtctagctttcttgagaagaggaaaaaaaataaattaagaaggcaaaatatgctccccatcctgcaggattgaaggagcaatgtttggaggaagcgaaagaaaggagaggacacagagcacagagcagccaggcagagccaggagctgagaagggcccagacctgaggcctcccaacaactctcttcttggaaggatctgggatgttgctgaaggaaaataaaaaaatatgtaaaaagataaccttttgtttttccctctccaggaaatagccaaagttatttacatatcttggggagatttagagtataaactctaagatctttggtatttaagtgtcaacatcgatttatttatttattgctgagctgactgtaactgactcaataacaaatctaatcgtgtattgcactggaaaagaaatattcttattatgtattttctccaaataatggcctaccattgcatttgaatacctgctgtaaatatcaataatatgaagtaattactctgtagtcgagtaaactaatttattagcattaatgtttatgtggctctccacctccccccaccaccacctttacaaggattgcttatcacaaatcaagctacttggacacattggtttaatgaactctttattcaagatttgctacaagaattttcatgtcctttgaatccctgagaactgaacttgaaattatttgtgcatcttcagcttgacatatttgtccactgtggcttgtccagagggcagcagtgctgtgagtgagaaggtccagtgggaaggaaggttattggagaagagtagcctcagacctcctaaagctgggaagcacatttacagaattgccctgcagcgaaaaaacttctatttccagcagtgaccaacaaggcaaaatgtttgtttctccacagcatctcttttttagagacagaatataaaagacagaaggagaggtttcaaacagcggtattcgagctgttccctggcttgattttggctatcccaagctctctctctgcagcccacccagtccacgccacccctaccttcgaacaaaaggaatgcatgaagggtttcagtgactttgccataacaaaggcgccaccattgcggggctcgccccgcccctgggtgaaggcaaacaaattcttgcacttgtattagggcttttaagaccataattgaacccgggggcgtctaggaaaaccgaaaacagttctagacagacctgcggttttatagcagttttggcagtcaacttcagcttgtgcctgagcagacggggttgtggtggcccgccagcgggggatgccaggccacctcccccagcggcacgcagcccctctcttaattagatcggttttcccctggtgtccgggagagcggtcccggcagaaaggtcggtatgggggtgtgcgctgttccgcataaccactgcctcccatgtcctcctcgagggccgaaccgagagggtgctggcagggctggatcccacgggtgtccgcaggagacaaaggcgaattccggagaaaaggctggggctgagaaaggcgctccgggagcggctggcagggcaattcggcaggctgcaccgaagccgagtgcccggagggacttgccgcccggaagggggtgtgtgggggcgctgccgtgaagatggatgagggaaaaggtttttgatatcagcagaagggaaaacgcctggagtggccgaacacttttagttgcccagcaggaataggagacgggtactcagctccccaaggctgcgcaatatcccagctttgcccgctcctgccctcgtgttcggaatatgctggcggtgtgaatgtgaaggtttctccaggcaggcggctggggcgaggggtgggcgcagctctgaggatcagaccaaatctaggggaaaaaggggaggcagaccttcgggtccttggttttgactttgctctgagcctatgattgactcttccgctttgcaggaggtccaacagccgagcttagcccaccgggctctgggaaagacccgactgaggctaaagccgccccggaaggccaagtccgagttccatttcttgaagaggccggcgcgcgtaaggctgtgacattggccctggcgactggcttcccaggagctgttctttctcaggagctccacagcgcgggccatctccagaaaactgtcttcagagtgtatttccttttatcgtcaacccagagccccaccgcggctaatgcaagaggccaaaaaatgtttggaggaagaaaaacaaaggcaggaagtggcggcggcctgacggtgcgtgtgtgtctgcagagaagggagggagccggctcagtctcttcttgtttttccaaacttcaaggtccaggcagccctctgcagggccgggccccattgctccccgcgcggcattggaggtggccgcccggagaggagaaggccaacgcctgcgccaggcttgtcaggcggaaacggctaacaaggagatttggtcagcaaaacagacccagcctttccgaggcttcgtctgacttggcccgaaaggttggggagggggggcttgcgcagagcctcagggaccctcctctctggggactaccatccctgagccttacgcttctttccacagcctttgcaggcggaatatcggaataaagtgggtccaggcgcctctgc

SEQ ID NO: 349 - DNA, 34906 bp, Homo sapiens
agacggcggagagcagagagggagcgcgccttggctcgctggccttggcggcggctcctcaggagagctggggcgcccacgagaggatccctcacccggtgagtggttggccatccttgccgcaaaggatgtgcaaaaggaagacggcatccgcttctgggatgggctctgtcctcctggacatgccgagagcctgcctgatcctgggtcctgctgctggaggcggccacttcgcctggtccccgagcgtccgcaacaaaatttgtcagaaagaaaatcttgaggcacatttccctggggggaagtcagggctcctctctggagggtccagtccttaagggtgggctgggtggtagggacttcagttcagaggagcgggaggaatcagatggaactcctcttggattcgggtatacggcagtcactggggggcgaaccccggatttcctgtattagaagccgcctctagaatcgcgttaatagtgggagatatggcggcgatgccttctgcgtgccccatgaattagggggggaagcacccgaatagaagggtctcccgggcatatttgcctcgccagctgttggccaggtttttggtggatcgtgggcgggaggagtggaggttcctcttcgcgaggttttccgaatccaaatacacaggtttagtgcagtgtggaccccaggcaaaatgtggagtaaaatttctacccgatatcatctggttctgccctgatcagccactttcacagtggagagagatggcgcccaagtgcaaacctgccagtagccccctaggatcagtccttgccgaaggggggtcgtgggattgggggcactgggagaatagatgcagggggtgggttggggaggagagaaggccgtgtccttgggtctgggaagagggaggagagaaatgcagaaaagggggtgtgttgctggggtctggacgctgggagctggggatggggtgccgcgggggtcttcagagcgttgcgtggtggtcgctcgaaaatcctgacatgttgcagtcttggacttttggtcaaatcgccttttgccatttcctttgtcagagtcaagcccccccaggccgccccctcccaccctgggccggcgggcctggtgggggcgcaggcgggtggctacgtggcaggtttctggaaggtttcctggctggccgcgagagggcgctggcggcactgcggaattttggggggcggggtggggaggggaggtggcctttgttctcctgatggagggggtcgggcgcgggatctactggaggatcctggattcgtttacccaagagggaacagttttgagaccccccggattcactgcggagtggccgcagaggccggggtcggcctttgcgccgtggcttcgggtgttgtggaggcgcacagaggcacgttagttgatttccagtggtttttggtttcgggggtcttaggaaggtgtggctcatttgagcaggatggagagagaggctgtgacaaggtcagtgaggggccatcgtgcgggggctagaaattgttgttgtggcgaaggagggaggcacgactttggaggcgtgatgttgatgcctgggggcgaaggcggggagcggcgtggtggccccctttgcgttactttccagcgatgtcacaggttctgtctctcgttccgagaccacccacatgcgtgacagcggtgcctggaggactgggtctttctgactttagtgaacgtgtgtttaattggattgacgaaggtgggagtcgggatttctgcttttccctgtagcaggcggagcggcgctccagaggggcctggcgcaggtccgctgggtggcccaccttcctctggggctggggcccggtggctgggggcgcaggaggcgcctggtgcgggcgggaggcgctgcgccgcagccacaggtgggctctggctggtggtggctggagaggcgtccagggggcgtagcgacctggcgcggtggcctggggtgggctgtggagcccttcctagcctgagacctgttgggcaccccctgtccatccaggcccgccgggcgcgggccggggcgccgcaggtggctgctgcactcctgggttacgggtgcgggccgcgcgccccctagcggtgtgtgccagccccgctaccttgggttttgagttgcgcacacgcacacagctaacacttgtgacctgtcagtcaaatcatccttaccccctcccactcctctcctccacctcccatttctcctctccctccaccctttctcatttcctcgtccctcctccccctcctatttttcttctccctcctccctctttcctcttccctcctccctcttcccccctcattttcctcatctctcttttcccctccccttctctcctcccctctccctgcccccctccttcctccctccatacccctccctcttccctcccagcccctccctactgccttcctcagtcctcccctttgccactcctccctgcctttccctctgcctgcccccttttgctctctgctgttccggtgctggccgttagaggtcacgaagatggtttctaacctgcccccctcccatgccatagggtctctcctcagggatgacatcatccgtccacctccttgtcttcaaggaccacctcctctccatgctgagctgctgccaaggggcctgctgcccatctacacctcacggtacttcaaccctcctgctatcatttcataaccaacgtggcgggcagaatctcccaaccccaccaccatccttgcaccacccccagacccactagcaattaaaagacaattttaaattttaactaatcagctttaattgtaattaatgaacttaaactgtaattatgatctaggcttgggcttttaagcaggttctctaacctttgatcaattgcagagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgcccgacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacaccccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgctctgtcgcccaggctggagtgcagtggcgtgatctcggctcactgcaacctctgccttccgggttcaagcaattctcccacctcagcctcctgagtagctgggattacaggcgcccaccaccacagccggctactttttgtatttttaggagagacggggtttcaccatgttggtcaggctggtcttgaactcctgacctcatgatccacctgccttagcctcccaaagtgctgggattacaggcgtgagccaccatgcccagccctatagtagttcttcttttgccccttaatatcttcacccacatgtcctgtaccctgcctgaaccctcctcctctttttgttctgatctttgagctccctagagcccataattctttagagcaggtatgtcccgagtctgaaacatgcccttatttgtcccaagctctggacatttctcaccccaaggcggatcaatcatgattaaatcactccaattaaactttaggctccagtcagaccttcagccaaatggaaaaaaaaactaggggataagggaggtagttggagcaagaaaatgttattagttgaaaccttacgggaccttcctcccttagtgagtctgttggctaaaggttctctggcttcgtgaattagaatcggatactgtttccaagttagcaaaaccaactctaccccagcaccccacgaggaagaatgtggaaggatctcccattggccggttggggcaaaagcctgaggcaatctttcatccccttttgccaaggcgagactttcccagtgacggtgatgtagttggccactctgactatgggtggactcgggtgtagacctctgaagctgagatcacacgaaaacctggcctccccgccatgtagctgttggagagtagaaaaatagagcacgcctgatgtttctaaatgagaagactttcaatagtaatgaagaatccatggcactctcctcaccctcaaacacatggcagtcattcacatacaggccccaaagccactgttagtgctgcagtagctcctgtggacattggaaagcccggagagggcgtggaagaaatcagctggcccccggcaggttctctggggttttgtgcccaaggctcctggagccctaaaaactttcaaaagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactccgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggtgggtgttgcccccgcctgcctttgcctccgccgtggccctgagagtcctgggctctgccccgcccggtcccttgctccccactcagttctggatttggggctgcccctaacccagcccgttgctgctttgcaccttttcctgtcattgggcatcccccagtagtcaccccactccaccgaaaagtaaactgcaggtgaggccgtgccccgagtctttcttcggtgtgtttggcttttccggggcgcttgccttgccatgattctaactctctgcccttccccaaggcacgtgggccgtggcccggctgggtcggctgaagaactgcggatggaagctgcggaagaggccctgatggggcccaccatcccggacccaagtcttcttcctggcgggcctctcgtctccttcctggtttggggtgagtttcttgctttcttgagacccaggattttattagggtcagctcatgtctctcctctctgatcaacaagagtgtcaacatttaatttggggaggaggcaccctgccaaggtgaattctcttcacatcagccccaggggtctgggggccggagagctgcctggagtggagacccttgctatacccagcaagcatgtgtgggggtccaccctggctgatggcatgctgtgggccggcgacggtaggtggggagtgtccacctccactctagacccccgagagcggctcgggccaggcactcaggagccctcagtacggctttgctgaacacattgcaaaagggatccagggggcacttgccctgcccacacccggcccagggaccccttcggagaggaggaaatgggaatgcttgcctgctcctcagctaggaagacatttctttccaccagccatggtagcgtcaccccctgtgagaaccgtggtttctcacacatgaggctttgataatgtcctttaatcaaatagtggtttttgagcaagttcttctctttcctcctttcctcacccctgaaattgcaatgagacgggaatgtttttgtttgtttaaataaaacagcaatggtagagaagaagaaagcgggattggagccacacaattcactcgaggacccatcatttgtttatttgtgttttactaattcaagatgcagccgggagccgtccagggctcgggcctggggttgttctggggcgcctaaggctgggctttgcactaaggaccagagggtctacttgggtgccgtggagcacccatgcagcaaggtggcttgcacagcagccaggcgaggtgtcgtcgagggcgggggctcagggtggcatgctggacggccatgccaggctgaagtttgggctggcaggaagagaggaggctcagctgaggccactttcctttctgggggtcccagggactgagtctgtggctcactcagggcgatggggtgtttttagagccactgccctgggaggcagtgtcaggatcctggcacccctcatatatgacgcccctggggtggccattgtggtgaatgagtgcagttagacttcccagagaagctgggtgggcgctgagaaaggtctgaaccgtggggtgaggctggctccattcccccagacatttatggaggcttgagggggccctagcactgtccttggcccagatgccaatactcccctctggacgcccacgaatggggtctctgagaaggaagtggatgaacacagctgcacgctgggtggggcccagcctctagtcctcagccatgtgcacgcatcagcccttgtgcaggcctccgccctccgccaccccccacccccggagtgtctctggtttccgacgcagcctcgtaatgctctttaatcaaacagaggatttggagacagctctcctgcagccctgcacttctcccctgaaattgaaatgggatggggatattatttttaaacaaaatctggcagcgtaggcagagggggcagaggcgctctaacctggggctgttgcctttgtctgcttgtttctgctctctggagagccccagagcctggagagacggggaggggagtgtgtgcccagggctaaacccagggagggggcccaggaaggctctgccccgtgacatttactccaaggctagcatttgctgagccacctgcaaacacagtgatgtggagaagaggcccgggaggggaggtttgcacaggggcaggctgctggggtcctggggggatcctgtcccaagcttactagaatgcattcgagtaactggtctgagccagatgccctcagctcttggactggtttctcacggacatctcaggactttcccaaggtggactaagcccagggacaaagtcaaagtgaaggccaggggcacacaggagaggcccagataggaccaagctttggcagcccctggctctcaggggttgaaatggaaccctctttgcactgagttgtatttcaggtactcatgagtgtttcggtctcaggcaaacacatatttggggttttgtgtgtcattaggtataaaataggtaaaatatgccacgttctcaatgaaagaagttgaaacgtgacttactacgtcagccttgctggtgatcttctcgggaactgccgaaaggccactagtaagtgctgaaagacatgatcattttcaggaaaattctattttgatggattggccaatgcctgagccatagcgggtggagatgagaccctgactgactaggcagtgagccacagaggaccctgtcacatcagcggagggcggtgaggggtctctggccatttgtcatcgtgctgattcctagggggctgcctctagtgggactcttctgggtgggtgcaagtgtcagggtaaagacggcggtctggtctggaaactggctctcctctcgcacctgcccgccctgggtggttgggaaaggaaaccaagagggtagctcaggcctgagctcgtggaaaggaagaacatgacccctcattcgctcactcgcccccacattctctcacctgcgagttgctcattgctgctttcagggcccctgacctcatgcctcctgagttgtgattcaaaccccaaatgaatttccaagtacatttctccaaataatgtcaaaacctggcaagacttaagggcaacaggatgcatgtgtttcttattcattcatttacataaaataacttaagtgtgttttttatgagcaatctgacttccaaaaagaatgaaaaggaaaatctacccatctttaatgaacttgctaatgaatttttccttgcaaagaggaagggagcttcctacagaagggggtgtggagggagacagattcaggtcccaaagggttaaagggcagtggacaatgcggaagccagcattgtgagctgcagtggaaaagccctgggtcgctgggagtggcttctttttaggagactggaattaatgagttgtgaagtgtcccaaggactggttccccctccctgctgtttctctgagccctgtcccctcttccaaaggaggaataaggaggtctagcttcgtctcccatccccgatttgagcagatggaagagtctagaaaagaggtgtaccttttgaaacgaggcctcagatgtggggttcctggtctggaaaggggaaggatgaatctggggtaggagagggtctcgtatggagccccattcagacagggcagtcccacacctgggctgcccacaggttcttgggggagtctaaggaaaggggagccacagaacaggcttgcctccttggcatggattgggtcagtgtttcagagccaggaaaggtgggagtgtggggggccctcggggctgatgagggcgtgcagaccctcccctcccacctcctgtcccaggagccctgcagacactgcagcaggagggcactctgccagaagaggggttccagctccagccggatccagcagacatggagagaccccttatctttgccaagacgagctctgcggtgcctgagaggcccgtaggtctggaattctagggccttctgggtttgagtcaggtcctgaggccagggcctgggccctgatcctcaccatggaaaactggtcactttactcaggataaactgtgatgaggacttgggacatatctctgtctgtcctctcagctcgcgtcacccctgagcccttggcgatcgtgggcggcccgtgtacagagcaggtgctgggtcactggggccgccgtgggcctcccaacatgagggactgtgtgtgagagaggagttcattaagggagaggatggtggtgaagggtgtagccatgactttcttaactgctctccaatttctttgagcttaaaaataaatccagatggagagttcttaagtcccctatcctgggagaaaggaaggctgcccaccaccttcggcttgcctcgactctgagcagtgaatagggtctttggcaggggcttaaggaggagactcttagcctgggagctcccagggctgtttcagatggaaacaaaggctcaggccgagaggaatgtgggggagccccccgtggggaacagccacctggggataattgggagggctgagcgcagatgagttttcccaggttctgtgaatgcgccctttcaatggaaggtgcctttttttccagatgaaaagaagaaaacgtcaattaccttcccctgaaacggagtgtgtgtgtgttccctcccaggggttgtgtggggccccttgcccttgtgtgtgtgtcgggagctccaaggctgcacaatgacgcacttaaccagccactgggttcgcgcgaccctgggatgctcacgctcttagattctagggcttgattttgaaagtttcttagcaaaggggaatcagagtgattgagcctgtaaacaaaaatttgatcaacctgggcctgatgcctgaaatatagccaaagagacagaatggggctgcggggagagaggtccaggatggaaagttggggaaggaggacagtcgggggccaaaggctgaccgcatgtctgcgccggcctccgcgctcacagctgggctgctccttctgccaccccagccctttctctgggccttcctggcagtggacatagagtgattccctactcaggaagttggcggtagggggctcagaaatccacagggctgttgtttcacagttagccaggagaggagggggtcatggtggcccgcagggatggtgggcagctgcgagagaggggacgcttcaggttagagcgaagctgtttgcaccaccactgccccagactgccgtaagggtagggccactccagaggcaccagggacaaagtccctgccgtgacaggaggggggcacaggtctcagtcttggctggtcactgactttgctgctgctggcttctgagcctcagagaggtcagcagtcttccagagacctggttagagcctgtgctcagccctgactatgggtgtgaccttggcccctgtctccagccccttaggcctcagttttcccgtctacgaaatgggcgagtgcaggcccatggtcgtccgagtggctcggggtttcttcaggcctccctggaggtcatctgtcgtttgtttgctgggtctttggagttgttgggactttgggggtcactggtccgctgccccctctgctttagaggtggggaaaccagcgatcccagaggcccggagccttgcccgaggttgcacggtgagccggcagcaggccctggaggtgaagcccctgccagttgccagctcctgtgtgacctgtgtggtcggggggggtcacagtcaccggtcattagtgtgggtcagagctcttgcccaaagaaggttccaaggggctgccccatgagctgggatgcagggatcgtgttttatggggcattattccaaacaggcaggctgctggtctggtctggaacacctttttggtctgtagagtgactcttgtttaatgagactggacttgtggcttcagaaccaggagatgttcgttcccccaacccccgtggctcaccttgtgccttttgggtcctgagaccctcgccagcgcctctgttggcacggtggcccagtcggctgagaacttcctgaaaaagccaacaggatgacaacttctggaaaagtgatcatcacccgcctgcactggctgcccatcttagactcagctttgccaacattcccagctatctctgtgtgctgcagtgtgtagtaatgaacagctcacaaaacctccggctgggcctgcacctggttattaccgtggtgggctgcagcttttgttttgtgaccttggttgctacaatacctgcgagctgaaatgaggaatcgaaaaattgccagcttcaattagacgggcagactgctttcccaaggctgcctccgccactccatccattaacggtaaacaggcaccaaataggccctaattctctctaattgcccactcctgaagcaaagaggtgaaattccaggaagaggcgtatgtaaacatcctctgtaacctgaccaagtaaaattagagggctgatgggggcctgcgagagagaggggacatgatttcaaaagatgtcccaattacctctcctattttcataaatgggtctgtaatgtccagggccccggcctcacaaaggtacaggaaattagctctgcaaagagcttgcatttgtcaggggaagttgtaagggggtggtgtttactcaacaggtaggaagtacgagatctgaggcaagactgattatttgtgtaacgacgggctctatttcttgagatcaacattttaataaaagtcatccttttaggtccttttgtgtttgaaacagccataagttgtttataccaaagacatgccagatcagttaggtgctgtttgcctccagaaaagaggaacttttaaaatcctaagatgcagagctagagttttctaatcccattaagctgtggaagatgtttttggagtgttcaccaatgctttctgcgtgggtcatgagctcactgcacgcacttatgaggtcttccatcaaatgcttgtgacaattactcctctggactctataaggaggcctcgtgtttttctttggttccagacagtgactcatctctgcagcttttctgacatttgttaagattctagcccagcactgcgttattaacacatcacagcaagcccagagctggcacacgcagcttttaaaccaaggcacgaatttgctggggcttctctgtagcagagcagcctgcggtctgcacacaagagttaattaaggacggtcagggactctgaggtttcatggggtccctggagcagaagcaggaaaaaacccagatgctccttcctgcttctgatttctccgctcctattaaaaacacaaaaaagaacaaaacaaaaacagccaaacaaagcacccgcctctgattcctgcgggaaatggcagtgcctttggtcgcgctgtgtgttcttggcctgagtctcgttgccaccttaggacgtggcgatggtgagaggccaccccagccacgcacagtctcggagggagggtgggaaacggtctcgagtggtggtcagtagataatgggtggtctggcagcctttaggtaaccgaagtcggcccctcagtcacccatgcactgatcattgcttcactaacacttattttaagacttgttgtttcttggttatcaaattaaccagttatggcagaacagggtttatgaagggcaaggccagggaaggagattttaggaagatttggaggcaagaagtgtccccagtgccctggccgggtcttggacatcctggctggagacatgactaggaatagagaggcagaggcagcaggggtggcccagatggcaggggtgggttggagagatccctgagaggcctgaggacaggcggcagtcttgggagcccctgaagacctgcagtggggcaggcagctggagtcaggtgtctcccgggacctgttttttttttttttttttttttttgagacagagtcttgttctgttgtccaggctggagggtagtggcgcaatcttggctcactgtaatctctgcctcccacgttcaagcgattctcctgtctcagcctcccgagtagctgagaccataggcacataccaccacgctgagctagtttttagtagagacggggtttcatcatgttggtcaggctggtctcgaactcctgacctcaggcgatccacctgcctcagcctcccaaagcgctgggatgacaggcatgagccacccccctggggctggtacctgtggtctgtggcttctgcctgccctggtgcccccacatctctctcatggcctttctgtttcctgggtggctttgtgggggtgtcccatggtctccccctggcttcctgtctccacctgtgcctaatccaggaaacggtccccagagatggtgttttcaaacagaccttggccctgtcctcctggcccagcccctggctgccctatcacctagcttgctgcgttggtgggacctcagctgtcacaggctacctttctatgacgcctcctcaccttaagtagactctgaacagattttaaaagccattcattcaacacattttttaaatgaataaactttttttctgtgtagttttcagtttacagaaacattggtgggaaagtacagagaattcccagatcccgtccccaccatctcccctgtcattcacacgttgcctccgtgtggtgtggtctgtttgttccgatcgatggaacgactctgatacatgattaactagaggccttggttcacatcattagggctcactctttgtggcgcacatcctgtgggtcttgacaaatgtgtcatgatacgtgtctgacattgctgaagtcaccttttcttaaagcttaacattttgggagtattctgaactatgtttggcccagcctgctgcccgatttttataaaaaagaaaaaacaaaacaaaacaaaaaaacaagttaaaacgtaaggcagatcttgacactgaagactcgatgtgcctggccatggtgcttcccggggcctactgcactgtgaacaaaattgccacagtggagttgtctgtccaggcacacaacgtgtgtgccatggttttgggaaacgctgcccattaatagccctgcagccctctgtgggctgccctcccggccacaccccgcttccctggtctcctccagggccagccatcctgctcgccgacctgggcaccttgcttctgccagagcacaggttcatgccctgtcttcagggcctgggccacccccgtttctcatctatgcagggtcctaagcctttgggtcccacagagcacgacttcgctccgtgaacagcaccaacccaagtctgttccatgtctccacacctgccccttccgctccataggcagctggtgggtgagtggagtcaggagagaaatgcgtggcttctccaattccacacttgctggaggttggggagtctctgctccaggccacccctgcccgccccccagagctgttgtcctcatccgccctcctcctcctcgccggcctgagtgaggttctactctgtgacctagtgccttcttgttacagcggaagccatcacctggatgcctacgtgggaagggacctcgaatgtgggaccccagcccctctccagctcgaaatcgtaagtggctggagtgtaaagaacacacatgtggccttgctgctgagggtggggccagctgcccggagcacaccgccaggcggacctcgtggaggggctggcgggcactggccgggggtctgtgcaccgggaggtgggtgcccatcgagtcaagccaagtgcagacctgggggctcctgttttctaagacaggagccccctgcctccttgtgttgtctctgtggcaaaagaattctataggcgggcttcaaatgtcggaccccaaaagaatttcttctttttcactcttctaaatgaatggctctttcattattgagtctccctttggctcttgtgccgcagggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaaaccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggccaaaaagtctacattgcgtgtgtggatggatgaatgagcagtgggagtgcagcgccaggtgacaagatgttgtgaggggttttgagtcatccagtcctgggcactgaggtctgttagatgaaaggatatgagaaaggtaatattggtaaataaagaaataggaaacaatgtaacaaatgttaagtacagaaatacattaatgggtggtaaataaagatgtaaaagaaggcaatgcgatcgatggtggcaaaagatcatcacagattaagggctatggctggtccacttctagaaaaccacaggctgtccattaaataatgaacatctaagtgaacaagtcagtgagtacctaaatagacaaggatgaggtgaatgagaagacatggccccatgggtcctcctgatgagggtgttggggtcccccctgggcaccccagctgcatgaaaatgaaggacaggaggtatggaaagctatgacagaagagagaaaggaacggtaaaaagaaataacaaccaaatggataaatgggtagatccacgagaagagttaggctaggacttgtcataagggcacctgactccactaatagaggaataaatgcctaataaaaagagagcaagcaggaaggaaggatgctatgaatgcaggaaggaagtaatgagtgagacgtggaaccgcacggccaaggatggacgtttgcgggtggctttttgatgcgtacagccaagccactccatggcaatgagctccgaagacaaagtgcaagagagaatgagtgagagagtgagagagagagaaacaataaaaaatgggaagaaatgtaaaaaggaagaaaggaagagaggtaatatattaaggaataaatacatgcatgcagatttaagacagagccatgctagaacaggaatgaaaggctgtgtgaaccaagcagaccgcttaattggcaccagtgctgctggtatggtcaatcacctactcaactaaggaacggctcaaagcatacacatgggagggaggagtggggccacagagagagggcccattagttgcagattacgatgtatccagttaggtgcacctgccttcgagaagtgtaaaaataagtatttacatagaaagaaagactgaatggatgcacggtgaatgcatgaatgattgaacgacagaaaagatttgcattgaccgatgaggagggcattgtagacagggatgagggtcattgatcctgggtgcagatctccaaaagaatgacagaaagaaagagggagtggtggaaagaaacaataggatgggaaaaaatgaaaatagaaaaaaggaagtgaaagagataataaataattagatcaaataagttgatgaaaggggactggtttagcacaagccatccacattaattcaaacctgtggctctgaagtttgttttttaaatgaccacaagtgtaagactgaatgaaagaataaatgcgtgcattccataggatgcaagaaaaggagtgaggaatgggaaaattggaagaacgagagagggagagatgtaagaaaagaaaggaaaagtgaagtaggcatatgaaagaaaaggcacttcttggacaagcactgaaatataatgagacagttttacccattaaatataataaacagtaaacgttgaggttcatcaataaaagcacagatacctgaatagaggagtgacctgaatagaattcgttcagccgaacgaatgagaatggatgattttcactatcctgtgcactcaaggcccaaaagagaaagcaagagaggagagaatatggaaacgtatgacaggatgtatataagcaatacaaacatattgaatgaataaataaagacataaatatgtgggagagtggaccacgcaaggacaaaaagaggagagaaggcagcaagaattatgactaattcaaaactgggttcctgagatagttaaataaatcctgcaccaaatccccagggggagaaattaacaaacaaaagacagccccacacggaccagtgtgcagaaggctccaggaaccgcagattatggttaatccaattctgtgcacctgaggtccataaataaaagaataagtattgaaatgaaagaatgacagaaagaatgaatggacacatgaacgactgaattagaaatggaaatgcctggcacagccaggaaggagctgcccatgggattgtcattcatctcactctgggcacctgaggtccataagcgtgaaaagaggcaggaagagaagtgtcagggagtcaaagatagagctaaggaaaggcaaaaatgaaactaaatgaaagcgaaagggaaaataaagaaaaaccaataaaaaagagaacgaatacgtgggtgtatctgtaagagtaggatctgttaggattagtcataagactgtcagtaatcctgaagatggatgagataatccaggcccaggttcccagggggagggaaaatggagaaaatataaaaagatgtgaaaaaggaaaaaggaaaggtaataaacaaacaaccaaagtgataaatggatagttaagggaggttgtctgaacagggattataattagtttacatacatactccttaaacagataaatacattacacctttcaaagaataaatgaaaaatagagagacatacctggctccaaaacaaggctgtatcttctgccactgtaataaaatagatgcaattgaggttcataaataaaagaataaatacttaaacgtgaaaggtgactaaatgcggggaagaaagattgcaaataaatacatgggccaaagatgtttggtttgcccatggagttttaattaaaaaaattaataaggaaaacaaatacccaaaataaggaagactgacaaatgagtgagtggatgagagagtgaatggtgcttgacgtaggagcagtagtgctttagggaccagcatgaaggtggtgaccgggagccctgattcatgggattctgtccacctgactttataagaaccaagaatggctgggaatggtggctcacgcctgtaatcccagcactttgggaggccgaggtgggcggatcatgaggtcaggagtttgagaccagccagtttgagatcagcctggccaacatggtgaaattccatctctactaaaaaaatacaaaaattatgggcgtggtggcacctgtctgtaatcctagctactcgggaggctgagagaggagaattgcttgaacccgggaggtggaggttgtagtgagccaagattgcaccactgcactccagcctgggctacagagcaagacactatcttagatcaaaaaagaaaaaaaaaaaaagaaggagaaagaaccagagaaacataaggaagagtgagaggaagaaagaaagatgcaatttgggaagaaatgaaaaagaaatgaataaagaataaaataatgtaacggtcaataaataggacttgtgaatggaggcctttaggccaaaggctatgattaatttcaagctatgttactgaagtccataaacaaaggactcagatctaaatggatgaacgaatgactggaagaaagggtggtaggaaggtaggaagaaaggaaggagggaaaaagggaagagaggaaggaaccttctttccagtcctgtgttctagacagtggaatgaagtggtccccagggagggtggctgtaggcatgtcatgtgcttgtcacatgcacttgccctggcagggaggagctggctcaggaagaccctggtcttggggtgctgttgccctatcttggctgtgtgggccatttcactgcatctgtctcttcctcagtttccccatctgtaaacctggagtggcaccagctgcctactagagttgatcttatgtgtctctgttgatggtaccccatctatggcctggataggcaggaagggcttggaccctgagccccgcagaaggttgcatgaacgagtggtgtgaagcctgttgggtagcttggccactcccgcggcatgggtcacctgcacaggaggttttgcccaccagggggcagcagagggtcagggagcaataggccctgggtggagcatgggccccgcctgctgtgtgccaccctgggtgtggcacctactcacatccaggggttggtgcagggaaaggccagaaggtggccaggcgcacctgagaagggggacccagaagccccgggacccaggagccctgggcaagccaccagaaaccttgttcttgcaactctctgcagtgtgcccaggccaccctctggcctggtcttccatggggcagggcgcccacccttctcaactcaggtttccctgggcagcaggtgcacctcagcacccctggggttgcagaagtggtccggggaccctggcttccttgacatgccatccccagagcctggttcaaggcctctctgtcttctcggctgtttcacgacgtgttttgtaacttggcgggattgcgtttcgctgtgtcgaggttgtctcttctctgactcgccctccgggggactgccggggtaaatctggagagttgctcgtgctgacagtcctcccccagggcctccccggttctgttgagtctcctttctctgtagtggaggaaatgtgtgtagttttgtgttgtgtgcctgtgtttgtctgtaaaagcaaggaccaaagtctcccttgttgacctctcaattcctatttgggacatataaaaacactggattcttaacaagcgcccggagcagtaggagcacagcttggatggactcaggacttgtggcagggagcacgtgggaggcaggggagtggggtggggccaggccatctggagtgggaggcgtcatgctcagagtgactctgtagacgctgggtgggatggggagtgcgggcgcaggcatggatggggctgttagctagtgtgatgcttgaggtctgagctgatggcagcaaagtggggtgctcaggaatcaaagctatggggttatagacaggatatgaaggagggagggaggcaagaagaagggggtggttcccacgcttctagctccggccgagtggatggcaacagcatttggaaggcggaggacatggaattcatgtgtcaggagccaccttccgagcctccagtaccacgtgtcagggccacatgagctgggcctcgtgggcctgatgtggtgctggggcctcaggggtctgctcttcttctctttcagaatctggggctccaggctatgccttggctggactgaggtctgggggtgcacttattatccctggggacacctgctgaagcttctccctgacaagctgtgtcactgttggatgaggatggggcgggaggggttcagggcagaagaagaccgggagggtctttcaaaagaactcatgtacggctgttaaaaaaagtcagcagaggctcaggaagacttaaagtgtgcagaaggcggggaagggagggcccattgcatgcaccaagaggaaattggaaggaacaagcgacgttggctgctaggagagcctgctcccaacatctaggggctgtcctgacgggtcacagtgggtcgaactgagccaatgagagcagctctggggagacccactggtgccctggaggctgggtgggtttgggttggatgaattctgtgtgtccttttggaaatgtggaggccatgaggggggatcagggctcttagggttttgacccttaagagttttgtatctgtaattcaaaggttctttagttctgggatgctgagattcgggatagggttcctaatggcacaaaagccagagataaaacatccttcacgtgctccctacccggttctttctgtaccagacccacaaggtccgagttgggatcctagtgctcctgtctggtcagggcctatctttatgtgttcgttaaacttttaacaatgagaattaattctgtctcttgacattgtcatttgcatgctccccacacacaaatcctttcctggtgacaccaggagctacaactctccttggcctcctcttgtgactcccaactccctccttgggaagcttggcctcaggacctctgggatagacaggccacgaatcctgctgtgtcccgttgtgttcctaatataaatggtgtggatggcacttgacctagagcagtgggaaatgcatgcaccactcaacattctgacatgtcacccattttacattcttacaggcatactttttttaaaaaaagagtgtctattctttaatgagcatcccttctttaaaaaaacctaattgccattattcaccacatacacttttttttttttgtatcctgcctcttctatttaattttctgtcatcaacattttcccttgttccatgaatcttcataacctcacttgctgcgttgtgccttgttgagtggctatggcatcattcacagaaccattctgttattcttatgtataaccaccttttaaaaatattatgaataatgccacaactaactgcttaaaacaccctttttttcattcttaagaattatgttcttccacccagaaattatcattgcttcactacagatcagtttcccctgctagactgtgagccccataagggcaaggagcttattgaattggcctttgtatctctgatgcccaacatgttgtagactataaataaatgatgaatgagtggatggaagaatggaggaaggagcgagtgagtgagtgtttggctgatggataagagggtggaaggataggcggaaggatggattggtgaatgaatgaatgaatttcctttggttaagtctcttgaaagaaaggctatggatctttgtatggatgttgaataatttcagtaagcttacagcattttacaatgttcagcaatgtatgaccacttaattaagatatggctagtttgtctctgttataaagtacttttgcattactttaacttgcattgctttaattactaatgatgggtgaacactttgacctatgtttgttaacaaattgtattttatcttctgtgaactgtttgtccaagtcctttgggtcatggctttctgaagagactggtcccagatgtccttgggatgtagggagcccatagctcactggaggcattcaaggaaccagccaggcagccctcagagaaagtagtgtttaggagattctcatggtgtggggttggcctaggtggcctttcaggtctgtttgatgttaggatttgcttctccctgggaagtgggtgatggggaaaaagacaccttccattggcaggtgtagacactgcaggctggacctcctgggtgtgcttgtggactccgatcttgcccttgataaaacccctgtgggacaggaatagctctttgaacctccaaggtccagacagccacatcctagcaccctgtacaatcagttagtggccttcccaccagcgcagtcactcattcctattagatcccgatgaagccaggccctggggtttccattttcccacctcttaggggaattgggttccccgcgtcctgtgatatgtcagcaaatgtcctcagccctggcctgcacatgtggcctcagtggtggtctttggggtttaactgacgaatggaacattttggatcaggactgatgggagaatctcctttcatttttcttcacctggggcaattacattctaaggagcggaataaagggcatgttctgcccaaagcatcagggctcacaggtcagtcacagccatttagggagggcatgtcacccaaggagggctcgcccttctttccagagcatcctccgctctcagcagagctgcttctgcccacccatccctctactatagcactgagcactgtttgcccgtgtcagaatccctcacccacatgtttagcttggtatccgagtttgggaggccggcaatgactttcaacatgaattgctccatctacccatccatgcatttggcctacttatcttgaccccgtgcttttggccttttcttctcctgaaagcaaaccctttcattttgggtgggctgtgtagcgccatgggctgtggttatgaagcaaacaccctttcttgtagctgcctcctccggggttactgccctgagcacgtcccagctggatctcgtctgccactgtcacccatagcttcttccccatggtgctttccatgtgtcacacaccacgactgtgacccagggtcggggtcaagagtagcctggggccaagccctcccacccatgagcggagaagtcctccccaggcctcaccttgcctggcgcatggtccctcccatgagctttgctttcagcctttcagcttcctccacagggtggcagtggttgtaactcatccattcatcccttcatcccttcattcattcactcacagccaacagacgtttttaaaaaattagccagtgctatactagagctggctcccaaggacccgctgccgcattgccttttgaaacaaaacaatgaacacgttggtaaaggggccgtgcttgtgtgtcggtgacaaggcgagatccctgagtcaggtcaggcttgtagattcgagttctgttgcgagtttgattgcccctctgactttgtcccctgtacaactaggttgattaggaatcagccaactgtgttccctgggtgctcagaaatcacagcccatatcctcgagaggccaaaatgagagccagggggttccaagatgagtggctgcttctggccgggagcaggttttcaagtcattagaacactctggcctttcctggaggtgatcttggagccattcctgcccctttcaagaggagttaatgcccagctctgtttagagaaaattgggggagatgattgctcatgtgggtgataagaatcacctcccgtgcaggggtctgcatagaacactccataggcaaacctgggtgtccaaggcacgtggcattttgcaaactctgggtgcagctccgagctgtcctgcaggtcccagaccaggtgagaactccctgagttcctgctgcctgggtcgggggtgaggcataggtcttgggggttcaacctggaattctgaatgtcattcattgcattggagaggaaggagagtaggcaaagccaagaccctggaactggacaaactcgtgtggtttaaagtcactgtgagagctggagttgagtctgcctacgggggaggactgcggcacctacctcgcagggctgttgtgaggagcaatgtaaccgtgattttgaactgtgattctggaagggcggtgtgcgtgtccccgggggtgtgccaggggagtgaggagaaaaggccagggagacagcctcactcaggcagctgagtgggagagcatttatctctaaacctggaggggtatatggtgggacaggaggaatttgggcaggaactttcatgctaggggtttgggggactcgctggacaatgcccctggaccccccgggggtacgcgttcacgctcacctctgagaggctggaaacgcctggctgtgctttctgaatgctgtgtgcttcctgcctctgtgcctggcctgtgtgcagcacctacttgtgtccgccttcaaaaggcccttctgggtggcgtccttttccccaaaatattaggcaccagccatcaaagatactgcattgttgcctcccccacccctccccccaactgacaacatttgggctcaaatgcagcaggctgggtgcccaacacagtgcctggcgagtggtagcgcttacgtttcttttctgttgaatggatggatagctaatgaaattgtaaccaatgacaagccttgatgtttataacctttactaagagattattattttgctcttcatggacctgttaacaaccaccatattgtatcttacggacgtttgtatgccacgtttgaagagcaggagccttgtttcggcgtcatgttgatggaacttgagctgtctgatgcgaatctgtgttttatgttagaaagcgcgtagccttaggatctggcagacccaggggccacttaattaaccctttgcctctttgaccctcaatctccttttctctaagccataggtcacctgaaagcctacctcacagggctgttgtgagggccgagggtgggtgtgtttcaacagtgtgcagatgctggctttccctgggaatgggcatatgttgggatttgtcttgaaagcatgagtgatggctttactagtcctaagtgaataaaaagtcagccctgaccttacgctgggattgcatttcccacagtcagtggcatgtgcagaccactggcagagcagcctgcaggtgcttagcgatgtgggcccagagtaaatatttgtttgattgatgagtgatggctttttccttcctcagagtttgccctgccccccattccaacgtgggctgctgcttctccccagcgggttgtagctggcagggccgttgtgctttggggtttgctgtacctgtcgctgccgtgaggggacgatctgtctgcccggaggggtttctgcaaacattcatgtatgcccctgctttcgtttgttagggagaaggagtggggtgacctagagagaggatgaggaaggggttctgggtggcatccttggggtaccaaccctgcttccatcctgcgctctgaatttcctcacagcccttttctgtctctggtagaaggtgcagaaggtaggctttgccaccttccctgggcctggcaccaagctcgggggtcttgtacacactttcccttctctaactggggtgtgggcccatttcctagatgagcttgctgagaatcaggacagctggtatcagagccaggacttcccagtcttgcacaaacaacctgtgcatttttgagtccaccaaataaggcctcctgcctggtccggctcacccctgccagcccccagcaaatgcagcctggtgcgtccccacccctgccaagagcccaggagtgctctggcagagaagtgcagggatgaggaaggaggctgtgccctccaggggactcagctgcgttagaggaggtgctgctgcagtggcaggggtctccagacatcccacgcaggggtcctttcagatcaggcatctcttcaccagaccaccgtattcctttttcagccctcgtctcttgcacgtgggggtgcagtgtttggctctcacatccccacattccagctggtgggggtttgagctgggtgttccttctgctccccactccccactcacggcccccaccccacgcaagcctcccttgcccccactctttgtctccagctttcacagccttggcgggcaggctgctgcgcctgttgctgccccggctctcttccacccgcctcttctttctcagcctgagctttaccgtgaggtctgggcgccacaccttggcccctgccatgcctgctcccagaagcacccacgtgggtcccctgattctctcctcccctgggctttgctaaggagccctttcattgtggcctttggtgtctgcctcatgcccatcccctgttcttgagaacttggaagcagagggggcccctcctattgctcccaagaggctccacagtagggagcccctcccaggagattctgagtctgtgtttaggtgtcgattcctgggtgggccttggggtcccctcaggccaggcctgtgtgtgacctaaggctggggggctctgtcaggcacctagtgtcccttggaggtgggcggggctgggtcctggtctcctgaggacgggtggggagacaggctcagggagatttccacgaagctgcccttgaacccctcctctgaggcccacactgccctggccctttacaccctgcctcctgcactagtaggcacataatagatgctcgccacctgtggagggcagggtttaaatggctggaaagagctgagtgggctgtttggctagcgtacgcgcatttgtttaaaaggaaagggtgtgtttcttggcaaagactcttcggaggaaacgctgaactggggatgggtctctacctgttctggggcctcactgcccttcctgccggggacaggcagtcactggtgggtttccccccagtggaaacacaatattttggaaatatttgtatctaggataaaacttcatctggaccaacatgtctttgttggtgttgtggcccaggtgattttgagaatgtagaatacatttggcaatttccaaacggagtgatgacctgctcctccgccccccatgccctccctgaggctggaggcttcagaagcccctgccttgggaggaggctgttctacctgagaagtctttgtccccaccgttggtgacaatcagcattgacctgtgaggcacctgccaggttcgggacgcagctttagacatccagaaaaccgggggtggaggggtggggtgggggcttaagaccccagagcttgattccttttaactgtctcatccccaaagaatggtacatgggtaccaggtaggttacttgaatcaccctgagcctcgattttcccacccgttagaaacagggtaattcatgacagtgtccgcttgggagacggctgtgacccctgagaattctcgctgcatgccgtgggctggctcgtgagactcaaggtctgggttcgaggcccccgcaaccccttctgactgtgtggcctgggcgagtttgttgtttgtaacctggaaagcgtcacacctgcctggcacggttattgtgggcttcaatgagattgtttgtgtgaaataaacgctttgtgactggcacacaggcgctctcatcccggctctcctggtgggcccggaccgctgggtgctggctgcggaggccctgtgctccctggaactgtctgcgctggtcccagggactcttgggcagagtggagggcaagggggaaagcaccagcctgctctggggagacagtggcagagggaagtgtttgcttttaaatacactcagcaggttcagacaggagaggatccgaggggaaatgtttagagccctcaggaggaggaagagaccgagttttaggaaaaacatcaaagctggataggttgggcagaagagctggggatagcatttagagaggctgagagtcctgggttctgggttatcaaggtgagagaaaccagaggttgccagttgtaggtgggcgtcaggactagagtgatgcttccagaagtttctgcaagtgggccgagtctaaggtagggcagggtacgccagaagttgaggggcactaggtagacaggccgagctggtggctgggtgctcccctcaccctccatgctgctaggagcccgtgagcagggacttgctctcctctccctccctcctggggcctgcctgtctgtctgtgaactcttgtcggccagcgaggccgggagcaggtggccttcatctgcaactgtgtctctctcagcctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaa

SEQ ID NO: 350 - DNA, 2139 bp, Homo sapiens
aacccaaattttttcatcatcaactaattcatctcagaaaacagtaaagtttaaaaaaaaatactatcagtaagaataatatatttccttggtttggaaatttccaaaccacgatattctgccctgtcaaaatatattcactggggaattttttacttcatacgtttcttttgaacttagtcacatttttatatctagctggtttcattattaaataaaagaaaaggtgattcccctcttgtactgcaggagaccacatacttgaatgatactctaacttctaggttctgttatagtaacactgaaatcagaaacctgtgggagaaatgtcactttatctgagagagtaaaatcagactctaaaaggaagtagcaaattcatcttgttcttttttttaatcaaccctctgcctaagacaagtagtttgaaacacagaggactctttaagtcatacttcctttatgtagtcaaaaccaaagccactgggtagtgctttccccaaaggaatctctaaatagtagacggggacattttcagatagattcgtttgtaggcaaacctccattgcttgtatcacatttcctgaaagaataaaggtaaaacttcaactatgtattacagaaagaaaaattcagcctgaaccctacccttataaaacaggttaattgggttttaattttcataaatcataaaggactattttgaacatttgggcctttaattgtctagctcctagatgaagtacaaatcagaaaaaaaaaaaactgtactgtgtcagaatgcaagctttcctctttgcattttggcatttgaaaactccgaagagcggtttttgttttttatttaaagaagatgatacatatgtgtacccgattcaaaactagagaatagaatttaaaacataattttcaaagtcttcaaatatgcctaaaggtaacaatgtcatcttttaattgccaatttctctaccactttcaaaaaattacttccaaggatttaatgagctccttcctttcaacagaaaatggactattttcctttcagatttactatatgctgtcactccagctttataaccgcatgtgcatacacaaacatttctttctctcttgcaggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttcccccaggtaacgattttctgttcaggcaacttcagtttaaaattaatacttttatttgactcttaaagggaaactgaaaggctatgaagctgaatttttttaatgaaatatttttaacagttagcagggtaaataacatctgacagctaatgagatattttttccatacaagataaaaagatttaatcaaaaaatttcatatttgaaatgaagtcccaaatctaggttcaagttcaatagcttagccacataatacggttgtgcgagcagagaatctacctttccacttctaagcctgtttcttcctccatatggggataatactttacaaggttgttgtgaggcttagatgagatagagaattattccataagataatcaagtgctacattaatgttat

SEQ ID NO: 351 - DNA, 17437 bp, Homo sapiens
ttctgcctcggagggcttcctgagccagtgctgcttccaaggtaggtttctggatggctgaccccatggcaagcattttcctgaggatgcatgtaactgacctactaactttagagtccaagctgaccctaaaacaacttcctggggcactaccaactttaggaaaatcgagagaggttgttgggatgccctaattttttaaaagttaagattgaaatacacatggctgacttctttttttattcctatcaaattcaaccttggagttgaatcttgggcatctagaagcatcttttattagtcagccgtcgggatacagaagaaaacaggaacaggactctgtgcgacccctggtttactaacccacagcagccttacaccctccagagaattcctgtaagggaatcccaggtttaccaaggaggcagtgcttagcctgcttttgcacacacatttgtgtgtggtttgcttcatatttaatgactcctgtgccactgacatccttgcattattaaatgttgcctgcatggccagctgagcacaagaagtggtatttctgtgcacactaatcctggcttggtgaacctggggttggccggagagcatgggtttgagccacctggtccactcatcctcagggtcccatccaccctcagaggccactcccaagctgcccaggctgtgcagaagatgcaggaatgctgcgagcagtgccacctcatggtactcggagggaggttgtccgtggtgagttcgcattatttaatgatgcccaatacacggtcgacctcttttcggtatcagatctcaccaggtgtcttcttggacctgatgccgatttaggggacaccatactcatgttggttccacaccagtgcaactgaacatgtgtgtggccctggaaccaatgggtaggtgctgctagcactcctaatcctcagccagtgcattcctggggaagaagcatgtgatctgtgctcaagacccctctgtgactgaggaagtggtggtgcccatgatgcttctggggttttgtgtttttttttaaagaaaaacaatgtatagttctcttctctttcactattaaatcttaccatggaggaaggacttcttagacatgttgacaaattcagggaaggggcgttgatttcagcattcttggggactcactggaagggtgactcaccacatctgttgatctggaggccacagcaaatttaagaacagaagacagttgcattttcaatttcttgtttttcttttcaaaaaggataattattctaccttattaccatatttatgaaaatgacacatgcttaataaaattcaagcgatgtggaaaaatctaaatgaaaaagaaggaaaattgcccaattctctggcacccagaaataaccattaagggctttagaaatttcatacacctgtctgagcatacatgcaaatagaaaaacaagacagacgcagggaaaatatgagatcacactgtacctaatcattttattaaaaatgctaactataattttccttgaatttatcataaaaaacaagctaaaggagattgaaatgattgataaatgtttctcgctttaccaccacaggtagcaactcctaaaagatccctgtaaaattaagaaaaattagagtgtaaaaattaagtggttaggattgttatggtttttaactatttcaatttcactcctagttcagaaagataaagaagtcagcattcttattcttcctttgcttactatctcctgctttttctcaattatacattttaattttacattataaatatctgcaatttgttctagaactataattcttgcaggtgttttgccatagttctatatttaaatgaattcatttctgaccacaaggtttgtttttttttaactgaggtttctccgttctttagtttttaagtttaatttatctctcaatggaaatgatcttattgtttctgtgagaatagctcatagacactacccttgagttcctgtgcatttgagagtatatatctctttatgcacaagggacagcttaactaggtataaaagtctcagcctacttgttttttctcagaaatttatagctattgtccactgttttttgcattgaggctttcactagctgtcttaatgtggcttctccatgtagctcttacttacctggactattttatctagcgatcttcacaaaccttgttggaaagactttgaggtactatgttctgtgaggtatttcgtctctgagaatgtctgaccattgctcttacaccttttcccatctgtccatttttttttcattctgttctatttggcctttatgatttcaagtttttaaaatttctttagtcactttaaagatatttattgtataatttctttcagctttagggatacaagcccctttctttgttgaatctattgactctcatgatggtgcttttcttcatggtttttgtagctttgtgttgtgaggttatcatcagttgagcacttaggtgtttctgttttgtttcaatccctatgcacatgagtttgcatttggttctgcctggtaccccaaggaatttaccagttggtaccagtttttcaactcattttgttggcttaaggattcccagacatatggctggcagaagtcctcaccatatctttgtcctgaacctttggtatctcacaggagacctcattctatccactccctaaaaatgacaaattctcttatccctggccattataaaattttctggttcccctttccattcccagatcaacttctcctggatgcacggtcatgtcttttcatcctgcttgtacttgaacttgactgtagacccttggagcctctagccagcacagcatcccttagatcccttagtggcaggttgcatgaactaattcttttcattaacacctgagggttttgcctttcagctgtatgtttatttgggaattgattttgcctgctgttgcattttatccaacacttctcaatgtttgtggaggagagggttccctatcagtgcttgttgctgggatggagcctttgagctgaatgatgggtgaacttggcatgacattcttggctcccagtttcttccctctgaactttgtaaacttgcctccattgctttctggtgttaaaccattgctgtggacaagcctggggacagctgctttcccttggatggatgaactttttttttttcctgcttagatttcctgattctttctttagtcttgaacgttggtgactttaccgggttatgactcagtcactatttttattcattagtttttctgaatcataatatgccttcttgatgagtagatttaatcgttcctttgtttcaaggatttattcattttatgagcacttttctactccaggtgttggttttttctttggtgaaataatctgttttgttcatttcattgtgtactggaggagaagaaagtctgtcatctggccccttgctgccatctgtctgcacgtcagtctgttgtcatttgcactgtgcatttgtctatttaaaacaatcctacccagatgccccctcctcagtgtcaccttccaccctggcaggatgccttatggcaatgccacttctgagatggtcgtgggagtcagcaccactggccaggtatgtgaattttctgctaacaatggaagagtttgaaaaaccatatatgaagtaccattaaccccaagcatgcaatctatccttaggaagacttcctggaaattatgctcacctttggggatgaggccatgattctgaggtcagtgccatgccatggtctaataaagtttgcattcaatgctgtttgtttctgtatgatcaatattgtaaagtcagtctctttgtcatggactcagctttggagggttcctggacacaaggcctgtgtaaggaaaggatcattactgtcagcctcgatgctaatgtgagatgagggaatgtgccctgctctgatccaaatgctgagtttctgtgcacttggcctctccaccatcaggttccctggcagtgctcctttagacatgcacccaccttggcaaaggcattgaggtctggatggctgcagggtccgggatggaatggttgaatacagggcgtgtgctttcttctcaaccctcttgcagtccgtctgctaaccgtcaatgttcactgtctcctagggggacttcctggaggaggccaactttggagaacaggcattgacattgggtctgcgctagcgtgtggtacttgaagataggttatccgtgttgccttcgctttatttgtgacgaatcatacacggttgacctatttttcagtaccaaatcccgccttggagggcttcctggagcggagtcttacttcagggtgtcagctcctctccagggtaaggaaggggaccattgaccatagccgacccagcagtgtgccctggccctaaccctgtgtgtgccccgtccttggggaggtttctagagatggtgccacctttggggaagaagtggagcttttcctatcagagctactctgtggtactggtggagaggtcttccatgatgcattcgatttattttttgaccaatcctacatagtggactcttttgaaagcattaaatctagccttaaagcaccctcgggtggtgccgagtttaggaactagaactggtgtctgaatgcctgaacgcacggcgaagctgacagtgtgcacactcttcttggtgggtcgtgcacctgcaggcgtcctgcttgcttaccatggcagtttcctcgaaagaggcggcagttccctcatcggctcactgcatgtttgacaagacaccgtcttgctgtcttccctgctgccctctcttcatgtatcacagatggtgctctgcagacctctctgctgtggcacttccctccctgaatggcttcctgcaagaggtgctaattgcaagtaagggatggagtgcggcccggaccgcagagcttatttcgtgggtggtgtgttgccaccttcctgactctcagtatcccgtccgtcctcaggcctgctgctgggacgcgctggaagcgagcacccaagtcaggtactcgaatggaggttgtccatggtgtgttcattttatttatgatgagtattacatggccaatctcctttcggtactcaattcttcttgggaaacgtcacgaggggaaagcccagccggcacctgcgcagggtaaggaagtggatcacctccgcatgacaggtgctctctgtgtgacttacatcacttggctcatatcccggccatcattaggaggaattccccgaaatgatgctgacgttttagttgacatggtggtcttctagtcgcatccttgaagactcgtcagtgaataaaccacatttagtcaacctttttaggtgtgaaatcatcttggctgtgtggcacactttagggaaaggaactcctggctgaatggaagacatccacattacgccctcaaataccttatcttctgggtgacctctgggaagcaaggggtgaagggggtttcctcagcagtgagaattaatgttgtttaaagacacatttccatggcacgactcggttattcctactgcaagacgagaattgttaatagcatttattactaccttatgttgccagctgtgtgcccttggaaaatcccttcacctatcagctctctgggcctcagtctcttcctctgtaaagcagggttaacagcggagtggaaacgtgctctttgtgaagtgtctagacagcgtctggcacgtggctgtaggataagcattgtttctgaggatggtcattatatgaatgttatgtcatctgcactcattgtcctctcgccactagaatggaagctccctgagggcagagtccttgtctgttttgcctggtgctgtgtcgccagatgtgcacagtaggtgtgatgctgaatgaatgaataggcagcgtgacctgttttcttggttgaactctctttgaggcctcctggaatggagtgcatggagtacagtcacctgagcctgtgctgtccctgtgacgcagccccacccaccctctgaggatgctgcgctggacgaggagtcgccagccttcaggtcgggtcctccctcaaacccctgtaggctggactgaacacggtcacatggttcattggcagcccccttctctgtgtgaaatcctgcttcagagacttccagaggagataccggctctggaggtggaccttggtgttccagcccctctagggtaggtgaccaggggctgactctagctcgggctgacctgtgatgtgtgtgtgcatagcctcgcccccactgcctgctccagggctacagaagctggtccatgaccaaccatgttctgaccactgcctggggggcttctcggaggtagagagagagagagagcaagaggggagagagcgagccagcaagccagcgagcctgcagctggagtcagcagggaggtcccgcaggcaatgccgcctttggtgaagaggcatctcggtgtgttcttgcccgtgctgatgtttgacccttgagcagaggttgcccttggtgaattcgctttatttatgttgaatcacacaaaggcaacttttgtttgagtatcaaatcctgcttgggatggcttccgggacccagtggcaagctcaggggcatctacacccctcccgtgagcaagaatggacggggtagacgtgggtggtctgccctctgcggtcctctgcggtggatgagaacagatgtcgctcagagaacacaagcttcattcatgatgggggcggggctcgcggcccggggaggatggcgttggtgtcgcgtcggctttagctcttaccctggaccctgtctctttacatcaccattttggctgtgttgatcccaaagacattttgactccaccatttttttttcggaaggtatttgacctcgcggatacacaaagagctcacacttggcagggtctgtgacgagtctgcagccccagacccccgtctagctcacaagcactgtgcttctttctgcacctttccttgtctctatctttctctttctatcccccaaccaaacattgttcccaattttctcctgggttatgaaacaaatagaggctatcagtatctcatcccatttgtattaaataatactgataaaaataatcaacacaaaataaaactaaaaacagctgaaacggcacagtgctaaatgtgttcagttgactacaaattggcagaggaatccaattttcttgacaacatttcagctgtgacatttgacctggggaaatagcaagctgccgacgtggcagccatggaaggaaattcacggtggcggcggtgataaacagtgatatttgatgtagacaagaacacattgaggaatcaaatcttcatgcagatttttaaatggaaaaaattgatcctaatgaaaatgatttggggaaaataacaagggaaataagagaaatgaaaacagctcaacagcgcggtcaggaaagctaaacagggaattggattagtataatggcattggctctgaaaaacacgtttctatgaatatcagtgttggtacaattcttgtgaaggtggttacatttgtgcgtgtttacagtggagttggtggggtcagtaggaacctagggtcaaaaaatgggatacagtctccccctttatgcagttgatcttttcttgctgccccaaaccttcccgagagcttcccggaaaggtgtgctgacttcaggcgtgacacactggtaaggcgtcctcccggggatctgggtgcatgttgtccccagagcattcatacgtaagtgacaggcatcacctggtctccctccatccccacggagggttctgggtgagacgctgactccggagggaagcagaagttctacggtcagtggggtctggtctttcaggacagttgcttctgtgaactcagaaaatctgagacagctcttagttaatttagaaagtttattttgacaaggttgaggatacacccgtaacacagcttcaggaagtactgtggtcaaggcacagcttggctttatacattttagggagacatgagacatcattcagcacatgtaagaagtacattggttttgtctgcaaaggtgggacaacttgaagcgaaggcaggaaggagggagcttccaggtcacagacaggtgatacacaaatgattacattctttcgcgtttctcatgagcctttccaaaggaggcaaatcagatacgcatctgtctcagtgagcagagggatgactttgaatggaatgagaggcaggtttatcctgagcagcttccagcttgagttttccttagtgattttaggggcccgagataactttcctttcacacttccaaggctattgatgaacacacaggcatccaggaacattctggggttcagtccttcctcagactctgctgttgataccttacatggttccatgctggccccaaggacgtgcccttcgttggtgccgaatgtcatttggtcatagaggctgaaagtcattctggagttgatgtttccaaggtcaaaaaccttgctggggctgtggaaagagctcgttgtttgctggcctgctttgttggtgaccagcattgcacatggctttcttttcagatcaaaccctacctggagaatttccagaagcaacagcaccctcaggaggcggcctgcagccggagccctctccagggcaggtgcctgagggccgcccatgggacaggcccgattgtacccacggtgcatgtcatctgttccactcctgctgactccggtgcgttccgggaccaccttgggaggtgatgcctgccccaggaaggaggctctgatgcaggtcagtgcccatggctcctgaagggaagtcgtctgtgacatcttttctttctttacagcaggcctcgcatggctggcctcttgctccacttgtagcaaggcgcagagggctctctgagctcatgccaacgtcagggaaaggattctgctgtcggtcccactccaaagttcacagaatgggtggtgggcacagaatctggactctgcttgtggcatccatcgtctggcccgatgcttgctggctgcccgctccaggaggcaccttctgggtgttctctgagtctggggaaggttgggttctgaggtcagggctgccctgacccttgtgaagagaagacatctgtgactcacctgctttcttctgctgcatttatccccccagtcccttattttgaatgtctcacttgctttatgaggctaatcagatggtcagccagctgttgataactgtgaagttactctttgagggatcctggggtgatgcctctgtgggctggagatggtgctggtgagaccgcaggtctggggtcagcgttgtgccccgttgagctcccgccaaaggaatcctctgctgggagggaggctctgtgcttgtgcaggggtccctacagggtcaccccctctcagggtctgggaatgaaaagcgggtgcgagcagggtttcattttcatctttagcaaggtgcccaaggaaggttgccgtcttttcagtataagatcctacctgggtcttgcactcaacttctgggaagagtctctagattcattctggaaggggttggaatcgttggacttggtgattgggaacgtccttggagagtgtgaggctctgggctctgaatgcccagaccttgtgctgcccttgggggagggtcttctgcaagcacagccgcctgcaagcattcaccttagtccgagcatctgagcctctccatggtactcggggagaggttacccgagcaactttgcatctggacgacgaatgttgctcggtgaaccccttttcggtatcaaattccaccagggaggccgtcttggaggctggggcacctcggggaaggacgccggcatcagcaccattctggggtacggggatggatggtcgaccagttggaaagtaattgtttctaatgtacttcacctggtccactagccgtccgtatccgctgcagcctgtggggcctgcgggccggggagccgatcgcgcttcagctcagcgcctttcctggtacttgaagggagatcgaccgtgttatattcgctttattgacttcgaataatacatggttgatcttttctcagtatcaaatctcaccttggaggacccgttggagatgaagcccttttgagggtaggagcaggacgggtgctttggagtcgctgcctcagtggggcctggtcaccgagagtgggccgggcaggggtctctttcctgtctctgtgtcttctcacctttgatgtcccatccgtcctcaggactgcttcccgggggcagcgctggcaccacgggacgcggcagccacgttcttgagccgatggcactctgggtacctgagaagaggttgtctgtgatgagttcgcttttattaatgacgaatataacacagatggcctgttttcagtaccgctaccgcccggtggtgtgcgggcgccacgcctgaggcgggactttccagggtacgtgaatgcatgggctggtgtgacatttgtcatcctttcccctgacccccgccattgaatcattttgggagagctttcggggggccatgtggactttggggaagatgctagggttgtgcactgtggtggggggcggtcatgaagctgatgagcaatggtgacggggctcagtctgtttttcatggccagtgtcatcgaggcagaggacacgggggagctagtcccgctggaaggcatcctgctggaaggccacccacccctcgccaggatgttgggggcggctgcatgcattccctgcacctgggctgccttctgctcatctcagtgctgtgagaccctgggtgggagctggtgccttgggtggccgtgtgcgtgtgctgctccttgtggtgcctgaggagaggtggcctgtgttgcattcacagaaatcatgacacacaagacacgagcggcctctcttcagtatcagatcccacctgcatgattcctgcacctgctgatgtcggggaggtccggttgcgcgccctgtgggcccccagaggcatggctggtggccgagcacgcgcttgacttccacctgcagccctgtgctggcctccatcctggaggcgggtgggtggcagggcccttccctgtggaagaagcctcctccctggagtcagtgctgctcagtggtacctgaaataggttgcctgtgaggtgttcactttctatatgatgaatattatacagtcaacctctttccgatatcgaatcccaccttggatgccttcctctttgctgtcaactccaggcagcagctggctctgcgctggttgaccctgtggactttgtgtaggacctgtgtcacttggcctgttaattttccagctccactctgttctggggggctttggaagtgtgacagaatggcatccccaattccagtgtcagcgggagcacccgccatgcccttgcttccggttggcacatcccccaggctgggctggctctcagctacccgatgcttatgtcatatttgcacccctggcctgcccagactacaggaagatgaccagaggcctgtttgcagctgacctggagacttagtgactccagaacatgctgcccatgcccagggtccagggctgaaggcaaggagcacctcaggagtgaccccaaagaatgagctaaggctgtcctttatcactcattgttgatcagtgagctcctgggctcgggagatcttcctgagctgggctcccgtcatcccctagttgagacgtcgctgccttggaagtcacagcctgtgcctgccctcccccttgtcctcctcctcgggaccgctcctctccatgcctagcatgggagtggggatccctggcaccatccctctgggctgcctgctcccactctccctcagcacccctcttccccagcccctgggccacagccctgctggagaggccgccccacaggctaggtccctccagcctgtggcacttgggtctccctccagtgcccctccctctgccagggagagcatttccaagtgcagagtccagctgtttaactccgctgcccagggcacctctgcaggccccttcccttgggcttggtaccaaaatgatccgaggaccccccaggccctcagagtggcagcccccctcttcttttggagccacagcctatcccccacgtgttttcatccttcattctggccttgcacatgcccctccttccggagctgggtcctgggccgccctgctctgccctcggctgcctcctgtccaggctctggcccttccttccttaaaggcccacatcctttgcattttcctttcccaggggttcacaattcccaaggggatggaatggctcttgttcagcaaggtcatccctgataaccctataaaagcagctccccttgcctcttccctatcacattctaccagttgccccgttactgttttcttcctagcttacagttctctgaaattgcctaatgttaatgtctaccttctttgtgccctagactgtgagatttctcattggcagaaatttctctctctctctctctctctctctctctctctctctctctctcatcccctgctgtgttcagtagcagaacagtgagtgtttgttgattgactaatggagtccccaaaggcagggaccggatcagatgaattcccaggcaggtgctgggcacaaagcaggcagtcaataagatgtggtgatggagtacatgaatatgttaattgatttttagaaattcttcccatttgttcaaagctgtttggttttctagctttttctgcccttccaggatgaggctgagattagctgcaggaggcacgagtcagttgggtctgggttctctcttccacttgtcggggggtgggggcaccaaagccccagaggaagtgacaggccctgtgttcccctgcagatgccgactgatcgcgcccccgcccctccagcaaacgccccagcgctgagagccaaatgctctggggaactccatctgcaacgggctggagcgtggtgttagggctcatattttatgcatggggctgactaaatgggaacatttggagatgaaaattgctgttaatgcatctacacatctttggaatatattaaatgtgtgtgtgaggggaagagtgacattagccttatttaatagcttcaatataaccatccccgcacaccacggcgttaacaggcacggcccccccgccgagtctcccaggccaccactcaggaagagtgctgggtgcatcacgcgccacttgagaattagggggtgagtccggcgtcggcccggcatgcagcagcgtgcatgttccccgccgatttctaacccaaacacagtgaccctgtgccacttgatgcagaatttcattaaaagcaaaaatgattgatttatctattgtttgcggagaagaaaaaataaacaaagggcctttctcatcagataagccaaataagaacgtgtgccccacaggtggccaggatgaaagtctccatggacccttcaaccagaggctctgtgacttgtcccgtcttcagtgcggtgtgtaaaccctgccgccggtccaagttcacgaggtgtgctcccttctccagtgcaagggcccggtttatccccactatgtctcctggacgtggttgggaaattgaacaacctggacctccgttcccatttccttgttgtttcagcgggagataagaggagaagtaatagctgtcgtgttggggcgcttgccttggtcctgggccccatcagctgctgtgaggagacagtttcttttccatagttgaggaaatggagcgcagagaggttgagtgagtcaaccaaggtcacccagctggaggtggggcagggtctggctccaggctgtgtgctctcacccaccctgcttgcacgggctttaggaatagcccctgtgtcctggaagacagatcgctcaccgaatgggcctcttttcttggtatcatatgatgaggtaggctcactttcccccagacttagcttgccagaatattcatggttttttctctgtactcacctgtcatctctccaacttggtgccatcacccatgaagtgggatgctttggtgcgtgtctggcctggggagagggctgcttgctttgtcagaagactcaaagcatgatgggcatccaaataccaaagacctatgttgacctgtgtttttcactccgcttgatggcagttgagggctatattcactgcctcagttgcatggagtgaacaagacctagtgaaggtggtgggtgcgctgagaccatctggttgatctctcctgggtgggaccaggtgctcccctcaccacccccacccttgtctgtgtaccaccactctgcacagacacgttggctggtgcagtcctggagacccacggagctcacggtcgtcaggggtcctcaaggattcagagaacccccaaatgtcagggctgctcccttcttgtcctgcctctctgctcacacccttggacaggtaagaaaactgaggtccacagagggcagggtgcattgctgtggcttttgttctgagcactgtctccccagctttggggttgagactctggggtcaagacccacctctgatgaacgagcggcttccttctttgtaaaaattgaggcgacccagaccaagaagggctgcaaaatcaccaagccaggacctcaatacccaaggggctggggtttcggccaccctgtggcagagcttttagaagccagggcccttggctcggcagtgctggctcatagtaggtgcttagttcatgcctgtctccttggatgaaatctgaccatagacaccagtgcaaagcaggtgttcaacacaggagggtgtactgaacccgatctctctatcaccaggaggaagcacacgggaggcactcagagaacgtttgtggaatgaataaataaaagcatattttgagggaataaagaagcagaaaaacaaagaagaatctggggaagatgggcataaatctccaccaagtgctgccaaggcttcccaggcgaggctgctgaaaagaccctgtggaggtagagggacaatttgtcatggatgggaatgggcttgagggccgggaagcagggcatgatggggcctcattcatcattttcccgttatcccagcagcgtgcaggggagcaggtacagcacctgcctgtgcagctgcactgcctgcccgaaggccctaggccctgggccaagtgagtgaccagagggggactgggaatggaaaggacctcaaggaaggacaagctgagctctgggaggccacctcctccaggaagccttccctgattcatccttcacaggcagtctcaatttgcagtcagatatccactgctctgattcttagatcagcaagtatctccctacccagactgcaggctctgctggggccgcggctgtttctgacttgtgcacaatggcatccctgtacctagcacaggactgagtccagagaaagtgctcagtgatgcttgttggccttgtctctcctctgtgggcagcacagggcacccggcgggtcctgagggtgtggacatcccacggcagagcctgcggttgatcccgaccatgaaccaaggcctggggcgggggtggccacatcaggccacttctgccaggagagatgtggctgtgagctgggggtctggcctgtccccggaggcattccttgggtttgcatccatcagaagatccactggttgcctctatttgggcctggagcagggatgggatttttccaaggtacatggggtctaggggagacccaggcccattattagggtcggtcttgagaaggcagagatcaggccaccactttatttggtgtagctcctcgctccattggtgtgtgctgagtgaatgaatgcatcagggactcctgcttcctgcccagagccccctccgcaccccacacagccttgctccaaggagaaggggtcagagccaactggacagtgctacagcatggggagcctcgaccaggctcggccctcgacgatgggataggcagacagccccctgtgcaaggcagctagcttgcagggtcccgagaggccaaaggccctggtctttcctggggcaagaggctgctgagaaggtgcacagagcctgggtgcaggaaaccatccagaatgctgcttcccgccatctgtgagatcttcgttttctctaacactcaaaaatagatgtttctgttatgctctctcgttggcaggggagcggcaggacctgccaaggcctgggggagcccgccagcctgctgagttctactgtacaaacagttggggagggggcgctgtctctgttaacttgaaattccccgatcagtaaacatgccaatttaaagtgtaattaactcaggccggaaaaaattcagatttggactgcttttcacagttgaggttgtttttcttttatttatttatctctttccgggtgtggtggtatctgtggctggttttagccaggaaaaatagaagggggaccgggtggggagggggctggttgggagaggaaaggctggaaggaaaggaagagaaacgggcgggtggcctgacacccagcagccaggtgtctataggttttctgtcctgggagggggctgtcagggtgatgcccgcctgcagagagggggtcattctgcgaggttgggctgcagacccctgtgccagcgggcctggtgattcggaaatgatggggcactgtggagagaccccaggaaaacacccagtgctgcttttgacattctctctccatctcccctttcagcggctgctctgcctgggataaacacatttcaagagtctcagtccccgctttgccaccatctcctcctctgatctcctttcctgcttcaaaagactccagaatcttctcggttctcagagaaggctgaatccacctatgacctagtgggagcaccctgtgccgaaactgtttaccttctggtccccggagccatgggtcacgacctgggcctcatgtaggcccgctcctcagcagaccccaatctgcggcttctcccacctcactggggaagaaggagagccctggggatgtggagaagccaccccccaccccgccacatcccccacatcttacagaatctcgattgaatccccgggggcacatccctcagcaggacagcaacagtctttgccgcagcctggggagggctgtgctggggatgagcgccgagtggccgtggactaagtgaaggaaatgaccatgctcttctcccagctggatggcgaggccgggcaggaaccgcggaattcctgctcttcgttttcaaacactttgctgtcaagctatttgaataataaatacacattataaaaatgt

SEQ ID NO: 352 - DNA, 56111 bp, Homo sapiens
tcactgcccccagtgggcagtgggtccagggggtttctgaggacagggcatgacccagccctgctgcccccaagatggcacctggcttggaggggtgaggggccctgttagtctgactttgaagaagaccagccttccagactcgcttggtgccctgacaggtatgtgtgctcttctctctcccacctaacagccccttttgggagacagggtctgagaggagtcagggtcgtataaccttaacacagtgtgttatccaaaaacccactaaccctgttactcttgtctgtctgctatgtgaaaccaagggcggtgttaaagtttatcaccatgatatacagatgtgcgtggggacatctgggatggggctcaggggtctacctggaggtcagagagggcaggatctgcttaggggagatggatgactgtgggggtcagacagggcagggtttgcttaggggagatggatgactgtggacatgtggctgtaaatcatcctccccgtcttacataggatggggatgcaactttcaagagttgccttgattggtaccttaaaggaaataaaacataaaatgcttggcacatagtagatgctcaacacatgtagaaaaggcacttattttaggtggatctgccgccgaatggcccttttgcaagctcttctcattttttggaatccaaagggaaggtgtggggagcagggtcggggtggaggggaaggacgacgtgaggttgcagagggcattttcttgaggcaatggcatatctttcattggtactggctgggtttatgcggactttgagaggagtggagtgtctccaagtggggctaccccagcctgcaggttggatgcaggtaacctcagtctgggcactgcatttttatttaccataaaaatatttcatatttgctgggtgtggtggctcacgcttataatcccagcactttcggaggccgaggccggtggatcacctgaggccaggagtttgagaccagcctggccaacatggtgaaaccccgtctctacaaaaatacacaaaattagctgggcgtggtggtgcatgcctgtagttccagctactcaggagactgaggcatgagaattgctcgaacctggaaggcagaagttgcagttagccgagattgcaccattgcactccagcctgggtgacagcaagactccgtctcaaaaaaaaaaaaaagaaagaaaaattgcaaaactatagcaatcacctcaaggttttcacaggaatcaaactcagtccaaactaaaatgctgtgtaataaatagtggggcttcacgtgcaggaaaggcgattaagagcgaggcatgcaggccgagggctgcttaacctgtctcagatttcttccgcacaaagtcatggttgaaaataggtctctgcctggcagagggtaaagaagttctcgaaggcctctgtctgcattagcttggtgagagggaagacatttaaccaattaaccaattagtgatctgtgcggatggagactgagcaggacgagggtgccacccgactgggtgtaaagtgggcttagttttgtcttcttggtgtctgggagcctcagtgcctttctacgtagatgggagtatgcttgtcacatccttgtcacacaagtaaccctgtgcctgtttgaggattccaagagcctgtgacggctgcagggggccctgaagcttagtgtgcaagcaggagctggggacagaggggcttctgacgggagtcggggtgcctcctctggatgtgggggtgggctagggtgggcaaaggttgcttcccgttctcctgcagctgacagttagaaatgccagtgccgtttagccacagtccctctgggttagagtcgggaagaaacatggcagttgtgtgttttgcacaggaatcaagctgtcagggggcacagtgaggccccagctccttaccagcaagccgtctaggctgcgaacgcgagccgccgggccgcagctctctagaggtccctgtccccaccgcctggccccatctcatgtcacattcccccaaggtctcattccactcggctaatctccaagaacaccggccagggcattggctttcgggtccttttaaagaccaaaaagtaaagcactcccccgtgggtgctggacagcttgggagggatttggggctgtgggtggtgaaatcacagccctgggcacacacctgccagcccgatgtcactgacaggctgctcggaggcttggggctccagtgagagcatatagatattttttaaaaaacatattcgcgataaaataaatcccctgtgtctgcagaacttgctctgggcatgtacccactcccaatccatcaggaaacatgccctttgctttgtatttgtaaaaacagaaacaaaaacaaaaacaacccacaggcgaacaagcaaattaaatcccccccacacaaaatgtttattctaattatgcaagaaatggattgataattaatacacgcattagtaaaaatcaaacactgcagataaagccatctttaatgcttccctcgatccctccccatcaccccccagcaaattaactgctcttctcagtttcaggcgtctggttccagatatttttttctgtgcatttgcatatgtagataaatatacctctaaaatctatgactttgtttattttttacataaactatatcatagtgtacatttcctctcgcagcagcttgtgtttcttccttcaagagtctgcttagagataataaagatcaacactattccttataacaacacctcagtatcctgcgagctgtacacaccagagtttatttaaccaccttgctgctggcatgaaagcctcaggtcctttaccctggttggcgggggggggggtgggggggtggggggcgggggggggcagtgaattggtggcggcaggtgtaagtaattgctgagatttgggtttggggagtgggctcacgagtgtttatgacattattataaatgaatatatgagtgcataaattagcaaaataaaagggggcttttctggaccaatgatgagacagtgtttatgaacaaaagatcatgattaatccagttctgcacaaaacactgaggtccattagaagacaataggtcttggctgtttcattccttttaagagctgtttaatattccacggtatgtatgcaccattgttgattacactcttctactgttgaaaatcccagctgaaagtgctctgggggaggagaagctttggtcacagtcctagccgtcagggtgggtcacagattcataggtgttcattaaattattttttaaaaaagaatacataaaaatggtgcttaatgcagatcagtgaggaagcgtgtcacaaatcgaggttttaattaatacgattctgctcaactaatgcccgataaaaaagatctaagctgtttccattttttgttgctgttaccaacgacactgcagtgagcattcttgcagctaaatctgtaaacacatcctcgactgttcctttaccccagcttcttagagatggggtggtgggttaaattgtttgcaaaagtttattttcattgagtgatctttctaaaatggcattttgaccttgttactgtcttgctttaaagcctccatctgacttcctggagcttccgggacggggtccaaaaaataaggccttatcctggcatggaagaccctttagggtctgtcttggaacttgccagcctcagcccctccccactggtgtttacctgctaggcgcacctcacccccacggggctacctgtttctctcagcgggctccctacttcttaggctttgcgcggccgtgccttttcagccagtttctccccggccttaaagagcaggcttgaaatatccctgttggggagcccaaagttagatgggccccacgaaacactgtgttcagaagcccaccgaagccctgaccctggaagtgggatgcctcattgacatttttttcccaattaaagggaatgttttgcatttttctagaattgatgaaactggtcaactgttactcaccctccttcctttgtccctttctaggagccctgggctcccccagtgttgcctgggtctgactttgcctcagtgaaaactgcctcgaattctttcttgcaccgatgggcagatgggcagtgtcggaggatcgtgtcatctgtcccgtggcgctgggtaagtctgcagtgttgtaaagctgcaaacacccttctgggtggggctcaggctggcacccccccactgccccagcctgcgctataccacgttcccctgatgcttgccttgtgccgggccccagaacccagagtcatggggtccacagcgcgggagtagcgtctcagtgttgtgagttctggggatgaggttcggggtatgattacagcttggaaatggctgattgccattatggctcctccttgccagaggtaaacgggtctggtcccagaacaggaggaggacatgtgatgactggagtaacgatgaggggctctggggaaggacagggctgagagcaagtgctgggacctttgggaccgagtcatattctaaaaagagcacaggctttgggggagaggagctgtgaggccaaggcagcatccccctggggagcttgtcaggagtaacaggagccactggcagtgtttgggcttttggtccctttttttctctcccaggggaagggagaaggaggcattgcaggaagccagccaccctgagcacagacccagctacagaacagacttgagctgcgtgtccttggcaaatccccaagtgtttctgtgccttggtttcctgatattaaaaaaaaaaaaaaggactcataatctctctcacacagggctattgagatctcaatgaggaaataacgcaaataaatcatccagcacagtagccaacacgcagtacccagcaaaactcggtagctctccccatcttaccccgtcatgaaatgcttaaccccctccctgagacgggcagctgctccctttcagggcagggagacccaacagaggacaacacaaatgccagagagagtgtgaggggcaataaaagctgatgctcgcctccctcccagacatcttcccagggaaaagtgtgctttcttgaacacctgggggccggggaaggggctgccctaccactttgaatcgggtttcccgaaaagtttggtgagagtttatttttatgtaaataacatataaaaagtcagacttctccacaggcagattttttgaggctcatattttacagactttggcaagggtcactcggaaggaacagtggttacagtctccagaggttcataattcctggaaaaacttctggccaaacctgacttctcctaaatttcacagaaaattctccctgggctgggctcaggctaaatgagctttttgtgtgttagtacagccttacctagtggaagcatgacttgcacgttgccctttacacaaaagggaacctcctcggccgctgtgaacaaaggctccgctctccgaaatgtttgatttgtttactcgggagcgtgagcctggtcaggcacatgtctgatactggggctatttctctgcggccatatgtagagctgtccaggtctctgcaatttaaccctgcgcttcatgccagaatcccatttcctaacttcctcaagcaacggggcaagggaaccacagcaaaaaggagtgtagggggagtgttccctccgtgtccggcaggggctaaagggcttgctgccctgtggcgtctgcctctaaatagggatttgggtcggtgacttttcacatctacaccaaagcccttcagaaccctttctgcaccaccagctatcctgaaccagaaatccctgttcacagaatttcccatgtgggtgcctcttgttctgcaccctgcatcgcgccccctcccccgtttatgtaaatgacacatgtaaatgtcactctcccaaacattttcacacctgcagcttcaaatcaaccttttaataggttaaaacaacagcaccaacaaaaaccaacaaaaacagaggctcccgagaaacaaacagtttttcccgaagggcttgcagtgcctaactgagctgccagggccgtctgtctgtctgttagccaggaaggcaaaccagcctgcgcactccacctgcaacacgatgctgcccccccacggcgggtcggagcagctgtggcgaccccagggctgacagattgggttgtcaggagcaggacaatgaggctgcagtgaggatgggctccatccttgaatgactctgccctccttgaaatttttctgctccatggaggtgcatctctgcccccgaggaccttgggcatttcacagacaaggagccctggctggcctcgcagccatcccccatatgcacacacgcacacgcacagacatgcgcgcacacacacatgctgagtgcctgcactgggagcataaggcagaaaactcctttggaaactgcagaacagagccttgtctagcagaggtcccctgataaaggtcccacagttcctgggaactgaacccctgtgaatgggccaggagaggcagctcccgactcccgtgtgggctgcattcatcagcaggccggcaccccagccctgtcactgtgtgaggagctttcatgagtccactgaacatgtaagtcacagtctggcagctggctgcatctgtggttgctgctcagcctccagaaaagggcccctcaacctgccagacctcctcgctccttccactcactctgccagcctgttgccccagagaggacacaggccagcctctgtgggctcaggagccagggcaggtgcttggccactctaggtgttctggccctcaagaggggagttggcagcaggacagtccccacctccccccaccagccctgggcactcaaccccattctctgctcctctccctcattgccttattgggacagaggcaccccgccaaccatctctgtgcctttgccatttagcccagggcaagctactcgggagaggccaaatggcctcatactgacccctgcctggtcccctctggccacctcgctcacttgcccgcttgcctgctcaggagttggtgctgtgggagcttctcaaaggcctaaacatgtgggctgccagcctgggcaggaaaccgtgctgcagccttctcagccaagcactggcctgcctctctcccctcggatgcctcctgtaacagggagctccctctctccccaggcagcctgctcagggctcgcacgcagagctgctttgctgagccctcccctgccttttgcatctgcctcctcggctgtgcagcagcccccttgccccctctgccctccgatctctgcaggctgtgggctccctctcttttcagtcctctcctttctgtgctgaatggcaatacccccaccaatggtgggaacaggattgggcgcctctacacctgtcctaacacctctgtctctgttcttttagacctgggacagagccctttgccctgctgttctgctaaaagcccaggggagggcgtggtgctcccctcctggggccagctgctccatgtctatctgttgagcggcttctcagccctcttgggttttctatggccccttttccagttgctagggagaacgctctgtatgcagccccctgccttttctgcaggagctgctggcctcccggccagccctggtcagccctgcagtagcagcagcagcagcagcagcagcagtaggcagccacagcagggctgggggctcccgagccaggcagaccggcttgactccctgctctctagctgcaagacaattccctttacttttcagactcggcttttcccctgtgaaatggagatgagagtttctccgtcactggcgtgaagtgaggactaaatgagataagtgtaggcttgcacacatcagacacttcataaatgcttgtggagtagacggtgggacccagggagggagagagaggtatgtaacaagtgtcgcaagagagaaaacagcctggcctttcaagaccctgctcccaatacaaacgggaacctctcctggcagagtcccctctgctggcttaatcgcacaaatcaagtcagccggaggcagcccccggcctgtggaactcacagtagatgcagcaggcagcataaatgacatgcagagcccacatctgcatttaatagaccgagaatttgcattgtatataacagcacgaggggtaaagcatgaaggcataaaggaacagtttttcccggcggcttccttgaagggccagcttagacaggggtctggggaggagaaactcagcggggtccgggcatcccatagactatgggacagacatccatccatgcactcattctccaagccaccacagtgtacctaccttccccgggcccagtcccaagcgtgaggctggggatgaagtgatgccggtggcttagtgatgccggtggcttcctgtcctcgaagctcagtcggtctggtgggggaaacaaacagggaataagacactggaaattgaggtgatcaagagggggtgcaggcatggagatttatggagccccgtcttggagccaagtcccgaactgggctgtctgcaaagaactcacccgggcaataaccctgcacactggtctcatgagccccattagattgatgaggaaactgaggcacagaaaggcaaagtcctatactcaccgtctctcagctggtgtgaggctgggccaggatggaaccccagactctccgaggctccccaccacaccctgctgctgaaggctgctcagcgaggctgtgccgagtgctgggggggtgtgggtgggcaggggacggattgattagttataagcacctcccagcggtgcttgagatcccagctcctctgtggcccaatccgtttgaagggcagattcaaaattaggtggtagcacctatgggcagaggcttatgaaaatggcattattaacctgatgtggagagggccctgcctgtctgcaagtagattgcagatagagacggagggggctgggcttgtttgtgtggacagtgagttagagaggacagagaacatccaggggccctccagggcttccggacggggagaaccagatctggaggggctggacaagtgggagggggaagaggggtacgtcttaagggtgccccggcacctcagggaaatgccccaggctggacttggaggaggatctccagccttgactctgacacagacagggactatggccctccccgcacctcggtttcccatctgtgagataagagatggaaaccaaacgtcatttcgagaaaagcccccattcccaccaccctcctggccccccccttcccccaccaccccaatcacgtttgccagacacctgtctgcttgtcagagcaatattcaacaggagagttccttcgcttcctccctggagggagaagggagaggtgtggacggggagaggggaggggagaggtgccccccactcagagaggccgctgagcagagttctgcatcgggtaggagttgggccaccgaagatttgtgccaactcacggtgcggtggaatcagacagtctgaattcttcagacaccagccaagagtctgtggcgcccccacgtgccacaagggggctgcctgggccacatttctgagcccgaaaagtgaggagggggacagtcaagagggaccggcgcttttgctctggcagcggcgcttttaactgcgacagatgcgtgcggtgcggcgggggagccggccgtgccggggctgggggctgctgggcgggggtggtcggggcggggggcgggggctgcaggttgcgcccctccctcacagacggctgcgctgcaatgcagcaggctgcgggagctgtcccgggagctgtcctgtccggtggccggctttccaaagtggggaacgagagatgagggagggagcacttccaggcgctgcgtggtggccaggcgcccaggaagccgaggggcccgagactctgcagcggggccagaaagagaagagtgggggaggaggccgggagtggtgcatggaccagggggtagagggaggtgggtgtggacctggggtcgggcgccagtcagcttgcagcctatgaaggacggaaaggagggctacagagataggggaagagtggggctgaggatagccagagcggcttggcacacagttttagggtaaaagcatcaactcttatctttccaaaagaaataaaaaagccaaaaaaaaaaaaaaaggcatttgaaagctagacagctgaatccttcccagcatgactgagccggtcactccagggtcttccttcaaagcgtgtctaatgggagacagcgttgtcccagtaaccaaattgggaccagagtcccagggaagggctcatcaggtggccgctctgccttgaagagtggtaccctcaggcccttttccagccaggggtcagggagagagctggagggctcggggaggcagggactgggagggagagtggggagaggagcgctgggggctgcaggagggtctctgggcagctggcgggtgtctcgttccgcaacactctgcaccctggtacatcgtcctccgtccactcaacgtggaatgattctcttccctctggatccagcccctctagttcccttttcactttgaggcatttgccccctgtgaatcagttccctgctactccagaaaatttctctcataccccaggcccctctgttcttttaaatggcacccttcacccccagcccttcatcttctgcactgtattttcacttgttgatttaaaaatccctttattatgggaaattgcaaacaacacaaaagtagagaaaatagtacgtatttttactgtttactcaattttcatcttgccattacccggacacggttgccgtcaaaccctggcccctcttgtttcatctaaaccctaaactgtccctctactcccactgcccaacccctacccctggactatttcgaagcaaatttcagacaccatcctgtttcctctgagcattttttagtttgtatctctaaataagaagcttttgtttcttaaaaataaaaccacaacaccattatcacaagttaaaaaattaatagcctttccttaatatcatccaccatctatgtagcattccaatattcttgattgactcataaatttcttttacagttggcttggtcaagtcagtgttcaaactatctcctgctctttcaaggggatctggggctctagaaggtaagtatggctacacatttaggggttgaatatctgcctggaccttaaatgagaaactcaacctcagcaaacctcagtgttctcactgaaaatggggcaagttctgggtctctccttgggtcattgagagggttagagcattaacccctgaagccccagccgcatgtctaatatgtcagagacactcagcaaacagtagctgcgagaatgattctttttcccagaaacgtttaaaggggatttgggcaggggcaggcaaaacatagctggctattgtccataaaacaaaaggctcctggcagtccaggtcccctgagtggttaaaacagcacatgcactacatcccaaaaagggcagcctacagtctgggggctgggttcgcctggacctcctggcttgccgtttagctgcctgacctcagctgttgtgacctgggaccaacaggggaccccggcaggtgcctatccactagatggcactctctactgtgagtccaggggggaccaccaccccaaactgctttggccactgcccagccctgggtgccaccggaagatgcacaccactaaaacatcgcagataatttctaaaaagcacttctcaacatgtcatgcaaaagatgcggtggtttatttccttgcataaatcccaaccagattgcagaagcagagggaatgaacatttaatgactttgctgaggccagacactggtatgtctacgctctctttaaatcctcatcccagcgacatctgatttcccttcattttacagattagaggacttggagaggttagtgacttgctcgaggtcggctaggaagcaagacccaggattccaactcaggtctgtgtgattcctctgcaaaatggagaggtggaaggatggatgtcaggtctgatggatggatggatgcctacatcaagatacatgcatagatggagagatggctggctacctcatgaatgctggtaagatggatgagtgaattgaagcacaggtggtggaaggagagaggaatgagagaggatagtcaatttcccaccaagatcaaaggcttacttgatctttgaagagaggttccctctgaatggagcttgctggtgaagctcctgccttctgttctgcttctgagcgcactgactggctcaggtggctctgggacaacaggtgggatgccagcttacagggaccaagtcccagctgtggtgctggagctgctcagtggcaactctccgtctctgctgctttcacgcagcactgacgaagagcaggcatccgcctttccactggctctcctggatgactaagccctaagccccaaccgcatactcagcccttcactggcacttggcataattttatctcctctaaatcatcacagccaccctccatgatagcaatttctattctcaattaagtgaaaaggaaaccgaagtttaggagtggtaagtgacttacccaaaatcgtataaggaggaaatgcagacccaggatttgaactcgagtcttctttccttccaaactcatcccctcaacctgtttatttccttttctctatgaccatgtctgaagaaatctgccttggggttgtctcatattggactcactctcttggtctgtcagtgagctgaacttctcatccaatcaaatccaagcttatttcccaagtaatatctctagtgtattctatttgtaatgatcacacaggcaagggccacacatatcactggcatcctacagtacaattaatcaagtcaaattagattcctggcatctcatattctgactgaatgctaatggtagtagatgtaaaaatgactccagtgcaaggcaaggagggaggggactggatgtagggctgaatggcgaatcagtaagccttgctgcagacctgggttaacattagcagataggttttgagaacctgctcatgggctaggccctacttcacacattctaggtgctaaggtttcaatctcagctttgccattgactacttttgtgagtttggacaaggtatttaatttctgtgccgcgttttcttcagttgtaccaacagtaccttactaataccgatagtaccttactaatgagtacttgaggattaaatgaggcaaacatataaattccttaaaagagagcattccaggctgggcatggtggcttatgcctgtaatcccagcactttgggaggctgaggtgggaggatcccttgagcccaggagttcgagaccagcctgagaaacatagggagaccccaatctctacaaaatatttaaaaattatctgggtgtagtggtgcacatctgtggtcctagttacctgggagactgagatgggaagattgcttgggcctgggaggtcaaggctgcagtgagccatggttgtgccactgcactttagcctggatgacagagggaaacccggtctccaaagaaaaaaaaacaaaaacaaaaaagaatgctttccagatgttgagcattcaataaatatttacttacagtgaaaattacagttgttataagtattgttattgaggtgtcatttgatatcattggcaggtaagaatcattatccacattttaccagtaactgaacaggtgctcagagaggcctgtgtgcttgtctttggagaatgcatcagtgaaatagaaacagaaatactaatttaaaactagaagttctagtgatagaagtaagagttctacacagcaaatgggcatgatccatctaaagaaagatgaaaccctaagagaggtgagactcctgtgaaggaatttccttgcagtataggggcttacacaggggttgcatggttgctgggaagaagctgagtaggtcaaaggcaagataaataattacagtcctctgaatccaagtttctgaggttgaaattcattaaacttcatggtttctagcagtagtgggcaaggttccccagttctcagatatgatttcattaaacttctttcccttcctattttttgggggagaaacagtcacttgagaaatgtttcttgacttgctcttttggaggtggccagttggaaaaattctgagtctcttaccatgaggggcatgaggactgggaagcctcctccttttcctggggcagcacatctgtaactggagcctaggtggcatgtggctgcacatcacatggggtgcctctggcggggtgcaatcggatgccctaacagccaggcgggaggagatgggtttagcattggtgctgacttgctgggctgtgttgaggataagctgtgatcccagcattgcctgacttcagattctgtgccagtcctgtaagaactgttgcccctgcatctcctccaagatggacagtctatttattcatccaggtccaatggtacatcctggggattccctctgcttctggggctgcctgtgtgggaggtcagaaaaaccttcgcacctcccccccagcccccgccacgtgatttattctcacactcacattgcgggctggcagtgggacattgctgccaaaacgaggcttccggaagaagtggtaaggccgactctggagcgacactgcccgggtttgcctcctggctcagcatttccttgctgtgtgaccacttataagtcacttaacttccctgagtctcagtttccttaggtataaaataggactagtaatgctttgctcaaatatcatcatctccgtgaggcctcctccctggtgtcactccctacccccttcctgctttattttcctccctagttcttaccaccatcttttatcccatgcattaggcttaccttttctgatgattttctgttcctatctccacccacagggatgttaattctcatggaaccgggatctgtccgttttgctcactactgtatccctggcacttagacccagcaacaatacaaagtgcatgctcagaaattttggggaaaaatttatgagatactattgaattgtatccaccccagaggagtgtcaatgtatgcaaagtaggcagtgtggtgcttggtacagagtatgcattcaataaatattggctaattatgattattatgtctaattcacaggactgttgtgagaatcaaacgagataatgtatgctgaggcatgctgtgaacactacgtgctgggtacaggaggtacaatattaatgatccctgctgcttggagggaacttgcacttaaaatgttatgcttttcattttcacaccacttaggagggaggaaaggctggtgggacgatcgccacctgaggctcagggaggggacaggccttctccaaggcctcacagtatgaagaaggcaggggcaggtccccacactggtggtcttcccacgactccctcatgacagtcccccaatggacagattgatgtgtaaatgacgttatacacctacaccataactctatataatatatagaattattttcaggtccctgagttgctctgaggccagttgtggcaggtggtacacacccaggacaagctggggggaggggtaagaaggaaactggctgtgtatctttggtaaggcccatagtgaagcctcttttggtttcttggaatcaagttgaacatcaagaatctcactgcatagacttccccaagggcagtcccacttcacaaaatgaattttcattttccaaagcacatcccttagttggatttctgtttttcagtgtatttgtttaagctctgatgccatgtccaaaaaagaacatgcccgaacaattccctgcccgagtcccaaacccttggcttgatctgagcattgaactaattcatttctttgatcaaactggggactgtttgagcagtgggctgggcgtcatgggacggggaaagggtggggtgtgcgcaggtgtgcaaggcgggctacttgagggatgggcgatagttcaggtcaccctccggttggacccacgagggcgctgcattcctcattctacaaaccgtacaagtcggggcacaagacagagaagccaggtcacgtctctgcagttacacagctcacgagtgcctgctggggtggaacctggtctgtctgtctgtctaacaccagagctcgggcgctgctgcagagggagccaagatttgggtgagggagggggctcagaggtgggatggagggtttttttgtatttttttttaacctggttgccattggcttgaaaataataacataactttgcttggggaccccccactgcaactatcttgctgatggggaaacaggcacagagacgttagtttgctttgctgatgtcacccagctcgtctggcattgaggctggatttgggaggtgggtactgaggtgtgagcatatgtgctgcaaccactgggcccactggctcgtggtgtgtgcgcaggtgcagatggctcagtgatctgggtttgagggcttttaccaatccccccagcagtgggtgtactctgaactcaagcttgtgtatttcacactctccctcgacccttctctttagccttcactgaaaactcctgcaagccactgacccatggaaaatatttaagaatacatatattacatatatgttgtaaatttatatatatatatatctggaaagggattgtatccaggagatttgggagtgattgtttaaggtagagggaggcaggggcatgagagggggagggatggaggtggggaccaccagtggtaattctcgtgggtggttttaacaatcaatacaagaagagagagacatgccagcagcaaggacgggagtgggttgtaaaccagggatggtgattaattcttcacaactgaggggcattaaaaaaagaaatcagagtggttcgtggctattaattttgttattaaaaataatcaaggaataaagaaataaggtaataaaggcctcgaatggaacaattctgagaatgtgttctgggcaaaggattatgactaatccaggtctggtaacctgatattaacaaacaaaaaaggcctcgtaggctattttctttttttaaccggctttatgttccatagaatgggcacactggggtttctctcccagagaaggtgagtgcagacaaataaaagccggctttgtgggtgttgattgaacagttaaaaatgaatgaatgcgtaaataaaaccagagacagccaagcatgtaccaatgatggcaatgtgttcctcactccccagctttataaatatataattgataaatcagtattgtatgtatttgtattgtatttaaattgtacagtgtgacattttgatatacatatatattgtgaaatgattaccataatcaagcgaattaacatacccatcacctcatgtagttccgtttttccatgtgtgcagtgagaatacttaaggtctactcttttagcaaatttcaagcatgaaatacattattgttaactatagtcaccgtactctgcattgggttaccagaacttactcctaactgcatcttactcctaagtttgcatcctctcactaagatctccagattcctctcactcctgacccctagtaactacctttctagtctctgcttctgtgaggttattccaaaacaaaagccaggttctaggctgttgaggctgagggtaggaagtgtatcaacaggtatacagaatagtcactggtcttgggctaaatggtgacttcaagtgtagtggctgcatagtcaaaaatgaattagatgagtacaaaagtgacgaaatgaaagaatgtcaagaatggaccacaaagacagtgttttatgacctaaagattaagatttatccatttgtgtacaattgtggactatataaaataaaacaagactttgacctcagtggataagaagtatttggatgtactaatcaatatttttggtctgggtcagtggtgggttcatctgtgtttgttgtatttaaaaaaataaatgaaaacattgaaaagggtgagtaggaatcaaatatgattgtcactccaagtctgcgtcatctgcatccgttaggaagaatatctgggttggttccttcttgggtaagatgcacagggacatatgtttgtgagagtcatgattcttgtttttgattagagtggtgaattaatacacactcatttgtaataatacaaattaataaatgaataattgcggagagctatgcttgggccagtggtgagactgtcatgaaccaaagattatgattaatactgtgcttctcacctgatggccattaaaaaaatctaggttttttcatcctttttaatatcagccttgtgttccacagaatggaggctccagagtgaaattaatgacactttgtcgatgaagatcttgattgtgacctctgtggaaaatgagccatgaaccaaccaatgtgagtaatgtttagtgttgttgttttgaagttgggtggttggttgatggttgtttattacattattaaacatgaatcaatacataaataaggtcaaagatgacgggcatgatgagaatgtcatgaaccaagggtgattaatttcatatagcgtaactgttaccaaattaaaaaacaatattactgggctgttctctgtagcaaatgagcaaagaaaaaaaggaacacacacacacacacacacgtatactacatatatatcacatgtatcatgtgttatgtttatacatgtatcctatatatatatcacatacgtaatatgtgttatgtttatttttcatatttgcaggctggggtgggtttatatatgtttatggggtaattaaacataaatggatgcatgtataaacaagatcaaagagagtcaagcatggactaatgaagacaatgtatcatgatctaagatttatgattgcacagctctgcaaattggagagacattgaaacacaaatatttatgctgtttcattcatttcagtagcattccactattaatttatgcactacacttttgcatgaacacttccctattgaagaagtttgggatgttatgtcggtggcagagagtcacatagggaagtaaggtattggtcgttttctgtttgttgaataggattcgtgattgttctttcatgatttttgtttaaagcgataaataaaacttaaaagggccaagcatagataatgaggataatatttcatgtaaagtgaggcttattaattaaattctacacaagtaaaagtcattaaaaatgatccagggtgtttatttttctaatagttgctgtttgttgcacagaatggacaaatcatagtttatatagtcatgcagtatttatgagaatgttgactcttacttgggtagataaggtacttaaagaaaatgtaattaatagttgatgttgttaaatcttggctggagagttgtttaagggtgttcataaatgagtaaatgaatgaatgaacaaacacatgaataaaacaagagagggcaaacatgggacaaaggtgatcatatctcattgtcgtaaattctttttatgtagcttcagcatccgttttcaacctaagtttaactttctcattccagaagcaggcttagtcacccttgacacagtttgcagttatccacctcctccaagttcttaatatgttagatccagataactgccttgtacagccacctccaggatactgcctccctaaaaaacagctagatacactgaccccacagcctatgtggaccacacagatatagtggcttgctctaaatgcaccagtgagaactctctgcaggaaacctgcttgggaaatgccatagcctgcaatacaggctttccccttcccgctggccctgtgaggcatgcaggatctgtaagtaataaactgcttctgttgtttcatttcatgtgttttgttgagttgcttcctctgtgtctcacctgaccaacacacttgaattgaacttctttcctggtcagggatctcctagagaatggctatcttggcaggaatagactagatgtaggtcagacaagaaccacaggggtactgccagtgtaaatgagtttcctatgagagggacacctggtaatggataggatgcttaggcattagactgtctgctgggataaagacgtatcccataaaagatacgctgtaaacacccatgaccacctctcctgcatccccatcaggcagagctagaatttatattcactctcttgagacagacctcaagaccatgttagaagaaagtacaacactcatcatcctagaattatgattattccaattcagttcatccaaggtccctttaaaaatgcattggttaaagagtcagttaatattcttttttttggcatggtggcatgttggatgttgattttagtactaaaaataaataaataattacctaagtgtgtaaaataaacaaaaggccaaaacatggactggtgatgagaatggtccaagaatgaaagcattatagttaattaaattctgactgccacacaaataacctaccctgtttcacttcctttaccagctgttttgtatttcattttgtacatgaacatagtttatttacacgtttgcccataaatagaaatctgggctatttactctgaccaaggagcacacaaagagatgaaagatgacgtcagtgttctattagtggagtaacagattggatttatgattgctcattgcaacttctttagaaatgatcaaatcaaataaaagagtgtcagcataaaccaatgatgatgtttcatgaagcagagatcatgattaatccaattaggttcattagaaaaagttctagaatataacctaagagtattttctagtattgcccaatggaactttctttctttttttttttttttgccttgagacaggtctcactctgttgcccaggctagacctccctgtgctcaggtgatcctcccacctcagcctcctgagtagctaggactacaggtgtgcaccaccatacccagctaatttttgtattttttgtggagacagggtttctccatgttgcccaggctggtcttgaactcctaggctcaagcagttcaccggccttggctcccaaacagctggttacaggtgcaagccaccatacccgtccgcagtagaactttctgcagtgatggaaatgttctgtaatctgttctgtacagtatggtagctactagtccatgtgattattgagtccttgaaatgtggctggcgttcatgagtaactgaatttttaatattacttaatttttattaatttaaatttaaatagtcacatgtggctactggcccatgcaagtctgatatccagtggggcagtcaaattttaaagctactacattagtcagttgtgttaggtggttggttcatggcagttttttgaatattaaatatgaatacataaatacaaaagttaaataaaagcctaagcatggaccagtgatgaaagtgtgtcatgaaccaaatattatatccatacatttctcaacagatgaagtccattatgtaaaggtttctgtttctccagttatggttaaggatgaaaagattatctatctatctatctatctatctatctatctatctatctattcatctatctatctattatctatctatctatctatctatctatctttctatctatctacctacccacctatctattatatatctatctatctctataatatactactgtttttcttggttttgatggtagattcgtggtgttttacttgattatgttataaaaatcaataagtgaatacatttttaaaattcaaagaccttaaataaataggttatctgtcttctatatggtaaatattctatagacacgaaggtcacaagaaccactcccacttacaaaaagaataggaggcactgagcagtgccaccccacggcaactccgtagtcctgctgggcagatgatgtgggctctccttacctgggcctgtcactcatataagtggggacacatagagaggggtttgtaatggtcatcattctcatttttattttaggtgattcactccatggtgttcattaagttaataattaaaataatcaattgattaagtcaattaagaatgaagtgttaattgtgggtcagtggtgagaaagagggccagccatggaccaatgttgagaatgtggcacaagccaaggattatggtcaatccagtatattaaaattttaatatttctttaaaaagtttaaatctagtctctttcacaccttttcacacctgctttctcttctacagagtgagtgcaccgcaggtgatcagctattctgtaatgatgagggccgggctgctttctctgtgggcaaggagcatggaggctgatgacaggacagtcagggtccttgttcttggtttggatgatttgctcatggatgttgactgtattatttaaaagaaataaatagctctacatattaaaatattgcagaacatgcatggaccaatgatgagaatgttatatgaatcagtgttcatgattaatccaattcaacaccacttctattaagagtacagtcaggctattttatttgtgctgctggcagtttaatattcatatacattttacatcactgttgatttaaacagtcctccattgatatacacctatgccattaactgcttaagagggtatcacaaaggaagattgaaagtaattatcagtattctattgggcaagaagatggtggatttatagtagctcattgtgtcatctttgaaatatagacaaattaaaagaaagagggctaaggatgggccagtgataactgtggcattgctatgtatgaagaatgttgattgatccattgatccatgtgtgtcatactgagatgcgttataggaagagatctagtgtattatctctgtgggaaattagattatagacatgcacagtctagtatcatcagtgctagccactggagctactgtgcacttggaatgtgactagtctaatcgacatgtgatctacatggaaaaatacacaccgagtttagaagcctcaatatgaaaaaggtaaaatatttctagaattatttatatttattaaatgatagtattttagatattgggctaaataaaatacacaattacagttgatttcatctttttctttttactttttaaatattgtagcttctagaaaatttacaagtattcgtgtaggtggcattatattttttattgctcagcactgctataatccaatgagaggaatattcaattttatgtttttctaatccatgggtactgattgtattattattggctaatcagtgatgaatcaatgacaagtgaataaatgaatgagaaaaaaatgggaacagcacatgctaaacattaaagtgtatactgctgaaacaaggattattttccttttttttttttttttttgagacagagtctcactctgtcacccaggctggagtgcagtggcgcagtcacaactcaccacagcctcgacctctaggcttaagcaatcctcctgcctcagcttccctagtagctgggaccacaggctcatgtcaccacacctggctaatttttttgtattttttgtagagatgaggtttcaccatgttgcctaggctggtctcaaattcctgggctcaagtgatccacccgccttggcctcccaaagtgcatgagccactgtctggcctattataagtagtttttattaagcaccaaaacccgtaaaaataatggctatggtttaatggttaattcttttaggtaaggatggttagtttgtttaggtaaggaagacatgaaaagatcatgtaataatcgatgctgttctgtgttgttggtggtgtcttgctagtcttcagttttttgtttcaaagaaaattactgacattaacaaatacctgattatgtagctgactaaatggaagaggatcaagcatggcaagtgctgagtgaggattaatccatgtaggcactactgaaatccactgtaagagatacccagtctcttaccttcatagatgggcctgtagcagggtcttgatcttaacccttttatgcctcatggtagtgattacattagtatagtgtaagtgaatcgatgagtaaatcattaaacaaattgaacaaatgtataaacgaacttttttttttttttggaaagggagtctcactctgtcgcccaggctggagtgcaatggcgcgatctcggctcactgcaacctccgcttcctgggttcaagcgattctcctgcctcagccttctgggtagctgggattacaggtgcctaccaccatgcccagctaatttttgtattttagtagagacggggtttcattatgtaggtcaagctggtctcgaactcgtgacctcaaatgatctgcccacctaggcctcccaaagtgctgggattacaggtgagcttattaaacaagtgtgtaaatgaataaaaaaagaaagccaagcatgaaccaatggattattattatgtttttgaagcattgaagtcaataaaatacacacaagcccagggctggatggttgctcttacttctaagggaaagatttttacataaagaagaaaatggaagaggaccagtgttgagaatgtgtcaggtgataagaattaatattaatccagttctagtcattgagttcattgaataacaatgagaatgaagatctagttgattatctctgtgggtgatgggcagattgacagatgttagttttattcagagtttttgaacagttttctttggattctcagctatggattgtaagggaatgaatgaataagtttatgtcacaataagttaaaagaggacagatgacagaccagtgatggtcataaattttgaagcaagtattaggataatacatttctatactgctgatgtccatgtaaaggatataatgtctggactcctaaatgcttaatgttcacagatgtgttcttgttatagtcagttttggatgctggtagatttatccttcttaattttctttcaaaagatagatatgagattaaattaacctattacaaattaaatagtaaataagcaaatagatgaatacataaagagggacaagaaggatttgtcaattaaataaaattttattttattttaagaataaaataaaacttaaaaaaagaatgagcattggtgaaaatgtaccctgaaacaaaatttaagatcaatataattctgaacaagtgggttccactacaaaacagatggaagaaaataacttcattcagtttacaattgtttaatatgtcattttttcaccactcttaatttacacattctgccattgataaagatttaggtttctaagctattgacagagaaaacacaagtaaggaaaaaaatgttgtcagggaagtaaaacaagtggttcctttatgttctttgttaaatgtttaaaatttgaaaaagttgaggaaaggctagagaaagagggccctgcctggaccacattgagtgtgggactgtataaggattttggttggtccatatgtgtaacagtgagatccactgttgaaggagatttggtggattagctcttggagaaattagcctacatctatcagttataatattcatatatcttattcttgctttgttgtgattcatgaatattgataaagcaatttttgtcaattaatgaattaaatcaataaacaactgtataaataaataaaaatgtctcaaaactaaaccaatggtaagtaccctgaggtgcttgaatcaaggattttgattaaactatatgactctaggtccattataaaaacaaacctaatttactgcctcagtgggacatgagcttgtagctgcagtgaggaatataggcatctcgtgcttgggattttgcacatctgatatgaatcctattattagtagtaaatcagtgcatgagtaaataaagacacataccaatgaattcagccaaagagggctggatatgcaccaattatgagagtattattctaagtaaatgaaggaagggattatttatttgcttatttattttttattgacagaatgcttttttattatctatagcatcaagaacaatacttccttcatagcaatgacaaaataaaactataataataaaataataaaaaataataaaaatgttagcagtatagctaacaattgtttactatatattaatcactgagcaattttttaaaaattttctatttttatttcaatagttttgggggaacaggtggtttttgtttacatgggtaagttctttagtggtgatttcggagatgttggcgcacctgtcacctgagcagtgtacagtgtacccaatgtgtagtcttttattcttcatcccctaccagccttcgccctgagtccccaaagtttattatgtcattattatgcctttacatcctcacagcttagctcccacttataagtaagaacatacaatgtttggttttattcctaagttaattcactgagaataatggtcttcaactccatccaggttgctgcgaatgccattattttgttcctttttacggctgagtagtattccacagtttgtgtgtgtgtgtgtgtgtgtgtatatatatatatatatcacattttccttatccacttgcagattgttgggcatgtaggctgatttcatatttttaaaattgtgaattgtgttgctataaacatgtgtgtgcaaatgtctttttcatgtaatgacttcttttcctctgggtgaatacccagtagtgggattggtgggttaaatggtagttctacttttaattctttaaggaatcgccatacttttttccatactgcttgtactagtttgcattcccaccagcagtgtaaaagtgttcccttttcaccacatccatgcaaacattgattaacttttgatagtttaattatggccattcttgcaagactaaggtggcatcccactgtggttttaatttgcatttccccggtaattagtgatgttgaacatttttcatatgttttttgggcatttgtttatcttcttttgggaattatctattcatgtcctttgcccactttttgatagattttttttttgtgtgttttgtttttttgctgatttgtttgggttccttgtagattctgaatattagtcctttgtcagatcatagtttgcaaatattttctcccactctgagaggtgtctgtttactctgctgattatttcttttgctgtgcagaagctttttagtttcattaggtcccatctatttatttttgtttttgttgcacttgtttttgcattcttgatcataaactctttgcctaggccaataactagaagagtttttctgatgttatattgcagagtttttatggtttcaggtcttagattttaagtctttgatccattttgagttggcttttgtttaaggtgtgagagatgatgatccagttttattcttctacacgtggcttgccaattatcccagcagcatttgttgaatagggtgtccttttcccactttatgtttttgtttgctttgttgaagatcagttggctgtaactgtttggttttatttctgggttctttctccttttccattggtctatgtgcctatttttatacaagtatcatgctgttttggtgactatagctttgtagtatagtttgaagttgggcaatgtaatgcctccagatttggtctttatgcttagtattgctttggctatgtgggctctttttcagttccatatgaattttaggattatttttctagttctgcgaagaatgatgatggtatttggatggtaattgcattgaatctgtagatttcttttggcagtatggccattttcacaatattgattctatccatgcatgaacgtgggatgtgttttcatttgtttgtgtcatctatgatttctttcagcagtgttttgtagtttttctagtagagatctttcacctctttggttaggtatattcccaagcacttttttgttcttgttccagttgctgtaaaagggattgagtttttgatttgattcttagcttggttattgttggagtatagcagtcctactgattgcatgaaagggattatttaaaagaggacaaacatagatgaataaagttaatgtatcattaaaaatgttcatataaataaaaggggactagggttctgcacactgtggataaagaacatagagtcagttatttgtaataatattgtaggccattttgcattttccttgaagaaaataaaaatactaacaaattattccatgagtgaataaaaaataaacaaataaatggattcataaattaggatcaaacatggaccattggtgaaaatgtgttaagaaatggggacataaatttatccaattctaatcaaggaagacctataaaaaagatcaccttggttcttacctatgtgggtggggcttaagtgatagaatttggaacatgcctagttttttattattttttttagggcacaggtttgggagttttcactatattgcctaaattagtaatttaaaaagtcaataaataaaatcagggccattcttgggctaatgatgggaatttgacaaaaactggagttttttttttccataaatttggtacaacaggacttaggtcccttaaaaaaaatctaaatctgtgctgcttcttgaattttctaaaatctagtttttactccacattctgtatgccagatctgacttatttgttatccaatgatggagatcatggctgtcacttatgtggataagaagcagagaggcacgttaagtaacagagttcttgttcttgctttgaagggggctattcatgttgtccatggaattaattcaagggaatgaatggctaccacaaacataaatagaattaaaaaatgctgagagagtggatgtgaagtgttctcaccacaaaaatggcaactacgagaagtaatggttatatcaattagctagagttagtcatccgacaatgtatatataattcaaaacatcatgtcgtatgcgataaatacacataattttatctgtcaattaaaaataaaataataaaatcaaaaccaattaaacaatgccatgcatgggcaaatattgggaatatgtaatgaaccataggttaagatgaattcattttagtacagctgaagtcccttacaaagatgaatttattttggtacaactgaaatcccttacaaacataattggagggggttgtattcattttcacagttgcttaatattctactctattgtgcaccgtattttaagaagatttctctattgataaagatctaggctttttcattggtggggagggagcacctacaaatactgaacaaattgccagtgttccagttgtggaatgaggtgatagggtgttcattgtactgctattaagttatgagtaaattaagcgaaagacgattgagcaaagagcagtagcacacgggatggttaggaagcaaggttatcgattaattataggcacagtctgaggcccaattaaaaagagatctcgtctaccagctctgtgggaaacaagcctggaaatagcattctgcagcagtcagaggtcttgttcttgggtttttgtgattcatggatattaaattattttgtgggtgaaaccatgaatgaaataatatgcataatcaataaacagtgcataagtaaatacatgaggaaaaagtgagtgatgaatagttctgtggcatatgaatcattaattttgattaaaccctaaactctgaagtccattagaaagagaccttgctcttctctgtaagagagtggaattcagagtaaaagttcagtttcttgggctttagtgcttcctaggtagggatcataaatgaatcgatgaatgcattaacaaagaaatgtgtaagtgaagataaagactgtcatatgtggaccatttatgagagcatgtcatgaaacaagtatttctaggaatatatttgtagaatactgaatttcaatataacatataggcaaaagctgtcatttggagtacataggagctgcagacacgcagaagcacatggacagatgcatctaagtgtccatgttggcattctggattggtaagaggttgctagctgtcagcttattgagaaggaaaaatatttacacaaacaaaagattacatgactgtaatagaaaaggagcaaatatgtgccaatttgaggatgtgttacatgacaccagttatgatggatctaattgtatccactgaattttataaaaagcgacaaaaaatggcaagggatagagtcggttatttctatgggttgttttgttttgtgttcaagttcaagtgtagagtctgggatctctggtaattatatattgttttttaagttgaatgaatataattatatctcaagggccaactctggacagtgtggagcatgtgatgtggaataaagcttatgactaatcccgttctaccctactggtgtccttatagagaaagtaggatctaggcgcttctaacttgggttaacttgggttaagttcatagagagggatcatagaatatttcagttctgggctgctggtgggtttaccatattttattgagagagggccaaacacgaaccaatattcagaatgtgtcgtatgaccagggttataattaatccaacattatttagtgagttttatttttaagaaaattaaaagaggattttttgggctgtagctatgggctatgaatatgtagacagatattgacagttcttatcctttgtcttggagtccattgttattgatatgttgttctaagggaataaaggaggttattcatatcaagatcaattatttaagagaaggccaagcatgggccagtgaggaacaggtgttatgaaccaaagataatgattactccagttatactctaatgttgtccagataaatagagctccaggttgcccctgctttggataaagcacacattgaaatttccatggagtaattctttagaaaaacagatatgtaatttattccatgcataattgtatatatgagtaaataagtgaatcactagacatgtaaatcagaaagattttgcatcattaatgagaatatgccataaaacaaaggtttacatttatctaattttgcacaagtgagatccactaaaagtgatcacctatctggtaaatttatggatctggagtatgtagacagatatttatgatagatatggctcttattctcatgttgatattcattgtattatttaaaagcccaaactacacaagtcaataaataaggagtgccatttttgggcaatgatgagatgaccgaagtttatgattaatctaatactgccaaacaaatttccattaaaaagtctaactgtagggtctttctttctcttgaaagtatgtattttacttcaccaaatgagcacattatggtgaagaactgatttagtcattctctaatgctaaagatcttgccttttacttctgtgggtaaggagagaagagatttatgtaagtaacaattagtgtttactgttcttggattgggaggttggttcatgggtgttgcctgaatttattaaaataataactggatatattaataaataaaactaggtaacaccaatatgtaccagtgatgagaatatgttcagaattgggatttatgattaatctgatttggtactagtaaaattcaataaaaaagatacagggtatttcattcattttcagagatgattcagattgttttattattgcgttgtgattcagttaagtacctctccattgataaagatttaggctattaattccttgagggaggagcacataggaagatggacagtgttgtcagtgttctagttgtgcagtaagattatgattccttggtgattcattataccatatttggcacttgaaaaaggaccaaccgtggaccagtgagtagcatggagctgacatgaaagaaggaagttgattaatttataagtgccaaaagtgcatatatgtatatatatgtatacaaactcacacacacatatgttgcagaaagtgacttccatctattagctctttggtcaatggacatatatacaatcattagtattcacagatgttgttcttgagctttttgattcatgagaattgattatactattattattaatgaatcaatgaataaagaaataaacaatgcataaagtatgtcaagtatagccaatcattagtattctgagctgtaggaatcaaagattttgattagattctgtaactcagaggtttattagaaaaaagaaactagttatttcgtctgtgggaaaggggcttacagcaaaagttaggaatagccaaagatctgattctcagttcttcatgcctgtgaactgtatgagaagtgaaccaatgcaagaataaagatgtagaaattaatgatggctaattatgcaagtctttaatgaaacaagggttattactaattattgttattttctgaagcactgagtttcataacataaatagattaagtgtcccttactattttccacaaaagacatatctaatttcacgagagtccctgttgtaattttggattgatgttgggttgtcggttttatttagaaaagaaacaaatcatttacattaaaagtaattgttccaataattgcctaattgaaagaaggccaggtgtggactaatactgagaatatgaccataggtcttattaatccaattctgttcactgaacattatctaaaacaacaaaaatgatctagccatttgtatttttgggcagtgagcatacaaacagatattagtcagtgttcttgtccattgtcttggcttttattcattttgatgtattgtaaaaagtgaatgaataaatgagtttgcgtttcaattatttaaaagagtatggaggattggccaaagtgtcatcaaacaaaaataacaattaacccatttttacagatgaaaaataaaagaaatctacatggatcccactttggacaaagtgcgtgtcaacagttgcatgaaatggtatttcacttcttgattattgtttgtttttattctttttttagaaaaaatgaataaatgatcaaattattttgggggtaattaaataaaagaaagaacacaagtgagtcagtaaatgcttaaattaaggtagatcttggatcattgcttcatggcacactctcagaaatgctcaaatatggtgccttaaaaaaattaatgaggtttgggtgttgatgtggttagggagtatacagatagatagttgttagtggttacatttattactcttgcattgggtggatttaagggttcattatattaagaattaaacagtaagtaaattcatacataaaaggtatggttattcttgagtcaataatgagaatgtgttaggaaccaaggtttatgattaatctaaaataatttctaaaagaagttaagtctttgctgtttcgttctttctaaaatgtgtattttccttcacacaatgaacatgccacagctaattattcgataacaataaagacattggtgttttgcctctgtggttaaggagctcagagtctgttgtagataatagttaaagttcatgtcctgggtttaggtggcttgttcatcactaaattatgttagaagaataaaccgctaaatatatacatatataaaaagcataccatacaagaaccaataatggaagtgaaccaaggtttatgattagtttaattcagcccaacttaggtccattacaaatgatggagggcttttattaatttcagaggtttttaatattgtattttattttgtgccgtggttgatttacacacatttctttaaagttaaagatcaaggctattcactcctctagggagaagcagataggaaaaggaagatagtgtcagtgtcctcattgtgagttaagatggtggttcacagttgttcattctattgtattattatcttttgctgtgtaatgaattactgaacaatttaatggattaaaacaacaataaacatttgtcatttctcacggtttctatgtggcaggaatccaggagaggcttactgggggcagttttagcttagggtttcttgtgaagttgcaggcaagatgtcaggttgagttgcagtcatctgaaagcttgactgtgctagagtgtctgcttcacttacatggctggaaagttggtgctgattgcgggaagccacagtttcttcacaaatagactcttcctcaggactgcttgagtatccttacaacatggcagttgatgtcccctagagcagtcaatctaagacagagaaaggtggaaccctcaatgtattttataatctagctccagaagtcatacaccatcatttccacagtattctgttggtaatacaggcggtcatgatttaatatgtaaagaagctacacaaggctatgcataacaggagcatgggccttgggagccatttggaggctggctacctcatgtactatctttaaaatatggacaaattaaataaaagaaagtctggatgaaatattaatgtgagattggtatgaagcaaggaagtgtagttaattatttgtataatgcttggatccattctgaaaaaatgcagtatcacttctatggaaaataagcttatagatctcagtaatattcaaggatcttgttcttagttttttttgatttgtgtctattggctttgttgttagtgattcaatgagtgaaacaataaacaaaggtatgaatgaatgaataaaaaagaaatgctaggcctagaccaatgatgagtattctggggtgtctgaatcaatgattttgattaaaccctgtaactctgaggtccattataagaggagacctagttaatacctatatggtaaatgatattatagtggaagttagaattatttgggattttgttcttaggtggttgaagttcataggtgtggattgtattactagaaaagatttagtaaatgaaaaatgaaacaaatatgtaaataaaggaagacaagtagagccatatgttgcctaattatgagaatgtataatgtatttattattattaacacacttctgaagcactcagtttcaacataaattgattaaatctgatacctatttgggtaaggaatatacatacagagacaagtacctagaaatcagtattgtttgtcctgcattatttagatgttgctgtttcttaatgaacacaagaaaatatgatctagtctgggaatcatgagcaaatgacaggtgttaacgccattcatatttctgatgcaatctgtatgttcacagatattgatgatgtcatgagtgaatgtatacacaggagtgaatgtattcagttatttgaggaaggtaaagcagtgtttcttgactttggctctattgacattttgggtaattctctatggtgcaagattgtcttgtatattgtagggtgtgtagtaacttcattggcttctactcagtagatgccaatgttgaccctcctcccagtgtgacgatcaaacatttcttcagactttggcaaatttcatctgtggggggcaacattgtccccagttgagaaccactgaggtacaacatggactgaagaggagcatgtgttaaaaacgtgtgaattatttatcctgtagtatcttactgatgttcagataaagaaaaagcaaaacaaaagacctaaaactaggctcttcccccacggggtcaggttcatgtgtatagttgcatttaattgtattacgattctgggttgttgatgggctgatcatactgtgttttctccgaaaaaacaaagaattgttcatgagtacttactaaatgaataagtgaaatgacaaatgaataaagaaacacataaaggagagtctagcatggactattttggtgaaaatttaccataaaaaaagtggttaaatttacctaattctgtactgtataaatgagatccattattgggaataaagttcagatttttaccatctgggtagaaaacacatagatggatacttgtagtagcttttattcttgtgttgggtgccagataaatcagtaaataatattccaggccattcttgggccactgattaaaatgtggtgtgaataagagtttataattaatctagtactgtcctacaaatgtcccttgaaagatttaaatgcatgtaggctgttctttcttaaatctactcttactttacacaatagatgcaccatacctgatttaattatttttcagtggtgaaaattatggcttttacttctgtgggtaaaaagtgtaggaatggatttaagttaatttttatattcttgattcgtgtgggcttgttcatgctttttattattttagagaaataaatgggcacatatttaaataaagtaaaaaagctctgtgctgtgatcgcgccactgtactccagccttggcaacacagtgagactctgtctcaaaaaaaaaaaaaaaaaaaaaaaaagctctgtgcattgcccagtgatagaaatgattgtaaacaataacaaaattctatttccattcgacacaactgagaacattaaagaaaataagttagagggtttttaaatgacttttagagttgaggattattccattttatttttgcaccatagctaacttatatttcctcaagtgacctaatctgttgaacatatatatatatatatatatatatatatatattttttttttttttttttttttttttttttttgagacggagcctctgtctgtcaccaggcaggagtgcagtggtgagatctcggctcactgcaatctccgcctcttgggttcaagcgattcttctgcctcagcctcccgagtagctgggactacagacacgtgccaccatgcccagctaatttttgtatttttagtggagagaaggtttcaccgtgttggccaggatggtctcgatctcttgacctcgtgatacgtctgccttggcctcccaaagtggtgagattacaggcgtgagccacggtgcccggccaatctgttgaatgtttaagggcagtacatagacaatggtttatattgtcagtgttcctattgtggggtaagatggtgtgctcgtggtcatttattgtgccacatttaaaatacagacaaattaggccgggcactgtggctcacacctgtaatctcagcattttgggaggctgaggcatgcggatcacccgaggtcaggttgccccggctggagtgcagtggtgcgatctcggctcactgcaacctccgcctcctgggttcaagcggttctcctgcctcagcctcctgagtagctgggattacaggcacacactgccacgcctggctaattttttgtattttagtagagacagggtttcaccgtcttgaactcttgagctcagacaatctgtccgcctgggcctcccaaagtgttggaattacaggggtggaccaccgcgcctgtaattttgggttcacagcaaaattgagcagaaggtacagagattatttcccatatgccctttgtccttctgcatgtatagcctcccctgttatcaacatccaccccattagagtagtgcttttgttataatctacattggcatatcataatcacccaaagtccatagtttacaatagggtgcactcttggtgttgtacattatgtggttttggacaaatttataatgacatatatccaccattatagtatcatacaaaataccacaatgctctgaacatcctctgggttctgcctagtcatccctccctcccctaccaacccgtggcaaccactgatcttttattgtctctgtagttttgccttttccagaatgtcatacagttgaaatcatacaatacgtggccttttcagattggcttctttcacaagtactctgcatttaaggttcttccatgttaagcatagcttgatcgctcttttttttagtgctgaataatattccattttctaggtttaccacagttgatttatccattcacctactgaaggatatcttggtttcttccaagttttggcaattatgaaaaaagctggtataaacgtgtgtgtgcaggtttttgtgtggatataatttttcaactatgggtaaataccaaggtgcatgattgctggattgtatggtaaaactatgtttagttgtagaagaaactgccaaactgtcttccaatgtgattgtgttgattttgtattcctaccagcaatgaatgagagttcttgtgactccacgtttttgccatcatttggtgttgttagtgttctgcattttggtcattctaataggtgtgcggtggtatctcgttgttttaatttgcattttcccaataatatatgatgtggagcacgttttcatgtgattatttgccacccttatatctttgttggtgaggtgtctgttaaggtctttggcccattttaaaatctgatcactttcttattgttgagtgtttttgtttgtttgcttgtttttgagacagagtctcactccgtcaccaggctgatcttggctcactgcaaccgccatttcccgggttcaagcgattctcctccctcagcctcccaagtagctgaaactacaagtgctcgtcaccatgcccagctaatttttgtatttttagtagagacggggtttcaccatgttggccaggatggtcttgatctcttgacctcgtgatctgcccaccttggcctcccaaagggctgggagccaccatgcccagcctattgttgagttttaagagtattttgtgtattttgtataatagtgctttatccaatatgtcttttgcaaatatcttctcctaatttgttgcttgtcttttcattttcttgacagtttctttatggagcagaaattttgaaagttcaaagatcagttgattatatttatgtgagtctatttctgggctttctactctgttccattgatctatttgtctgttcttttgccaataccacactgtctattactgtagctttgtagtaagttttgaatatgggtattgccagtcctccaactttgttcttctcttcaatgttgtgttggcaattctgggtcttttgcctctccatgtaaactttaggacagttttgtcaatatccacaaaataacttcctggggtttttattgggattgcattgaatcaagctgggaagaactgacatcttgacaatattggactttcctatccataatctccataacttcttccacaatggctgtactaaattacattcctaccaacaatgtagaagagttcccttttctctgcatccttgccatcatttgttacctttcatttttttgatgaaagccattctaaaagataagagatgatatctcattgtgattttaatttgtgtttccctagtgattagagtgactgataatttttttatatatctgttggccattagtatgtcttctttgggaaaatatctgtccaaatcatgtgtctatttttaaattgggttttcttgctattgaattgtttgtgttccttatatattttgcatattaacccctatgagatgtatggtttgcagatttgttttcctgacctggaagttgtctcttcattttgttaattgttcctttgctgggcataaggtttttaatttgatgacattctacttgtctatttttacttttgttgtctgtgtttttggggtcttattaaaaaaatcattgtctatgccaatgttgtggagcttttcctctagtagttttatagtttcagattttatgttgaagtttttaatccattttgagttgatttttgtatattgggtgagataaagatctaatttcattctgcatgttgataaccagttttcccaaaaccatttattgaagatactgtctttttcccattgtgttctctcggcacctttgtccaaaatcaattgattgtaaatgtgtgagtttatttatgaacttttaattctgctccattggctgatgtatctgtttttatgccagtattatgctgttttgattataatcactttataatatattttgaagtcagggatgtaatgcctccagctttgttctttttgtttaagattttttgtatgtggctattcagtgtcttttgtggttctatatggatttaaggatttccccccctatttctatgcaaaatgacattggaattttaataggaattgaattgaacctgtaaatgggtttaggtagcatagacactttaacaattttagttctttcaacccatgaacacagggtatatttccatttatttgtgttttcttcaatttctttcactagtgttttatagttttcagcatacaggtctttcaccatctaggttaaatttagacaatatttttggtgctattgtaaatgggcttattttcttcatttcaagttaattacctattaggatatagagtcactactgaattttttttgatgattttctatccagcaattttactgaagtcatttatcagttctaacagttttttttttttgtgtgaggtagtttggattttctgtatataaaatcgtgtcatcagcaaatagagacaatctcacctcttcttttttctataaagatgccttttatttcttcttgttcttctaggataagtctacttttcttccacgtaacaaccacaggatagatgacattcattttctaagaaacaaaatcttggcagttagatccgtggggtaaagaatatagatactaatgtaagttaacacctcaagttcatgtccttggtttggatgctttgttcaggagtgtttagtggtatttcaaaggaatcaatatctataacaaattaaaataaccaggaatggaccagtgatggaaatgtgttccgaaaatatgtttaatataatttggcacaactgaagtgataaaaatatagtagttagaccatttatattcacaattatttaacattgtatcttattttctacctcaaatgatttaatcttttccatattggtatggtcctggccgataactctttgtgtggcagcctgagagaatatggaagacactgtcagtgttggaagatggtggttttatcacttttcattgcactgtctttaaaacatgggcaaattgactaaaagaagactacagaagaaataatggtgattgtgaatttggtatgaagcatggatgttaattaatcacacatgttctctgaggtccattgtaaaaggagacctagtcttcagggagagagccactaatggggagatcttattcctagaattttgtggttatattattattcatgaaccaatgaataataaatgaatgatataaaggaagaaaaacgtgcttggaccaatgatgagtaccatggggtatctgaaacaggatttttgattaaacccatatgcaattctgaggtccattacaaagagacacgtattattccttttttgggaagtgagcctatggtaccttttccttggactttgtggttcttggggatggattgcatttttgttataaaatcagcccatgaattaaaaatttatcaatgagtaaaacataaagcataagtcatgtacttattatcagtgactgtaatgaaacatggattattattaaaacttatctgagactcccaataaattaatacccaaggcttctaccattctggtaaggagcatatggtcatttgtatgcaagagtcagtttttgttctgtgttggtggtgggttgctgactattttatgaagaaaatgaagcatctttaatcatataaatagttggttaaataaccacttaattgagaccaagcagagaccaatgatgagtgtattaatctattttttaatggatttttattaaacaaataataaaagaaacacagtctattcttcctgagggcaataactctagacagatgtaaatattcttcagtgttcttgtccagtgctgtgagatcacagatactgatgtcttttgtatatgagaaggaacttgcatttttatgtctcagtttatattttagagtcagcaaaccatggaccaattaggaacaaatgttatgatatgagaatgctgattcttgtttttttttttcatgatagacattctaagaaaaactctaggctctctcattgtttttggaatacatacatggttctttccaagtagtttcttagaaaaatgtttttaaaaagaggcttttaaaaagagccttttaaaatgtttttaaaagaaggctttatttttctctatagaatgaaaaccatgtagctggtcttattattctctaatcatgaagaccattattgttatttgtggactaaggagcagaaagactgatgtaagtaaacatcaaattgatgttttgggcttggactgtattcattcatgggaacccactacattattttgataaaataaatggttaaataacacatgaaattaaggaatgccagtcatggacctatgattgtaatgtgtcatcaacaaaattttatgattaattcaacccaacccaactgaagaccattgttaaataaaggaagagcatttcatatattgtcatagtaatttaaattcccatttaatgtttttgctatagttgcttaacatattccttcacggacagacattgaagttgttgagtttttgaggtagaggtaccttgggagatattatatattaatttgcttaattgtgggctcacatggtagatccatggtttgcaatcacattaatgagtagacaaatcaagtggaagggaagctggtagacaccaatcataagtatgagatttaaatgcagcagagtcgctgatgaatctctatgtgtaaacttgaggttgatcacaaaatatgatctagtctatttgttctgcatgaaagagagtaatgaacagatcttggttctattaaagacttctgttctcagttttgtgtcattaagggatattgatcatataattattattcctgaaaccatgaatgactgagtcagttcaacaaggtataaatgaatgaagaaatagaatgcctagcctggatcaatgatgagtattggtggaggtgtctgaatcaacacttttgattaagccctctgtgtaactctgagatctgttattgaatgagaaccagcctatattctctgtagaaattacctaatagaagttaggaaaattcaataaaacttgttcctgaacttttgtagttcaaagatatggaatgtattattttaagtgaattcaatgcgtaaatagagaaatgtgtatacatgagagaagattaacagtcctacttatggaactattctttgagtacaatgaaaaagtattataaatattaacactggcaataaaacaagtataattattaatctgaggtaaaatcctattatacagaacatattgtatctgcagttgagacaatttttttggttttatagtttgctttttttttaattaagaaaagggaaagtgtttgcatcagccagaaatccattaagtaatatctacttaacagatttttatatagacaaatattcataatcattacagatcttattcttgggctaggtgacgcattagtgtctattatactatttaaaactaaaagttcaatactggcctgaaaaaattgcatttttgagccaaggtttattgttatctagttctgcttgactaacatccattgagaaaaccgtatatctattctaaatctgcctttttccctccagagtggacataggccagctgatttaataatttaagaaagaactgttatcctgagtaaggagcatagagacaaatataagtaagttccttatttcaagttctttctttgaatggtttgtttttgggtgttagctaaaggatttcaaaggaatcaatgtctacatacgtgaaataaataacacaccccaaatgcaccaatgatgggaatgtgtaatgaaccatgaattatgtttaatctaaatcgtcacaactgagttgattataaaagaagacaaaagttaacttattctcagagcagctcaacattattctttatttcatgccatggttattttacacgttcccttatgggtagagatcctggctgacatccgttttggggcagcgcatgagaatatggaaataggtgatttcgttgttttttatcaggccatcgttgacatatgtatgaattaaatagaagtgggctatatcagaacgaatgctgaatgtgaactgagagcatgcaggggcattgaccaattcacatgtgcacctttacgtgtcatggcctaagaaatgtagtctagctctatgggccaagagcctaaaatttaatgatcttgttttggggatttttgattgtatcgttatttgtgagtcaataggtcaatcaatagatgaaaaaaatgcacatcatggaccagtgatgaatatcatggggtttctgaaacaacatttttgattaaacccatctgcaactctgaggtccattacaaagagacacctctttattcttcatggaaaatgagtctaggaccttgttcatgggccttttgtggtttgagggtatgaattaattattataataaacttagtccatgaatatagaattttatcaatgaatgaagaataagaaaggtatgcatgcacttacctactaaggcatgtaatgcaacatggattattattgaaacaattttgaggttcttagtcccaataaattagtggctaaggctctattcattttggtaaggagcatatggtcatctgtgcacaagactgaatgtttttgttctgtgttgaggcaggttactggttgatcattttattaaggaaaaagaaatacatttacataaataaatagttgactgagtaactgtaattgagagagggagagcatggaatgatgatgagatctatatacaacgacactcatgattaattcagtcttttatggaattttacttaagcaaacagacaagtttggtactagattcacagcgtttattatattatctaaaacaaaaaatttcatggtgagagatatttcatcttgacaaaaacaatttatgtaagttaataaatagaagtgttctctcttctcaagtgttcagaatagggtacaaaacaaggtttatgattgtttactacagagctatgattcattttaaagagctaaacatatagtatttgattctttttaaaatttgcgttttatgctgcagaatgaacgcactctacctgatttaattatagtcttctggtgaagatcttgctgttatctctgtgaatcaggagagaagagattgatgtaagtaaaaatcaaactttgtgttctcgcttgggaaacttgatcaagtttattcattgaattatttcaaaggaataaaaggctacatacataaatgagtcaaaggtggttatgcatggaacaatggtagaaatgtgttatgaattaagaattatgattaatccatttcagcacaacgaaattcattaggacaaaaagttgaaaggtatttctgtcattttcagaatgccttaatatgctgtttttgtaccatagtggatttaaatacttccccattgtgattgttattgacagttaactaattgagggaagaacataagaaaatggaaaaccttgcctatagctgtggtataacttggtggttataccatgatataaccatagtaacgtcttaaaaatacggatgttaaatgaaaaaagcccaaccatggactaatggaatatatggaattgacgtggtgcaatttgtggaatgaattaattcacctttgcaatactgaggctcattacagagagagccagtcctctagttctgtggaatatgaatcttacagacatagttacttcttcaaggatctttttgccctctaattcatggatagtgattttactattagtgaatcaatgcctaaatcaagaacagtataattgaattaaagcacagaataccaagtctggatcaatgatgagtatgcgtggggcatctgaatcaaatattctgattataccctgtctgtatctctgaggtccattgcatctatgggaaatgtgcttggagagaaagttagacatattcaaggaatatgtttttggtcctttttggttaatgggtatagattgtattataagtaaatcaatgaatgaataaagaaaaatacaaataaagacaaggaaggcttcatttcattcaattatgaaaggagctaatgatgttttgagtttatataagtctgctcctccttcgagagcatatagatagatatgcactcagtgttccgagttagtggcaagtttctggttgcgtgtcttgtttgatttagaaagggataaaacatatacttaaatgatgtatttagtttaataatacttaatataataaatattagccaataaaattaacattcatattcaataataacaatattgcaaatcatgctaaacacattaacataatttttataataaacaacaatttaatacaattaataataaacactaaaatactaatgattaggttgtgaaatgtggagaaagtctaaggatgaacgttgaaaatttgaatataataaccaaaaatcctcttatgtttgctcatttttatttaaaaagaaaaatgcaaatgcatttttatgactttcatgagtaataagtgaataaatagatgctagtgtcatgaagggtttttgtccagtgtcttctgaattcatgaatagtggcactattattatgagtaaaagaatcattttatatctccatcccttatttaaaagagggcaaatcatggactagtgagaagcatatgtaatgtatgaaagggtgtgattaatcttgtctatcctcttgaggtttacttaaacaaaaaggtccaggaccctccttcctttggaagggttgtgaagacccactctctagacatattttgatattaacatttaaatggaaattaattaaaaataaaaattcagttcctcagtcgcactagccacaccccaagccacatgtcgcaagtgaccaccatttcagaattgccaatagagaacactcgtatcaccgaagaacgttcccacagtgcatacagggctaatatgaacagttgcaggtaatagtatttaattttaggtagcaggtgtcttcaccattttgagttttctttagaaaggagagtagataattaaattattttttgagttattaaatagatgagtaaataaacaaatcagtaaatagtttgaattaaaataactgtggcccactggtcagattgtgttataaaacaacaatttaaattcgtcttatagtgcaaaagttttcctcattaaaaatgtgtcttccctttatgctaggaatacctaggcagatattgaaaactgctcttctagtgtttggtggtagattcaaaaatgttcatgatattatttcatgctaagaattatgtcaatacatgaaaaagaactactgttgggttgatgattaaaatttgacacaaaccaatgtttatgatccatccagtaatggagaactaacttctacttaaaaatggattttaaaatgtacactttttattcttataaaaatctgccttttcctccagaaggaatagacgagattggatttggtcatttccccaaggtgaagagcatggcgatttcttctgtggtaaggagcaatgtgagtaatggagtttctgttggtgggttatgtggttggttcatgtgtgattattgaagaaaggaacaaaaggccatatacacaaaaatgaaaacatcaagtaacaaccaataataggaatgtgttgtaggccaaggagtaggactgacccatttcagcacaatagagacttattttttaaaaaggtagaaggaatttaattttcagaagtgtttcatattttgtagtatttctgcgccatacctgatttaagcatttccatattggaagagattcaggctgttaactgttcaggagaagctcttgtaaggtgaaacatgctgtttgtgttctagtgggggataccattgtggattttcattgttcattataccacctttaaaattaggcaaattaaatgaacatagcccagtcatcggccattcatgttgatagtactgatctgaagcaagatttgttgattattccatgtgtggcactgagatctagtctgacagctttgtgggaattgagcctagagatatattgttgtgatatccaggatcttgttcttagaatttgtgattcatgggaaaatgaaggtatacatgaatgaagaaagagtgccaagcctggaccaatgatgagattggagggtgtctgaatcaaaaattttgattaaagccatctgtaactctgaggtccattttaaaaagaggcccccatttttccctctagggaaatgagcttataacacaagttcagaatattcaggtatcttgatcatgggtgttcatagttttttggtatagattccattttataagtaaatcaatgcataaattttgcataaatgggtaaatataaggagagcttggcattgaccaattatgagagtatgtaatgacgaatggattattattatatgcttcgatagcactgaattccagtgatatataatgatagaggctgttgccttgttttggaaggcgtatgtggacagatgtatgccagacacaaaataattgtttgatgttgatggttgtttactgattggttttatttagaggagggaaaattgcataaataaataatagatgaaacagttatttaattggaaataaatgagcatgtttcaacttgagaatattccttatgaaaagttattataaatccaactctgtactgagttttattaaaaactaaaaaaagcatctagtttctaaatcttgtggatagcataatggacatatggagacataatattattcaagcttcttctataatgtaagtaaattcctatatattgaattgttacatgtgaatagaatatgtccttgtcacaattaattttttaaaagagggcgtaacacaactgagtgagaaatgaaaatgaaagttagtctttttctaaactactgatgctgtcttcctggttaggtgtgggaatatagacattgaacatgaaaagcatttctgttgtgggttcttcatgagtttactgctctgtgtgtgtgtgtgtgtgtgtgtgtgtgtgtgttagtatttgtgaatgtataatgaaatattccatgcgtcataacataaacaaatcaaaacaataaatgaattcatatataagtagggtaaagcatttaccattggtgataatatgccatgaatcatgaatttaaattcatccatttctacacatgttgagtccattaaataaaaaagatgatctaaagcggttgcctgtgtaggtgtctatagacagatgtgtgccatagtcatagtttttgttttgggtgatgaatttaacagtgtttattgtattatttaaagttaatagttaaatcaggaaataaaaataagtgcagttcttgggtcagtgataaaaatgggatttgaatcaactttatgattaatttaatatcacacaactaatgtcttttaagtcaatctaaatctgtactgttcattcttttgaaaatttgtattcaactccacagaatgaagaccatggttgatttaatcagtctctgctgatgaagatcttggctgttacctttgtgtgtaaggaagctaaagacttaagtaaataacagtccaaaaacttgtcaattagggtaaatttttcattaatgttcactgaattatttaaagttaaggcatatgtagatcaatgagatgaatgtgttatgaaacttagattgtggttagtccaattaagcacaattttggttaaaaataagatgaaagacattttattcatttttttatctgattaataattcatcttattttgtactgcatttaatttaagatttattcactaataaaatctatggctgcactgttcaatgtcgtttcctctatccacatgtggctatttatatttaaaataattaaaggtacatgcacttttaaatgtaatttcttggttgcattagccacatttctagtgctcagcagctgtatgttgctattggtgactgtaatggagaacgcagttacagtacgtttacattatatgcaaagtcctgttagacagctctttaatgagggaggaatgcatggaaaggtggaagataagtggaatgagatggctaggaagcaaggatgttcattgatctatacttgcttcactgtgggccactacaaaaggagatctagtctattgagaatagggctagtctatgcgaaaagagcctgtaaacagatcttggttatattcaaggatactgtttgtggatgctaaaataacaatgggtattgattttattactgctactgaatcaatgaatggatcaataaacaaaggtataaatgaaggaaaagattgcttatcctggatcaatgatgagtaccctggggtgtctgaatcttggattttgattaaaccctataactctgaggtccattacaaaaagagtacttttcattatgtctatgggaaatgagcttattccagaagctaacaataatcaggatttagtttttgggcttctgagtatggactgtattatttttagtaaagaagtatatggataaatcaagaaaagtacggtataaataacagaatggttattcctgctccaaatatgagagtacataaaataataggaatcattactaatacgtttctgaagcactaagtcccagtaaaataaattaatcaaagctgaccctttgggtaaggagcagttagataaatggatgttagagtccatgttgttgttctgcttgagggtgttcatttttttttttttaaagaaaagggcaaaatgtttactttaattattgcttaaattactacctaattgagagagagtttacacatggatctatcttgagaatatgtcaaatgaccagttataatgaattctaataatcttcactatttaaattcagttcctcagtttaatttacgaaagcaaggaaaatgatctgaattttctgtctaatgagcatgggatgggcattgatattgtccagtttctgtgaagtcacagacataatgattttattataaatgtaaaaaggaacaaattaatgtctcaatcagttattcaaaataaggccaaatcatggaccaatgagggccaggtattatggaacaaaaagagtgattaatccagttccatacaacagctctccagtattgtcattatttccataaacaaaattgaggtaggctcttgcatttttggaatggtgaatatgtttatatatttggatagtatttccctttcagtctcattggtgcaatttccttaaaacacggaatagacatgcctccatgtgtaactatttaactttatatgtatgtgtgtatgcacgcatacacaattgttgagaatgtactcgaatccaggattcagattaatttaattctttctagcaagattcatgtagaaaggaaatttaaccctttcctagttgagtagaaggcagataaacagacagacgtgtttaatagtcacaattattattattttgcctggttttacttacagtagttaaatttcatacttgagtcaattagtcaatgaatcaatgttgttcatcttttaaatacacgacaagtaccagggtttatttctaatcaataattgttgacttgaacggaattttaaaaaaatctaaatctaggctgatccatttctctctatctctctctctctctctctctctctttctcatctacctattatattcaccttgtactccacagaatgaatgcgcaatgattcaattattctccagcgaggaagatcatggttgttgtctgtttgagtaatgagtgtagaaacctatgtaagtaacaaagtgattgcttttgctttagtggttgttaagagagttaagtctttctggaaaggaataaatgactatgtatacaaataaaatgaatgaagttatatgtgaatcattcagcacatctgtggtcagttaaggagaaaaaagcaagaccatcttattcattttaatagttaattattgagttaattaatgtaaaaataaattattcaattttatttgagtcacagttgattttaacctccctctataaagacagcttattcacattccaagatggaagatattgtcagtgtggagtaaaatggcagcttcgtagttcttcatcatcacatccttaaaatatggacagggtcaatgaaagatgatcaagccttgaccaattaagagtatgggattaatatgaagcagatatggtcattaatctgctaatctgaaaaactgaatctatcacacaaagggatctatcttccttcctctgtgagaaatgacctatgaagagatgtcagggttgtctgatttcttgttattgggtttttgggattcataggaattgattatactgttagtaaatcaatgaaacatgaaataatgtgtaaatgaatgatgatgaagaatactaaatatggaccaatggtgggtttttgttgggtatgaaccaaggattaagattagttcaaatatgcagtagtagtgtccattcccaagagggatagtggtaaatgagcccacagacaatgtggcagtactcatggtatttaagttttaaggttttgataggtattgattatattattataaatatatcgatgattgaatcagtgcactaatgtagaataaaagaagaaaagaatctactgtgggcatatagaatgaaataataattttttgtttcttctttacatcttaattttattttaagttctggggtatatgtgcaggatatgcaggtttgttacctaggtaaatgtgtgccatggtggtttgctgcacctgtcaatccatcacttaggtattaagcccagcatgaatttgctattccaaaaaatatttctgaaacactgactttcactaggacttgatgaagcattttttccctttggatgaggagaatataggcaatttttgtaatagtcagtgttcttgttcaggttatagagtgaattcatagtttttcattttattaaaagaaaaaagccattaaataaataagtaaaagattaacccactaactaaactaaagagggccaaacattgactgttaagaagcctgggttcctttttatttacctgctgttcagatatacaaagaatttcaaggctctgtccacttagggtattttatacgtagacagatgcaaacattatattttagtacttagttgttggttttcttaacctgttcattttctttagaaatgtgaatgatgattaattaatccataaggaagtacagacacaaatacatagatacagatgtatacaaactgatgtatacataaataagggataccgtagaccattgatgaaactgtgctgtgaaacaatcatttagattaatttcatttaaatgcagttcatttaaaggtaaacctaaattattgttatctatgcgagaggggcatagagacaagtattcattatatagttcttttccttgtatttaggaatgaggtttattgtacttactagtttattaaaacttaactttgagctagtcataggcaatcataagctgatgataaaactctgttacctatcaagaatttcaattaatccagtaacacatgacatccataaacagaaagaaaaatcacagtggtttcattctttctaacatctcttttgtacttcacagaatggaggcgtgatggctgatgcaatcattttccactgatgaaggttttgatggccacctgtgtgagtagggaggacataggctgctgttagtaattgtcttaagttcttaagtctaatatcaaggattttgttagtaaattttgattttattattataaagagatcaatgacaaatccaacaaacaagcatataaacaagtaaaaaacgagactgaagcattgttcgcctatgaataaatgtgattaggcaagaaaaactactaatataaatggaaaacactgacgtctcaagaaatacatgtatcaagcatgctactttgtctaagggtcttaagacactgcatataagaaatagtcaatattattgttctggatcagttcaagttcaagtttgttaattttttaaaagaaaaatatgtaaatattatcacagattaataaatacctaaactactgtgaaaatgaaagggtaatacaaaggtgactgaagacaagttatcagtgtttatcatctggtctgctttgtattcctcagaatgaacagccccatctgatttaatcactgtgcaatgaccgtgaactgtacagttacctccgtgtgtcacaggaagactcttgtgagtagtagttaaaattcttgttttgttttaagggtattctctgtattcttaagaagtctaaaatataatcaaataaggtcaagcatttttattattcactacctaagtacaaatttattcttaagacttccctattcatagctatttattttatgattacagcactattaatgaattgattaatcaaaaaacgaatgtagatagacatgaatgaagaaagatagagtcaatcttggacctatgatgatgactggtggcgtatgagtcattgacggtgaatacaggtctggaagtctgaggtccaatataataaaaaatctagtcttcaccttctatcctagggatagacattaggaatatttgaggatgttgttcttggtcttcacgttcatgcattttccctctatttttataattggatcaatgaatcaataagcaaatatattttaactgcataaagataaaaataggcgttgtccaattatggaaatatatggtgaaataagaaatactattcacatttattaaaaacactgaggtcttctttctattaacaaataaatgactcagaggtattactcgcttgctgcaggatggcatatacagtaaaaataataataacgtatgtgaggtcatttgggtcaggaccatgttcatggttgtttgttttctcaagaaaaaatagtttcacacatacttacatgactaatagaatgaaaggagaaatgtgtggataaatggacagaatatttccatctttttatcttttttgctttgtactctcacaatgaacaccctcaagttgacttaagcacccttccatggtcatgaggtttctggttgcctctgtgtgttagaagcttggagaccaatgtgagtatagtcaaagttcttgtcttggttctgggtttttaaggggtagtcattgttttattaagaacattacagataatccaaaaggttaaccatggtccaggggtaattatggcattgccatgaaacattatgttgattatctaatatttataaaattaaaaatgattaatgataaaatcactgtgagagatgatcctatagagagctatacagtatttcttgttcttaagtttttgtaacattatttaattactattagtgaaaggatgaattaataaataaacaaatgtagaagtaatggagaagaggagggccagtcttcagtcaatgatgactctgcctctgttgaaaataccataccctatagacagatttaagaatacacaaggctcatgttcttggtttttgcattaatggattttgattctattattataaatagatcaatgaaagaatcaataaagcaatagaaacacacatgagtaatgaaatcatcgtacaattatgaaactat

SEQ ID NO: 353 - DNA, 4024 bp, Homo sapiens
ctccccgggccccgccccttcccggtacaggacccccaccttcgctcctgggagccccgctgcaccccaggagttccattccagcctccccagtgcgagtgcggccgagcgctgacttttgggggctccctcccccgtctcactgggtccctctgcggctcccccgcccgctgtcccggttcagacgtggctgcaccccggaggggggcgccggccgagacctgagacgtggcgctccctctctgccggcctcggcttcaggtacgtgcggttccctcggctaaatctggcccgggggatggggggcaggggccgtctggtcctccggaactcgaactttgtgattttgttctttctgtgtgacatcctcatccgttctgagggagaaactccttaaagaagacgagagagtcagtcgttgcgggttcttggaggagcactttgggggtgagactcccggctagttcgggtcgatttcagcgggattaagtcaaggaaatgaacaaatctgacgaatcagggaggccagagaaggcgtccccaggtagccacgctgagcgttaagagagaagtcccgtatggtcaaagtcattcgtccaattctgtgtcaattattccttgttgcacttttgcaggatccttgggccttactaagtactcaggtgaaaagttgataattgggaagcaagtaaagtacctttgaagacgtgtataattggacactttgttgcagttcttcagtttctggaggaggcggtggggggggagagggagggggtcagcctcgcgaaaagagcaaatggtaaagttataggagtataaggcataaaacttgggttgggagtcctgactggccttgagtggccctttcccactggatgggggtgcgggacagtatctctgggccctttttactcagtctgcgcctcagagggaggcttgaaggtcccctgcatgaggaaatgtgtgaattgccccctcctgaccgcagtgaggtagggacccccgcaaggacccacgttcacaccagcgcccttccagccagtggtggggtatggatgggcctcgctggtcctgggcatggtccggtgcgtccataagggttccattgagctcatccataaaacaaagaagctattgcaggctgcagggtgtcatagctcgcacagtagccatgcagacctaagaggacaatggaaatacaaattgctatcgatgtgtctttattttctagaacttttttttaaaataaaagaattaagtgaaagcaattccgaaggtttctatgaaagcccagcccatccccaaatgcccagtctctggcacgggtgatctggctgtcttgggtactcaggccttactgggatttcctttaagacctctgggaggaagtgtcagtagctgggcaggccttcttggcaagcattcctccctgggttgtggcgggggctcccggcctgctgtgtggcagctgcaggctcctggggacctgaaggaaaagcttaaccgttctcccttcccttgcttggcacttagagcactagttccattccagacattccgattatcttgcctacgtggcacagaggcctaggagcctccctgggaggaagaggcaggccaaggtcttgcctggctgcttctagggggaaagatgtagggaggaagctgccttatgcttggatctgcagcctttgcctggacctgtggagcctacgtggccagggtgagggagacagaaattagaacccaatgtattcagctaatcctcttcttgcctctgaacattgccgttaatacttgaaaagaaaaaaaaaaagcaaaaaaactcttggcatatagagctaagcagtgggaagaagatagctttctaaaccatgacccaataggtctgataacataacatttaactggataaattacataattttgtatatatgtaggggggagttgaattcagttttgctgtttacaggctgcaccaatgcattgttaaaagatgtatattttagtgataattgtgattaattacaaaataattgctaataagcaggtaaataaaccaaattataatttagagtgcatcctttgtttaaagtgaaatggatctaaattgaggatataattttgagttttaatctggggaaagttctttaacttttctgagctacagtctcttcacctggagcttagacacaccagcctggcaggggtatgtcagctgtctgcttgaaaggagaaagacagtaatctgtgtgaaatactcaccgagcacccaacatataagcaggctcttcataaagtcattttgaggtatccacaagtatttcttttttctaaacaaaatttctttgttttttgtttgttttgctttgcaaaggtcttgcttgctagaaagctatctgcattaagctgcttctcatcacattataaaactaaggatgatcatttttaaacaaacaaaagtatttagttatcttttcaaagtaaaatatagctttccctaaactgttttaggtgagccatgcacacaatgtgaaagaatgaagaaaccaacaaaacacttggtgaaaatgatgaattctggggcgctgattcatgtgacttgaaaaatgccatccatttcctgattcacctcaattctgttcggaactatgaaagatcatttatgtttctgcactaattgaccaattttgtcttgtctttacttccctccctagtgcttgaatttcagccacatccctaagctgccatctcagaccagaggaacagggaggggggctttctggaaagaacatcacctggaagaaatcaggacatgactgtgggccatgagtgaccttcaaaggaaagccgggtatctgtggtctttaagatgtggtaagattgtattaaaattatagaaaaaaacctcaatccagaaatcgtggcctcttgacatttacatcttaactgcattttcctaccaatgagatgcattacaatcatcctccataagtgttctctttttacccctgtttccattcttttagatccatgacatttaaaaactgaagaaatggaaagatcatctgatcaggcccatcagtctttttcctaatgctaaacattggtacaaagacgtgaagtttgatgtctcactaagattgcctagggctgctttattgctcacctacttcaaagtattgggaaaacatgattatgggtacaggtgatgctgtgttgcccccagacaggtttcttttgtcaggttcttttgatggattaggaacctacaagtggggagattttagggaaatagcccctccacttggatttcaccaaaacgtctttagggttctcttaccccaagaaacacgcattcctctttagtgtggcagcccactctattggcaaagttaagcagaccagttttactaaaaaggagccacccagaaacttagacagaaaatacttgaggcacagatgagaatgagcacaaatgtgcatagcaagtgcagtttcctggcccttaaactgaagggccaggtcagtctgctcctccaggcacagcctgggaccccatcatgtgccccactctgcagtctgagcttccactcaagtccaccagggcctgcctcacatatatatacaagacccaatgtcagagtctgcctctgcccatgtctggtcagagggttgcactttgccactgctacatgttcccagaggttggcacagcatgacctggacctcacctaacccaggcaaactctgctcatcttcgagctctctggaacccatttctcaagggagaaccacattcccccacctcacagccaagttcaaggaagcagcctggctaaagcaatgactcaaggataccagaagcagagcacgcatttaagaagatgcgctgactcgcaggagcagctgactcttcttaagaagagtttactgattcttctttcagtacgggccttttaataagatattgtattttacttcagctatgggtgcagacaattaaaggattctagaaatc

SEQ ID NO: 354 - DNA, 133083 bp, Homo sapiens
tccccttgcaccagggctgactgtagctgggggaagacattttactcatttgctctttcctttcatacagtcagctggtccctcttctcaggtgtagatcacctattataattttacctaattttgatactctgataaggaaagtcccaggacttatcagctgggataggcctcacttacaagacagctctgttcagtatttggaaggtaagctatttgcacaacttctctgctgtagtgtactggcctagctctaaaactttgcagtacatcacttatttttaactttcactttttttctcttttcttcttttggagaaagaaagcctgacaggtttcttcggaaaagtggccatccatggaatgaatgaaatgttctctttctattccagtaagtaattgacttgtaactaaaaattgaactagctgctatgtcagctgcaatgtgagctgctgctggcacaggtgttgcttactctttagcctggaaagaaaaggggtttaaactgtgattaaatttcaagtcaattgacctcaacatgatagtacataattctcacttgcctaccaaatggcctgagttctcattttgaccctgattctgacacctgcgtttttaatgtttggtgtagctaaagctatggttgctcttttgtttagaaataaagtgggtagagaacagttctaagtaaataacaaatggtagccagccgaatgagtctttaatacagcgctcaacgtgttcgatttttttaatgcattaactctgagttcatgtaaattattattcaatcttttctttttaaacagtatggatttatgggtaacaatttactaactatggatacacagtaaatccaaatcagtgaattacaaataaggaaaggatgtgagaattttgatgttaagtgctttcaaattaactttgattatgtaacatatcataggcgaaatatgccttgcacttcaattatttttgagccctaggaatgaaatagcagcattgtttttcttccttagtataaatagaacaaaagtctccttaacttaagcaagatgaccgtatttgagtttgggagacaaacctttatcttttcccaaaagcaaaataaaaatcatctaaaatttagtgacatctaaaattacaatttacacttaaggctattctccattcattttttgtaaaatggttgcatgctaaggattgatctgtaagatgagagcacccatggattgttgttttttcctcctaacttcctttctaacctgggaattaggagaacttgctgatgatgcttgcttaaccctgcttttagtgccaggctgtaactagctctctgtgaaaccatttctgatcctctgcttgcagtggtgagcctgaatttttccccctcctggcccatcactgtcagtcaattataagattgaactgaaccagaaaatctggtacagtctggtaattactacaaagggtttccagtctagtgtaaagacagagatgcaagagccccagcagtctcagaaatcgttttgattggccatggacattgccttttagtgctgcttggtgacttcctaaagatattgcctcctaccctacaggtcttctccttcaagtacattatgggccttttttaaaagtcgtgcgtgtgtgtgtgtgtgtgtgtgtgtgtgtgtgtgtgtgttcatgtgtgttcgtgtgtgtgtgtttctttttttagattcaacttctcccatttttagtctgtcatttttgcctatcaaacagacacattttgacttgcccaacaaagaaccaagttatcaacactcacagaaactgacatttttaattcaggcttcattatgtctttgaattatgacagtgacatacaaagacattttaagggtttttcattgttttttaaaaatccagcattgggatgtttatctttctttagtattcatatttccctttctacctttattctcagtaatatataattagcattatcaaaaccatcagctattatcctttctgacttttgacctttattttttaaataagcctcaagctaacattctccagaataagaaaaattccctaacagattttaatgaaatattttaggattattttaaaacatgaatcccttttaaacatcaacactacatgactagacaagtaatgggtcttacgataaaacaatagcaacaaaataaatttgatgaaaaattattttgtaaatctaacttgcatttgatggtaagtgcgattttatagtgtgtatttcatcagacattttaaaccattactttggagttctttgcttattatgaaaggttgtttggggtaaattcttattttttacagaagcaaacattctttttgattatagattacaacgactcattagtcatatcagatatagtgaaagtgtttggtaatttgtcgatataacaagtgcctatcccaaaagatagattatgtctatcttattttttttaatttgctttaaggacaagtttaatgtctgacaccctgcacaaaattgcaaaagcagcagtgcccaaaagaaaaacaatcaaaagaaagcacagggttttcatctccaagaatgctatctttaggacaatctgcatcatgaatttagttgtgatgtgtgttgtgaatcttctaaaggatcctttatttatctacaccttaatgtagctttaaatatctgctttatttctatgtataatcttaacaaaagtagttacattaccatgcctggtactgatttttacatctgactttttgctgttacatttcaagaaggttaatattgcttttgtaaccctgtcatgagtaatgcattttcccagtaaacatgtcataatgttaaaggctgttcaagaagcagtgtttctgttgaaacagttttgtatttatttctctattgtttattatccataatatagtgtaaggctttgaaaagaacacgcatatttatgtaattaacactttttgttattaggaaagccttcccattaaaaactaagagagtctaagaaaactatataaatgggcaacttttcaggaaaaatatttgcattcgattttaatttgccatcaagcttatatgttaaaatgtatacataaagtgactgagggaagggtactttctggtgttttttttcttattttttaatctaaaatatatgttgaaattcaaaaggtgttcaccacatgcagtgtggcagcgttcaatattctttaacagctgtatactgtgtgggtctgtatgaagttacaggggctcacaagctttataacggacacaaacattcttttctatttcagtcttaactcctagaagcaggagtaagacttggaaagaaccaagcagcctcctgccccactgagaccagagtacctctgctattatctgctgtgtatattagagttccattaagatttactcatgaaaatcccatgctagaaagaaaaagtgaaacattactgactgaggctatcttatagaaaaggaaagcagggtttactcaaggttgtacactgagtgagtgacagtgtcaattttatcacccagtttcttgtctcctggtcccaggcttactctcctaaccagacacagtcatggctctgtatgtccaggcctcctaaactatattgctaaaagctcacaccaagagattcacagccatatgtttaaaatcaggatgcttcctgaagatatagtatctaggtggtaaatggaattttttaacattatagaccaaaatcaagccctttatttggcaatattattcattctggctgcattgttgtagctgttaggtaaaagattgattcctcttacttcttagtaaagtaatattttggaggtttcttaatggtatttctaattgtggtaaaaaaataaaatttactaccctcaccatttttaacggtatagttcagtaatgttaacttaagtggtattttttacagtagaaaaataattagtacttaaatccaaaagaaagaaattttttttaaaaaactgaattaagatgctaatttttcaaaacatgttttatggaataccatccctataagctatgccagctaaaaaaaaaataacacggtcaaataatttatgtccttctctaagaaattcacaatgaaaatttgtacttgaaaaactctggtaaatcataaagatctctttgaaccttgtataatatagtgtatcccaaactatttttccataggtttcccccaacctattttgccaaaaagtctatttttattcttcagagctaatatttttaacacattttaggaaattttcctctaatccaacctttgcagattaaaaaagatctataaagtgatgtttatactatttatgttcactggctctgtgtttacaaatcttttatctttatcttatggtagtaaatctcattaattcaatcactcaacaaatatttaggcatgggctaagtgctgggaatacagtaatgagtaaatcagtcagaacccctgaccttacagagtttacagtctgggaaagaagtcactgaaagtgctctaatgtgaaagtcagaagaagggaagaaagaaaagaagaaagcaagaaagggaggaaacaaaaaaggagggagggagggatggagggaaggaaggaaggaagggagggaggaagggagggagggagagagggaaaaggaaagaaaggaatgaatgaatacaggaagcacaagcaatattagctgtttctaacacttatagcttatctggctatgttttttgttgttgtttttcctcattctgaaatgagagaagagggaaagggggaaaaactccatcagttcagtggtctggtctttgaatagagatagaaataatatttctttgaaagctacgtatgtatcagcaattgattctatgatagttctctagcaattcaaagatgggcttctattgcttagaagggaaggagatagaaagagaaggagagaagaaaaggagaggaaaggaggaaggaaaaaagaaaagaaaatgcattttctggtcttccctcctattgtggcatcttagctgttgatgttaccttccatataagaagattcctttcaagcgtcagcagaagaccttatttgatggtaaccatgggtcctacctctgtcaggacatattgcttctgactatctatccatccttctctctcaggctctgaccttcatgctgggaacctttcttcatgggagtggaatgtgtctcctaagcaaaggaaaaggataggcccataggcatatcattgttatccagcatcttactcatccttagagctcctacacaaaaatacaaatcatgatcctgccaaaaaggagcacttgaaaggctgaagaagggcctcatcttcttgttggactgttgtccagtgttccacttccttgtatgaaactgaatgccttgcatcctaactcctgtgtataccacttgaaaatacatattgtaggtgactgccctttgatcacagagattagggaagcaggaaagattgcaaaatctaaaagaaaaaaaaaaggcttataactaagagaaaaagaaggaggaccttatgcccactctggtttgttacctgcatttttcatcatggatgtgtcacatgtgagttctgtgaatcagtgctgagctgaattctctgggatattgcaactttgttttgctttttctttctttctcatcccagcatttccttcaatgggaacaatgtgacataaaattattatcagaatactgcgaggaaaagaacttagaaaataatttggaattttcaagttaaaattaagagctgtgttagtaggcttccttcctctagttagctgggaatcaattttctaattcagtctctcctctctgtcatttgtctattgatatatgctaggccatgcagtatttgcctctttttattccttttaattaactttttaaaatcaattatgattatttatatggattcctattctctcttctcatcaaatttgtttggcttactttttatttacatgccactacccactgctgtgaattaacaataacaaaaaatctgcactcttcccttccacctcttgaactggagaaacagttagctaataagaggctaaatgagccttagagtatagagaagctggaatccttaaattatttaaattgaaaaatggctggttttacaatcagaaaaactcaagtggaccgtaagcccctacttgattgttcccccttatctggatgatcttgtaatgacagctggagttatctgccatcagcatcactgtccacaaaagcttctactctctctgctcaactcttcagcagccctggggagctggggctgtttcaggggagagggccctagaggattggaaactttattaaaatgcaaagctctctctagtgacataaaagctcagtaaagggtaatggatctaaaatcacagagccagaaattatctgcagaatgaaaaaaactgagatttcatatactgtaggctagggtcagtgtaaaataaggggcaatataaaataaatagcagtttaaaataaggagcaagagatagaaggaaaagaaaatgtagtgtttcaacatcaatagtgcaacaaacgccacatgtgtcagactggcccttgtagaattctgtctcaggaagtgacccaatgaaatgtattatgggaagtcaggatagttgtctgctttgaaagtttagagaagtgcccccaaaccttcctgattttctcttgataagcaattcattcttgggctaccacccattaattttctgaaacttattgttgctaatagaattggtagtaacagatagtaataggaccccatcacacttttgcttgacatctgaatgtgggctctcccttcactggccttatgaaaatgaggaatctaattcacaaactgtatattttaaatgtatttgctcattttgatccattttactttaaaaattaaagagtaagatcttaattcatttaactcaaaggactccacttaagattactcactaataagttaaatgttgaaatgaaaattgaggcactaaaagatagaacaattatataatttgtcttaaacaatggcaattagtagcagaatgaaaaacggcatccaggtgatttcagtttgcatatactaaattattcaaaaatcctttattttatattctaaatttcttactagaaaaaaatgactgtcagcatgaaaaagtcataagtaatattcaaaatagcccattgctcttaaaaggcagagtagtatgttcccttctgcacattactactttgaaaacagttctcagggaaatttattatcatcatcactaccctgacaactacctaccgacaatcatttattgagtgcttaccgtatttctcccttctccaggtcttatcttcaagcctcgttttcccttctgctcagaactttaaaaaaaaaaatcagtgttgggttaaattacttaactgataatttctcttttcatgcaactagcaagttcagttagcaaatgaaaagctaaatgaagtattcattccttcatcttcagcagaagacattaaaattaccagtcagatcacaagtacttcatgtatcaggagaattcccaccccacacatatatataatgatttggcttcattttttccaaaaattttgtatttacccttcacacatttaaaaactgatttttagtgatgagaaaaggttgatagaattacttaggacttttttttttcatttttagtgcagagatagcttcaggtgtgactttataaacaagctttcatctccaatgtaagaaaacaaggttctctctgtcccccgaaaagagactgggtactggaacacagagaagctcctttgtctgggtctccccttcaccctccattagtatgcactgctgcaaacttgaggcacagtgaagaacttctttgacttgggagggtggtttttataaaaccccaagctttgttccacagggacactcatgtcaaatagcagtcccccatagtaattgtaactccatcatattctcccattcaaaacagtgtactggggtatgagtgaaagcaatactattgcaaggataatcttgaatttgctgtaattcattcttaaatatattgtctgcaaacaccagaactttattattatttcatacttcttagaacagatctcaatcacagctgatcatggcacattgatctcatgaaactggggttaagacatatccttttagtgaaattggcaactaaattggcagagctactaagaaatggagattcttagatctgtggagctgagacttgagaaggtactctgaccaaccattggctcttgagactatttcagcaaatgattggagcacatcatactgcttttctccttccaacctgatgtctcctcacaccaggttgactcaacagccttatgtttatggagcaagacaggacagagttattgtttaccttaaactaggatcgaaataatcataaaatgccgaaatatgattaatagcataaaactaattttatgtgtcgtaactaaatttctgtctttttactaattgcattattggcatgtgttagcttaggctttatgttgaaaactaaattatttttgaagtttttagtgttcaaagtgtgatgattttctggggaattttttcaaagcccagtactgagactatgctccagacaagttgaataagagcttctgaggatgggacccagacatcagtattttttaaagctccacagattattccaaagtgcagccaaggttaagaaccaccagtctaaggaagggaaaaaggtgggagaagggggaatcagtatagggagatattaggaaactaatttagtcatgcagttataattggtgctattttgatttgttaacctgatagtctgagagcatccaatgaccactagatgagcctaagacatccccagttatcactccctgcttctgtgcatctaatcctgtggagatttgtaatcctgggaaccaagggcaggaggaaactgtgacatctctatagctgcaggattctttgctctttaataaagtcagggcaagcttaatcccacatagttcatagggaggctcaaaatggatggaggaaaacctgtctctatccctctcttcaaaggcaggtacaaataaagagtcctaggattactgcaaatttcctaagaataaaaaacattcagacaagagttaaaaaatattacagtgtctattgtgagcaaagtgctaacctaatccttactacaactctgtgaggcaggtattagatgtgctcccattttacagaggaagacactgagaaacagtaacaagaaagctgcccaaggtcatacagataatgtgtgcctaagtctggactttttactctaagacagatggaaaactgaccaaaggtcaccctagctattcatggacagctgtctgtgtcaaaagaatcttcctttctttagataaagaatcaaattagtatgctaattgtgttctttgctagtatgtgtaagcaagcattatactcacagacatggaaaagaaccttagtattcagacatcagtatggcatttgttgtcttttgaaacatcaccactagttctcatgaccaatttgagtctattggagtttcttcaattaaaaaaaaaaaaaaaagttggaatagctaagataacccagcatacgcatctaagctcaagcttacatcaaaccttgaaaacagggtagaactcctccttataatatttctgaaaatggaaatcctcttgacttagtagtgataaaaacgaaaaaaaattttgtatgttctccctctaaagtcttagaatttgatagtgtaattgggatgtggcatcaaccccaaacagctgcagctatctgtttcatattttgtaaactttttctgaaccagaaattgctagttacctaagacagcagcctaaggtagggccaaccctcaaccaatgtgaagaaagcagtttatcttttatttactcaaccaagcgttgtcttgtgtctattatgtgctaggcactattcttccagatctttcccagcttactgacatttcttgtccctcttcctctcatgctcccaacatccgtatcccctgtccctgtaccctctgggtcaaaacccactctcagatacctcactcccatgaaggtaaatgtggttaataacagctttaacaagttattatttccaggattataggtattataacagggaccagatcatttaatctaaaagggtgatggtcttgtggtataattataggcaggggtttcctgaagacagttgaaaccttctccagtcttgcaactcaggtggcagcctatgactctcctgaggtcagggccatgcattttcatgtttttatttttatttttatttatttatttattgagacggagtctcgctctgttgcccaggctggagtgcagtggcgggatcttggctcactgcaacctccgcctcccgggttcaagcaattctcctgcctcagccttctgagtagctgggattacaggtgcccgccagcacgcctggctaatttttttttttttttgtatttttagtagagacaggatttcaccatcttggccaggctggtcttggactcctgacctcgtgacccacctacctcggcctcccaaaatgctgggattacaggtgtgattcatgtttttatcccaaatgcttggcacagtgacttttccagttggaactcaataacgaaggaagctctggcctgaggaaagcaagttgcaataataaagatgtcctgacacagatgaatgggaagatgttggattcattttgagccaaactggtatgaggaggtcagctaaaagcatgaagaggagataacctagtcccatcaattgaattctcctaggagccagggtcagatttgagaaacttctggaggatccagttagctttagaagctgtagatctggttttacttagcagttctggtccattttaatttgttacatttgcgtttcactgaaattggtataaaaagtaaataaaacgttcaaaaaatatttattgagtacctactatgtaccagaaatgtggctaggcattgtggatattgctgtataaatcccaattcctgccctcttgaagctaacattctacttaaagaaactgatatgaaaccattaattatataattcagtatttaattggagtcatattaaatgctacaaaggaaaaatgcaaagtactgaaaaaacacacaacagaaggatgtgatctaatatagaatatcaggcaaaccttctcagaaataaaaattatatatatatatatatatgtatagagagagagagagagagagaaaggaatataaagataaatgaggcatatctttagagagagagagagaggaatataaagataaatgagacatatctttagagagagagagagagagagagcaagagagctgatacctaaaagatgagtgggagttagctaagcggagaatttataaatggagtggacatttctaataaacacctttaacattcaatacgctagagctaattctcagatcaatcttcttgctaacaattgtcttggttccttttcttgaggttgttcacataagaaacattttgaggtctttgtgacaagctgcttattctgggctctaaattcaaataaaacattggcatagagaaataaatcatttccatagatgtcaacatctttgtgagacacacaagtgtattataatctcacccgttactgtttcacctaggtcgttagcatgaatacccatttgagataccccatcattacactctaggccagaagctttcaaattctgaaatgtccacagacaagactttctatttcactctgtccagaaaccttgagtaaaagaaaaggaggtaggaaaaggaaatgagtcagggaactgaaaacaccagagagagcccggtctgtgtaagggatattttcaccatccccaccctgttaactcagtacttcgtacgttcacaaaaagacattcccaagttcgtcatgctattttatgcagcaccttcccttggcccgcttcttcagctaattaaattctcattcctaaaaactcagttctggcatgttatcctcttaccccactgtcccagtctaatttagatacacctcctttgtgatctcatagcttgctacgcttttatatcttatggctgtataataataattgatttacttatctaacttatcttcttcttgagagaagtagttccttgagggcaaggctcatgttttaatcatttttgtacccctcatttctagcagagtacttaaaaagaatcctttcaatgacttcatattcatgcatgatagttacttttccttccttagcccctagagagacatggaaacttagattttgtttatccagtaaacaaggctggttttgtatgtaggaaacttttgacccatcccagtctgaaattcttctccatttacagataagcctattttagttaccttgactaaggtattgctctagagacttcctttgaaaaacctcttaataaaaaaacagaccagtctacatgatcccactgaccaatacatttgtcaggaacaaaattgagctgggcatggtgatgcgtgcctatagttccagctactaaggagactgaggcaggaggactcctttagtctatctctaaaaaaaaaaaaaaaaaaaaaaaattaagttaaaacaaaaaacaatatgggttttgatgttctatttggtataggacacaaccatatgtttaagtgtgatcttttagtcagtgtatttagaataatttccatgtttcatgttagaaatggcataatttgcagactagaagaaagaaaggaataaactatgtctagcagaatacttgtcaactagtaagatgagaaaaggaaaggatacattaatgaaggaataattgaatgcatggataaacacagtacaacccaaaagaatcatcaagccataagctagaataaggacttatcattgacaaaaacgacaaagccatcaaacaaaaaataaaagctattggaagatcacattttccagtcaaacaggacccagatattattcaaatacctaaaaagaaaagaatgtgtttttttaaaatactagtgtatagagacaaaagtttgagacatgaggaagaagtattataaattccagaaaaatcctcttcccacccaatctttcctctcacacccaccgctacacacacacacaccattgtgctatatacacacaagtcatagttgtctacttgcttttcctgaaataaccatgattagaaaaagaggaagttagggtaagagaaagttccttcccactgaaatttcctccttctattcctgcctatcattcttcaagataagcataaatgctacctcctctctgacaacctgtttttgatttactgtagcccccagctaattgctcctttcctctgcactaccactacagcttacctcatccctcttttgcacttatgtcaccatcttttattagagttagctgcgtacatctttccttcctctatcataggagctttggacaaggggctatgtctcatttatctttatattccgctctccctctcttccttctccattcctatcgcagtgcctggcaaaagtaagaactcagaaaatgtttgtgggatggaaggaagggggaaagaaaaaaaaggaacaaagtttatttctgaagaaaatgccatttgtctcccttctccaaagtattttctttttctaaaatcagggagcagcctttgtttttcccctaggtattagggtgtgtgcccttgaataccttactttggcaaaaagccaacattccatctccaaccagctgagtcattttcagtttttttgtggttcattcatgcttttctcctttattgacacattaacatttcatggtgagtaggtcctgttcagctggcagcccctctcagccccaacacctctaagctgtcctcacttcgctagttcccaattgcctgtctctctgggagctctctgtcatcatcatcaactggcagcagaagaattgtttgtttgctgttgctatacctatgttttgataattaacatgaaacaaactcagagaatgagagaactctgttagcagctctcttttcttatgtgttgttttcaaaagctcccagtttgtttttaagaaaaagagaaaaatatggataatgaaaacactagatagatctaaaatccgtttaatttgatatcttgtcaaaatccttccttttaaatttttctccaatacctatacatctattacttccatgccatctgcaatagtgactctcaatgagtttctagtttgctctgttttgtaggtcatcaatttgtaccttaacctaaaaaatagtattaatcctaggctaggtgtggtggctcatgccaatagtcccaacactttgggaagccaaggtgagaggatcacttgaagcctggagtttgagaccagcctgtgccacatagtaagaccccatccataacaaaaaaaaaaaaaaaaagtttttaaatttaaaatagcattaatccatgagcaaatttagtaattaaaaatctagtctctctaaagcatggcatacaagggttgttgtttattggtttctgagaggaaataccacacagaaaaaattatgttacaaggttacaaatttacctttgcatcttgcccgtagtaggtgctcaataacttcctgctgacagactgattagttttagtagctccctgttatttccaaatagacaacatttttcagacttttctgatccataatgaaacatactttttcttaaggctgtggaaatagaataattcttattgcgaggttatttattaccagccagaccctcatctcgctctacggggctctgataatcacctatttcagaagccattagccttctgtgtgttgtaaagcactcttcactataacatatctatgcctttgtattctaaggggaggaatggtgtgtactgaagtaacagacctctgttgaccaagtaagaaagtctttgatgcacaaatagtaaattaaattgcttttatttgatagtgttgaaattaaacagtgtgtggaatccatgcccaggcatgagaatatgtacattctttcaaatgttcaatattactgaaacagatgtataagaaaaatacacattgaaaaaaatgtaatactcactcaaggtttaggtacttacaggaggacagcaggagctggatttaacttattgattttagagccactgtttttttaaaaaagaggtgaaatattgcttttactgttttcagataatagtgactgttgttgcaaattataaaatttaattagctatataaatgccagaggaacaaataatgtgctattgtcttgatatctttccagaaattagtcttttaaaataaatttgccatattaatcatctaaaaatatttttgatcactgaattaatagtttgcagcctgttttcaggtactcattgccataggtgattgcttcttaattactacatgggctttttctattcactcatattaattcatgttttctggcacagtcccaaaaggcagcttgccctatatcttctaattacttctataattgaatttgcccactttttctaacctattttttaaactgactgtgtttgttcatggtttattgtgtcttttttgtgtcagttctctgcaagcagaatgtacattgattctttcctcgtttctcattaattttcaagagctttgctgcatgtctgttttttcagtctgtcagacctattgctagactccccccctcaaaaaaaggctcttattattaaaggttaggtaaaatagactgaagttaattaattcattagtaactctgagccaattactgaagccttctcttatttatatacttgttaacaagacagaaataagaaaggccaattacaggctcatgtccttcagaagttcagcaaacccagagcttatgcatttattgacatcacttcaaaaaattcagtttatatatcatatgtgtgaaatttctttttaaaaaattgttagttaacactctattctatcccttccattaataaattttagaggtgtttttctgccatctagatatcataaatatatctaatgttactacatcctcctaaaatctttctagggagtactgcttagccttagagcaattacaggaataaatttggcatattttctgattttcattattctcctcttgtctaaactattaaggttttaattcttgaaatgggacaattcattagcagatctcacaactgtagtcacttgacatatgttttactttttttaattgaatataccaaagatttacaacatgtggaaaggaaggtttttttatatttttcttcatgaccagtataaaaaattctaattgtctcatgcacacaaactacctgcccaatacatactacaactgtgacttccccttccctgcctcacaaatattttgttaatttcacaggagttaggaagaaaggggatggacacttaaccagttttctatctattgatactgtctccatatgttgatgtcagcatgaggccacaaatcagtgaagagtcacttgatgctaatgtttcagtaaattaattggttgtttgaattaaaacccatttgagtttttttttttaaacttttgaaatatgatatggatttgggttatcatagtacagtgatgccaaagtaatgtcacagttactgctacctaacttttagttttttcctcagtcctaggtatattaaaatttaatcagttatttcatttcataataatggcaatcacagcatcatcgagcaagaaaagtctcaccagattatttgataataatatcaatatttgataatgtccttgattcttggaaaactaatggaaaaatagttgtctacctaatacaggaagccgttcttaatacctcttatagcaatgtaaacactttcttgccccagaattctcatgctgtcttatttataactattttatagaacttttcactttctactatgcattatagtaactttctctgctgaattattagcaaattgaaggcagtaactgtgttttatgtactttgtagccccagaattttagcccaatgcctgcaaatagtaagctctcaatcagcatatgtcaaatgaattagggatgaggagtcctaatctctctttaacttcagcgtctaacctccctcactactttggctaactaaagaatctcttgcttgaaatcggttaatgtatcttaattttctgtggtaactacaatacattggtaacagatgttccattattaatgcattatgtaggcttctttgctccaagatttaaaatctgtattaatttttcctcagatgagctgtttttcattcctttaattactatatagctatatttttaatttcttatggctttaccgacctcaggtctgtgactttgggccaagaccacacaggcccttgttactcttcccactcccatgtgtggcacagtctctgtattttcagaaacacctatgagaatcggaaattagctttcctggactccttcactccttagggcttttacccaccaactcttcatgctcctgcttcagtgaggctagttttccttcagctaacttttgtatattatccctgcctttctttctttttacttcctttttctttcttcctttcttctgtctcttttctttctatttgttttttaaaataatatattttatagccatgtctcctaatagcagtgctttatatatttataatgagttccctgtgtagaagcttttgtcacagataacttctcacttgattcttacaggccaagttctatgcagatgaggaaactaaattcagagaggttaagtgacttgcccaaggtcacacagctaggttacaatttcagtttttacatttttaacttgttggcctccttatgaaaatgaaacacagaagagttccttttcttagttaagtcttatcttttgtgtaaggaaaatacctaatgtagacccccaaaagctacatttgtagccaggtgaatatttttccagtaattatatagatcattataaaaagaaaatgtagcctagtctagtgcttctgcaacttcaatgtgcatataggatcctgtgaaaatgcagattttgattcagtaggtctgtagtcctcatgagctccccggggagccaaagccaccagtccataggccttacttggagtagttaggtccaatgcacagagtagggctttagagccagagatgcttgattcacatcgtagcgcttctgtttactaaccgtgatcttgggcaagctccttcacctctctgagcctgtttcttcattcttaaaatgagaataataatatatatcttactcgctgaaagccaagctggcttgcagggaattgacttttagtgacttggcctgcttccactacacactactaccagattaatcttcctaaagcctctttcactcagaactttccagtgagccccatggcctggtgaattacatacacactcctcttccccttgagcctcaaatgtctgatgtaatagtcacaagtcatatttctagcttgatctcttcctacttcctactgacactcatgtgttactaacacagagatttcctgtttcatctctctgattcacttttgtcctacccaacccttcatcatatccataaaaatctcacccttccattaagtcccttctttcatccaggctctggctggaagcattctccctattgtctaccctctattgctccccaaaactcccacacatatcgagttaggtctcactggtatttgaatttttctaacagtgtgtttatatctctggacagtttctttacatttttatcttatattctagtatttctataatggtgtctaagttccatgaggatgtggatccgatatcgttcagatagcacagtggcaagaactcagccctgaggcccacagacctgagcatgtacctcaggtcagctctgccatttgccagcttgtttgccttagacaggtctcctaaaccatctgagcaaaaagtaggtgccagtaatacctaacttgcagttactaggaagaaattttgtattaaaaatactttacatggtatccaacgcacaggaagggctcctgtcagcgaaactgaatgaattagaactgactgtttaatcccaacacaactcagacattcattctagttgtgttaacactggattcaagcccagacttccagtttgtatgagtattttaacattttcttttccggttatgtttatgtcagtattaagtcttatcagaatattccatattctgcctcttgaaatcaaagcacatttgttgatctagctccaataggtataacttaaatgtgatgatgaaaaggtaacatagtgtgcttttattttaaagcatgtagtttatagttaaacctaggtttgaatctaaacctagtggttgccttaacctctccaagctatggtaatatctaagttgaatttgggattttttttaactttttttactcttaaaaataattagaggaagaatatatgaaatagaaaaatatttatagaaacaagtagcatattagttctacagcccaaaacactaataatattataatattatcatggatgagggggataactctaaacaccccaaatagccccccttttgtaagttgaatttacatatatttatcctagagaatttaagtattctgtttatttcagtaattggtaaggagcagtacatttttttaaacttcctatcagctaatttcaaaaagaactatatttaataagctatatcatcatttagtttaactttttggagaacaaaattaaacgattttaaaagtagaagttaaatgatgccagtgtaatcaaagttgactcaatgcttagacacagtgtaagagatgaatcaaagttgcatctgaacttagggcaacagaaccaaagtcacagctatagtcagtatgttgttttgttgatgtgggtaaagagggttttcaaaagaaaaatagaaaatggggcaaaccttgttttaatcagggagtatatggaaagaaaattaaatgcctatattaaaacctattctttcatactaccaataacatttttccttagcctctagagaccatcaaaaaacaatggctcataatgcttttagaacagaaactgaagttgtatactgtgcatatgtaatcctacacaagaggaaggcaatgtttaaagctgctgtcacctcttagggaaaaaactggaattctgagtcaagtatgtatgcattttctgttttcctgtcttgtgggtctttatgactaaaaacatttttatgaaattgctctctgcttctttaagctttgtgtggtcttgtttgtttgttctcaaatctcaaaccatgccatagttaggaaacatcttgagttgttaaaagttaaagaaattgtattttgtttatgagcaaaagagcaggccaagcaatgtcttcagaaacaaagatcttattttatttaaagaagttcctttttgttataagctagaatgaagaatgatttcaggacaatgagacagaaactacctcttgaaagctgtaatgttgaagctggctacatagctaaaatagagtagactgattttcttttctaggcctgtttggtcaatttaaaccatattaatgggtgatcaaaccctgaagagttctctgaggatttaagttaccagcccacaatatactgacaatccactgaacaacaacaaaacaacatttaatttcactttatgcagcacaaacgcagactgagacactctatcaaatggttaagagcatgggtttcaagtcagatccacctggatgtgagctctgggtctagcacttgctaaccatgtaatcttgggcaatttaacttcatgaattctatttcttcatctgtattataggaatgaggccatatttcatgagagtaagatgcattttttttcacattttaacatctctgatgttagaatgcatgttacaattgatggtgtgtcttcattcaattgccaacactttttcttttcttactagtacataactgtgtaattacaacctatgacatttgagattcaattaaataattaacatatacctcatagagttgttctgagatataaataaaataatgatgtagaaccttatgtcctataaaacctgccccacggaagacttctagtaaatcataccagttaatgttgtacagtgtgatgtttgtaaagtctggcattttcctgtcttgttagtcataatttctgtttgccaactctaaaagttaatttctttgcaaaaatctttttgttggaacagtctgcctactgagtagctcgtcaaatttcctctaattgttctggcagcatgacattgaccctacgggtttacatatgaaatatggtcaaaataaaggttttatgaaagtccatattgacttgtctgatgagttgtttgcagacaaaaagaagagtatgtagtgtgcatgcttcaacagtgcctggcccacaggaagcactatagaagtggtgttgagaggcagcagcatgcagggtggttaaagggagaggctctcgagccaaattggctgcgatcaaatcctggcttttccccttacaagctgtgtaactttggacaaataatctctctgtggcctccatgttctcatacagttgtgagaattaaatgagctaatatactgaaagcaattgtacaaaaaaggtgctagataagttttctgctactggaggaaatacacctttcttttatttaagtacctttaaaaggtctgaggtttttcatactgaaaaagaatattccagtaagtttacttttttttttcctttttgagacagagtctctgtcgcccaggctggagtgcagtggtgcagtctctgctcactgcaacccccactgccccagttcaagcaattctcctgcttcagcctcctgagtagctgggattacaggcatgagccaccatgcctggctaatttttctatttttagtagagatgagggttcactatgttcaccaggctggtctcgaaagcctgacctcaggtgatctgcacgtctcagcctcccgaagtgctgggattacaggtgtgagccaccatgcccagccaataaatttacttgtcaagcaggtgattgttataattctgactgtaagaggcttctagtgtataaaacacataacctataaacatgccattgagatatttgtgatcatgtggcacagctcttaaaactggtttgtctagcagtaaacgtatgactgaaaacaaaatatcagataagtctgagattgcttctaacagcctctagagtgtctgtataatattatcttgtatggcttaaaatccagttagtataggtcagcctatactccaagaaagggtcattatgcctaggattttcagaagggcttccttctagcatttattcactggtaacccatattgttctaattttttaaggttgcaaactggctgctatgctggaataactatggccatcaagcatgtatctctaagcatcaacactggtgcttagttggcttttaacttattgatcacaccttttacatatagagaacttcaaaatgaaataaaacttatctatagtttttcattatttttgagtggtaattatgtgttaattcagctgaacaattgcaattagtattatttctttgtaaccaagacacattttttacttttcttttctccctttgtttgcattttattcactctctaatgtcaatatcaagaaactataggctgggcatggtggctcatgcctataattctagcgtttggtgcagggtagggggcgccaaggcaggaggattacttagcccaggagtttaaaaccagccttgacaacatagcaagatcttatctctacaaaaaagtaaaaaattagctgggtgcggtggcatgagtctgtagtcctagctagtcaggcggctgaggcaggaggatcacttgagcccaggagttcaaggttgcagtgagtcatgtgcgcaccactccattacagcccgggtggcagagtaaggcctcaactcaaaaaaaaaaaaaaaaaaattaaaattaaataaaaacctatgtgtccagtgtgttgaaacattgatgtccagacaacttcactctaaagttcagttctgtcgctcagctcaccccctaatatccaatgagttaataataacttatgtgataaggttaataatagcttatgtgatgataataataatcacttaaaaataataataacttatgtgataagttaataatagctcatgtgataagggctgggtggccctctttatcctgtggctctgccacggaatacatgttttccaagaccaccttcacaggaagagcaagacccgaagcaacccttttgggagccacttccagaaatggcttacaagacttctgtgccccaattcttttggcacacatccagtcacaaggcccaaccaaattacaagggaggctaggaaatatcttccctagtgtctaggaagagaaaatcatgtggtgaatagcattttctccaccatagccatacagctgtgtaagttgggttacttaacctccctgagcctcagcttagatgataatacttaccttgcaaagcttctgtgaggattaaatggggaaaagcacttagcatgtggtaagtactttattaacttgttgtatattattactaataattaatagtttctccctaaacacacaaacatacacaggacccaagtcattagcacctgagcctctggtcctctttagtctgaccctctgctgaccctttagttcctatccagccggggttcaggacttaaggcaggcaagactcttgcccatgagatgtgactgtgactagcatcatactccaggagctaggatatgggaaatcaaagccaaagatgctgaaaatgaaccctagctccttcaggagtcttgggggaaggactgtaaatacattaacgtggtagagaggagaatcatcagttgcgtaaaattatgcttaaaagagaccaagtcttaagatagcagctgagccagatgtattggctcatacctgtaatcccagcactttaggaggccgagatgtgtagatcacttgaggtcaggagttcgagaccagcctggccaacatggcgaaaccccatctctactaaaaatacaaaaattagccaggcgtggtggcacgtgcctgtaatcccagctactcaggaggctgaggcacgagaattgcttgaacccgggaggcgaagtttgcagtgagcggtgattgtaccactgcactccagcctgggcgacagagtgagacttcataaaaaaaaaaaaaaatggcaactgaaagaaaggaataaaatgaacacatattgatatttcaaatttggcaggcatcatcatgccaaggctttcacacaaatggcctcctttaattatcacaaggatccttaggtaagaatcattaaccccagcttccagtaggattaaagtaacacacccgggcttacatagctaaaaagtgacatatttaaaattgagtcttcagagtcctaatgttctttgttccatgacagcacttcacacctcttagtcatgctgaatcgtgctaaggatcaatagatctcaaggaatataccagaagtgtttcttgcccaggggaaagggaagtagacccattatcttcaagcaattctccttctcctacttcccacaagaccaaaagcgaaactcagaatcaacgtagggtacaatatattttagttaacctctcccaagcacagacaaatacacccttatctgtttgctaatgtctgaaattcatttcgctgagggaggttatgtgtatgtggatggatttccattaacatacatgtaagaccatacatctcatttgggtcatatagaagatggaaagattttactgagtaaagcaagaatttggatgaagaaagctttcaaaccagggccacagcttcctgacttcagtctgacagccaaaaaatggtccagatgtagtcttgagtcctctgtagccatgcaggcttagaatatggtgggaactggtcccatggaacagtcccatgaactgaactctgagtaccatgccataaagtgcccttaggacatccaaatatatccaaacaaaccaagggatttggagcttagcattttacaggaacagtattaaaacaaaactacatctgcagcagcaggagtgaaatgaatataagattaggttcttccaatctgtcaaaataaatttatctggaattgtgagcaatataaacgctgtaagttccagtctctgactctatttctaatacatgttaggattctacccactgattcgggcatgtataagaagtagtttatgacgccacatgcctcttactttcaatgtatttgggactcctttgtcagttctataaggtggtgacttctttacattaattttcatgaagaatacttagaacagtgttttcataatctgaaaggcaatacagcggagtggttactggttgagagtatgggctctgcggccagagtaactttgtttgaacccaggcttcataatgtaaaagctctctaactttgggcaagttacttctgtgtgcctcagtttccttatctgtcaaacaaggaggtgactagtgctgccttgtaagcttgtttcaaagattaaataatttattctatatatagcatgtagaaaagtgactgacatggtaagggcttcattctctagcaaggacctcaagaataagagaaaggggcaagaaggagacaagagccaagaaaccaccacagtcactgttaccatgcagcggaatggaggagaactagctaatatttgtctcaccagttcatgtctcaacagttgtgaaacagagatcagtgcttctcaaaattgaatgtgcttatgtcacctagcgaacttgttaaaatgtggatttttatccattaggtccaaggtgcagctggaggttctgcatgtcttctttttctttttctttttcttttttttgagacagagtctcactctgtcacccaggctggagtgcagtgtcgtgatcgcggctcactgcaagctccgcctcccgggttcacgccattctcctgcctcagcctcccgagtagctaggactacaggcgccccccaccacgcccagctaatctttttgtatttttagtagagacgggatttcaccatgttagccaggatggtctcgatctcctgacctcgtgatctgccctcctcagcctcccaaagtgctagaattatagacgtgagccaccgcgcccagctgaggttctgcatttctaataggctctcaggtgatgctgatgccactggtctgaagatcaccctttgaagagcaagagtttagagaacacctgttcctaaatgccatatggtctctttcttaaggttgagctctccaaggatctacttacgaaacccttttgttatttttggtcatgggtcatgagtcaagaaaacatttgaaaatagatgttgcttcaaggaaaatggcataggtatttgatattgcattaatgaaatattttgaattcttaagcatttggtcattttccccactcaggatccaagattgatttttccctttcagatcattaattacaaaataaaagattgaggttttttttaaggtaggcagaatatctccatttgctttccaaatagggatggaatcagcaaaagcaaacatcttcttgtcatatgatgactgtccccttcccaaacaaccagtcctttaattctaacctcatgcacatttcaagagaaatgtaaagcagatggttgtgttccactgatacataaatcacagaaatttctcataaattcttttgattgttaaaaagcttcaaactgccaggcagtgttttgcttaaaccaaagatgggcctgagcaaacagctaagtggaacagcattcaggcttgaaaagcttaagtttagtcagatgatttccttgctatctcctatagacactttttcatagaaattcaagatatgcgaagacttgaacactgtgtgtgtgtgtgtgtgtgtgtgtgttttaaaatgtctacaagcgaaatcaacaagtatcattcctgttctcgaacagcagagagacctccatatcccaccaagttacttgtgacagattgttacttactaattccaccaagatcataaagcaatgccttacagtaagagttggcaaactttttctgtaaatggccagatagtaaatattatagattttgttgctcattcagtatactagtttgctaaggcagctgtaataaagtaccacaaactgggtggttaaaagaataaaaatgggttgtcttacagttctggaggccagacatctgagatcaaggtattggcagggttgattctttctgagggctgccagaatctgttccatgctgctcttctagcttgtggtggtttgctggcaatctttgacattcctcagctgcatcacttcaatctctgtctttctcttcacctgacattatccccgggtgcatatctgtgtccaaattcaccctttttagaaggataccagtcatgttgaattaggggcccacactactccagtatgacctcatcctaacttaactaattacatctgcaaagaccctatttccaaataaagtcacattcaaaggtaatgggggctaggacttcaacatatggatttgggtggggtttgggaaggacacaattcaacccataacagtatctgtcaataacatatgctatttgtctcagctattcaactctgcccttgaagtgcaaaagcatccatggaaaaatacataaacaaatgggcatggctgtgttacaataaagctatacttatatattttttaatagatggcaagcctgtaggcagtagtttgtgaacacttgccttagagtatctctgattctttgtgagtatgaaaaagaaaaaaaaaacacatgaggagatttggcacttggcatagaagaagagaaaaaactttgcaagttttcaaaatgcctattttatatttggaattttagtcaaaatgctttacatttagctttaatatcttatctctacattcaaatatactctggatttatgtacacagtttcaattaagcaaactgatataaattttataatggtgactctagtaaacatgatacactttgtcttcagactgctactaagttctagaatgacagcaaaacaggcttttccatttaacattatacctgtatgctttgattttttgtatgaatatgtctgaaacatcaacaattgcttatgaacttggaatttctttagaaatgtatccatgtttatcctctgtgaatacatgtgtatattcctttccctttaattaatatttctagagtacctacaggcagtgtattaggctgtaaacaatgaatcctgcacaagacacattgtttccaaagacttataccctctggaagatatatacacaaagaaaacagacagcatatgacatatgttcaagcatcatccaaagatttacatacacaactgccatgtagaggacattgctttgttctgcttgggtccgtataaatgcatatatgtaaatctcacatctccatttataatgcatcttcacttggaaccttcatggaaccaaattagagagttctgtatagggtcatagatgtaagagcactttaaaaggctttcatggaaaacttgaagattgactatgccgtaaagaaaagactcaatcaggcacatactgtatgttttgcaatagtaacaaaggtcatgctaccattatattaaaacttagatccagcttattttatattaaaatgttaggcctctggaactcttcctccacatggttataaagatagctagagtcaggggccagcatctgcttgaaattttaaagtaacatatgtgcaagtagtgactggtgttactgaacccactcacaggtatcagtattggatatggggggctcattcagcttcagcaaaggtgccccataaaatcacttatctggagtgccccatttagaagctgaaagaaaatacccgctagattatacaaattataaaataggtcaaactaggagagcaaatgagtagatcatgtgcttttaattaggtttttaccttaaaggttttcagttcagacagagatattcagagcaagtaccaactatgctgacatacatgaaatgctgtatgaccagaaatgtcagatgtatatggctttaataattttaaccattttaggtccaaagaatacttctaaaatcataattcatagagtattctctttgggattataaaaacactatcacatttcctgactaaagacccatgacttccaacaacacaagccaacatctgcctttacacatacagttgattccaaaaccacatgtgggttgactttatattgctcaaattaagatttgaacattggtaatgaaactagaatttatcttacaaataaaacaataaagcatccctacattatttttaacctagaaactctgtgaatctcttggattctctggtctgtagtttagaagccatcgtcctgtcctaagaatcttccacacatttgtttggagatggggcaatttctctcatttctttctgcgtttacttaaataaaggaaaggggcttccatcttctcatagaactaaaaaagaaaatgaaactaaatggctttttttcttctcaacactttgtaaactttgactaggaaatgaagcactacagtgtgtcaatgaagaataatgataatattaataatgatggtgatgatgatgataatgatgaattaggcagtataattctcttcttattctaagtctgaaaactgaagcaaaatgatgaagtgcctttcccaagatcagcggctccacaatgagaacttgggtttgtcctccctcacacatcttcttcagaggagaacaaatatcactaatgttcatccgcaccaggagaaaaccatactggcccattcaatggccaattagaataaattgtatattaagaaaaatacgataggtagtacaaaaatcaaaagctctccaaagaaaaggaacaaaaaacctgaataaataagcttaacggtccattgtttgtggggaaaatgatgaaattatcatcaaaatatcctatgaattgagaatgaagatacatttttatgtagaaagatttttacaaaaaataaaaataaaaaattctacccagaaaagtaagactcttctaggacaggtattagtttttgttaaaggggtatcagtctctttctgataatagaaacaaatatactgtatatgaatcttagtaaactagtcaattatgattcttcatcctaacccatatttaagagaatgtttgtgactgtgctgaagatttgtacattaaaactgtctatacaggagagtgttctaattatcacagaattggcctcacagaatctgaatcattcaggtgaaaacattctttttatttaagagcaatttagagacacaggttaacaatagatactataacacagctttttgcctacaaaaaacaaacaaactcgtctaaatatcaatctgcagatgccaagcctgtgtttaaacaacgtgttaatttgcttcccctgacaaaactctgggtgaggtattgtttccacattcagggacgttagcccagtaatgcagaaaaaaaaaatcttcatttggacattgcatctttcagacattcccttcttttattgatttgttttctcctgtcccttttctccttcttttgtttccttatcatagcttcaggttattacgtgcaaagtattgatgggaatggatggttttggtcgatggagagctaatgcatccctaatcccactattgttgtagagttatgctttcctctggtctctgatgggggaaaaggtgcaaagctgttgatcctagttttatttgtcacaaacccatccatcaatcaagcgcaagcatgtctgaatgctgaatggcatgggggtctcagctgaaaaaattcgataactgtattgtcaggtctctcactctttttttgataagaaatacatttgactgaaatagataagcatgcaactactaaagacttgaagagagagaatgacatattggcaccaaaggttatatatctttggtattaatgatacttatgagtaaataaaacaggagggggcagctatagctagagacatacaacatccctaaggcttggtgatgtttaagtattgtcgctctactattatgtggatttttgaatattaatctgaccatatttcacagttgacaactctggttaaaatgcaagtcaatctgcagctggtgaaggtggtgtggttcagggaatcgaatatcacttgtttacatggatctggacattacagacagatcctttgttgttatgtacagtaggtaatcccatggcatatttttgtgtatgcatgaactcatacgttcacaactgtctcatcttgcaagtgaaagcatttgggggggaaataagctttaattattttaaactgggaatatatatgcatgtaatttcaatagtgaattaacttatagtatcaaaaatagtttctggtgtcccttttattctagttactaaattaggtattttaatataacataattaaaattaatattttaattatgaaagcttgtcttttcagttatataaatttttctactcataattatttcaagataatttcatttagaaatagtaaaaacattaaaaacaacactagtataatacaattttaggggcaaaattaatcaacaaatcagaacatttttaaaaactagtttattttcttgtcataacatgttagagaagacaagtattttttaaatgacctaaaaaaaagcccatcaagaaaaacaacaaaaagacagccttgaattagagggcatgaagatgaatgttttgtagccttaagtatcccatgttatgaaagtaagccatttttttctctgttcagtgactgggggctagacaactgaaaaaaaaaatcaatgtgggaatgctttagatttgttgggtaaattacatgtgcttggctgctccattgtatctgccctatattctacacaagataactgtagatggaactgtcacataatgcatatacttcacattgatttttatacttttaacagaatttcaattgaactccataataaagcaagaagagaaatgatatctccctcacattcctaatacttgaattatttttgaaattaattaagtaaaagctcccagttttgaaggcatggtgagaggcaaaaaaaaaaaaaaaaaaaaaaaaaaaaaatcaaatttggtttctaattctcctcaccgtctgtttttctgtttttgtttcagttatttacatttcatcttaacttccccacctctttaaaaatacgttaattcttaaagactttccaggagggcccatgaaccagcaaatgagagacagctgaaccttcgggagttgcgggagttgcaaacattgatctttctgttgacatccttttgggtttctagcttgctctagttttgcctcactttccagtgatttttagcattactgtgaagtctgatcctgtttaaagtctctgatgccaccataagggtttgagcaagagttcaaggagtccttggtgatcccaaggacaacctttctcagcctgaccttacctatagagaccccaaacaatcctagtggggaaagaagtaagtcagcccctactcagaaaaatactagaaaattgctccatcaactgtgcatacccaggtgttcggctctagacagaaatgtaatgcagcttctacataccctgagaacaaggttttactgaatttggggtggcagttccagattgggtgcccagggggaatgtggactttgtaatttcacccaggatgatgagaaactacagcaacatcaagaattcaagaaacttgagatttggcaacattgggactcccctcatccagaaatgccttgggaagaaggataaaatgtgagatgaaagagattcatgttcttatggcattctgaaactattattgaaatattttagaaaatgtaaaatattataaagaaaataaaattggctgagcacggtgactcacacctgtaatctcagcactttgggaggccgaggtgggtggatcacaaggtcaggagttcgaaaccagcctggccaatatggtgaaaccccgtctcaactaaaaatacaaaaaattagccaggcatggtggtgggcacctgtagtcccagttcctcaggaggctgaggcaggagaatcacttgaacctgagaggcggaggttgcagtgagttgagattgcaccactgcactccagcctgggtgacagagcgagactacatctcaaaaaatttaaaaaaaaaaaagaaaagaaaatcaggtcgggcacggtggcttatgcccataatcccagcactttgggaggccaaggtgggtggatcacctgaggtcaagagttcgagaccagcctggccaacatgataaaaccctgtctctactaaaaatacaaaattagccaggcatggtggtgcatggctgtaatcccagctacttgggaggctgaagcaagagactcgcttgaacccaggaggtggaggttgcagtgagctgagatcgcaccattgcactccggcctgggcaacaagagtgaaactccatctcaaaaaaaaaaagaaaagaaaataattcatagtgccatcacccacaagtggcatttgttgctcttttatagtatatgatatgtgatacaatgtaatattgagagacaaataattgatttcatgtttcataggaatattttaattatggccaattccacattaataattctattccaaatattctctgattaaagaaaaatcatttgataagactccatatgataaacagattaatttttccaagtaaatatatagatgtaaaacaaaaactctaatcccatatttaaactttatagactaattgtaatgtttatttggaagaataaatgtgtgatcaaagcccaaaaaagtgtttaaaaaaaagaaaaatgagaaaggactggtaccaggtgggaactatattgtaaagcttcagtaattaaacagtttgtgttctaggaatttgtgtccccagttctgataatgttcactcttaaattgtaatattctataccctaaagcactctccaaaccttaagatgaagaaaataggcaaagcaatagcagcaatgacaagagacctttttttttctactggtatacctcggattttcccccggcagagaaccaaggggaaatgacagcctccacaggatcacataaagaactgagaaattttttctttttttttttttttttgagacagggtctcattctgtcacccaggctaaagtgcagtggtacaatcacagctcactatagctgcaacctcctgggctcaaacaatcctcccacttcagcctcccaagtagctgggactacaggcatgtgccactatgcctgtctacttttttattttttgtagagacagggtcttactatgttgcccaagcaggtctcaaactcctgggctcaaacgatcttcctgcctcagcctcccgaagtactgtgattacaggtatgaatcactgtgtctggccaagaaaccttgatacccatcttttgtcccatcttacagaactcatagaattcatttcaaaacacatatagagaaattttgttatgttctccccagtttttgtctctattgcattggtcatagttctggtagctgtgccttaaaatagttaacaatgttcctccaaggaattaaaactaacacctttgtaattctttttttttttttttttgagatggagtttcgctcttgttgcccaggctggagtgtaatggcacaacctctgctcactgcaacctctgcctcctgggttcaagcaattctcctgcctcagcctcctgagtagctgggattacagacatgcgccactatgcccggctaattttgtgtttttagtagagatagggtttctccatgttggtcaggctggtctcgaactcccgacctcaggtgatccacccaccttggcctcccaaagtgctgggattacaggcgtgagccactgcacctggctataattcttttaaaactcaaacacctttgcagaaaagagaggaagacaactctacacaaaaagctcactcaagcattttaggaactggttatagaaaaataattgtcttatatgtttatatataaaggagtgggaattattacatagcttttaggcctgaccctggttcatgaattttccaaattctaccaaaacagcaaaacagacaaatcagtagaatagaatagagtctggaaaaagactctgggaatttggtattggtaaaagagagatcttaaataagcaaggttgctttaatatactaccagtatgaatgtaaaattggtaagccaatttagaagccaattttgcagtgcctactaaaagacatgcattgacccaacaatgcattgatccaataattccacttctctatatctcccagagaaacactggcacatgttcataataagacagtacagtgatgtagcagtagttgaaatcgtaaaaaattggaaactccaaatgactaccaacaggggactggctaaataaactatgccagaaccatactatgaatatgatgcataagtagaaaaagataagacagggctctctgcactggcccaaaaaaatttccaaaccatgtcactgagtgggaaaaaaaagcaaacttcagaatatcactacacaaggtatcatatgctgaggtaaatacacctcatatacacatgtataacaactacatcaataccattaaaaaaacataaactctcactaatctttgtctaccccaaatcatacatgaaaatatatttttatgaattaggaacttaatgacatttttaaaactataaaaattactaaaaataaatatacaaaaatatgtatttaaccttagcatgacacgaaggccagaaacactaaagaaaatttctggcagcattaactttatgacagaataacaacaataacaaacttctgtatatcaaataatgccacagcaaaaattttaaacaaaattgttggagggagtttaagtggctacagtatctcttcaaaaaaaatttctcagtatgtatatttaaaatgcacataccttgtaccctagcaatttgacttacaggggtttatgccaaaaaaaattgtacatgttgccagttgtgtgtgtaaaaggatgtttagcacagtattttgtgtttatagttgcatataaaagggggaggattaaatgcccaccaagaagaaaatggctaaatagattatggtacttccatatgctagaatacaatacagccattaagatagataatagtatatagtcaaccctttgcatccagttccacatctgtgagttcatccaactgcagatcaaaaatattaaggaaacacactgaaaataacaatactgcagttaaaaatataaatcttggctggacgccgaggttcatgcctataatcccagcactttgggaggctgaggcggatggatcacttgaagtcaggagtttgagaccagcctggccaacatggtgaaaccccgtctctactaaaaatataaaaactagccaggcatggtggtggacacctgtaatcccagctactcgggaggctgaggcaggggaatcacttgaacctgggaggcagaggctgcagtgagctgagattgtgccactgcactccaatgcattgatccaataattccacttctctatatctcacagcgagatatagagaattacaaaggtgttagagtttgaattctttggaggaacattgttaactattttaaggcacagctaccagaactatgactaatgcaatagagacaaaaactggggagaacacagcgagactccatctcaaaaaacaaaaacaaaaacaaaaacaaacaaacaaacaaacaatatatatatatcaaaatatagtataacaatgacattgtgttaggtagtataagtaatctaaagatgatttaatatatatgggaggatgtgcataagttatatgcaaatacttccccattttatagaactgcttaacatcctgaagaatggaggctttcctggacccaatctccagcagattccaagagacaactgtattaacttttattaagttccatgagcaaaggtccatttctgagttaaatacattatctcattcaatcctttcagtaatgctttgaggtaggcatcatcagaattctcattttaaagatgatagggctgagactcagagaggataagtgcctccaaaacatacaactgtctcaatccaaaacagaaattcttggaagatttgtatgtactaacatagaaagatgttattgaaacactgatatgaagaaaaaagaaattataaaagaagaaaaaggaagttatagtatgtatactgtaatgacatttatgtaaaacaatgtaaaagtgcaatgggaagaaataaacatgttaatgtggttgtctgtagatggatgagggagtgatggggattccctatcttctttttacttaactatattttctaaatttttttcagcgaggtacacacgttgcacttttaaaaataaagtagataattctaggataaaaccagtaatgttgaaatgtagagcaatgaatattattattattgtagcaaagataggtatttaagattcagtgttttgagacttctaatgattttgcctggagaacacattcctatctgtagaggttagaacatgaaaaggcagctggccttttttaatgataaaaaattagtatatcaattaagatataaaaattatttctttctatgttctaattacctagaagttcaggtactattttaagtactttggtgtttctgtttatttatttgtttggagatagggtctcactctgtcacccaggctggattgcagtggcagtaatatggcagcctcaacctccctggctcaggtgaacctcctacctccacctcccgaatagctgggactacaggcatgcaccaccatgcccaggtgcttttttacctggagtttcaccatgttgcccaggctggcctcaaactcctggactccagtgatctgcccaccttggcctcacaaagtgctgggattacaggtgtgagccaccacacccagcctgtttttaagtactgtaaaataacaatttatgagcagactaacatgaattgtgggtttcttaacaaaaaggatgaacgaagcaagttaccctaaacctattgtctctatttttcaaatgccatcctttgagatcagacacactttgtttccaggcaatatgctgagtgggaaatgcctagtccagtgggctgagcctgtcagatcaatacaatggaatctgaacttgtcacttgcaggggtgtgctacctgaggcaaaataactgtcaagcaccaacctctaactcaactataatcatatcaaacactcttgccttttctttgctctttcttattcttttctttctttcctttttttttttaatcttagtgaaatcaggttaaaatgggtatcaagaaaacttggaggctgtagcaagaaaaggtagtcctatactttctatggcagaaatattaaatgggaccgaaagtattgaataccttttttcgctcttgttgcccaggctggagtacaacagcgcgatctctgctcaccgcaacttccacctcctgtgttcaagcaattctcctgcctcagcctcagtagctggaattacaggcatgcgccaccatgccaggctaattttgtattttgtagtagagatggggtttctgcatgttggtcaggctggtctcaaactcctgacctcaggtgatccgcccacctaagcctcccaaattgctgggattacaggcatgagccatggcgcccagctgaataccttcttattcctatagttagaataaaagctagcactgcaacctgggttgcctgattcctgctggcacagagttctttgacgggacaaaactaagtaacattcagtctgagggggcttgtgtccgtaataacacagatgttttgcctttgtggataatggcagtggaggtgagggtggggtgaagagatggggatatgcactaactgtagacacgtaagctttaacaacagcaatcggagtcactttcttttcccttaactgcattttcctgagaatgacaagccaatggttccagtgttacagactctgaaatgccatactctaaggaaagtttctattcatggaaagccaaggactgggaaagaaagagtccttgatgtttttttttttattttcatttgcactttgactaaaaagatagtgaattgaggataaacaggcacatacacatatgatttgaggaaaacagtcctcttgcctcagaaatatgtcctctagtgactttctggcatacttgatatgcccacagtgaagaatcatttgttggagatgaagaattatctacgtattcaacattgaaaaaatattaagaatgcatttaccaaacctgttcttcatgccccccacctcaaaaaaagtgatgactgaatagtagagtctctatcccaaagaaacttaaaatctagataggagtcagacaagaaataagacaatttaaataaagagtgatgtgggccagatgcagtggctcatatctataatcccagcattttgagaggccgaggcaggaggattgcttgagcccaggagttcgagaccagcctgggcaacacagtaagacccccaactctacgaaaaatttttaaaatgagctaggcatggtggcacacacctgtagtcccagatactcaggaggctgaggcaggaggattgcttgatcccaagaagtcgaggctgcagtgagctgcgatcacatcactccagcctcggtgacagagtaggacctcgtctcaaaagcgaaagaaagaaaggaaaggaaaggaagagggggaggggaataaagggaaaaagaagaaagagagaagaagggagggaaggatagagggaggaaaggaggaaggaaggaaggaagggaggggagagggaaggaggaaggaagggagggagggaagtgttagcacaaggtgaggatatttatcactcaggagaaaggaagatgagacataccaatcgatgagcatagatatggtggaacccagaactggaagaagtggcaagaggctagaaagtaaatagcagagagtaagggctaacacaaagggctctttttatcctgaggagaaggaggagagcctttgaagggtttaagctggtgaggaagggtggagtgagtagggatgagaagacatgtgatatatgaatatattatatttatgcttgtataataatggagagaaaaatgcatcaagccattaacagtcacaaacatacttgaagaatttgttttaaaaaaacaattggcagagggaagcattcagaaattcatctcaaaattacattcttgctccaaaactgtggaaaacccagagatacaaactcctgacagaatatgtatctatttgagaagtcaaaactcctgtacacacacaaaaaataaagtgtacctattaacctatggggtggggatttctatgtagcagtggcttaggaaagggcacgttccagaaaaaattaaagcagcctccaaaggcctcatggaggagaggaaagaagacttcctgaggagagatagtgaggacaagggttttcttgggagggtggggcggggtagatggaatttgtgttcaaaaccaaaggcttgtgacatttgttgtttgtttgtttttgtttgtttgaggcagggtctcacttgttgcccaggctggagtacagtggtgcaatcacagctcattgcagccttaacctcccaggctcaaatgatcctcccacctcagcctccagagtagctgggactatagatacaaacgccaccacacctggctttttttttttttttttttttttttttgtagagacagggtctcactatgttgcccaggctggtctcaaactcctgggctcaagcaatcctcctgtctcaggcttccaaagtgctggaatttcaggcatgagccaccactgccagccttgacattcattcttgaaaccttaactgagccctgaaccagatggttttgatgtatgcagtaaaaataggtggaaacgacttgtctccaaagaccttcagtttagttatctggtaggaaaagagaagatactggtttgaatggaatagaagctttgttgaagggcagttcagagtaagggaatctcctcagggtagggggtgggggctgggactgggaggaaagggacctgcatgaccaggggtgcaacttgagggttctgagagagtagagaccaatcagaactctgaagcaaacttgatcacttcacagtatttgtcctactgatctggccaaagatacacacatacatgtgcatacgcacatgtacacacacacacacatttaatgcctacagactgcagtgtaccctagaagtatacatagattgtccttagatggaaaaacagcctatagaatgcttcgttacaatgtgtttgtattttagctagagttgccttccaaagaccttattgctaagaaacaatcaaagtgagagccctcctttgttaggaacaaagaagtttgaaaaaagattcctttggttcatgtgtcatttagttgaaggatgtttgttatggaaaatgcagttatgaaagtcataacaggcatcctaaaccttgacttaaagggtttgctttctacataagaaatcgttatctatttgttatattacatttgtttaaataattatctatttgttatattgaatttgtaatgtatagaaaaatataaatgaaaaattattcatagttgaccacagctaacatttaaatgtaatttctttcaattctatgtattttagccagttatgtcattgaagctgagctttttatttagtaatagatactttcagtttcccctctgatcacaaaggccagaggactctgttcaccgacgcaggtttctggcctgctaacctaaagtcctgtgttaatgttccgggtaacacagattttaggttttgagctgaaaggcacctaagggattaaggtaattgccctagaacagtggctctcaaagtgtaggcctcagacatgcagctgtgactttacctgtgaggtggttggaaatgcaaaaccaagggatcttcccaacttgctgcatatgaagctctggggatggtgcccagaaaagagtggggtcttggatgggggtggggtgttttgttttgttttgttttttgagacagagtttacctcttgttgcccaggctggagtgcaatggcgtgatcttggctcactgcaacctccgccttccaggttcaagcgattctcatgcctcagcctcccgagcagctgagattataggcacctgccaccacgcccggctaatttttgtatttttagtagagatggggtttcaccatgttgcccaggctggtctcgaactcctgacctcaggtaatccacccacctcagcctcccaaagtgctgggattacaggcatgagccactgcacctggccagaaaagagtgttttaacaagctctccaggtaattcttgtgcatgttcaagtttgaggacaaatcccagagaacacacaacaagctagtaatcatcacaaatccacagcaaaccctaggaataacgtgttccatggtgcctcctctcactcacacagtacttgcaaagagtaggtacttaaagcttgttggccgggtgtggtggctcacacctgtaatcccagcactttgggaggctgaggagagcaaatcccttgagtccaggaggtcgagaccagcctgggcaacatggtgaaacctctctctacaaaaatataaaaagttagcagggcgtggtggcccatacctgtagttgcagctactctggagaatgagatggaggattgcttgaactctggagctctggaggctgcagtgagccatgatcatgccactgcactccagcctgggcgacagagactctgtctcaaaaaaatatatatataaaataaaataaaataaagcatgttgactaaaagaatgctctcctaaatttccccaaatctgtaaaccatttcccatgcccttctgaacagatgccacctaaatttgcccttgaagcaaactttccttttattttccccagactttcctttgacctcctctaaagaaaaaaataagtaccacagaattttcttcttatctttcctggttgcaggcccttgctactcaaagtgtaggcagcagaccagcagcagggcatcgcctggcagcttgttagaaatgtagaatctcagacttactgaatcagagcctgaattttagcaagacccctaggtgatgcattcacacagcaacatttgagaagcaaagttctagaaagccagctgctgctcatgttcctgctcaagtgagtttcataataagtaaatttcatttttttttttatttgacggagtttcgctcttgttgcccaggctggagtgcaatgacacgatcttagctcaccacaacccccacctcccgggttcaagtgagtctcctgtctcagcctcctgagtagctggaattacaggcatgcaccaccatgcctggctaattttgtatttttagtagagacagggtttctccatgttggtcaggctggtctcaaactcccaacctcaggtgatacacctgccttggcctcccaaagtgctgggattacaagcgtgagccaccgcgtctggcctcataacaagtaatttttaatattacactatgtggcactaatttattcaacaagtatttcccaagtacctactatgtgcaaggattggtggtatggaaacaacattgaacaagacatggtctcagactccttgaggaatgtatagtttacagaagagatagactgtggccaccaatagccgggataccaagcagggtttggtaagaggcttctgagtggcctaaggtattgctattcagagaggacagagaatacttcctacaggagtgatgacaatgattgcttctacatgtagaagaggattttaaaagtcatgaaattagcaaattatattatagtataaacatacgaagttcagagtatcagaaatgactttagaaggtccctcatctaaagacatagcagaatatagtgaaaagagcttcagctttgaaaacagaaagacctgagttcaagtccaactggttaatcttgggaatgttacttagactctctgaaactaacttcctcatctataaaaaacacaatacctaagtttcagagttgttcacaggattagtgagagtgtgtgtatagtgtctggcacacagtaggcactcaacaagtggtatgactgttctgttcttgttcctgaggttctgtgtgacctataccctgtctccctttatctcaggcatgtggcaggagctgcttgaaagtgtccacacttgggagtggctggatctggcctagaaaggttctagccactagttcctagtcattgctctgaattgtagcactttcttcatacttcagtcttgagtggacatgaaacctgaaaattatgtgtttctatgaaaatcacttattgatctgcacaagaccgagaggatattactaagttgatttatgtttatgcaataatgtagatcaaattattttgaaatgttttgagtctagactgaataagtgagttttcctttgaataattggtattgtgtagataaggcctttattcctctcattcaatctagaccaatttgaacctcagttcgtcttgtgtctggtaacgtcaggagccatcaggatccagaataaagaatgaatcttatctctcctctcctctcctctcctccgcccttcttcctccttcaactcctttttttccttctcctttttctttccctccctctcaaggctattgaattttttatttgcttctcttaggaactgagccttgattcagctctgtactgccaagtaaatgactagatcagcttgaaatcttatgtaaatgataagatgtcaaaatagtagtccaaaatagtagttgtctaatgcctctcatagtctttaagaggtcattataatctgtaagagaaagctgaaaatattttttcaatgttaatgactcagaaaacagtagatattgtaccctcctatttctctgaaggaaaaaaagaaagcgtctcatagcccaatagattctataaaacagaaggcaagaaaaaatatcttagaaattactcttgaatactaagggcttaaagctcaaagtgcctgattatccaatggacagacccatacaagatggagccccacaaaatcagtattgccataaagctagagtgatcatatactttatcacttctaactcatttaacaattaaagggtgctattaataactattaattatagtcatacatacttataataattattaatgtagaatagtcctgggaaacagggatgtatagctatccttcctaaaggcatgcaagaataggaatatgatttggagcagaggtgatggtaaagagataagaaaaatattatttttcttcatttaaaagacaatgtttgatgtgataagtgtatttgtaaaatctgtccactaggctatatagcttgatagctatgaatgctcaaaaacatacctcaccttatttattaagcaagttcagctctatgaaacataacctagaattaaatctctgagtggcaaagcacacccattaacatttacgtgcctcaaagaacacgaaaagaagccccttagcccttccctcaaagcttactgaatcctccttgaaacacagcttgttaacacatttggttaacgaattccaacccacagtcctagaaataagaagtcatatataagaaaatataatgagcctggcacacgcaaaagcagcagagggacacttgatagcctcattacgagaagccagacagaagaactccaaagcacattctctgtggcctgtaaacctatagtccctgaaaatcccactgttctacaacacagcacactaactgatttccatcattacaatcttgagtcatcaataagaaagttataatttaaatgagaagtcatggagttagaaagactggattgtagttctaacactgccattcactagctttgaccttgagtaaattattcaacccctcgtttagagggatttaacccttattagcattagcatcatctgcaaaatgggaagaatacttacctaaggatgatgataatgatgaaatgtgttcatgcttttaaaggcctagcactgtgtttggtgtatgggagctgctcaatcaatggaagttgtcattcatcataataggaagtcctgtgtgttctacataacaagaatgttaccctgcatggcaagaaacattacaagattatcactattagggtttttaccaatgaggtgctaaccgggtcagtttatgacagcagatgttatggcttgtttggaatggtaggcatgaaaatcaaatagccatgcatgattacataagcaagaagaagaatttgagcagtagattatcacagaccaacagaacagaaagtgtcatgttctattggggtcaggatagaaagtgatatcccaggggctcaatttagggaggaatagagtactcccagatacccaggtcctcttccaaagttggggcctaggatcctgtggcagaccatttgaccaacatgaataaaatttggaaaaaaataaaaaggtttttttttcccccataaaagattagccttcagaagttcccaaagtaaaaattgtttataagtggattgcattgccttgagaaattagtgagtttttcatcaacagaaaggtgtgttcaaacataactttaaaatctcttgaaatgaccattattaaatggatttaagcattgtttggaaagctaaattaaattactttatcatcgtcctttccaaaactaaaacaatatttcacttatgtggaataatttatagattcattaaaaatgctaagtaaatgaagtgctattgtaaatcatttattgttctgaatataaatgaatatgttaattgaagaaattcataaggtatcaaatacatatataagagaaaataaacaatcatgagcctgctcatctgtcataaacattttctttccatcatttttccacaagtttttccaaagtttagactgtattatacaggcaatttttatcttacagttttttgctttgttataatcatttttgtgtcatcaaaaaatgttttgggggggccagccacagtgactcacacatatattcccagcactttgggaggccaacatgggaggactgtttgagcccaggtgttcaagatgagcctgggcaacacagggagaccctgtctctacaaaatttttttttgattatccacgtctctgtgatgtgattattatgcactgcatgcctgtatcaaaagtctcatctaccccatatacacacctactatgtacccacaaaaattaaaaattaaaattaaataaacattttttaaaaggaagaaaattagccaggcatggtggcgtgtgcctctagtctcagctacctgggaggctgaggtaggaagattgcttgagcccaggaggtcaaggttacagtgagctgtgttccagccacagtactctagcatgggtgacaaagcgagaccttgtctcaaaaaaaaaaaaaaagttttttgggcattattttaagggttacaaatattatgttatctcaacacatcaaatttgggctccaaatctacatgcctcagtggaaatcctgctctgcacttaccagctacgtgatttgcgcaatttactaacacctctgtgcctatttcatcatctgtacaatgtgaataatagcactacctatctcatagctttattatggagatgtaatgagttaatacatgtaaaatacttagtatctgacacatagtaaatattcaataaatctttattattgttctattcatttccctaacatgaggcacttagattacttttcatttttaaccattacaaataattctgataaatatctttgtaataaatgggttatgaaagatattcttcacaatccaaactcttcagccatttttttttgtttcagctgtttgtttttaagcatgaaataatggatgaacagatactatttgtttgaaaccagtagctttgtcaatatgtttttaaagaaagaataataatctatttttattgttttctgtcttccttttttacaaaatcatggtacaatacacataaattttaccataagtgacatttagtatgttcccaatgttgtacaatttgccaatatgttttcaggccactgatctcaaagatggtcaaataaaatgcataggaaggaagcaagaagaagcaaaccttattagcctcaaaatgtcttttatgaacaaggaaacaatatttccttgttttcaaatttcattaagaaactattgggtccaaccaccaagttatagccactttaaatattttctggaagatacatgcatccgtaaaactttacttccataatctgttcggtcagaaagatgacagaagaaaaagggttaacacttaaggagtctttaaggagttcggatattgtggaaggtggttaacataaatgaccctatttagtccttataaagatgatgagctatagcaattgtccttcagattacagatgaggaaactgaagtttggagaatgtgacataatttatctagatgcacacagctaagaagtaacagagacaggactcaactcagacctacctgattcctcaggtccatactctttccatataccactgccttgttgaaataagcatgtagagcccagagtggtggctcatgcttgtaattccagcactttggtaggctgggacaggaggatcacttgagcccaggagtttgagaccagcctaggcaacaaaatgagaccccatctctacaaaaaataaaaaaattagccaggtgtggtggcatgtgcctgtagtcgcagctacttgggaaactgaggtgggaggatcacctgaacctgggagatcgagtctgcagtgagctgtgatcatgccagtgcactccagcctgggtgaccctgtcaaagaaaagaaaagacaaagacaagacaagatgagacgagacgggacgggacgggatgggacgggatgaagggaggaagggaggaagggagggagatgaaataagcatgtaatattatcctaaaagaaagagattctctgaaagttacaacagaaacttcaataaccatctagatagaaaatctcaagtccgctaactaggcaatccaggttttgcagctttccttagtagttgagatagtccttctaatattgcatcctctatttctgtccctttattgcctagatgtgtcaacatccctgaaggggttatcctgaatgtgttaggcactagcgctcagttccatgtcaaaacacacaaaggcttgttgacccaacaagaaattggttgtagtgctgctttacataaaccaaaatcacagatctcaaaaactttcactcttcttctatcagttattttttttcacatttgacaacaaacacacacagataatcaagaaaagagggaaaaaatgtttttcactggaagaatcaccagaatttactgatagaaattagcagtgggaaatggagtcttgtgttcatagtctcatcttgtctaaagccttgttttttatttgctcatgtccttgagttttctataaggctcaatttttcatttgcaacacatgaataattaaaacttgtagctttgggacatgtaaaatcatattcatcaaatgctttcatataaaaattgtttttagacagacatgcaaacatatatggaacacctagtactgcactaagcataataaaaacaaaatgctaatactaagtagaaaccagtatgaacgtggctccctcatccaaccagccctgaatggattagtctgttgtggttgctgaattcaacttctctgacactaatacagctggattgcaggaatgtcctgtaattcacttgtattagaagccattaaaattttgaatatgttgcctattaagtaggttgtatattcctacccctctacttctctgttacttttttataaagaggccatttctgcttcagttgttcttactttactttctttgcacctctccctcccatttcacccataccactaccatctgaggcagtgtgtggtattcctgaaacattactgaccttcttcaaagtaaaagaaaaagagctagcaaatactgtaaaccttagaagagggggaaaaaaaaacttccttcctaaatggctacaattgacaaccctgccatttagtctaaagagcagtgaccaattttaagtcaatcttcaacttttaagtggggccagaattccccagtcctgtatctagctcagtgctttggtgggataagagcatatgcccgtagagcacaatactcttttttcagagtgacattcatctactcagacaaatttaactccatcagcagaatcaagttcacgaaacagtggctgtgcaaattcacaatgaaatctttattaaaatctagaatcttccagagcattttacaggaaaactgtaaaaagttaacttccttttttcctttctctctctttcccctagcccccacaatgatatcagtaccttatgtaacttggatgttccacagcttataacagaaaaaatatgtcagtttagtctttaaacagataaggaggaagtgtacgcaagaaaaaggaaagttttggagaggcattttataatttctcaagtaataaatactagtaactattgtaaccaaaaaacaatgcattgactatggttatcacataaaaatcctctaaggattgcttttaaggacattatgacaagctggtgatttccagatatttgtgctagtaggacactcaatactccataaatcattccaccaagatggttgcttattatggtctgtaagattgcattttccagggcatgactatagaatatctaaaaatcagcttatagaatactttgagtcaaacaaattgctcagaaaaaaagtaattaaatctatcctttaggcaatttggagggtatttatcaaaattataaatgcatatacctttattacagcaattctacatctaggaatttattctaatgaagtacacatgtacagaatgacttatatacaaaattactcatacatacaaaatatgacattattgcttgtaataataactattgaaaatgattttaatttccattattaagaaatagtttaagtacattatgatagaaccatgcagttgaatctgaagccataaaaaagaatgaagatgttccatatgtattaattcatttagaaagctgtgtaagatacagtgttaaatttaaaaagcacaaattatctctggaaaactacacaagaaggtactaacatagtctgtaagtaggggaactaagtgtctagggctggagtcaaaaatgagagagaaaactttttatatgttttgaattttgagtgataggaaagagtctggtcagttagatcaaaacaaatgatgtagaaaatgccttaaaaagtaaaacatggccgggcatggtggctcatgcctgtaatcccagcactttggaaggctgaggtgggtggatcacgaggtcaggagatcgagaccatcctggtcaacatggcaaaaccctgtcactactaaaaatacaaaaattagctgggtgtggtggcatatgcctgtaatcccagctactcaggaggctgaggcaggagaatcgcttgaatccaggaggcagaggttgcagtgagccgagatagtgccactgcactccagcctggcgacagaacgagactccatctcaaaaaaagagtaaaacattacaatccacgtatccttcaaactggcttgtaacagaaaaactgctataaatagttgtcttgtaaatgctttcagacaccaagataaccaatttagcaaaaaggaaaaaaatcaaatcaacaataaaaaaggctttaattatataatatacaatatacatacatacacacagtgaatggcaatttaatttttcggttttcacatgttacaatcatatcatgtaggcaccattatttatctgatcaattaagagaccaatggttattctttattatcttaaatattttttgagcacctatgatatgtaagtaccaggttgattctggaaattcctgtgtcgaataagacagacatggtctctgatctcctggacagttctggtacttcagctactaaagacagaaaaatttccttttttagaatgatacatgcaaccctcaatagctgctttcccagctaagtaaaatagtaaacattcaaatgtgaaatgaaaacagctggagcagctgggtacaatttaactttacatgaaaaagtcctcagacatagattacttattctctccatatacttgagcaacttctgttctgggtcaggaggctcagtgtataagaatagagtcaggaaaagctctcctctttcctcacatctccatcttcctctatatgaacaccttcctcagcccagaaagaaggaaacacacgaggagtgcttttaacaagattccataatttgcagttgatataagctgtttgcatgatgtgtgctctatttttagggagtttagaaacatgttgcttaacacttgtgagaaaatgattgcacagtctctattagaatctcattagcatacgtgctccatttttttgagtgtagacttacaattgtaaatctcccaaactagcaaagcatactttggtgaaaggtgggacaggggatggtgttttcaaaaagcaggggaagcgaagacagaacagggagaatgtagtaagagtaactccatccttgagtgcctccttcgcacgtgagacattatacttcagaaataagatgctttcccatatgagacaaccagagtcaagggtagagaatagtctgcaaatgagtgaatgaacaggagaaatcaattgttaactgatgtatattccatgcaagtctgagcaagtcacaggaaggaaacagagaggcccactacctgaggaatacctggactgcaaaagtggaagaacagcataatcacaaatagaatatcaggaagatttggaatagctagattggtctcatcactgacaatctgataaagtgaactcctgtctttgcttccttgctctttttttttaacactattggacatacaggtatgcacaagtttcaggaagcaatatgccttcagaagaacaagatatactttgcaaacctgagttcatcactgaatcaaatagatcatttttatatgtttttcagggaactttaattatacatagaaaaggaaacagccttgatttctattgcatttcttttggctaccagagtagcacatataattttgaagtaaccatatgtcactaactttacatacaaagaattccaatttgcctcatagtttgcaagaccacacactttcaaatgtctaccatacacaatagaaaaaattggtgagtgctttacctcttacattgagacaagggtggggggaggaacttaaatatgttaacataaaatgaactagtgagagcaaatttactgttgaaaattataaaatcctacagaaatactcctgtgttgtctgcttatcacatataaattgtacaccaaaatttttatttattggaaacatataaacttttgtacacttaaggattaaatcaccaagatgccaacgtatttatcttatggcaattgctcatgaaatgacatctcttttagtagatgaggtagttaaattctttgaagacaaatgaaacctagatcttgttttagtcataattcaaaggctaatcttacaaaatggctaatctttaggaatctcattcacacttattcattaccaaatttttacagtctggccaaagaactgctaagaaataataacaagcagtttagttttgatatttatgaacaatctaaaaataggccaggtgcaatatagcctagtgtgtcaataagatctttgaaatttattctttgtagataggaaagaggatatagattatcttttgaatacttgttaatattaaagagttgacagtcattttaggcttataaatatgtaactataagtgcaattgtttgcatgaagaattcactaaagttttagaatttctaagggattgagtactatcttgaatctcaaattctatagtcttctagttaacgatgaaaattatagtagtagcagctaaggaccaacacaaaatattttcaaatgaataattttgagtgtcatcatctatattatattggtagagcaaatgatagcaaacagattatgttgcctgggtttaaagaggctttccaaaaacttttaatctattagctattcctaaaattatttgttttctgcacagttcactgctgctctcccatcagctaccttcttttttttctttcatgttctttattcatcaaatacttatggagcacctgctgggcactaggaccagagtagcaaacaagacacagcttttgtagcccaggtatagttacctttgggccttcattcatcactaggtgcctgtaccatttctaatttatgaaggatgcaaaaatgataatcttttaatcctagatttatttgactgaacataaaatcccgtttcttaacgtcaagcccagaaaatcatttcagagtcatggcaagtgtgacctctcagcctatgagcttcttcattagcccatccatcctaggtcatggccatttttcacaccttttttacactcttctgactttatcccatcttatatgtttactgctttgagtgaatttattaattagttaattttatatacataatagactatatttaaagcacatgcctcactgtcctgatgaaaagcaaaatattaggtaaattaaatgctttttctttttactaatttctgaattctcacttttttttgtttttgtttttgtttttgtttttgttttgagatggtgttttgctcttgtcgcccaggctggagcgcaatggtgcgatcttagctcactgcaacctctgcctcccgggttcaagcaattttcctgcctcagcctcccgagtagctgggattacaggcgtctgccactatgcccagctaatttttgtatttttagtagagacagggtttcaccatcttggccaggctggtctcgaacccctaacctcaggtaatccacccgcctcagcctcccagagtgctgggattacaggcgtgagccaccgtgcccagcctgaattctcactttttatgtagctgtcttaatattgtatatgtgataacctcatgtctggatttcaaaatcgataaaacttccaaaaaactagagagatctatagaaagctgccaccaaaaagatgtttaaaacaaactattatctagcccctctgtcatataacaaaagaacaaatacttaaaagtgtaaaataacatagtctcagtgtaaaggatagtcttaatttaaactggagcgattttactcaattgagcaaacttactatgttgtcctaatattcctatttcatgtagatgggcaaaaatcatgaattactacttaagaatgtgagcaaaggttatctgaaaaggaatttggagaaaagagactccttcttcttctttttttttttttttttttttttttttgttgaggtggagtctcgctctgtcttccaggctggagtgtggtggcgcgatctcgtctcactgcaacctcctccttcccagttcaagccattgtcctacctcagcctcccaggaaagatactttatcccagtgaacagtttgcaaaccaaggagatgcagttttcagtttcaaacaaagatgcattccagagagcaaaggagggggggtggtggtttacagagaaagttcccacccaggttcacaatcaggtccgttcatacaaataaacaattcaaacctgcttaggttctgattggtcaacacagctgtttgatgggttgatgtagctgaattctgattggtcaatgcaggtgagctctaattggttggctctggtgagctctgaaagtcccaaagttgaacagaggtttgtgttttggagaaacgcagaataccatgtgtgacttctaggcagcaaatggctgcttggttctattttaaatttaggcccagttagccactttgaatccatcttgaacaattggctctttcaggtttacatttgttcacaggaaccactagtatacataggtaataacaagtctagacatctcagctattttaagaatttcatttaaaagatatttgcgaaaagttcactgcctttattttaaattttgcagaaaataaatgagtattacgctttgccaactaaagtaagttgaaactttttaaaaaaaatcttattgctggcgtttcaataaagcaattttagaaattagggaatctatccttttttaaaataacttctaagagcttccattacttctcaggataaattattttggggatttttcagctgtgttggagaacgttgaagatctgatgcagctgtatctaagacctcaagttgggtctgtaggggagtaaaatgtctgttacctattcagtagttggatttgtattcactttcaaaaaattaatttcagatgcagaaatcacaagctttccataaatgttttcaggcagacagacaatataacgtttctgttaataatgaaaaaaacctttgacaggctactccatagctgtgttcctgctcctcccatgtatgaatgggaggcagttactgcaaaggaattctcattccaaccatatgtgaaaatagagcagagacgcctctaagtttgaaattatgccattctcagaaaagtctgtgtgacacaataaagataaaaatggattatgtacccatttaaattacttctgatttttcttctagatataaaagtttacctcctactttcccaaacattaaatttaatttgaaataaaagtgaagtaatttgatctcatcatatggggtaaatttaggagaatattgaccttgattttgttctcaaagtttacagtctgtatttttatttataaaaataaagaataatttaataatgaaagtgctatatcaaaaataaattcttacaattatgtcatttatagataatgcatttttatcaagaccacttttttaaaaagtggtggattattttgtgtcaacatatgtatatgcccatgaacacatatgcaaaatcacaaaatgcttcatcaaacaagctaaattgcatctttgctctgttttccaattatatgtcagaaatttgacaccatgtaatgtgttctgaagctctattgctgatagtaaaaataaaaaggaaaaattacatgcacacatgtttattgcggtactattcacaatagcaaagtcttggaaccaacccaaatgtccatcaatgatagagtggattaagaaaatgtggcacatatacaccatggaatactacgcagccataaaaaaggattcatccatgtcctttgcagggacatggatgaagctggaaaccatcatcctcagcaaattatcacaaggacagacaaccaaacaccgcatgttctcactcataggtcagagctgaacaatgacaacacatggacacagggcagggaacatcacaccggggcctgtcggggggtgggagactgggggagggatagcattagcagaaatacctaatgtaaatgacaagttgatgggtgcagcaaatcaatatggcatacctgtgtaacaaacatacctatgtaacaaacctgcacgttgtgcccatgtaccctagaacttaaagtataataaaaaacaaaaaaggaaaaactaatggtaattacagtgtatcataaaaggagtttataataacttgtattatgcattacagttcatgagagtttaactgagaaaacaatgaaacatctttttctgttattagtcatgtacattaaatatatatttatattacattacattaagcacatattttgatttaccagactgtaagttctcatgggacatttcatatctgaggaaagaattcactagtatgggagaagtaggcttactcaggaaacaacagattaattataaaacttcaaactcagatctcataatgtacacaaaagttttcagtaaaatttcaatatttaatctgtttattatttgtaaaagataatgggcataattctgaactactaggatgtcatacagacgtccattcacatggagtagttcttccgttaaaacatatttttatctcggtctgggtagtggaagatgagtagaagctcatgtttatgaaaacaaaaagaaggaagaaaggagggagggaagatgagaaagataatgtcccaaggagaaaggacagtgaactaaaagtgaattttatctcttgtgtgttccattatcttaaaatctaccttacaggctgggcgcggcggctcacacctataatcccaccactttgggaggccgaggcaggtgaatcacctgaggtcaggggtttgggaccagcctgcccaacatggtgaaaccccatctctactaaaaatacaaaaattagcccagcgtggtggcaggcacctgtaatcccagctacttggaggctgaggcaggagaattgcttgaacccaggaggcggaggttgcagtgagccaagactgcgccattgcactccagtctgggcgacgagagcaaaactccaactcagaaaaaaaaaaaaaaaaaaactaccttacagctatgcaatgtcattgttcatttatttcatttatttttatcaatatattaagtgaccacttaagatataattaggcacataatttcagttattcaattcagataaaaagatttttaaaatcttatttcctatctatctagtaactataaaaaggaaatttagtatttgccagggaggacagagtttttttgttctttaaaaaagttaatggataatatatttaaatttttcaataaaatatatgggtaaaaattctccctcttattcctgcccccaataggccccattatcactttttccttcaacacgtaatcgctgttattagtcccttactgatagacagctaattgtttctaaacttttgcaaatacaaccaacacacacaaaaaatacttcatttaaatgtcagttcatgtctatgcatctgcaagttcatctctaggaaaattttctagaagaattgcagggcaaagagcaatttgcaaattcaatagatatttctaaattctaaatagtacttctaatttctaaatagtatatcccctttcacagggaatatactaattgatactgctacaagcagtgtacaacaatattctttttcctacaatcttggcaatatatcacctaatttaaagattttgtcagtggataagtgggaaatggcattttattgtatctgtaatttgcatttatgaagagtagggtcaagcatcttttcatacattaaggagccattcaaagttccttttctgtgaagtatctgtttatatgtttttccattattctcttataatcttggaattctttacatattaaggaggttagtattttgttttacacaagttacaaatatttgtctcttgatgttatagaatttttttgtcgtgcataagtactttcgtaaaaaaaaatgcaatatattttttcttctgtagtttctgaacttcttattagaaatactttccccactgtaacactccaacatcatttatgtatttaagtatgtatatacttaaatttgaatatagagatttctaaagctgtgatacagagtagagaatataatccaaagcacaaatctaccctccttctgtctcttcactttcttttctttttctttttctttttctttttttttttttttgagatggagtctcaccctgtcacccaggctggagtgcagtggtgtgatctcagcttactgcaacctccgcctcctgggttcaagcgattctcctgcgttcaagcgattctcctgcctcagcctccccagtagctgggaatacaggtgcccgccaccacgcctgactaatttttgtatttttagtagagacagggtttcaccgtgttggccaggctggcctcaaactcctgacctcaggtgatccgcccgtctctgccccccaaagtgctaggattacaggcgcaagccaccgcgcccggtccctcttcactatttcttatttcttcccctctttctcaggtaatttcttgatccccttcctaagtattgttctgagttcctgggagaagttcagctatcctaattcacaaatcgttcttcaaatgtagaaaatgagaagagatggaagccaaggaagggtgtgtggaatcaagtagcagttctcaaaacagcatatatcaagacctcagcacatatcaagacctcagcacatatcaagacagtggcacaaaagcatcgtagtgttgtcattcaccactatgcaggagggaaagccaatttcatttcagaatgtcctcaattaatctgtagaaattattaattttattaaatcccaacccttgagaccaagtctttgtaatattctgttttataatatatgaagtatgcataaagcacttctgtgtattgaacaaagaaccacaagtaatctcatcacactttcagtagcaattgagttgcataccaaaccactggcaccttttcttgtgaaataccatttttatttgaaagaataattggcaaacaaactatggttattcagacttgcattttttttaatttaattaaaaacaaaatgaatgtgtaatcttgagaaaaaaatgacagcattattgacagtaataaattttaagctttcaaatagaaattaggattttggaaaacttatatccaccactgtgagtttcatatcttcccaatacttaagcacttttctgatgagatcggtgttattattaacaaacatgatttttaaatattgtatgcgatatgcattactcagcgaaccaatattttctaaatgacaaatgcataaaattataaaattataaatgggtaaaagattcatccaagtacaagacatgccaattaattttaatataataaacttcaaaaagttcactgacaatagtttcagattctatattgcaaataacctttaagaaactaccacttgtcaatctttggtgcagtatcaaagaaaaatatccacaggtatctgcaaaggctgttaaaatactcctcacttttccaactatatgtctgtgtgaagccggattttctagatatacttcaatcaaaacaacatttcacacgagattgaatgctgaagcaaatatgagaatccagctgtcttctattaagccagacattaaagagatttgtacatgtgtaaaatgatgacgctcttctcactcaatgtttatgttgtaaaagcattatttttcatttaaaaatgttaatattttatggctttatgattatttttaattattaaatattacagttttctgttttaatttctaatatggtaaataacaaaagcttttgagatcctcaataattttttttttttgagacaagctctcacgctgttacccaggctggagtgcagcagtgcaatcttggctcactgcagcctcaacctcatgtgctcaagtgatcctcccacctcagcctcctcaggagccaggaccacaggtgtgtgccaccacacccagctaatttttgaattttttttgtagagatagggttttgctctgttgtccaggctggtcttgaactcctgggctcaagaggtccacctgcctcagtctcccaaagtgctgggattacagacgtgagccacttggcctggctccaagatcctcaataattttaagagtataaaagggtcctgaaaaaaaatgtttgagagctgctgaaatagagtttatttctcagataactgaaacttcagaataatcatacaggccatgaaaacaccctctatatttgccaggcatataactataatttgacctttggctaaaataccttgattctctcttaggaaaaaataagagtacaggagacacccccaaaaatgcatagtacaagaaaaatgttttattttttttaattacaaaatgggtccaggcatgatggctcacgcctgtaatccatgcactttgggaggccgaggcgagcggatcacttggggtcaggagtttgagaccagcctggtcaacatagtgaatcccgtctctactaaaaaatacaaaaattagctgatcataatcccagctactcacgaggctgaggctgaggcagaagaatcacttgaacccaggaggcggaggttgcagggagcccatatcatgccactacactccagcctgggcgacaaagtgagactccatctcaaaaacaaaaagaaagaaagacagagaaagaaaggaaggaaggaaggaaggaaggaaggaaggaaggaaggaaggaaggaaggaaagaaaagaaagaaggaaagaaagagaaagaaagaaagaaagaaggaaagaaagaaagaaagaaagaaagagaaagaaaaagcctggcacggtggctcacacctgtaattccagcactttgggaggccaaggtgggtggatcacttgaggtcaagagttcaagaccagcctggccaacatggtgaaaccccgtctctactaaaaatacagaagttagctaggcatggtatggtggtgggtacctgtaatcccagctacttaggctgaggcaggagaatcactttaacccgagaggcagaggttgcagtgagctgagatcaggccactgcactccagcttgagtgacacagtgagactccgtctcaataaataaataaataggctgggcggggtggctcacacctgtaatcccagcactttgggaggccaaggcaggtgggccacctgaggttggaagttcaagaccagcctggccaacatggagaaatgccatctctactaaaaatacaaaattagccgggcgtggtggtgcatgcctgtaatcccagctactcgagaggctgaggcaggagaatcgcttgaacccgggaggcggaggttgtggtgagccgagattgtgccattgcactccagcccgggcaacaagagtgaaactctgtctcaaaataaataaataaataaaatacataaataaaaatgaaattacaaaatggtatgtgacagccattgtagcataatttgaaatagcaaaagattgaaattgtaaaacacctaaatccggtttggtttggtttgttgttgttagttttttgtttatttttgagacaaggtcttgctctgtcacccaggttggagtgcagtggtgtgatcatagttcactgcagcctctacctcctgggctcaagcaatcctcccacgtcagcctccagagtaactggcaccacaagtgcacaccaccatgcctggctaatttttttttttgagacgaagttttgctctttgttgcccaggctggagtgcagtggcatgatcttggctcactgcaacatctgcctcccaagttcaagtgattctcctgtctcagcctctcaagtagctggcattaccaggcacccaccaccatgcccggctaatttttgtatttttagtagagatgtggtttcaccatgttggctgggctggtctcgaactcctgacctcatgatccacccaccttggtttcctcaaagtgctgggattacaggtgtgagccaccgtgcacagctgctaatttttttttttactttttgttgagatggagtcttgctattttgcccaggctggtctcaaactcctggccttaagtgatcctcctgcctcagtcccccaaagcactgggattacagctgtgagtcaccacacccagccttgttgttagtttttgaacctcagattcccagaggcagcaggttgattaaattatggccttaatttcttagtatactgtcattggcccatgcaagatgcttctccttcactttattttgccctttcttcaattattttattttcctccatcaaagacttgcccattttaaagagattgatgtgtatcttttaatgtgtacagaattaaaaaatagttatggttgttttgtaaagaatgatgtgttttctatttaaataaatagcacttgtggccagacccagtggctcacccctgtaatcccaacactttgggaggccaaggtgggtgatcacttgagaccaacagttcaagaccagcctggccaacatggcagaaccccgtctttactaaaaataccaaaattagccgggcgtggtggcacatacctgtaagccctctccaatacttgctattatccacctttctaactgctgccattcaaatccatataaagtgatatctcattgttgttttaatctgtgttttgcctctttatcataaactttagcaactcacgatatatttgttatttatttgaacctcctctgtgaactgtttaccctgttaggaatttttatttttgtttcctatctttttcttgttaatttaagaagttctcacatgttttgcatattatccctgctagtttttaaatattggaaataataacatgtttgttaactttatctatgttactcacactgaacaaaattccttaattttggcgcagccaaattcaaccatactttttgacttatagttggtgcttttgagattttgtttaagaaacttttccccactccttagtcacaaaaactttatttcatattttcttctatcatctttatagatttatctgttacatttaggtctttcatccgtcaacagacaacctttgtgtgagttagaaatctgtatttttcttcacatgatgagacatgtatcctaacataatctattatgctaaacaatttgtccatttttaattcctttgtgatacaaatgtttagtgttaatttttttcttttgtagagatgagttcttactatgttgcttaagctggtctcgaagttctggcctaaagtgatcctcccacctcagcctctcaaagtactggaattacaggcatgagccactagatgtttatcatataacaagtcctcacattaacttgatcttcagatctatttctgagttctcaattctgttttctctgtttgtttgttttgtttttttcaattctgttttattgatctatttatatattgctgggttaacaacatttatcatcattatcatcatttatagtatgtgttaatatctgatgagtgaaagtaataccatctatttggcccatcattttttatgctattctttagacattttgggcttctagccatccatataaatttcagaatttgttgtgttctttaaaaattcaattaaattttgtattggaattttatttactttgtatgtatacttacacagaattggtaactatagtaggttacgacataccaaccgtaaacatagtatatttcatcacttattcaaatcttatttatatcttttgctgtctttctactaaaggaaacagtagaatgaggattttttttatttaattttaacgcacatttttatttaaaagaggtttagccgggcgcagtggctcatgcctgtaatcccagcactttgggaggctgaggtgggcggatcacaacgtcaggagttcaagaccagcctgaccaatatggtgaaaccccatctctactaaaaatacaaaaattagctgggcatggtggcgcacacctgtagtcccagttactcagggggctgaggcaggagaatctcttgaatccaagaggcggaggttgcagtgagccgagattgtgccactgcactccagcctgggtgacagaacgagactccgtctcaaaaaaaaataataaaataaaataaaataaaataaaataaaataaaagaggtttagtagatagcaaatctggtgacaccaatttcactctcagcaatggtttttcccccaaaaatgagtaacatactgcctaataggaattatataataaggaagacacttagtaagacacttaagaaagaaatggaaaaatatagctgtgattattaaatcacccagaaggagctaatgcaaaggaggaggagcatcagcaaaacttgttctgggattgcagtttacttttatctttgtcttttaaacacctatgctttgtataaggaagaaaagatgtctcttagtagaagccacagaaagaatgcaatgtcagcttgggtaaacttctgatagtaagcttgtcggaggcacttagtgtttgttgaatggataaagaaatataaaggaacaacaaataatccttcttgatttgtcctgaaatgtaattacaattcttattggggggtgagtaagaacatttaacatgagatctaccctcttaacaaaattttaattgtacaatacgttattattgactatagatagtgttttacagtagatctctcgagcttattcatcttgcttagctgaaacatgatgcccattgattagtaactccaatttacccctcctctagcccttggcaaccaccattccactttcaatgtatgaatctaactattttagattcctcttataaatggaataatatggtatttgcctttctgtgattggtttattttacttagaataatgtcctcaatgttgttacatattgtagagtttctttttttaaggctgaatagtattccatttaggtatataccacattttctttattcatcaatctggtgatggacatttcagctatttccacatcctggttcgtatgtatagtgcagcaatgaacatagagatgctaatatctctttgagatcctgatttcaattcttttggatgaattcccagagtgggattgctagattgtatggtagttctttattttaaggaacttctacgctgtcttctatagcagctacaccattttgcattcccaccaacagtacgtaagagttctaatttctccacatccttggcaatacttgttttcttgataatagccatcccgacaggtgtgaagtaatatcttattgtggttttgatttgcatttccctgatgattagtgctgttgaggatttttttttctatgcccattgtccatttttatgtccttggagaaatgtccatccaagtcttttgcccattttctaatggggttattagtttttttctggcattgagttgtagaagttccctcatatttcggaggttaaccccttatcagatatatggtttgtaaatattctcccattccacaggttgccttttaattctattgtttcctttactgtgcagaaacttttttagtttgatacagtcccatttgtttggttggtttttgctttaggtttttgttgtggtggtggttgcctgtgcatttggtgccatattcataaaatgattgccaagaccaatgtcatcaagcgttttacctacagtttcctctaggagttttatagtttgggggcttagatttgtccttaatctgtttggagttgattttcatgtgtgatgtaagataagggttcgatttcattcttttgcatgtggatattcagttctccaagcctcacttattggagactatccttttccccattatgtattcttggcaccctcatcaaagatcaattgactctatctgcatgaatttatttctgggctattatgttccatttgtctatttgcctgtctttatgccggtaccatactgttttgtttaccgttgccttgcaatatattttaaaatcaggctgtgtgatgcctccaggtctcttctttctcagattgatttggctattcattgtctttggggttacctataaattttggaattttttttccatttcagtaaaaattgccactgggaatttgatagagttgccattgaatctgaagattgctttgagtatggagacatatatatatgtatatgtttgtttgtttgttttttgacggagtcttgctctgttgcctaggctggagtgcagtggcatgatctcagctcactgcaacctccacctctggggttcaagcaattctcatgcttcagcctcccaagtagtgggcattacagatgcctgccaccacacccggctaatttttgtatttttagtagagacgaggtttcaccttgttgaccaggctggtctcaaactccttacctcaagtgattcacccacctcagcctcccaaagtgctggaattacatgtgtgagccactgctcctggccagatttatatttcttataataatactgtatcttatttttattttatgactaaattggctattcctttttaaagtgctttcttgggtgctttgtatatttctatcaatcttgctgaacttttgttagtactcatagaatgttgattcaatagaattttctatataggtaaacatgtcatctaccaataataattttttatatcttcttattcaatcctaacatgacttatgcctttattctgtctttaaagatagacagggcctctaatactatgttgagatggtaaacatgtaaatggattgtaactggaaattgtaaacattcttttcttctttgttttaaaggaaatgcttctaaatttattcttgtcagtttattttctcataagtttttttgtaaatagtccaggaatttccctgatattcttaatattctgtaaattttatcataagtacttttatattttattttgcctttttatcatgaataaaatgctttttctgtgtcttttgaaatcatcatatgttatgtcttctttggcctagtattaaagtgaaatatattgacacatttttctgatgtactatcctttcaatcttgggataaataaatactttttttctttttttttttttgagacagagtctcgctttgttgcccaggctggaatgcagtggtgtgatcttggctcactgcaagctccgcctcccggatccacaccattctcctgcctcagcttcccgagtagatgggactacaggcgcccaccaccatgcctggctaactttttttttgtattttttagtagagacggggtttcaccgtgttagccaggatggtctcgatctcctgacctcgtgatccacccgcctcggcctcccaaagtgctgggagtacaggcgtgagccaccacgcccagccggggataaataaatactacttgatcaatatgtgttatcttttcatgaactgttaactttggctagctaatattttatttaggaatattgcacttacatgtataagtgaaatgggtttatggctttcttatctagtttgagaatcaagattatatagccgtataaaattagctaggaaactgggcagcttttcttttgttctttttattcattttctgaagcaattaatacaaaataggtattatctcacaaaaaatggtatgtgaggtaatacatatgttaattggcatgattcaactattccacaatgtaaacatattttaaaacatgttgtacataattatatataattttatttgccaattttaataaagaaataaaataagatacataccatcaaactcttgaaagttttgtaaaactccactggaaaactctgtaagctaggggctttttggtggggaggttatagcttctttttcttcagttattattttatatactgctgtaccttacaaaattaggatgatgtgaatgcataaaccatgcagaaagttacatacacatacatacacacctacacacaccccttttagaaaccagagaagaggccaggtgtggtggctcatgcctgtaatcccagcactttgggatgttgaggcgggcagatcacctgaggtcaggagttcgagaccagcctggccaacgaagtgaaaccctatccctactaaaaatacaaaaattagccaggcatgatagcgggcacctgaaatgccagctactcgggaggctgaggcatgagaattgcttgaacccaagaggcagaggttgcagtgagccaagattgtgccactgcattccagcctgggtgacacagcaagactctgtctcaaaaataaataaaataaaataaaatattaaaattaataaaatcagagaagtaatacataattatttattttattgattttttttaatttttatggctgtataatagttttacatttctatggggtacatgtgaaattttgatgcaagcatacaatatgtaatgataaaatcaggataattggaatattaatcacctctaacatttattatatctttgtgttggaaacatgccaaatcttctcttctagctattttgaaatatacaacaaattactgttaactataattgtcctactgtgctatcaaacgtgaaatcttattccttctatcaaactgtattttgttgtacctgttgaccaacccctccgtaacctcctccctgcccactacttttcccagcctctgataaccaccattctactcagtacctccacaagagcaattttgttagctcctacatgtaaggatatgcaatatttgtctttctgtgccagacatattttacttaacataatgtcctccagctccatacatgttgctacaaatgacagtatttcatcatttttttagctaaataatattccattgtgtatatatacgccctattttctttatccattcatctgttcataggcattcaggttgattccatatctttgttattgtgaatagagctgtaataaacatgggagtacagacatctctttgatatgttgatttatttcttttgaatatgtattcagcagtgggattgctagattgtgtggtaggttttattttttagttttttgaggaacttctatactgttttccatagtggctatactaatttacatttccaccaacagtgtatgagagttctcctttctctgcatagtcgtcagcatttattattttatttttgctaatatcattttaactggggtgagataatatctcattgtggttctgatttgcatttccctgatcattagggttgttaagcattttttcatatatgcattggccatttgtaagtcttattttcagaaatgtctattcagatcttttgtccattttttaaattggattatttggtttttactttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcctggtttttactattgagttgagtttcttatatattctgattattaatcccttgttggataaatagtttgcaaatattttcttccatttcttaggttgtcttgatactttgttgattgttttctttactgtgtagaagtttttcagtttgatataatctcatttgtcaatttttgctttggttgcctgtgatttttaggtcttgtaagccaggggcttttttactcaagatatctttgcccagaacaatgtcctgcagaatttccccaatgatttcctctaatagttttatagtttcaggtcttacatttaaatatttaatccattttgatttgacttttgtgtatggtgagagagaggtctcatttcatttatttgcatatggatatacagttttcccagtaccatttattgcagactgtcctttccacaatgtacattctttggtgcctttgttgaaaatgagtttgccataaatacgtagatttatttctgggttctttattatgttccagtggtccatgtgtcggttttcatgccagtaccaagcaatgttggttactatggctttgtttttaaattcacataatccagtttgtgccatatatcttccatttaccaatccagacccttgccctccctgttctgcctcagaagcatgtatatatgtatatacatgttcccttgagagctagctttcaactgtgttagaccaatctccaacaagaaatccaagaaacaggggagtgcggtcaggatatgtacctccctagttcccttcctggaagtcccttcagacttgttgtttccttgaccagagtcagaagcctggccaaggaagcaacctctaccacttggctatataataggtgtgcttgtctgtggggtacatgtggtcctccctctaccactcattctctctgagttccaaatattgcttcctctgctcatctatttggacctagggatgttaacttctgctattcctggcactgggatactacattatcttttgtggtttccctgcactttgcctacatattcgtaaatagtttctttactaagcccttgttaggtttagtaaaacctagaattatctcagtttgaacatgccatctgtttcctcctgggaccttgactaacatacctgactagtagagagaaaatctgacactgccacttccccaccacacacactcttccagtttaatgattactaatagttttgtgtgtgaatgccttcaaacacagaacattatttgtgagacatataacaccaaagacatatggaagaaacatagacaatgtttttaacatgagaacttttttgaaaaagtgaaaatttctggttgctactgaccatgcctcattttgtaaactcctttcctgatccctataacccttcacaattttagtattcctttgatctttttgatgactcattgtctccccttatgggcttatcttcttaaatgtaggtgtctgggttctccatttttctcttctctcaccaccccccttctctctctctttgagattttatttccttgaatagcttaaattatcatcactatgccaaagattccaaaatctctacctccagccctgacctatctcccaaattcatccattttcattactctctgacagctatccccaacttgaacattctaacagtaattcaaatacaacaggatcaaaaccaaattcatatatttcccactaaattagttcttccacctgactttcccgtttctattctcaacacccccaatctcctcttctcagcccaaaattgtggtgccatacttgactcctgtttgttgcttttcaacactcctatttaggatactccaatagctacactattcatccagtattcatcttctcctttcaattgccacagccaaaatccaatataatattctcatcccagaatttcataacaccctctcaactcagcttcccagagctagtttttcctccccttacacctagccatctaacagattgacagcctgatcttcccccaaaatacaatatttctattctctgatttcaaaaataactgcccagtgttccctgaatttaagtctagacttcatggtctgtatataaatgtctctactatgtgaccttaacctatgcaagcccccatcccagtatgtcccccaggttccagtcaagaaaacttaactagcacatcatactgttttctctgcttatcaaaccttccacacatctctgcagatttacattcttcaaggtccaactcaaatcttacctccctaatgtgcttttcgtaaaactttaattatattctgctttacaatacattatttttgtattgtcatcttatataccagattcaaagttctctgagagcagggactatttcttactcattttttttcctcacagcacctatataagcccccttcacataatccgtgatcaataaatattcattgaataaattaataaatgaaaaatcatcagaaatatctcatttttaataaagatttggaagacatttcctttgtttcttaggatttttttctttttagatgcatgcatagctatattctgtagcatctgtttatttttagactttttaaaggttttagattctgtaaactatgtacagaatattccgttcaacatagggtgtgagattgatcacagcatgacccataattgtataatttctaatcaaaagtaagtgtgactttggcataagccaaactttaagaggaagtaagagtagaataaaaattctggaccgggcgcggtgtctcacgcctgtaatcccagcactttgggaggccaaggcgggcggatcacgaggtcaggagatcgagaccatcctggctaacacagtgaaaccccgtctctactaaaaatacaaaaaaattagccgggcttggtggcgggcgcctgtcccagctactcaggaggctgaggcaggagaatggcgtgaactcgggaggcggagcttgcagtgagccgagatagcgccactgtgctccagcctgggcgacagagtgagactccgtctcaaaaaacaaacaaacaaacaaaaacctcagtctattgggccttttactgaagtacttcttgtggttacttcctccttaaatacaccatccgaatctatcttaacaaaactatgttaattgtatttttacaaataatcagtgaaaataaaaaataaatatgatacttctggatatcagaagttgaacatattgagtaaccagctcatcttagaagctaatctatgaagtattatgtataaaataaaaaagatgtgttgttaaagatagagatagagtgacacaggtggctgagtagatctgttttctacttccatatgaagaaaagcttaaacatgtttgtttatttattccttcattcattcataatcctatactatgtgccaagcactatgttaggcataagggatatcataaagcataaatgtatgatcccttctttaaagagaagaaagaactacaacaaacgataggaaaataattcaaatgtaaagtttgttccaggcatagcagtagcacagaggagaaaaaaacttgtgacagtttcatccttgaatggcttcactaatctagctttctataacttactgtaaaatatcacccactggacaaagccaggaagaaagaacatattataagacttaagtatttgaataacttataatggtttcattgcttggaaaacttcaattcattttggcaacatatgagatcactggtctcaatgtggaagataaagcatacagcattgcagggcctgaaaaagaatatccaattgtaattacagtattttaaaagggaatgctagtcattattattttcagtggtcaggagtgaaaatgcttgtttacttcaagttttagcagcatatttacctaccttagatttgttatctctgagctaaacaaaccattttaatttcaagcaaagccacaaagcattatttctcaaaatatgcatttaattaatagcttatttgctttcttctcacttgactgtgagtttcatctaggacagaaattatttcttattgatctttacatttcatgcctaagcataattcctggcacacagcagacaatacttgctaatagaaatacttgttaaatagttgttaaaagaaaaatgtaaatgtagacctttagctccttaccaactgtcgatattcaagtgttctagtgcccacgatttgcaaccttttcttgtttttttctcctgataagatcaagcaaaggagaaggatttccaaatagcctgatagtgtatcagtgtttcaacaagttaaagccccaagacttaccagggaactttaattctcataaaaagaaaataaaccttatattaacctttacatgtaaactcaaaatggtgcactccctgaaagtattcctcttgttggatatttacgagatacctttgcaaatagaaaactgcagacatgacccctaagcttcatgtaaaatgactgtatttattatttttattttgatcttcacttttgcagtagttgctgtaaatggcttggaacatgcaaaatatgctaaacaagaaacctagcccctacctgaagagttagccgttgaaaggcacaaagaagtacaatggatataaaagcctcttgaagaacagccttttgctgcatagatgctaggcaagacagtatgtggcaggaaaagagttggggaaactgctttaaaaacctattaactaggaatgtgaaaagcaaggaacaattgggaaaggagggaggtgctcactgtttaaaagccttttaaaggtgaccatatttttgttggctttttgcctgcaacataaaatgaggatgatgtactgaatggctagctggctggtgaaggtagaatgaatggcctgggctaggaagtcaaggctgaattttgagatgctactctggactatgtgcagctgttgaaacaattctcagcaacgaccacttagactttgaagtaaagacaaaattcagtcagcctcctcaatcaccctttcatttttgtgtgtttttctcggtctcataaatatttgcctgtgctgtctttgctgcagatattaaggagttaataaattagacagccaacaagcaggaattgggaaaagccacagaacttagaattgaacagctgacagcagattctgcaggtgcaagatgggaatcagctctgcattttctatgtagcacagttttctctgcctggcctgtggcctgatttcctggcctctttgggataagctgaattataagacagagaattccagaagatctagctctgtgatcctatgaactctagcgcttcaaaaggaagcaatctccttctatgtttagactgacaatattacatattggtggcagccttgtaagattttggtttcacgttaggaaagaaaaatgctctaaatgccatcctacttaaagaaaaaatggttgattaaactgcactgcataacaaattagcctcctgcaattgggtgtctaggaatgtgtagtgtgtgtgtgtgtgtgtgtgtgtgtgtgtgtgtgtgtgttatgttaaagggaatcactacttattaaatatataagtaccacagtgaatattaaggccataatagggtatgggaaaggagagaaatgggctgcattcaagtgcatatttctaatcaactacttttttgtattcttctaatcattgtatttgatagtaatggacattcaaggctaaactctgcattgtggcagttcttccaaatctttttggctctatagtggtaaaaatattaattccattacacttgaaaatgtccaatatgatcccttgattaacaaaacattccggtgtttcttctgtgaaggactttgggctgcctgcaagggtgatggtaggagtggctgattgaattgataataggaaaattaatttttttccatgctggtgaatatggcctacacatccaaacccttttgacaaaactattttgaggaatatatttgtaataaggacagaaaaacttggagatctgggatttttttttacctaaatggactccaggaaggacagataaatacctctagttagcaacggttaaaatgggagctaataccaactattaattcccagtttggatcttctctttctctcaggactactttaagtccccaaaattccatgcttccaatttccccttctacaactgaagatcctatgatttaaatcataaaagattagctatatttggacactggccttgtattagtttgacagaaaattctgaaaagatctccccattccaaaaatgtctttctcagactttttgtggagacctaaaattccaccactagaaattttaatatttagagtaatgctgtgtcccttactgacaaattcaatttcaaaacacagtaaaattaaataaacataaaaataaatgtattaaataaatataatttttaagtatttgtgggccaaagatcaggagggaatatagaaatgttatttgtggcgtgaaggtagtagtattacagattacatcttcattttataatttctctttactatgctgataataaacatcaatagggaaaaaaatagtgttacttttgaaggctcaattctacctgaccactgtatctctagctagtggaacctaaaatataagtcaccaaaattttaaaataaaaaaattaaagaatactctcacttagtgatttacaactagatttagggagaaaaaaacaaaactcaacaaatattcacttaaaagttaatgagtatttgctatggagaaggcattttgttgagtgatacagaggatacaaaaatgaccaagatctgcaacccccctctttcaaaagcttatggcataaggctagtaactttgaagaaaaagcacattgttatcagtcatcagtatattttggtgaatccatctattagccatttgtttcagattttgaaaagctgaaggatggggcaagcctaggatactacctaggaaagatcagcctggattaagacacttaatgaaagaagatgagggaagtaggcacaagccgggggaggcgatagcacaaaagagggtagaagatgagagcacgctgactgcaaactgtgtgtgtttcagagggtggatttcctagctctgacttctagcaaataattttcaaaatgtaaagtggaccctaacaaagtactattcttatcaatccaagagtgccaagcaatcaaggagagagatttacagacaatgtactttcaaattcacaatgcaaactctaaagtaatatgtattttcttataagcttaactttagtaaagaatgatttttgaagttcactcaaatatctaatatttgcagatatccttatttcattactttgctccaaatatttaaaaccagatgaaaaaaagtaatgtccttaaggagtcaaattcattattaaaataagatattttccaagttgtttggaaaatggtttactttctttttttccccctttactagacctcaaaatacactgagttttcctcactggtaaagaaataaaacattgagaagtatcaagtgaatccacttgaacaggcttcaaaaccataccactaacgtattattttaaaatgtttctctaagacgcatttattacaagggaacactctttaggaagcattaacactcacagtccctaaattttaaattggtccctaatattccatttggtaatcaatatcctcctttgctcctcccccaccctctcagatggccttattctctgtcagtatctatcacattttcttttttcttttatcaccttcttcattcttaatccttccttttgggccaagctgtctgccctttatagctatatttacttcctccttctctttcccctttaactctttgtagacctttagattatgaatgctgaaatttgtgattcattgtttttgccttattgacctcctattaataaaatttgcctcctccacaagattattctaagaaagcatacttttaagcatccacaactattgcccaaagagagacaaccatttggttcaacttcatatgtgttaagccaaatgtattcaaaaatgatttcctactccgattcttattcagtattttctgtgattctcctttattatacctttctagtgcaatggaaacttcagctatctgtggtctagtctgaactgtacctggggtagtgacaatggccttctgaccctatggctcttcctgactgtggatagaattgatagcactttttcaatttctcccttgtctttgcttgaacatactggaattacaacctctgacaaaggtaacatcccttttgtagtggaaacaaaaggggtgtgtaatgaattggttaagattacattgcatgtttagatgatgaaatccaactgcagctcaattcctttatttcctctcgctggacctggtctttcaataagacattattgactggcatcttccccagaacaggtgcttaggaatatagtcttgctgctttgagtcctttagactggaaaacaactatggaataggtcaagagaatcaggtatgagacaataatgcccagtatcttaggacatccactgtagatgattcatatccaggtggtattaatggaataaagggtccttagacttatatggggagctagagcttttcaaattaactaaggtggcaggatatgagttacaggtttatttgccatttttctgcaaaaattctatgaccaggaggagatagaggaggaaggcaatttttaaaataattcaccactatagattgtgctataatgatattataaaaggaatttttaatttttatgaagatgaaatcaatgccacaatgtgtggtattaacaaatgctatctttttaccacaaatcatatcacctttggttactctggatagcaaattattggcctctttcttctttttcccttaaattactttggcttgtggtttgtctttttttttatttttcaaaaacaagatcgcttacaatttttgcttttaaaaatgatataatacccatattggctgcagaaaatatttaaaatgtgtgcttttcaaagaatgatcagatcatttattcatctttagataaagatgattatattcatctcaattatttttgccaaggactgtaacactaattttactctttctaaaaattaaaatagcaaacagtttatataaggtgttgataattacctatattattgtactgctgtgacagatgttggcaaaaaagcctaaaatgcctacagctgtgcactccatgacatctagtttatactcagacagaaggctaacagatgttctgaactgtcactttgcctaaatgtttttaaagtctaaggacctgctttataattcgccggagtctggtttggtttcacagaggttctcagaattcccatctgtgacaattaatgctgaagacattgataaatcaacccttgtgttttctctcttctttaacagacatcagtttatacatggatggtagattgtgaaggctgtttttatatacatcctgtttgtaaaattatctccttaaacacagatagaattgggctataagaatacatggaggtttgttttgagccatggaaagggccaggaaatcacctattattttctttctgctaaattttatgcaccttggaagtaaaatgttaaccatttccaatgacaattttccaaagttatatttgttctagtgaataaaaaaagtttttatttttattcagcatgttaacagttctgctcataacaataactcttaattgtgcagcctgttagaaaaatgaaagaagacaataaatggcattgagaaaggacacagcacatcttctccagcttgacaccctaatacttcctcttcccaaacataccttcagatccctcatacagaattactgccccgtgcaaaggccatcaatgccttatttgctgttgctcttaattttaacaagctggattcctgtagtacacttgcttaatagtttaaacattctgttaacaatcaggtgtttggcctatcctgtttctcctctattctgtaaagaaatataactccaaatagtacatctttctgggtttgtttctaaattagtccccacacttaattatgaggatgagagggatgccttattcctctttgttataggctaagctctcagtaatcccaaacaaaagagccagttctggaagatataggatttgctagcaggattatggtctcatagataatgatgtgcagtcagcagaagcgaagctttattttaattcaaataagctagtaaacaaaccactgacaagtctgctggtgagagtaactggctgctgttgccacattggcagcaaaattatagaaaatctattataccctgttcaccatatgtttaatttaatacaagatacaaattaaactattcacagtgcctattaaaataacaatacttttttatatttgaatgttttaaaataatttctactgaccttttaaagggcagtttcgatataggtgactatcaggggtggagggaggtagttaataaaaggcaaaaaattgtaattgccttcctgaaaaaataaagtataaatgttcactggtttgcatatgttaataaggttaattagcagtcatgtgttctgctactactatatttccctcccatcctttgggtttctgaggctagagttttaagagtgatacttagtttgacctatgtgagtctgtcctcatgaaatcattacctggatcaagccagcctatgggtagccttagaagtaatgccaattgagacctataatctgaaaattgagtttaaactctaggcccaactttggtatggaaaaaggcacagacttttatattattgcttttagtcaatttctccgtagccaaaagatcctaaggggagccagaattaagaggctttcttccagagacaggagagaagaaaaagacaagcccacaacaaatttgtttataacaaatttttctcttgtacccacaacagtcagcaaccagtgatgcttgcttgagtctatggggactcagtctaccagattctaaagaccagactgggttttaaagttatagagctagatttgaatatctattatttcccagctgtgaaaccacagatctttaacctagctggatcttcctttattctgtaatgaggggacgttggggtgaggggaagtataataattccaattttatagtattattatgagaagtaaataagagaaagtatctggtacataatagatactcattaaagattggttcctttcctctttcactctcaagcaaatagacatgttgccctttcttcaaaggtgaagggagagtgttaggaggaggagctggagggggagatatgaacaaaaattcgtggaatcaatttctttggatcattaattcctttctacctccaaaacccaaaatggcattctccttttctctcaaaattcaccataatacttactctctttaagactgtattggtaagccacccaaaccagctccctattgttgggcatatgaattagaaaaataaaatataaccattgcactttgagatatcttttccaacttttatgtacagattttgcactgagtctacaattgtgttcatggggttgcctcatgtgaattttggttcagagaatagaagtctagcagatccaactacgtactggtaattacaatatgcataaggtgtacacttggaaaatggccttagtttcaattgttcttgaagtccaacagatgatattaatattttacccaaaaaactagtaaatttatctcagattgatgcaagaagcgattttcaaagcatggtcctggtaaggatatgccagagaaacaccagacaaatatccatggtcccttcccctctctccagtaacctgttattcagaggttgagagatcagagatatttccatttattgaaacactggatatatagttaaattaagaaactgaaaaaaaaaaagggtcacaaaatttgtggcatattttaagtgtttagcattttaaaattaatacttttaacacatgaagacaaaacacgattgtacgtataacttcattttgtatataacaaaggaatttaaatggatttaaaggctctccacaggccttgcttctacctctaaatttccacttagttacatccttctctagtccctgttgtcaggtcccagagcataaaacagactgagggagcctcagagctccagaagtgtgagaagggtgagaaggcaggccatgctggctaggtacatggccacttagcagacaggccgccagcgagcctgcactgtcaccttccccacctcaggtttccaggtccgtggctcctgacctgagagccgctctcttctgagagggtctcccagtcccttgctggcccaatctcggttcctgactttccacccccgaaccctccccgctctccagggaaccacgatccagccctccagagaggttctcctgggctcgccgtttcgcccacggggtgcggggaacgaacccaactggacacactgtgcacccggaaaaacagacggttccaaattcatttccgcatttgagtctagagtcagcaagatcttggccgcccgcctgcgcctcggagcagcccacgagcccgtgaaggcgcgtggggaaggggggcctggaaagcccgggcttcgactcactcggccagtaccgctccgaggaggggcctcagcctccttcggagccagggccgcgcccgagccgcgctaggccagggggccggacgcgcacggaagggggctggcggacacggccgggtggtggcgcagttcctgggggcacagggcagcccagcccgccggcccgcgcctccgcttccccactccagcgaaactggacaaggccgacccacccagccgggcccgatccctcaagacactttcagcctcagcccccgtttctcctcgggtttccacagacccaggaaaggacagaggcggcgagcaggctgacaagtttattctagaggctttgaaaaatgaggtttccaggtctcttcgcacgcgcgcgcgcgcgttctcgggctaaaggttcgaagctagagtttgaatttaagccacgtcctgggacaggtcgcgttcagcgtgggcgtcggccccgccgcggccccaggcctcttcgaagtgcgcgtcaagtggggtgtcgggtcgttttgttttttctctaagtgaataattcaatcgtgttaggccagattacatgctcataatacccaggtgtatttaaaagcacccgcgtttctaaacctcccgcagaaagtgggaagcaatcgccccctcggacctggcgccgctgcgcctgctggagcctcgcttccccacagtcgggcggccagtggagggcgaggagcgcgcgcgtcacgagaggcggccccggcctcccagagcccgcaccgggaggccgagggctcgggactcgagccttctgagtccgatttctttccacgtgcagagggtagaaagtggccagtcagggcgtgattgattgcttaaggaaagagaagctacagctttcacggtagttgataactaaagcatgacatgatgccatctgtgtgaaactcgtgatgtgtgtggtcattggctccctggaacatccagaccctgatcgtgcgtatcgtgtttccttataagcagcactcgcgatttaaaaacaggtcccggtgcccctcttgctgatcctctctgccattagcccgcttaattccctttttgtaaattcccctctttacctttctttcgtccctccctccctctctttcttctttcctcctctccttttcccctttctctttttcttcctcaatctaggtcgtttctgctgaatgatatttattcaccgaagtcccaatctgagggtgaggggaaaaccccaccctccacatctccccagctaggcttgcgcttgtaaaatatggggttcagctttggctccagagcgcttttgaacagtaaagtttccaattcagagccacctctaaataaatgcccataaatttcccaaccccgtgagaaagccatttctacaacccagcatcgtctgggtgatgtgtgtttgttccaactagagaggcactggtcagtcacctcagtttctgccctccggatacagaaagtgcttttgtttgtgttttttggtttgtttattgtttgtttttttaaaagcagctttccagttgtagactactggttcctgattccctcatctatcaagacagtttgtcagtttggccctgcaccttgcgtttcacattctacattttttagttaaacgttgaagcctttccctatgtcagatgggatgtcattgcattacagtttttgagacaacttttgcggacttgcctaaaaaaatatgtcgtcctgatctgccacaggagagcgaggtcaactgagggatttttcagctttcttatggctgggattgaatagatccaagtaataagatatctcaggtttcctcacctttagtcaccttgggctactcatggatgcactcctatcttacagtcttagattcagcccaaaacccctcagtggaaagaagacagcagttcagattcttctttcaggttgttgtaaaaaaaatgaaatggctttttttcagttaggagcatcctttgtaagttttgatatccaaaaaatacatatgacacaagaagcaggaagagatcttcagttattccagtggattacttttttatgaaaacactggctaaaacattttacattcacccttcctcattccacttttagttggaagaagtttctagtattgatttaattttgtataaggcccctaccctctcctacaataccattaagtaacaaattcacccaccttagccttttctggtgaaagtcactcttgatttactctcttcacttcccttctacccccaatgcactcacacttttacagacacatttttcttgatccagagagtattgggaggtacataactttttagtattgtcttgactttcattcttttctaactgagattggactctttatcctgtgatacaaaatgaatttttgagaaacaaccatgtgaaaaattacttaattttctgttttgatgtatttgtttttcaagcttcataggaaaggctttagttggtgtttaaatgatagtccataaaaattccttattagatgactccagaccaattgtaaaccaataacataattgtttccaaaagggaaagtggaagttgagatcagttagtcgagggattcatttgagtgtgtttatctttaaaatggtttatgagaagaaagggagaaatgaactgggtggaggacagaggtagagaatccagtgaaaacatgtttttaagattaaagccatttttccacattattttcttgccacaagtgacaacacagagcaggagtcatgaaagtggattactgtcactctgggctattggaggcccagagagccctggcattaattcctatagaaaggtagacaaacctagtcagtaactaacactgtcccccacagcgccctcactgccaagtgttcaggctctctcagagttgatacagacctcaggggggtctaggtggcagggcttcccttgtgagaggaagcggaggctctctgtggaactgagagggaggaagccaggtggctgtaagagcaagcctgaggggatagggtgctgtaataggaaggctgtggccaccagtccctcacatggctgcaattagtgagtcaaagctagctaatgatgaatcaaaaagagccaagagtaggactttctgggtgctaaagactaacctttagcttgttccactcctcccactgggctcccatcctaggttttccaggattggagaccttactggaggaaagggcaagtatgttaagaaaacatgcctagcccctgtctagcatgcgcatactggcggggtcttgcagagatggggagaaacaccttgggatgaaagaagccctcagtgatctgtgtgtctggctcatacagttgtgcacggccaaccagagagtgggggagagtaaagcctcatttttttttcagtcactctatctggggttgcttatctcctctcccccaaccctctgcctcaccccaccaggaccaaatagaattgaaacttcattgcctttgcctgtactgagcctaaaaactcagggtttgataaggttactgcaccaatgatacaattgtagatttttaaaagcctcctcaaagagacagatgtttgggctgattaagaattgaggaggaaacctgcagctgcaccaaggaataatctattggacaaatattgtaataaaaaaatatgaagagatcagcccgaccttgcaaggtcttctgctttaaaaaaatctttatcaaacccctattctatggcttcaataaacagaacccattacctcacggcatcttttgttggccccatacaagagagaacaaaatggttattcaggggaacgctttcgatttttattgtgggtagcctgcacaaagagccgtgttattgtatttaaaagaaccatctgtagcagaaacaatggcatcaaattatctttgaatacccactgaaaaaacataaagcttttttttttattcttcttctgtacggtggggggatagagcagtgttaggataactgacttttttgttgttctctgggtgcattcttctcgctccccctctctctccccctcaccctctctctcttctctctctccctctccctctctctctctctctctcttttaaaaaatcagccatttggggttttaagccataaacgatttttcttgttgcaggggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatgtaagtagcttgcaacccaactttgacattcactgctagctcactcctccccccacctcactttcttccccactcattctgtttttctttcttttttttttttttcttttgacctttaagagatctggaaatacaccctgtgtggcagtcatttaacactggtagatttaagtctgaaagcgttaacttttggaattaaattctaatttagatttaacaaatgcagaaatgaaatgacattatttcatcctattttggacggttttggtactgaacttaatcagttgtcttacaagggtgtgtttcttttactatgaaactgaagaaatagatctgtgagcccccagaaagaaacccactaatgaaaaattcaggcttccatcttaaaaatgttaaactctagcatttcacccccataaagaacctcttccagaccaatgttactaaatggaaagagtgatttgattcaaaaggtacatatcattaaggggttgctactacttcaatcggcgtcttaactattttggtggtggttacgggtagggggaagttgcaaaacaagaggaaggggacatggcgatacctcgttttttataagagattgacatagaggaagatagaaatgcatgggggcagaataagcaggaaatattacctgagagaaggaattacagagcatggcgaagctggaaggtgggagggtttctgcgggaagtcgagcgaggggtgatggggcttgctctttggcgccctctaatggcaacttgaaccaatgttttactttcgtaatgcagtactgggaaaagcagctgggtttttgttattgctgttggtttttttcctccgcagacttagaaactagagactattagtggagtaaattgattgttttcagcctaggaacttatatatatatgtcttaaactcaccagtgtttcctcctcaaacatcccctcctctccctaaatcttgttagactaatagaagaggacaggctaatggcaaattgacttatggagggtggtccacgcccaattagccattgcgggcgggggagagggtgtaggattcgtttcctacctgaacagcattctgactcttctaacatactcgagaggtgtagggggtggagtaggaagggatgatttggaaattgcagattctgacatgggctcattataatacacttttaagggggctcttgggaacctctgttattgcgacatgtggtggtcagggggctttccttcccgccttctttttcttttttctttttcttctttctttccttcttttttcttttctttttttttaatttgatagataaaggttaatcttgggctgaatgatagagctatgattgacaagagaaaaggtgttgagggcaggtcgcgctgtcttatttacagcccactgcttgctgtagagtctttgttaggactggaaagctaatttagtgctgatcaaaagcaccacagagttaaaggactggtaatgactgctaatttcatttcagcctcatgcatccccaactgctgtaattaaagacacgctatttaaatacaggtgaagggttttttttttttaagttgggttgggggggggtgggtgggtggattacaattttatttagatcttctactctacttgggtgttatgtagtcccaaattagattttattattattattatttagagccgctccttgtcatttatacctggctttgcagaatcggaagtgtgaaatgtgtcactcacataaaagcccctgtttaaagaaagggtgggacgggggagtgcagaggagtaactatttaggggtgatttaaatatttaggtctcctttttttctccttcaaattaatagaaaggccttcgatatagttaaaagtatttgaaactgggggcaaggttaacaggccaaagggatcagtgtcagctttttaagtacttctaaaaagatcatgtgaacagatggaaaaatatatttttaattaaataatttcccccacactatagctgcagtgttggctcagaaaccgtgtaatttctcatccgataggagtttctttatgagaacatcaaaggataaaaagctctgcattttcgtagttggttaaaattgataaccacccccccatgcgcgcgcgcgcacacacacatacacacatatacacacacacacaccaacacacacacacacacacacacacacacacacacacacacatatccccaaaaaagaatttagcctttaatctctttttatccacgaagactaaagctctgtactcgaccccgcgagcggctctcgccttccggggctggaacccgactcagatgtgaagcggcactgagccgctgcgcaggttcgtgcccagcgccccctgttggacacagtaggagctgcgcagcgccagtcccagaaatcgctggaatcctgctctggggttagagaaaactcttttattgccctccaaaaaagaaacgggatgcgaaaacaaatttttatatccttgaaaaataatataatattaactcaataaaaaactaaagaggcgatactacaattttaattcaataaaaaataaagactgtcctcctcacatcccagccatcccccacccggtttggttttgtaactcttttgaaaggttctgcgatggtaaaacaggtaaagaaaagtgacgaaaaacaaagcatttttctgtagccgtggagaatcaagcaaagtatacttcctccgttttgtccacatttcaaaaaattaaacggaagatgctgctgcttgctgttttgacgttgtcagcagcgtcttgaatgccctcagaggtcctgcaagtatcgtaactgagccttcgagtaaacgaaataacttgcttttatgtgtttatttccagagtataattaaaagaccagtctcttctttgagtgtttcccatcccctagaccaatcctggtcaaagtttttccttcccagatactggctaagaaacacatactggctaagaaacaggtgcctggtatcttttttctttcatcttagccgtaggatttcggggaaggtgtgccaatggtagggaaggttttctttgaaattcagcatttcgttgaccaggaatccaaattatcctagggaagggggagtatttttacacttccaaaaaactacctgtctacataataaagagctttgccttttttattattattatttcttcttcttctttttggtcagcaagtgagggcaaaagtagcctttgaattatttcagaaagagaaactgtaaaaatggcacatcctctgaatttaaaacaatagggaaatgtgggtttgcttaattgtttaaaatcaaatagaaataattactgtgctaaatgaacaagatgttttaagatttacatcttcagggttatggttattgattttaactttacccttaagaagtttagagatcgcgtttttaaagtttgcttattgacggaaatcggcttaatttttcataaaagaatggctttttaaaatattgaatactatggctatgcaaggtttatgatacctttatgtttattcttcccacctcccaaaattagcgaattcgagataacatttcaaggggaattgctatttagtgcgatgagagatgacttctccatctggttccagaattagatctcggcttaggttttttagtaagtaggttcagatgcaatggaaggagagaagaatcaagccttttgataaaatctctaccccgaattctatggaaaagacaggcaagcgggattccagccacagcacccccaccttttgctctaccaaaaggcttgtccccattacagaaataatatagtcggtgctagttttgtgaacccgcgccaaccgataaggtaagaaacggtgcgctgacagccgaggtccgaaggctgctcagtggttcccgcagcccgtggggtagggaggccaaagccagcaaaatgttggaggcgacgccagaaagagagtatatgcctgctattcggaagtgatgtcgaacgtgcaatagcagagtcctggagatttccaccccgttccgcacccagggatcccagcctgtggggtagcaggttgttgggtgaaggcaggagggagaagccgcacctggctgagggcgggtgggcgtgccgggagcgagtgcccaactttctagggcccatggagaaagcataacccctagttgaggaaagagagctaaacaagtgggtggcccaggcctgggaatgccacccagctctcccgacgcagtgttatttctgtggtcccagggggccccagcacctgcccgaatcccactccccaaggccgccagcaggaaggcagcccctccatctttgagggctgaggagggggcagcgagtgacttgattccttagtagcagggaaaaccgcagcggctggcaacgggccgcgtttctccgcggcggcaaagcgccctttaggggcggggcgggcatttttggtctcctgtcccagcgtccaggcctgagcccgcgcgggttggctgggcgccctgctttgtaagtaaccaatcttgctggattctgaggactatccaggcggatgggcccacttagcttaggcccactgagaccctgccaactcctcagacccttttccccttcatccctcacacctttcatgatgaacccaggaaagaacccgaactctgaaaaacagtacatgtggtttgaagtttgatagttatttgggtgtgagggacatgactctattaataaagactaagattcaaggctgagctctcatttattaaatttgctctttcactctgttttcaaactctggagatctttcagtttcgttgctccaaccctgacacagacaaaggcgccagggagaaagcccaggcgggcttgaagcagttgaggtatagactgatactcatctctccatcactcagacgggcagataagcactgccagactgggggtcctaatccagggcccagcggctacgtgggttgctgcggggtgttgaaaccacaagtacaacttgacaccattgagcccacggtgcttgtcaataatctgtgaattaggtgcagagattgtcactgtagatcataacagtttctgaaggactcattacagcctatcgtgtcaatgatcttcaaattaaggaggggaggtggggcgagacgaaaaaggagtggggagagccagcaaaaagggaagaagggtgggagggaagataaaagtcagagccccagctccgaaggagcctttaaagattatcaggccagcgatctgagaattccattgggatgggtttggaaacccaactccatctgagccaggactggaagaggggcgctgggggcaagcagaagtgggcccctgggaaggccgacttctcaggcatttcttttgaggccggaatagcttttgggagagggttctagatgtcaatgggaggccttgaggatgccagcccgcccaggatgggtgtacactttgatttagagcactttccagggcaagccgcagctgcagatctttgaaaaaagtggtaatagtttcgtttagggatgatggtgattgtaggatgactttttttttccaatggtttgctttaacttcttttcatgccacaggtgaaagctttcttccttttcctctgatagtattcctgtctgtccctcacatgttacgtagatctaatttctttccccaacttgtttttttgggtgccaaacacatcagccctctgagattttatcacttttgtggtttgtattgagtccaactgtaattctggaaagggaacttgtggataacacagtagcagtatgttccataagattccagaagaaagaagactaaattccatttatgcggtgtggcaggggccaggctaagggaaagaggttttccctgcttggtaaattgtccttgcagtgaaagggtagcccagccttcactggagtgtcatttaatactggctagagaaaggttaaggaaagtgtaggtttgtttttcccacaaaagttgtggtcacaactaaacgaagtaatcacagttggagaatttaaaacaactgttttttctctaaaatgagggtaataaccctagccactggaaaattgggattctaaggaaaaccttttcctttggtataattaattgcataagatagtgtggtcaatcagagacatatgtatttagactcaagcaatgatttacaggtgtaaaaggtccagtggctttttgggctacctggagttcctactgatcattttgccttttaaaaaattttcttctaattttaaaaataaaagtcatagatttaatgcaactgaaaaccactgatggcagctcttcaggttttcagtttatgtttttaaagggaatttatatttaaaataattaaatcatttaatggtcacactacattttctcctggacaacagctgtagtgcagggatagaatcttaacttacattaaaattgcttgataattcagaaatggaaatgaaattgtgaattaatttctccagaaaatatttgagctagaatataagaaggatgttcatatataatactgtaagtaacatgatgattattatatgcagcttgaaagacctacacaaatgattatatactacttctgttgctataatttaaagtaaggggaaatatatttagttttataactattgaattcttttcaaaatgtatttatttcatcaatgagaattagatgagagagaatgagtaaaaaggggagctgaatgcaaagctgttctgcattccttaggtttcaagggtacttacagctcttgagtgaaattatttggtgaaattgggtctggactgaaacagcaattgttatcccttgttcatttgttaagtgtaataccacttctggaaattaaaggcaaggtgctgaagggacagacaagaagaaaaaaatatgattaagcaatttgaaattgccaatgtaccatgcagccatatgcatatctctatcttagtaaatagaaagggatagagatatatgtttattctttttatcatctggaaacattcattatagttactgtcactaatccttcacacttccaaaatctgacaagtttgacataggaaaaaaatgggggaaatgtagatgaaagagtttctatcattttgaaaattgtgttataaaaattaagatgtctatcccctctaggaattcctatgagggatccttcacagtctaaaggaaatgaagtttgacaatggtacaattcagttttgaatttttgctcttactttctatatcctaaccttttccagcttatttcttgttaattgtttttggaaagtatgcaatgctcttttaagggaaaaaaaatcttctaatgcacttatttaccttcatttatatgtgtttgtttctgaaatgaagaatcaagctttggtcattccggaagtcgtgtagcatgctccaatttgaagtgactgagatcttttgtgacttacagaggagaaggaaatgttttaaaaattggcttatgccagtctccttactctgaaattctcaattttcttgtattacaggataaatataaatatcatctcaccaaattgtaccagcattgtcctaaacatttaaattttcctttatttttggcctttaaaattagaaaattttctccagttgctgcacttagctttttaattttgttttcttttcacttaccagactactggtatgatctctttcactgcagtatgattgctgctatggtcacttttagaggagattgtgggaaggttaggatttggaggaaacatgacaaaaaagggaagaaaaaaaaaaaccttcatttgaccacatctggctgcttgtatatttaaccagttctagaattagaaaacctttctgtacattttcttctatttttctcacttttttccttacataatgaaattaaaacttttggagcctacagttgacatttttcagaaaattgagttatcaaggcagtaattatttcacggggagataaaactctcatagccctaactgtcaaatagggcccttttcagattttaattacaaaataaaattagtctgctcttcctcagaatggtttgtgagtggttaaacagagctttcccccaatactggtggtcgtcaaactctgctaattagcaatgctgagaaattccagttaacaaggacattctccaagactctgcaggttccctgccgtttgccttcatttccataagaagattaagagaggaggggaacacactcaaatgcagatgcagaaaagaagcgttttttaacaagcatcataatagtaagatgcttggctagttctcacctaattactgcaagttaaacctctatttgacactaagaagaaaaaataagtctacagtcccctgtctccacaaaattgttagttggtttcagatataatacttgaggagtgctgaggagactttaggagagaaaaatcaatgtgcaagattttgaaataaaattgagttacacttaacagttaaggccttttggctagggcctataatagaacaaaataaaatcagaatattccaggagtcatgcatttttgttactaactactaatcttgctctaaaagtatgtagctttttgttgcccgtggaagggaagtgttacactccctttagattaagcactttcaattttcgtaaattgtgccaatggcaacattttagattctcagaggatgaagcatcctgttccaagtcttttttgattgtctagtagtcaatggtatattgttgttagtactgtagctgtctattacaaacctaaaacagtgttgcttctgtcatctattggaatcgttatagttattatatttagggatcagtgatggtgctggattgaaatagagtgggcagtgatctgattttttaaaatgcatatgttctaaaaaatctaatgagaaaatgttcctgctatcaccatcttctttaatcttattttcatagcacattattatgcataatcgccagccacagttagtttattgtctcgataagtacagcaggcttaattaaaataaagctgtaaataaatgcaaccaatgataacacaattgtaacgtaattccatagcttattaatgtgataaaagcaattaataaaagacctagccaacccctttaacctcttaaatacattattatagagttcatgcacaaacacatgcatctgagaatgtgtaaaagttgttatatatcctcccaaggaaaaaaattgtgccttgagagaaaggcaacgagatttaaaagatttgtgtctataaccgtctgttattagtatttattttaacaaatatacaccacccttatccacaccaattccttggttgtttcttcaaacaattatccacaagctttttaaagtttttagaataatgctattaagcagaccgatgcatacacaatcataaagtgaattcttggtctgccctttgtggcgtctggacaatcataattcattcacatgttgaatctcataatttgtacctattttttcccatggtctaacctcccacttacctcgaggttgtatgtatatttctaagttaggcaaattaaatctgattcttatgatttggttccgcagcttataagatatgttaacttttcttttgtttagattatgtataattagtctgatcttccatccccctcttttttttttttttactttaattattttcaaataccttcttttaaaggtaaaagcaatagtcttggaaaagcgaatctaccagcagggggcgcaccagccacatccctgaaaccagccgcgctgaaaagccggtggccgccttctcttccccagatcttctcaaccttttctctttcctaatctccaggtccgtgtttaccttaatattacacctggattaaacagaaaacagtgctgtattttgaagagcgccgaatatgtatgcattttgagaaacccaatctcaccctttccgggttcccaagaactaaaacaagccataacttgagagaaaaaggagaaccttcggggggcaggaaggttgattggaaataacttaaggaaagtctgcagaattcttttttttacaacttttctgagtttccagtgggtatatttagtgtgagtttgacagtaacaggctagggagggcagagattggagaaattgggggtcgggggagtgattatgggaagaaggttagtaaggaacaaaacaatgcaccgttttgtaaagataataaatggaacgtggctggtagatactattcagtacattttcttagggtgagtaagggtagaccaggggaggagggggcggagagagtgttacagaagaaagaaaataagtaaccctgatggtttaagccctttataaaaaagaaatggcatcaggtttttttttctttattcccccccaccccaccctttgtagtcaagtgcattttagccacaaagatcccaacaagagagtggaaggaaacttagacgaggctttgtttgactccgtgtagcgacaacaagagaaacaaaactacctatttgtaacggacgtgctgccattgccctccgcattgagcgcctacctattgaaatctttacgtcgggacaatgggagagcggctaaaattaccctcttgggtcctgggcgggcaagattcctgagcccctacccccgcccccatctcatcctcctctaacccgggccttgctgggctcccccttccccagtcccggccgccttctcccagtgtgcgctgcctgcacctgtgcctggagagcatcgaccccgcctcccaggccttgagcccctttgcggcgcagccccagccttgcgcggcctgggctttgcggccaccacaatggaaatctacggggaaaatgccagggctggttctgctggagtcctgggaactctgcgtgggagggagtttgtgactgcggcccaaaagccacctccatacagtgccgtgggatgccaggaagttgaaatcaccctcccccatcgcctgcacttttgagcgcccttccgtctgtgtctttccccagcccccatttgaaagccgcacgaccgaaacccttcttacggggaggcatgggatgggaatggggagtgggggcagacagtagaagcatcccctttgctacggttgaatgaagacagtctagtgggagatgtggctggggctaagaggaagagctgcagtttcctgggccaaagagctgagttggacagggagatggcagcttaccaaggcctgctggttctcagctctagagtctgccttatggtccgagcaggatttatttttaagaacagagcaagttacgtggaagcaaggaaggttttgaggacagaggtttgggtctcctaacttctagtcgggactgtgagaagggcgtgagagagtgttggcacctgtaaggtaagagaggagagcggaagagcgcagtacgggagcggcaccagaggggctggagttgggggggagtgctgtggatgagcgggagaacaatgacacaccaactcctgcactggctgtttccagaaatacgagttggacagccgccctgagccacccactgtgccctgccccacccccgcaccttagctgcttcccgcgtcccatcctcatttaagtaccctgcaccaaaaagtaaatcaatattaagtttaaagaaaaaaaaacccacgtagtcttagtgctgtttacccacttccttcgaaaaggcgtgtggtgtgacctgttgctgcgagaggggatacaaaggtttctcagtggctggcaggctggctctgggagcctcctccccctcctcgcctgccccctcctcccccggcctcccccgcgcggccggcggcgcgggaggccccgccccctttcatgcaaaacccggcagcgaggctgggctcgagtggaggagccgccgcgcgctgattggtcgctagaaacccatttattccctgacagcccccgtcacatggatggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaattattcttgagtctttcatttatttggataacactgtgattatacataacttttcggggaattataatactgtgctcagccaagaaagcaaaataccaaaaaccttggtattactagtccagcatcatgtgctaatgttaactgcaaaaaagaaacggctggatgattaataagtactggaaaaattgaaatttctgtcatttctaaaatagaaactagagacatatattgtaaatccgccccctccttttctaagcagcatgaataagcatgatggggacctatacttaaaactgatttatgccacttgttgccagaaaggattcaattctgaaatttttcatgtagtttagcagatgggatattgagccaaatcagaaccaggttggctggttttgttttcattttcttcacagcacaatggccctttgaaacctggctatagagaaaaatgatgcttcttgtatcagaataattgcaaactagacatgcaaagtgttcatctgctgggtgggtgtttggattactctggccctgctattgtctgagaggaaacaagtggtttgctttctttgttccttgacttcataaactttctcctctacattttcctgttcggggagagggaaagaaaagaacatcttgcaaaactccccggcttatcataaacatagttttttttattatttattttcttttttcccctctctctccctctctccctgaattccatttcttaaattggcagcgcgggtccaagcctgtagccccaaatcggataatctctgcagctgataacaagcaaaagagaagccaggcaacagccatattaaagaagaaaacaatcaactctgaggtagatattttactttgtccggtctaatcacatttggagatgattatgcttttgatctgttaacaatgttttactactgtagtagagaagtgggggaggggaaaggggtggggaaacaagattggatttgttgtgtggtggttttttttttttttttttttttttttttttttttttttttttttttttttgccctaggaaaggtaaagaaaggctatagttgtcctcagtgggagtggaaaagttgagacatcgccatggtctttgaattagcgatgcttctgcatcaccacccacccttgctttggggcagccggataatctgttacctagtcagggacttttctactttatttactacttgattcgctcgtcttcccccacccacggggaccaggaaccaacaatcgggcacttttaagagcacgggtttgcttcccacaatttcaagagcttgtgtcaacttgctacaactttggagaagttggaatccggcagcgtcttccacccttgagtaaagtacccgctgcagccactaagttagctcatcccgttggtttgcatcttctcatttccaagaaagtatttctttctcatggtgttgctaatgttagttctgggctgaactgaggatatctcatattttctgtactttctatttttttctagattgctttgttttagatatgtactggtttttatttattacttttttaatcctcatttttaggataacattgtactgggaagggacaattattattccagttcccaattctaagcaaggcattttcccccctaattaatgcagagactctaaaagaatttcccctagcctggccagccattgtaatgcatatacggattattcacgtggtaatgagcacattcgccagttcttgctcacacatacgaataaaagaaactttgaataaagatccaaatgatcatcctgggggagtggggaggatattcccggaatttgaggcagtcaaatatatagattatatatattttgaaaatagaaatatattagaaatatgtatagaggtttacagtaattgcactgcactcacctctcattttttaaaaaaaagcccacagggtcagcaactttctggcaaaatggtcaggttcaaatatttagcaaaaggaaagggagcacaatattttgggaagtagaactagctttgaataattgtcactatctgcataaaacaagagaactcccgttcccccttctaccccttcatatcgccgagccaaatagttgaaaaatgaaagtcaaaatattttgtttgcaaatataaatgcttttgataactacatctgagggaaatgatatatatcttgtacgatcattcatttgattaaattaaatggttacctgagatatgtaatttcatggctagattaatatcgaacatataatattttaataataatgtgattttcaaggagagtaaacccataaacttgcccagagatggttatctcatggtgctgaagatagttgttgtttagttcttttcctcgggatattattctgctcaatgaaaccactcaatttccagtcaaatagggtgaatttaaatgttttgttaactatatacacagaatagaaatgtgcaaaaggatgagagtacagtctgttctttctgaaatttttttctctccccaaaccacccaccccccccccaccacatactttaaataaagagcgttaaaatattttgctgagctgtagtagattagcaaggtttcttgccaatgctgggaagctggtattacagaccatcccaggggaaaatggctcacattaaccactaaatgaatatttgacaagggctcattcggaggtattattgctataaacgtgtccctactggacttttcaagggtcaaagagcaatgcttcaattaattatttagactgctagtagatttggtggtaatagctgtacttatttctagaaatcgacacattcttacagtaggaaaatctcaggagaatcttctccatcagcaataccttggattgaaatacacacggagccctggcattctaaagctgactttttcataaaacctttccctgggctggtggggggtggggggcacagaattatagtctctttttctgtttcactggctgtttttttcggtttaaaagaaaaaaaacagaatacagtaatttatcttaatatcctcatcatgtgtggcaaggtcttttagggatttgcaatatggggcaaaaggggagggtgctcatttacaacctttgccttttctaagtagagatgtcacaggatttcagagactcagagaggccctgaatttagacaggatacacattcctgtttgccaataaaatgcaagtttgaaagtggaaggttccataagctgagtacccttagttctagtagtctcgagtaaattggggtacaaggtagttcctccttctctccccacctattggtctgaacactgcaaggtgcagtaggggggccagtgttccatttctgccatgtcataggttcctctgtggccctaggtaaaatggtaagggaatgattttgagggtaagattcctcgacaataatataaattgaatgaataagagataagctgcaatggtggggggggtggcggtgggaacagtaattacaaacccaattcattcagcttttcagaacttttgttgtgggagctccattgacgggttttgagctgccagttttctcacattaaaaagaactgatcagcgcctcagggggacaagaaataccgcttaactgcatagtgatggggtcttcatttagaaccattacaagatgaaaattaaacagtgcctttgtgtgcatgaggtttacttttcaactgctaacagtttatagctaactgctctgagattgaagtttgactatggtttgatcgcctgctgattgacgctgctcatttatttatttatttatttatctgttataattaagagaacttttcatcacctcaccccagtttcatttattgatcttggagaattttgaaaaacagatcctcatatttttctttgtggaaggagtttcctttgccatgagctttagcagagacttcagttcacattccccaacggacaacccccaccccacacacccacattattcccttaaaataatttgcatctcattctctgttttttttttctgctgcattttcttgctctccaagctagagttgcttttcgggcagcaagtagggttggagataggggttaatttatttttttgctttgctttctttttgtgacctaaattggaagagggctggatggatttcctaaggacttcacctatgaggtgaatccctcaaagaaggaagaagggggagaaactctgacctttactgtgaaaatatggatacagtccaaaaggacatagtttccggagttctagagtaagaaaagctgtggaaggagcttcccaaagacaggaaagttgcccaaaccagataattagtttagtgtctttcatagttattttctattaaaacttttctggaaacccgacatctgttaccaccaagagacacttgtaacctcctctctccctgctaacagtgctgtccagttttatgattcttgttttcagtttgtctattttgcttctgtggcctttagaaaataatggacttgactttcttattttgactaaggggatttctctttggaagggtggagtattaagataagtctaagattcttgtctgtggcagaaagctctctttctctattcggagttcagatggattttattttatactttggtataatggtgatatttctgattccttgagcactttgctcagtttctctcctaaagcaaatagaatgtcttctcatttcgggatgcaaagatatttgcttcacctaggcgtttgaacttgagatgcttgttctactctgcaaagaagtgtcaggtgatttgaaagctggaggtgtccttcgttttattaccctagtctgcctgcgtgtacagaatgaagggtgcactgttttatatagagttcggcgctttgaactatcatttgcctagctctcccagcttccgcgcgggccacggctccgggctgtgagcgcgccggcctcccgccggctgccctggggagcgcgcagtgcccagtgctgagagccgacgcgcgggcaaattgaggccgagctgacgagctccggcgggtggacctgacgtcaccgcggcccgggtcacctcacccatggggctccccaagaaggtgctgtgtggggctcgagttctctctgcccgggctctgctcaaacggtcgcattccctctccctcaggcaccgacccgcgtcagacaagtctagaaagtctcccgaggcgttggggccctcaccactccagagtcctctgcctcctgcgccccagcccaagccctctccatgttgacctcgtgacacgggagacggtgtctaggccccagattcccacccacatcagagattgtctacccaaggggatgtttgtccctgtttgtggccaaatctcagtattagtgatctcgctcggttcttcccgattagaggccgaggattggcagggctgggggaagcccccggagcaatctgggatccctggaatattgggcccctctggattagagcaggtagggatgggaagatacagacccttcactttcccacttgtgagatagggataatatatagttacctcgaagaagatgaatacagagtgcctgacaaaacaggcttaattgataagcatgactttacttactgcccagcagaattagggaagggaagcagttctcacgttagactacagagaacaatacagaaaccccggtcctttctggccttcctggctctggacagtgaaattagtcttgttcataccacccttcttacttttccagtgctctctctgacttaagatttgcctaggaagttatcttgcaaacttgccatccctgggcatcgtcctgaagggagggatcccggcattccgggcaggacccgcccccacccgcagaaggcagaaaaataattactgtattaaataaggagcggtgaattcttcccaagggttcttatcgctggcggccaggccagaagcgggactgcgcccccacccccacctcgtgacgtcagggcctgcagggctccggggatgaaatgattcgtttgagtgttccagaaagggcaatccgaacgcttacagggcgaggccagtgcagcccagctccatcaccactaccaagccccagtttgggaggctcccgaggcccctggccgccccccagaccccgtctccagaacataaccacatatacaagtaaccataatcctaagtacgtatatagtcacgcgcacaactctcgtcacaggaccgcccttcttccaaatatatatatgttatttagtttgttagccacaatttgttgtgggatctgaatgagttgtttctgttgtgtttgtatgtttttgtttttagacggtcgacaaattacgacaaatgcctttacaaagcacaccatagctttatttaacccggtgcaagtttcagcggcgatttaagaaatggacttagaagagttttctggctctcatatccagccatggttaggacaattgctccaggcttaccattgctgcactagttctattttctctttcccctctattcctaagaatttgtatagcttttaaaaatctttttagagtcatgtattgctgagagaatttcttagaactgtgatttaaattgtagataagaggaaagattatctggtcagtggaatgtgtgtaagtggcatagaagtatttgttagggaaaagcacctgggcatttctggatttctgggagatgcacttctcaagttttctttccaactctcaaatcaatttgatttattgaatgcccttccaatggaaaggatcctggaaagcaggccttatgttctgatattggtccaggatctcacagagtaacgattagccaatattttgcatgcagtcagtttagtatcagctcacatccaggtcgattttatcacacttaacagctcaaatcggggttattgcataatattagagtttaatcagtctggaatactaaatggcaaacctgtcttctccttctcaaggccctcctccctttctctatttctccttcctcccacctccaaggaaactatcttaaaatcaagtttccctttgagagtttgtttaccccaacttctgttaaactagactaacacgctctcatcagctttctaaacactgtctcatcagctttgtgaaatggtgcaaaaacatcttggaatccaagatggcaaaataaacttgagcatatggggggaagactgccttgttaagaaattgatttaaatgtttagcttacacttcagcatcaatgcttcccttactacccactcttacttccctcactgcccactcctggttcttgggtaccccacctctattagcaagctggttcccccagcataaattatgaatgcatatcaacaggctcatctgctgtgataaatcagaggcttttctcttttgcacatttctgcttttattctcatcgaaatgtctttctgccccatgctagcagtgtctttctacaaacttactatccccgtataaactatggagatatattctcaattggaaaaatcaggtaatttcaaccgttccccccacccccaggaagccttacaagttaaggatacaaaatatttcatggttagttgtatgagcttccaaattagctgcatataaagtatttaagatttttttttttttttttggctgtcactggctggcaatactcattttgtgtgtgtgtgtgtgttggtttgaaaagcaggaagaaatgtaatgaattgagtgctgtcagagatgtcttctgtttgaacaatctgcgatgggctgaatggcagggactccctcatccagtgcaggtgcagtagagctggggaaggggggaggggggctccctctgttcagtcaaaaagcaccattctccacaatagaccacacactgacagccagcgtgacatcaactcacactttcatacttttccccccatccatagttctgagttcacaaagtggccatacagtagccttggttaggttcctttaatgaacattttgcggctcctatgaccaacattgaaatccgcagagccctgggaggaacaaatagatttttaatcgtgagttccaaaccagaatgtatagctatagatattaaaagtaagctggtctccacatcctctcccaatgccaatgcccacagcaaccccagatgatgtgaaaactctgagttaaaagttcttctaagacttattaggttccaagacactgttttccatgtcctgagagagatcaaacaggaaaggagagaaggcacaaattttatgtatttatttaaaggtaagagcacctctagtattttattatgcttcatgagatggttaatcctacaaattaacaaacattaatcttgtggagtggagttctgcccccttttgaattggttttactgggaagaggggtgtggaggaaaacaagagggttaggaaaggcagcaactgttttaaaactctgaacaaagatgcgaccaccttttggctgtcctgctgctgcaaggactggaccttccaagagttcgttttacatttgttgaagcccaggccttggtgcctcaagttttaaatggaattactcaaggggggcacactactagacaaactattctagccaattccttcatccccgacccagtccctactcctctctgcccccgcccacttcgccacttcttagtcccggatctgaacattttagctgaaagagggaggggtgaggaaagggccaggacagttccctcagtgccaccactgcgggcaaggacagttccctcagtgccaccactgcgcctggagagatccccgcggccctgccgctggctgattctcccctgtgccttgacttgctgaaacatctctctggggaaaattactccctacttgcttacatgtgtgtattaaaaaacacatgtagccatacacatgtttcatcacggcaacaaaaaatatcaacattctagccccaggagcaaaacgtatcaatcattcgcctaaatattgttcagtagatgggggcgggaataggtagacctcctaggagagcggtcacaagtcccctctcctccgcatggacaccaggaatgcggggtctggcggtgctgggcgcagggcgagaagatttgatgtgcagggtaagtaaaggacaagttatttaaaacctcaacacaggaaaagatggtaagagtgctgtgtagccctttgcttgcttgtgactacgagtcgctaggtggcccgcgtttagagtatgcctacggcgcctactaacgtctagacctaggagaggcgtctcccgcccctcgacccacagccagccgccacttgatagctaacgcgtcttccggccggtacacacccacaattaatctttcttattaaagcctccattctgtacccatggggcgactcaaacctatttagatttccgtggttggctgcacaaatttaagtgggcaacgagttataaacctaataacagaggacgagagagggtgatttgagtagagaagacgcaagattcactagggtcgtgaagatgctgcgggccttgcccaccacggcatctacctcggggtgcacgccaggctctgagaaaggtagtgaacctcacaatcacactcaccacacacaacatgcgtacacacacttgcactcctaccccctttgctcacaggtacacttgtgtggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgcggcgtctgcctttttcgctcccgctgccggcgcgggtgtactggtgaaagtgaagacgtcgcggtagctgtcacccagttcggctgtacttttttaaacgctcgcatattgtttgattactaattcgagttaatatgatctttatggcaacataacagtggataattggcctttttttctgaacaacaatgtaaatcacaatcgctttattatttaataacgtcaaacgcttcgttggattggccccgaccgagaagaccttttctttctagacagtgttgtggaggaagaacaatgaagatctaattgtggagatttcataagttggctcccgtaaatgaacagcttagatatggaagttccagcagatgtgggtactattcgcctctacaagctctaccccccacccccatatacgcagtccaaacactctattggagggttttttttttttttttttttttgtggtggtggtggtcctcagatcctagcaaccacctaaagtttccagtagtaattagagcttttatcgggcttgctcttcagccctttatattgccgatttagcgttaaggcattaagtccacacaccaaattagcgcgactcccaaatagccacaaccacttattctccccttccctcattttggtggttggacaccaagagcatgggcctgggacttttttttttttttttttttttggttttactttgttttgatttgatttttaaaacctattcgctaccgcactgtcttggaatatacttgtttcaggcagagttttgcaagggacctgagccattattttgcaaacgcctggaagagcacatgaaactcagagaactacaatgcagacgacaacgcctagaaggaatgggtccccgctgctcgaatgaaagattaattacatttgccccaaaagccccaattctaacggtctctatcgcggcttttgccgtcactgaaggaccgctgtctctggggtcttcagacatcggagtcctttgcaaatgaagagcccccaccatttggaattcgggtcaaggagaaagactctgagcctgcagcagtttttgtttttgcgtgtgcccgcctctccattttattcaacttcttctgcctgtcgggaagcagaacaatcgctccccacccacccccctccgccccgtttctaagataaacaggaggtgcaaaatgctttgcctgcacacgcgccctcgtggcccagtcttcctgcaacccccagcgcaccggccatgcatctgtctcccaaccagacgtgggagaagacatccccccttcactcttcccacctgcatttaaaaaccatcacattgactgctctagagtcaggttcacatttttggccctccatgccaccttccagtttcttcccggtccactctctttctcaggacctaaaaagtgacggggagagggtgaagaattggagaaagcagcggattttcaaaacgtatcccccccgcccccccatcttttaaagtagtatgttaccacaaggagtgcatttgggaaactttccctaacaggagctgggcgcagtgttattcttctccatgggtctgctggcctccccgcccccgctggacaatgcgtgctttgagactcggtggcctgcaggcagcgggagacgaggggactgggcagccttcctccaaggggcccgcagctgggggagcgccaggcagggagcagggacaaggaggcgagccacgcaggaaggaaaaccataaaagtgccattttttcccttagccctgcacagaggcaggctttgaggacctaggggcagggcagctggggcggggtggggtgggggtgttgagaggttttgcgtgttctttttaccccctttccccccactgaaacattttatttcggcacataattatgcactgcagattctccagcctcctcgccctcaatcttggtaacctggtctttggttaataatatcgcaactcgggacttcaacgctcagaccccctccaggccccagcctccgtattctcggagccctccactactgatacctctcgcggagtgcggcgccccgggaaaagcctcttggccagggactctgggacattactttctagtttgttttgttttttgtttttctcccagagaccaccaccaccctcatcctcttcaggcagcatttaggagaggacctctgagatcagcagaaggcctcagacggtcaccatattggtggaagcgtttgtctgatgttttaaaacgtataccaaacggggcgtcagggccacgtgctgtgccttcgaaacgccgccgcgggccctgcctttcagagctgcggcagccggggctggcgtggagggggcgctgaaacaccggcgggcgtcaggggccagcgctgagctgcagatctggccgcagcgctgagtgaagcgaattatctggagcgtgtttgatctgggactgcgtagtcagcttctgctttatttgtttgtttgtaatctcatatttagcaagccgggacggtggcagcaagggagaaaggacgggatggaggagggggcttcgcggtaaccacaccccttcctaatgagttaatttccatatttgcgcctcccgcatctagcgccctctttttttttttttttttttttttttttttgcctgacgccactgtgctgttgcgtcttgcgcagcgcagacacctccactctggattgaaacgaaaaagctcgcggtaagagcagaaaattggtctattgatacattcgctccgagtgttgatcttggcatcaccgatagccggttaattcccccaccccgcccccgccagtgggtcgcacgcggattgccgagggcttgcaggcactcaggcagacgcagacagaaacccacatcgaccccccccctttccccgcctccagctgtccgaccctcaagtctctttctttttcttttttacccaactccggattattttccccctcaaggtgagggcagtgagagcagcgagggcacagtccgcacaaaaagggggaaaataatcgcaaaccaaggaaccaaaagtgaaagtttcaaactagataccaaccctgatggaggttgggtgctgacccgactgtgggtacttaagagaaggaaggagggaaactgaggtggtgagattatgtccacagtatgggtcggttaaaagttgtagtaaagaagttttgggagggccctcactagaaactcaaggcgggtttcagctgatttaacctggtttcctacacatttttgcggtgattctgctctggaaattggcgaaagagacagacctttgcaattgctcacccctccctgcccccaaccaccctgcttactttcgcgaagcgcattaggatgtgggctctggcttgagctccaaaatagcttgcttgtcaattgcgagctgcagcaatatcaaagtgaactgtcccaagtaactcttgtctagaagctgggaagaagcttaagcagctcgctttaatgatgatttgtagctcggcgaggggcacggacagcaaacaccccgcaggtgtgtgccgtaacaccatcatccggacttgaatgtagattactctggcgatcgtttgatcggccctttgaaaccctttacaattgcctgtgacgaacggccagtctcagtttttctctgaataatccctgagggtaagtcctccgggcttttaaagagctctagtattttttttttaaagaataaaaagaaaaacgttcgattttagtttagacctcgtcaacttttagtcgctaacaggcatcactcaagccagtcaatacttaatgaccgttagttacccttgctgtcttcctagaaaccatatacatatgtgtgtatatatgtatgtgtgtgtgtatgtacctacatacatactttgtgtttataaaaaggagaacaatgttattaatttcattttctttagtttcatacctccttgcctgtttatagaggtgtgtgggggtgtttattgtaaacatgcattattattattaatgccattgttaatcttgtcttaatgccttctctgttctctctgaattatacctactcagtgggagttaacgtaaaggttaaagctttacaaagtaaaactagagtttaacccccctcagcaccttcacaccaaccgctgtcaccaaaatgaaaatgtagtgctgttcaacctttaatatttacttagagtatttacataaggggagggaaatgaacttttgtctgaaacatacaacaagcggcactttgattttataaaataaatgtcaacaattgctagggcttatcaaactggggtagggagtggggtggaagtgcagttggattaaaggcccattcctgccacttcagactacaaagggttacacataataagtgccgaatttgcctattgcaaaagttttcttggtgctttctaagtcacaacaggggagggggaaagctgtcgtttattatccagttctgggcaggagcagaccccagtaccaaggggctcttagctttgcccggcagaagaggggtagcctttcaacagcagccccctttgttctcctgatctctttcccaatttcaagcttcacttgcacatcccaagtttgtgtgttaatgacgctattaccatctggctcgccctactttccaaaagatataaatctcccagctccattgcccgcattatcatttaagtgccaccatagccagaagaaaaagatgctttcaagactccagattctcttgcacttactacccctggcatggctcttccactatatttatagactatacgttgggggtgggagtgctccttgagagacctgatttcccaagagctgtccctccaagccaaagaaaacatgcttttgggtgaaaagaaaggcatcaaatgaattttccctgaaaacatttttgttttgtttgcagcaagccgaatagtatgtgccaacatacttttacgtgcttgtggcttcctttctctcgcaggtttgtaaaagttttggtgcaactccccgacattcaagatgtgccactcttcaaccctattttgagcgggagaatagatttgtttctctataggagtgggggcaggggtgaagggagataaaaagagccctgtgaagcaacttttgggagctgggcatcccttctaaaccctcacttttattagtgcctgcatagatgtgtaggtgttgtatgatttacacacttctggttgtagatctagatccacctctctccttcgattctttcctgggcaaagtaatcagtgatttgcgtgttttgagcacaaaagctgagaaaatacgacaaaaggagtggggctggcttgtgcatggctccacaatgactccatttaactggccaggtccgagtgaatagaggagagcagagtctgcctctaaacgcgtgggcttttggttcaggcccctcgctgatttgaacagctaatttcccctttgcgggtttctgaactgtttgtgctcttggtccgtcatatgtgggtgcatctttctccgtgtgatgcctgctcttcttcccactgttatcttcacagaggcaagttccactaagataagccaacccaacaggttggaagaagaattggaaatatgaacctcccaggatcttaagggaagctcttaaaatcaacaggatttgagcagcaatacccctgcccccttaaaaaaaaatgtcaaacagagaaagcatctttaaggaaaaatatattctttttgaggaataacaaaatcacttattatatattcctaatactttgtatgaactgagcacagaaggtgtccacaacagtgattaatttatatcacactcatgtagctgtctgcatgcaaaagccacatttttctttctagttcactttcctgcttttttcccccaaactcaaacaagatcttgtttagaaatgtgtatccctactttttcctcttgagaacattatcaagttgatatgaacaaattgcagaggatataccatttaagtaagatgcacttttaatcactgatcattaaaatggttatgttaaatatactcaattacatgcatgacttaactctaacagtactttctattctcccagctgctcacgtattccttaacgatagtctgtggtagaaacttgattatgctgaatccatacatttcgatggatttcatcagcctaattaatgcctcagtgtggtcctggggtctgaatgaaccctttactatcgtttgaggttaaaggcagtggtggaatgtagaaggatttttttttccttagttactcccggggtacttagggattccattaagcaaggtggatagcagttgttaaacagactatgtggaacaagaaaacccatccaaatggcagaaaagtgaggctaattcttcattcttatttcacaccaacactttcggattccatagacaatctccaaatatttagtaaagtggaaattaccatcttccgttgtatcttaaaacttcactgagaaggaagagttgaaaatagatttacaactgatggctaaattcattttgttttattcatcaaggctgtccctgctccttctcttcctgttcccataactttcagactacttgccccctcaatttcaactttcatctttcacaaggaagcactcatggctgttattcagcagaaactcaagtcacccccaatggggtgactacattttgtcttttcaggtgtaaattaacatctgaatacatctcaatcttactgacccctaccaccaccaccaatcctgcctcagcagagttgcggctaatctgtacctccacaaatggcagggtagatagaagtcaaatttcccaaactccatcccccagcaggaagaccaaaagtgcttgtattgcctatgagataaatcctgatatttgcacatgtctaatgaaacacctgtggaagaatacctttcaagacatgtttccttggtggtcaagaagaaataaaaagaggaagaaaaaaaaagagatgaaggtatcttgattctttaagaaatgttccaactctgactttgagtccctaaggacaaactgttcacccagcagaacttccttcatgcaagagatccactgacccagcccttagttgcagaagggcaataccatacgtccatagaaatctgatggaactggaaggattttagacctataaccaaattactaccttggaactttgtgcttgttatgctaatgtaatgatttctgtagtaagggtatattgtaaggttgcaaattacgtttttataatgctttgtgtaatgacagacgttacatagaagagacacatgtgccaggattggtggcatagtactttttttttttttttttttttgagatggagttttgctcttgttgcccaggctggagtgcaatggtgcggtctcggctcactgcaacctccgcctcccgagttcaagcgattctcctgcctcatcctcccaagtagctgggattacaggcacctgccaccatacctggctaatttttttgtatttttagtagagacggggtttcaccatgttggctaggctggtcttggactcctgacctcaggtgattctccagcctcggcctcccaaaatgctgggattacaggcatgagccaccgcacctggccagtggcacagtactgacaaacactggaggacatttaaatagataaatgtagacctagatatgtttctaaaattaagctgagaatgagctcacggaactaggtaacaaagcagatgctgctggccagaccattgcaagggttaagatggtcttgcagcacccaccttttcactcagatctagtggagtagcagcacagcacattgctcaatcctttgggatagattcctagggaagaaaaaaagagactgtttcataaatagtactgcaagcaagcagttatctccagctcatggtttctgtagtgttaaggttagattgcagagggtcagagaaagcaatatttcctgttgggggtagaggagagagaaagtgagtgcaagtatgaagtatgtaaagaaataaacctttttttttttttttttttgaggcggagtctcgctctgttgcctaggctggagtgcagtggcacaatcttggctcaccacaacctccacctcccaagttcaagggattctcctgcctcaggctcctgagtagctgagatgacaagctcccaccaccatgctcagctaatttgtttgtattttgtatttttatttttattattattattattttttgagacagagtctcgttctgccggccaggctagagtacagtggcatgatctcggctcactgcaacctccgtttcccgggcttacgcaattctcctgcctcagcctcccgagtagctgggattacaggcatgtgccaccacgcccagctaatttttgtatttttagtagagacggggtttcaccatgttggccaggctggtctcgaactcctgacctcaggtaatccacccgcctcggcctcccaaagtgctgggattacaggcgtgagccactgcacctggcctaattttttttgtatttttagtagaaacgggttttcactatgttggctaggctggtctcgaactcctgacctcgtgatctgcccacctcggcctcccaaagtgctgggattacaggtgtgagccaccacgcctggcctgaccctaaaatattagagccatatatgctggggttgtcagtacatcccttacattcagtgcttcatgtctctgtgctatgtgattaagaatgcaggcaaatcatcaaacttgcagtattgaccttatgtgatttgtatcttggaaatcaaggacaagatagcttaatacagcacatttacaaaaattaaatacaactcttcagtgtttaagactgggctggggtttaatcatttcccttaattgtaaacaaggcaaattcacacactgatcaagcatccaagaaatgaacgtgttttcatcagtcacctctccttgatagataatcagaggtcagccactcccagcccggatattatgtgcctagttcttaccttctctgttccacctccacaattgacagctgcctcagaaataaataacttggttcctggataggtttggggctctttggcgtgacataatttccaaatgtcaacttacagctatggagaagcctgcggactacgataatggataaactctcctgtgttaacaggagagtttggagctagaataaggttgccaaaaaatagcctcagtgggttgggagcttctaagatcttgagaaatgaagccaatttgaaatgttggctttttatattagtccaagttgtcccattttcttctagagttgaataaaagcaaaatacctggcctgatgcagtgcttccctgatgacagttgaactaattagaggtggtgtttcttggttcagcccaaagatcctactgatggtagacgtaggagatgcagcctccaacagctttagttttagacaagttttacacagcccaagcgcggtggctcacgcctgtaatcccagcactttgggaggccaaggcgggtggatcacgaggtcaggagttcaaggtcagcctggccaatgtggtgaaaccccgtctctactaaaaaataaaaaacttagccgggcgtgttggtgggcgcctgtaatcccagctactcaggaggctgaggcagaagaatcacttgaaaccagaaggcggaggttgcagtgagccgagatcgtgccactgcactgtagcctgggtgaaaaagcaaaactccgcctcaaaaagaaaaacaaaaaaaaaagttttacacatccatgctttgaagttataaactgaatctgtgtcacttaggttgctatcatctgattcccctctagtgcatttctttgtatagatgagcccatgcaggcaaagtgtaactaactgtaatatttaatacataaactctctgacagagcaaattgataaatcagaatatttttacatttggtgtgtacatgattcatagtatgacaaggtcataagcatttttagcaaggttcttctgaactaaattaagatatttactacataatctaatctaccaagtggggtagattttagggtagggccacccagtgacaccttaaaaaatgccctcggtgaaatgactcattagtttaagagtagctgagtagtgtattatagataaaaatggagaggatacagatatggatacatcttcctcatgctctcttgtgatatggcaacatatgtgtgtggcagattgtagagacaatgctgagagttcagcaagaaacagtggcattgaggcagagaaatggcttgctgtcattttatgggttcacgttatttattatcagatgccattcagtttcttctgagctgaaggatttatctactgcagaaaccctgctcatgttgatgggaatgatctaaagcttcaaaggacaggttttaagattgttgggcattagtttcagatttggactcaaatccaagcctgaatttcttattggtttggggaagaaaacacttaatttgaaattctgatacgaactgtatggcagcaaacttagttgagcttagaaacagctttgaatctcagataccaatacactggctcttgtattacttatttatggaagaaaaaaaggcaacacctggtctctaaccaggagaaaagcctatttgaagtatttcagtcattctcagcaggtcagtcctcagcagttcttagagaccacaatatttaaagccgtctgggtagttctggtctcatgtcatccaaacaacacattttcaaactcagaaatgccaggtcgtgttatttctgtggcagagggttgcttaggatctgtgacagctgagattttcctatcgattatgtgacaatgtagttcatctatagagttcagagaaattagaaaagcctccagtttaacaagaagacccttaattcaattgctgtgttgtatttaaatgcagaaatcaaaattcaacttacagaaaatggaatagtgaattaaattttgaacccaaacttctgtagctaaatcaacctcctaggagggctgtgactaataatttaatttgaagcattacgattgggtaactggatttgtaaactaggcaagaaatcatatcttatataataaatgcatatttagatccatatatgtgtttaaaattgctcctaaatttaaagcacggagtgagtctaaaacaggaaagataaatcaaaaagcactcttgtgactgtgtgtgtgctggagaacagacagaggcgggtaattatagaagcactaacctgcaaacaccttgaaagatgtctttcagatgtgtcttaagttcttaaatgataaaatatgcatgcatttttcaaatgcattcacaggtaaaaatattattttttatatcatcaattctttatctgtcacagaatatgtacaggtatacagaagtaactagatgtccaatacattctaggggcccaggatttcaatcaaaagtaaacctgggtaatgtgactgtaaatcaagggtgcttgagaccatagacacacacacgcagaagggttaactggaggagagggaagagagacgctcctctgtgcagtttacgtgagtgacaggaagaaggggagcaagagctagagcaggcaagcaggcgccctgcagtcctcacactgaacacattcccttgttgtggagggacacagtgggaaaactgcagcctaggctgtggcctgcaccttgcccacccagccagcagctcttctcgcatctgcttatttcttgcctgaaagtcattcagcatgttgaaggtgcgattatcgacaatttgtcagtctgaatttgttgctggcaataacttctttgtgaagtttcactctcaggcacttgagttttgggattagaaaactggtgatgggagagcattatcctgtggtctgcttttcatttagacacagcccaggcagacagaaggaaacggagcattaatccaactgcagtcaccccaaagtacaggccatttggatccagaagagaaactggttccttctacaagctctcccgttctccctggggcccttcacagcctccttgtctacgttgtggctgtgctttccctggtgagcaattatgtataagaagtaggggatcctctgtattctgcccaaccaccccctcatccttcacaaaagttaatgtcttgggcctacaattcacttgggcagcctggaactgagactctgaagttgtaagtcttttgttttgttttgttttgtttacttttagttttctgtttgtggatgtgggtcctgaatcggcgccctcaaagttgaaacctttacctttttgtccaacctcttcccttcctctcatcgggggtgggggaagatggtggccaaaaagcaggccgtcccttggatagggcagctgggacagctgctccggagcagctgctgtacctcacccttatttcctgacaatcattaaaattcaatttcaaagtttctgtctttaacaatttcctaaggggcctatgaaggatgccaaaagggtgggcctcctttccagtggcagtgctttggcagcaagtagacactggtcaggttgcctgaggctgtgcccttctcacaatagtcctgtggagagtgtctagaatggaacactgcaggaacagctctgggaaagttttaaggtgggccaagaagtggacaagaccagcacctcttcccttaatcagcattgctcctgaagtacagccttcctggtcctagggtggagctcaagtacaaacctaggggaaatttctcatactttaatctcataattcctcattttcttttttgctcagctcaccaacttctcaaaccttgattctaaaaagaaaaataggccaggcgcagtggctcacacctgtaatcccagcactttgggaggctgaggtgggtggatcacttgaggtcaggagttcaagaccagcctggccaacatggtgaaaccccatctctactaaaaatacaaaaattagccgggtgtggtggtgcatgcctgtagtctgagctactcaggaggttgaggcaggagactcgcttgaacttgggaggcggagttgcagtgagcggagatcgtgccactgcactccagcctgagctacagagtgagactcggtctaaacaaaaagaaaaataaaaaaagatttgtatatctgaaatttcccttctatcaagaagctttccttaacacctcttttccctttggttggggaagtcttctattgggccaaggcaagacaactaagatattttgagaaacggaaaaatacatgtaaatgtacagcctaggtagctgagcctcatccacacattttgagtgaaggttgcccatcaaatgctattcagactcaccctcagaggagtttctcattccctgctcccaaaatttaacatgtgattagtaccaaaacatgccacccttaactaataccctcttgaatctatggaaaggaaacagcatttctttgaaattctagatgggagttaaggactacctgactactcttgccttcacctcgtaatcacatataactatctcaaacacccccctccttccctagagagccactgattggcccctcagcatacctagtacttttccttctcttctcaaattctcatcccttacccttttctcctttggaggcccctggaaaattttcagaattaaattatgattttttttgaaatgccatgacaagttagaaagggaaatttgagacagcactagaaatacactaacagagagtactattacaaggccgggtgcggtggctcatgcctgtaatcccagcactttgggaggccgaggcaggtggatcacccgaggacaagagtttaagaccagcctggccaacatggagaaacctcgtctctactacaaatacaaaaattagttgggcatggtggcacgcacctgtaatcctagctacttgggaggctgagggaggagaatcgcttgaacccaggaagcagaggctgcagtgagccaagatcatgccactacactccagcctaggcaacagagctacactctgactaaaaaaaaaaaaaaaaaaaaagtaccattacaactgaatgcagtagacaagtcacagtttggggtatcagcaattaattgcacatttttatacagtctttttttttaacttcatttttaagatccgttgatcctaacagatgcaagttaaacctgaagtaaattagagcaaagttaaagaaaaactagatcaagcccttcctggactggcagccctcctatctcgcgtagctcatggttatttggatagactctttcataatactggtagcagagacagaccaacaccaaagccccacttcttgttacttaatcacaaacctggcagaatggcgactccatacctacaaaaactagtcagtgcttattaaccacaacagatcaataaaaacaattatctggagaaataatattaacaacacgcccttgttaccataagacataagttcctgagaaatttggagcttccaatagcacatttctgcttatgtggtacctaaagttgtttcctggaagtgaaatttgaatcatttgcaatcattttatatccttgccccagaatgactctgtctctaaggctttgaatacgtttactactatgggcttttaatattctctaccctagtgaaaaggctacatattatagtagagaagatactgggttagaaatgccaaccagaatctaggttctagttcaggcgtctaactagtattttgtatgtaaggcagttcatgcttctggccttcagattttgcatatgtaaagtaaaaacatgagaatagataatctcttagatccttcattctgtacttttgtaacatttgtgaattttgaacctaagagaagatccagatccatacatttctgaataaaatacctatttatttcatagtccttttagtaaaaatttatgcaaaagactgaaaaaatgatttttggtcttctctgggagagattctgaactggactggaggaaaccaagctaagagacttggcattgttttcttttgtacaaatgaaccattgccttatactttaactttttttccttttcagatccaacttagaaataatgtttcattcaagataaggctcgtggcttaggagattgtgacctggcttgcatcattctaagacttctatcgtctgttttcaaaacccaaggaggacctccttttctgtgtgatagttcctcatgctttgccagccactgggtctttaaggaagcttgccaagagttcccggctgggaaggacagttcgagttcatcatagacaatgagctggcaccacagtttaagtgactcaccaacctggttgcccacttcaaaatgtcaagaaccacactatctaattgaaagaactgtgttttagcaaagtgtaattggatcgcctggcaagatcatctcaaactatgtctctgaccttgcctttcagtggctattttgagcacaagaggagaaaggaaatgattcctgaattatatcttgtttttaaaaattaagattaattaatacttggttttatgttcattccattgtaggaacttagtgattattacaaaacagtcaaaataggtcatagcaaaatgaacgtttaagattaggttaaaacattcctctgaaattttagtattcacttttgaagtgtcaattactatatttctgtaatttctcatttttttcttggcttagagtcaagatgaaaaatgatatttgaatcaaagacattgttttgttatatagccactcctttctaaaatgcaaatccaccctcccctcaccaatgctttattctttgtgcgcgcacacacacacacacacacacacacacacacacacacacacagacatacacagaaccagcacccaaatggtagaggaggtccttccaagacttctaggacctggatcatgtaagcagtagatgagaaaatgaagtaagagatatagagtaataacaataaaagtcaatgatttcattttacaaaaaagtcattgtgtagtactcagatatttttaagagcaagtattattatgactaaagtatattatacttctaaattattatgattctcatctaatttcaagccacacataggcgccatttgaaagcattttgtgttacaacctatcaacaaaaatcaactaatagttttataacgtgcataggtttaccccatggggaattaaaatttttatctgcaagtatttctgttgttgtgagactttaggacaagacaacatttggtgttaacatagaagaatattctatggcttttttagctttaaagttcattactctaaaataaagtacacgtggtatttttttcttcctagtgttctcttattatatgtagagtattttcggttgttgtttttaacgtatacattatttttattaagtcatttcataaaagataagatatatactaatagacccttggttttctcctaatttaattatttcaagtcaagcaaaattgggcaattttctttcaggaaaaaaaaaatattgagcatgattttgaggtaaaactgattatttacagcatcttttctctaataggctaacatttatgatggatcttatttcaaagttgattattctcaaagaaaagtggagatattagaatttccgagtaaattgcattgttttaaaaagtactttaatgcattgttcacattgttgccagctattgaccaaaaaagagaagaagaaaaaagaaataaaaaaagcagtatctgctccaaacgtcaagttttgcagtttgaaagacttgtacattataattgtttttttcttttttggaaagcagtagtaattaataccaaaggcatagacaatttagggccataacctcccttcccccctctccacctttttttttttttttttttttttttaactttaaccatgataggcatctctgcaaggtaggttttaacatatttttttcctaatttttttccctccattcagtaagaaggataagcttttagagtacccagtcaccgtggtaactgccaaaaaaattctcctgaagtttgaagaggtcagctagcagggtcaacaaccctggcctctctctgagctcggtctagcatgccccagcctgcggttggagtgtcaggccagatctgaccctgggaggtggaccattctggctctgatataaatttttcgagtcagttcatggcctggactctccaggtggcctccaaaatcgattttgaccccctgaccctgtctcacggaggcatagcatccaccctaagtaaggatttagccaggaatgacagctttccactgagtgttattggggacagtataaacagtttggaaagcaagtaaggaggtgtgagggctagcaatcattaaaagcacattaaaaaacaatttttaaaaatctttattagagaaagttgtaaatgcatatctgttacagaattcctgtgatttgtagagttttctagtcagttttgaatataaataggtcacatatctttatctttttgcatactttgttacaaatatgcaaataagataggcatacttgctacaaaataggtacagcaggaatgtaatatgttcagaaaaggcaaactggttattaaaacacattaacaggtaaggagtttctaatattttaaatactaaaattttacatgtgtattttgaagtttttaaaatggaaaaataaagaacctttaaaaaacccaacagtgtggaataaagataaacttgttgcactcaaggtacatttctactttgtaaagcaagaagccaatacactcagttggataaaaatgagagaaaaattgtaaatatagagagttacagcttatagagctgaagaggaataaaacaaaaaaaagtgtctctgaataactttatgtattttcaacagtttaagatatcagaaacttggaaaataaatatgatatatatataaatcatcagtgattatttccttttcattcccccccgcccccaggatgccaccgtgagtgtttgattttctctaggaaagtagaattctctttgagagttctagcctgtgaactcagtatgtaaatgtggccatcaagaagacagaactgccaagaggaaagattatgaatgtttttcttccttaaaaccattcacagtgtttcttcttccagtgctttactcagacttctccccttttcccagctctgttgaaaatggcttcaaaagcaacactgcagtggctaaaccaattgtactgtgaagttgttgagatgccatttcatctgaatccttcgtaaaaattagatttttaagtaggggtgaatatccttttgggagagggaatgggagggtagaagaaggggggaaaggacagagcagtttatatatatatatatatatatatatatatatatatatatatatatgagtatatatatatgagtatatatatatatgagtatatatatatgagtatatatatatgagtatatatatatgagtatatatatatgagtatatatatatatgagtatatatatatgagtatatatatatatgagtatatatatatgagtatatatatatatgagtatatatatatatactctttgtgtttgaaggcctctgtgtcttggcttctcactatgttaaatccctattataaaacttatcttcacaaagcctattatagtattctgagaacaaattggaccatgaataacttagttggaagtgtagattattttctactcaggggaagttagagatgacaacagcttaactgaaagaatagtgattaatcttaaatagatggatttcaaagtttcactcttgataaagagtacctttgatatttcccctcttcagaatcacgtttccactctctttgtattaagaattgtcctagtgattacactctccccctaatacagctcaaagtgtagatcattttttttccaggttgttaatttgtcagagaggtgaccagaaagacactctacttcctgttggttaaatcgatgattcctaagtggtactaggcttagatacaaaagtcaatgataagaatatcttgcataaatcatagcttcttacttagataaaattcttattt

SEQ ID NO: 355 - DNA, 59190 bp, Homo sapiens
ccacagattagctgaagccaaaaagcactggcagcatttgaaataactgagaacatattatacttaacactttattatctaagagaggcacttgaagttgagacctagaaatttgattctgggttctttgtttctaaggggcagggtgaacccagctatagcattcacagatgctatagaattatatatattctatatataattatatatattacattcatattaatatatgttaatatattctatattattcatatagaattcacagataatccaagtgcttttttaatacattgataccaaatctctcctgctctcaaaaaaaaaagcccaaggcaaaaatttttgattagcctgtatccgcaaattcatagtgcatggcatgatgggtactctacatccctcctcctattgcactcactgtgcccagatgaacctaaagtcaccagtaatagtgctaatgtagtaatgggcccaagcttcaaaagaaggaaaattagtattcagtatttaaatgtgggaaagaggaagaatatggaaattatcaattttataatacctatacatattcttacctgcattaatgtgaatagacatcaatgataaacagaataatgccccataaagatgtctacactgtaatctccaaaacttataactatactatatcacatggcaagagggaattaaggttactaatcagctgaccttgagatgggagattctcctggtttgtatgggtgggcccaatgtaatcacagggtccttataaatggaaaaggcagacaggagattcagtgtcagactgatacaatgagggaaagactaccagcagttgatggctttgaagatagaagaagggggccatgagccaagaaatgtgagtagcctctagaagctgaaaaaggcaagaaaacggattcttccctagaatctccagaaatgcagccctgccaacatggtgattttaactcaatgagatgcattttagacttctgacatctagaattgtgttattttcagccctcaagtttgtggtaatttgttacagcagcattaagaaaatgtacaatgaccatgtgcagtgcctcatgcttgtaatcccagcactttgggaggccaaggtgggtggatcgcttgagtccaagagttcgagaccagcctgggaaacatggtgaaaccttgtctctacaaaaacacaaaaattagcctggtgtggttgtgtggacctgtagtcccagctactctggaggctgaggtgggaggatggcttaaacccataaggtggagattacaatgagccaagatcatgccactgcactccagcctggacagtagagccagaacttctctcaaaaaaataaaaaagaaagaaactatacaatgctcctgtgattctagtgctatgtacatatatcctttatagggaattaaggaggttatagacacaaccagaagaggaggcatggaatagactaatgtataatggataggaaagtgtatcttttacaacttctctgtaaaaacaccttcacctactttatgagtttgcctcagctgccataacaaaatatcagaccaagtggcttaaataacaatttattttctcacagttctggaggctagaagtctaagatgaaagtgccagcaagtttgatttctggtgaagtctctcttccttgcttgccaatggccgctttctcactgtgtcttcaaatgtccttcctctgagtatgtgaggagagagaggtttgatgcctcttcaccttcttataaggacaccagtcctactggattagggctccacccttatgacctcatttaaccttaattacctccttaaaggttctatctccaaatacagtcacatttggagtcagacctacaacatatgaattttgagaggacacaattcagtctataacacctagatggaaggcaatttcatataaagatgatatgcagtctatgacagcaaagtagctagtggaaatcacaacccctaattctatttttatgtcattccctaagtccaggtcccatgtggatatagcattgttcagggctatctctttgctgttctttttttttttttagactcacacaagcaatgtggagaaggaacatgaaaacatctttgagatagagcttaatacagatgtcaatctctttgtaaataagcaattaaaagtggaaccactgtccaccatgtgagaagagtgactggctatggctggatatttttaaatacacataaaatgtggtataaatggtagaatgccagggatagaaggagtatcttataagttacctagtcaacgttctggcttctgggcagaaaactatctaaactcagccagataatcagtttcaactaaatcaggaaaacatggaatcatctttatctaggtagtgttatagttacattgcctcatttatctacacatcaataaattctttctcattgctaatatttatcattcttatcatagtataagcaaatgttttaattctattatggtaaagataaagcttctgtaattaaaacactttaatctggaaagacagcagtaaacccttcaagcaaaagcccaagtaggttcaaaaataatagccagagaggttaaaggtaaaccaatagagtgatatgttacagcaactaagggagagaggcaggagttttttaaaagagagaagaggaattataacaacagaaacaggttagccagctgccagtttagatgagcataatgagtcccttagatagatcattggtgatttttatcaaaacactatcggtggagttgtgggagtggtaggctgactatagtggattggggaattaaatagtgatgaacccaaaacagaaagtctgaagaaattccctttgagccaaaaaaaaaaaaggccgggtgcagtggctcacacccataatcccagcactttgggaggccgaggtgggaggatcacctgaggtcaggagttcaagacaagcctggccaacatggtgactctactaaacattgtctctactaaaagatacaaaaattagccggaagtggtggcaggcaacttaatcccagctacttgggaggcagaggcaggagaattgtttgaacccgggaggtggaggttgcactgagctgagatcgagccattgcactcaaacctgggggacaagagggagacttctctaaaaaaaaaaaattccctttgagcatctctactgtagagatgaaataagagagaagtggattctttagtatagagatggaaaggtatggagctagaacatgtgggttgtgaacagtggctaactaaaccaggaccagtaacctagatatcacattgggcttaattgctgggttattcattcattcaggcaacatgtatttgttgagagcctgaatgtgccaggtaatagaaacacaaaggtggttaaaatagaccttggcctctgtcttcaggaagcttccagtctgaagagggatgaagacatatattaatcaaacaatcccacaaatgcaggtataatctgcataaactgacaaatatatctactttggagtcaagaaattaagagaaatcactgatgtgatcagtgaacaagtaagatttattaggaagatggaaggatgacattacttcaaatatattacaggaaaccccaaccatggtaacaacatcaggcctatctttacatatgtttaataatgcttaacttcacttttgctcctatcctccccaaagcaatcttcaagttcttctgtatctttgttttattttctttgttcttttttgtctcatttcctatactgtttttattccatactttgacagttcagtgaactcctttgatagatcccaagtcctcctttttcaatatttacacttataatcatttttgatcactccaaaactgagaactttgagtgtagattttctaggcttcttattttatttttagacattatatagaaaaattagagggaagggaaaagaaggatggcaacatggtaactgggacagtgttcaaaaggtctaagtcctacttctcactccatacaaattatctgcaatttttttatttttgagacaggctcttatctctcacctgggctagagtgcagtggcacaatcatagctcactataaccttgaactccagggctcaagggatccttccatttcggcctcccgagtagttaggactacaggtgtgtgccactacacacagctagtttttaatttttttttattttcatagacacagggtctcactatgttgctcaaactggtcttgaactcctggccccaagcaatcctcctgccttggcctcccaaagttctagaattgttacaggaaagaggtcccaatccaggcccaaagagattttatttatgtactagtgtggagcctagcctaggacacatcaagcagaagtgcagataaggtctgactctttccagtacagctagggtgcctggctctccacatgtccccagaccttatctagaatctaatgtctccaaggtaggtacattgaataattttcaaaagtcaaggaagcagtttatgaccttaaagtagttagcaaacttaatatctgacctgactaatttagaccaaatgtttacatttttgaagatatttttattttatcagtaatctttaaaactattttctattttccaaagattacttaagtcaaatgaactaaaaggcattatacattttagttttctgatgaaatatctgatttaagcacttattatttttgaaccaattaaagcttttttatatcacacacacaacacatataaatacacagacaggctgggtgcagtggctcacacttgtaatcccagcactttgggtggccaaggcaggcggatcacgtgaggtcaggagtttgagagcagcctggtcaatgtggtaaaaccccatctccactaaaaatacaaaaattagctgggcatggtggaggatgcctgtaatcccagctactcaggaggctgaggcaggaggatagcttgaacccaggaggtagaggttgcagtgagccaagattgtgccactgcactccaggctgggtgacagagggagaccctgtctcaaaaaattaataaataaatacacagaagaagataaaggacttatcccctaaggcaggaatcaaaccctgaacacaggccaccattgtgaaaagaaaaagcacagccacatggttacaaggtcaagctcccaaggacatacaaaacaagaaggaaacctcatccagttttttcagggacctgcagcaaagtttgtacctgataaatttactgggccatcttgaacagcaggtttacaggtgtcctaagctcatgttctatcctaagatacccctctttatgacagaacaatacagaaagacacacaacagatttgctacaacttaagactagcctcataaatccattttttcactaatcaaaactttacagaggaaatgaacagtgatttttgccatccattcaaccagttttatagagagagagagaggaaagcattgcctgaggcagggtggggaaggcccggcactccgagtgccagagaaagccccacccattgcagcaacactgaaaagttcatgcagctgcttgtcagtcatgaacggattttttccagcagtcccatcagctctcatttccctttttaggagggaaaagctccccatgttctacaatcctctacatgcctaattctgtcaaccatagccatcagcaaagagtgcaaggcagatcaatccaaagagaatagcggttaacatcctataatgccaaacctgttcttagccgaaagggactttaaggagagggactttactgagagggacctctaaccccctaaatcttaaaagggactctaatcctcctaagttgggcctctaacccagtgtcagtcaagcatccttgccttttattgagaggaagctttaaccctctcttacgagagactctaactcccctaagttgagctataaccaatcccatcctttgcctgagtaccccaccacttacccaaagttgtccaattagtaatgctgcagtctatttcctttgtgctgggggtctcctcagtatcatcccttcgagtttcaccagaaagatgttatcaggccccaccacttacccaaagttagcctttggattgggggtttctgcattatagtcacttcagtggttgccaaaaagatgttataggacccccaacacttacccaaaattaacctttgggtcaggtatttctgcactatagtcccttctgtgataatcagaaagatgttataggaaaaggatcctgatccaggcccccaggagagggttcttggatcttgtgcaagaaagaattcagggcgagtccgcagtgcaaagcaaaaccaagtttattaggaaagtaaaggagtaacagaatggctactccatagacagagtaaccccaagggctgctggttgcccatttttgtgtttttttcttgatgatatactaaacaaggggtggattgttcatgccttcccattttagaccatatagggtaacttcctgacattgccatggcatttgtaaactgtcatggtgctgatgggaatgtagcagtgaggatggccacactaatgtgttttaagccttttcctcagccaaactacaaaaaagcaaaaattactttgtttcaatattacccctactggctaacacactagcaggtcatcagaatatttgccattcctacaaaattccaagattctgtgatgatcctttgagtataagaatcacagagatacacacaattgttacatgctctatttaagttttctatgttatattttctctttataccccccaccccatttcctgactctttctttttaaagggtctttgggatcatgaaagcaaaatgcagcatcctcagtgtcacacacgtccatgtgaagagaccaccaaacaggctttgtgtgagcaataaagctttttaataacctgggtgcgggcaggctgagtctgaaaagagagtcagcaaagggagataggggtggggcagttttataggatttgggtaggtagtggaaaattactgtcaaagggggttgttctctggcgggcaggggtggaggacacaaggtgctcagtgggggagcttctgagccaggagaatgaatttcacaaatgtcatcagctaaggcaggaaccagccattttcacttattttgtgattcttcagttgcttcaggccatctggatgtatacatgcaggcttgggctcagaggcctgacattcctgtctttttatattaataagaaaaataaaacaaaatagtgttgaagtgttggggcggtgaaaaattttttggggggtggtatggagagttactgggtgatgtttcttagggttgctttgagtgggattaggggtggcgtgggaacctagagtgggagagataaagctgaaggaagattttgtggtaaggggtgatattgtggatttgttagaaggaatatttgtcacatagaatgattggtgatggcctggatacagttttgtatgaattgagaaactaaacagaagacacaaggtcccaataacagaaggagaaaaacaggtattaaaggactaagaattgggaggactcaggacatccaatcagagtgcctaagggggttcagcgtgattattttcttggttgatgagtttttgggctctatccttgagtttttttatgttgtcatataccaagccagattgatttaggtaaaaacaacacttttcatttaaaaatacacacagtcccctttttttgagcagtaagtcaaggcctcagtgattttggaggaaagagaaatgcaaagccagcaatcattttttaaagaaggattagaaacagctaggagagagtgaatgagattgatagtgtggtggagatagctggggagaggtagagggtcgcataagaacaggaatgagaataagagtgaatataaaggtaaagaataggactttattagggtgaaagtattggagtgtaccttgtcactgaagatcttctatccacttcaagagagacttaaggaaggtggtttgaggtaaaaccaggagatatgagttatgatggtttggaggaaaagtgtaaactggcagtgtaaacaagggcagggcatttacgagtagttgagaatggtgaataggagtatgactagacagaagatagtagggatgacaagttttggggttgcagtccaagtagtgggggtgactgcataaagccttgttgcaataagtagggtaataaacttaatagaatgaaaggatgttttaggctcataagggttactactgttcttcagaaatgtgagtgagtttaagggaagtagggttgagtacttgcaacttctaggaggaagaggagagattaggctggctgtccaatggacacagctttattctggaatggtgagcctaatagggagggtcttacaggcggatggcagttggggtattatagatgactaagtagggtccggtctatcaaggttatagagtttgaggggtcagattcttaacaagaactgatcgtccatctagggtgtctttatatggctgggaatatggagtaggcaagaaaagattagcagcttggcaaatttcctgtcttgcctgctggaggaccagcagatagattcctagaggactggtgtctgagacgaggttggggccaagcaagaaagtgtgtctatataaaagtttaaatggactgtaccctctagcatctcaaggacaggctctaattctgagaaaggcaagaggtaaaagtactgtccaatcttttttaagttggaggctgagcttggtgagatgtgtctttaaaagaccattagtccattctacctctcctgaagattgagaatggtaaggggtatgaaggttccactgaataccaagagcctgagaaactgcttgggtgatttgactaataaaggccggtccattatcagactgtatagaggtgggaaggccaagcctaggaattatgtctgaaagaagggaagaaatgactatggtggccttctcagaccctgtgggaaagtcctctacccatccaatgaaagtgtctacccagaccaagaggtattttagtttcctgactcggggcatgtgagtaaagtcaatttgccagtcctgggcagggcaaattctcgagcttgatgtgtagggaagggagggggcctgaggaattcctgagtagtagtagtatagcagatgggacagagaagtgatttttttaggatagatttttacaaaggaaaggaaatgagaggttttaagaggcaggatagcagcttgcaacttacatggaaggggttacaaaatgacaacagaatagaataggcctgtgaggctggaaggagatattttccttgttccaagaaccatttgccttgtgtggaaagagattgataggtggaagtttcagtgggagagtaggtgggagtgacagatgagaaggagaaaaactggccatgagggacagaagttgggacactagctgcttctttagctaccttatcagcataagcactgtcctgagtgatgggatctgatgccttttgatggcccttggagtgaatgactccagcttcctttggaagtaaagtggccttgagaagagtttttattaaagaggcattaatgatggaggacacttgcatagcgaggaaacctcttttagcctacataacagcatggtggtgcaggatatggaaggcatatttagagtcagtataaatattgatgtgtagtccctttgcaagagtgagagcctgagttaaggcaatgagtttggcttgctgacaggtagtggaggtggacagagtggtaacatcaaggatagatgtggaagatactatagcatagcctgcctttgctaatgagtgacaattaggcctgatggaactgccatcaataaaccaagtgtgatcagggtgaggaacaggaaagaatgaaatatgggtaaatggagtgaatgtcaggtagatcagaaagatacagtcatgggggtcaggtgtggtatcaggaataatgtgggagccagcctaaaacagtaagatcaagttgcttggacagaaaggctacaggtcatggtcctggctcttgtgtaagaattctgaccgcacagccctgcacttcagctgtgtgtaatgaaaaagggttcagatgagttagggagagctagtgtgggagcagcttccagggctgttttaagaaatggaaaaaggagtggggaaaggatttaggatctatggggtcagctaggttttcttttgtgagtttatataatggtttagtcaggacagtaaagctaggtatttaaaggcaaaagtactgaaccatgctcaggaaagaaaggagttgttgctttgtcaagggggttggggtttgggagattagccagacacgatcagcagggagagcatgtgtgtttttatgaagaattatgtcaagatatataacggatgaggaagaaatttgggctttggaggcagatgtgcaatgtccttttgagaatagattgttggagcagcaggagggtgtcctgttgggaagatttgtaggaggggctataaagtagaaggtcatcaaaatatttaataaggtgagatgtagatggatggaaagagagtaaatcatgagaaagggcctgactgaagtaataggagctgtccctgaagccttgcagcagtacagcccaggtaagttgctgagactgatgggtgtcagggtcagtccaggtaaaagtaaagagggccttggaggaagggtgcaaaggaatagtaaagaaagcatatttgagatccagaacataataatgggttgtggaggggttgtgaagggaggtattaagaataagagagtatatgggtttggcaccatggggtggataggcaaacaatttggttgataaggtgcagatcctgaactaacctgtaagacttgtccggtttttggacaggtaaaatgggagaattgtaaggagagtttataggcttcagaagctcatgctgcagcaggcgagtgataacaggctttaacctttttaaagcatgttgtgggatgggatattggcattgagcggggtaagggtgattgtgttttaatgggatgctaaggggtgcatgatcggtccccaaggagggagtaaaggtgtcctatacttgtggattaaggtggggagatacaaggggaggatgcgaaggaggctttgaactggggaaaaggcggcaatgaggtgtggctgtagtccaggaatagccagggaagtagataatttggttaaaatgtcttggcctaataagagaactgggcaggtgggaataactgaaaaagagtgcataaaagaatgttgtccaagttggcaccagagtgggagagttttaaggggttttgaagcttggccgtcaatacccacaaccgttatgggggcaagggaaacaggcccttgaaaggaaggtaatgtggagtgggtagcctccatattgattaagaaggggatggacttaccttccactgtaagagttacctaaagtgtctgtgatggtccaggaggcttctgaggtgatcaggcagcgtcagtctccagctgctaagccaagcagatctgggaaagtgtcagtcagagagccttggaccagagctttaggggctgtaggagtagctgccaggtgagttggacaatcctatttccagtggggtcctgcatagatgggacatggcttacgaggaatcccaggctgcagcattccttggcccagtggccagatttccagcgtgtgaagcaagatcctgggggaggaggtctggaaggaatgcctgactgctgtggcttaggtgctatgaagttcttgtgtgctggagatgtggctggggtttctctcacagtggaggcaagtaattgcaactcttctctattattgtacaccttgcaggtgaggttgattaattcctgttgtggggtttgagggctggagtctaatttttggagctttttctaatgtcaggagctgactgggtgataaaatgcatattgagaatgagacggccttctgacccttctgggtctagctagggtggtaaagtgtctaagggttgttgccaaatgggccatgaactgggctgggtttttatatatgatgaaaaagagcctaaacactaactgatttgggagaggtcagctaaagaaaaaggagcattaaccttgactatgccttcagcttcagccacctctgtaagaggaaactgttgggtagatgggggagggctagccacagaacgcaactgtaagctggaccaggtgtgaggaggggaggtgatagaaggattatagggtgggagagcagaggctgaggaaaaattgggacctggctcagcctggtgaggagcagcctggggaggaggggagaggtcagatgggtctgtagaaaaggaggattcaaaggactcagagcttggggtggagactgaaggaagagacaggagagaaagaagaaagatttgggatgagtcacattgggagcagagattaggaaaagacttgttgcaggaagtcagggaccccaaatggagggaccggctgaagccatggcagaagaatgtggattgtgaagattttatggacatttattagttccccaaattaatacttttgtaatttcttatgcctgtctttattgcaatctctaaacataaattgtaaagatttcatggacacttatcacttccccaatcaatacccttgtgatttcctatgcctgtctttaatttaatctcaatcttgtcagttgaggaggatgtatattgtctcaggaccctgtaataattgcattaactacacaaattgtacagcatgtgtgtttgagcaatatgaaatgtgggcaccctgaaaaatgaacaggataacagcaattgttcagggaataagacagataaccttaaactctgactgccggtgagctgggcagaacagagccatacttctcttctttcaaaagcaaatgggagaaatatcgctgaattctttttctcagcatgggatatccctgagaaagagaatgcgcacctaggggtaggtctctgaactggcccccctggggcgtacctgtctcttatggttgagactgcaggggtgaaataaactccagtctcccatagcgctcccaggcttattagaaaaaggaaattcccacctaataaattttggtcagaccggttgatctcaaaaccctgtctcctgataagatattatcaatgacagtggtgccctaaacttcgttagcaattttaatttcaccttggtcctgtggtcctgtgatctcaccctgcctccacttgccttgtgatattctattaccctgttaagtacttgatgtctgtcacccacacctattcgcacactccctccccttctgaaaatccctaataaaaacttgctggtttttgtggcttgtggggcatcacagatcctaccgatgtgtgatgtctcccccagatgcccagctttaaaatttatctcttttgtactctgtccttttatttctcaagccagtcaatgcttagggaaatagaaaagaacctacgtgattatcagggcaggtcccccgatagggactgatgtgcaaaagaattcctggatatcaggcacctcagaccatttgcccattttacgacaagaattatctagatcttgtaggatggagaaatcgaaagtgctgttttctggctatttggaaccattgtcaagtttgtattggggtcaagtggtattgcagaagaaaataagatgtttaggttttaggtcaggtgtgagttgaagaggttttaagttattgagaacacagtctaagggtgaagatggaggaatggagggtggaagtttgcctatagtgaaggaggcaagccctgagaaaagagagggtagagacacggagagaaggggtggggggtacttgcctcccggggaggtggtgcttgccaccaaggtgaaggatcaaggcaggcatccccatggtgatcagacacctctgaaatgtgggtgaataatcaggcaggcatccccgcagtgattaaacactgagggaagactgtcttcccgagaccatgaccatcgtcagagttttgggttcacacataaaacatgtctcctctgtctctaccagaaaaggaaaggcactgaaattaagggaagggagagattgaagggtagcacagaaattgaaaggagaaagaggttgagggatagtgaaagaagttggagaagagagcaaaaagaggctgcttaccagatttaaaattggtgagatgttccttgggctggttggtctgaggaccagaggtcataggtggatctttctcacggagcaaagaacaggaggacaggggattgatctcccaagggaagtcccctgatctgagttatggcaccaaatgtcacgtgcatccgtgggaagagaccaccaaacaggctttgtgtgagcaataaagctttttaatcacctgggtgcaggcgggctgagtctgaaaagaaagtcagcaaagggagatagggatggggcagttttataggatttgggtaggtagtggaaaattacaatcaaagggagttgttctctggcaggcaggggtagtggtcacaaggtgctcagtgggggagcttctgagccaggagaaggaatttcacaaggtaatgtcatcagttaaggcaggaatcggccattttcacttcttttgtgattcttcagttgcttcaggccatctggatgtatatgtgcaggcttgggctcagaggcctgacactcagcagctactaccaccattggcaccactggcaccactgccaccaccccactgcaccccagttgcttcactctccatcacagaagccttttcagcaacagccaacatttgtaccctcaccaagccctctgattttcccaatcacaaggccttcactacaatattttcttcattcacaagtgtcacctattctccatccccaaggtaagtcaattctaattttcttgcaagggttgacagaggtaaaacctgtccagataccccaaaggtgtttcatcttggcaattcttgactctttcaaggaaataagaatagtcaaatataactaagtaaaataaataagaatatataaggtctgtaaaccaaaaatgaaattctaagccccccaaccaactgaatggacccctcctctcagccaagggcattctaaagttaacctgaaagactaattcaggccatgatggaagtgggtggtcaggcatgcctcattatatcctcctccctttggaatttagacacaaatgaccaacattaacattaaaacagagaccttaagattgacaaagtagactctttgtagcaataagatatgaacacaacagatagcaggccccaaaatatatttattcaacatatttttaaatggccctgcaaagctgtctcttgtggggaaacctacattctgtagagaatgcccttccctttccagatcttttcgcttatccaggagagaattaactaagagtctggtacctttttaagtctgataagaaacatttacaatctattctctctgaagcctcctacctggaggcttcatctgcataagagccttagtctcagaagccccttatgttaatgcagatactcccttctattgatttcaagactttaatcagaaaacctctgagtcttcctatgacctggaagcccccacttagagttgtcccacattttcagacccaaccaatgtacatcttacatgcattgattgatgtcttatgtttccctaaaatgtataaaaccaagctgtagcctgactactttgggtacatgttctcaggtctcttggagctgtgtcatgagctattggtcactcatatttacttggctcagaataaatctcttcaaatattttatagagtttgactctctgttgacaagtcctagttttaaaacagtttttatttcatttatttattttgagatggggtcttccctctgtcacccatgttggagtgcagtggcacaatctcagctcactgtaacctctgcctcccaggctcaggtcatcctgccacctcagtctcccaagtagttagaaccacatacgtgtgccaccatgtccagctaattttttgtatttttgatagagatggggtttctccattttgcccaggctggtctcaaactctctaagctcaggcaatccacctgcctcagcctcccaaaatgctgggactacaggcatgacccacagcgcccaaccaaaatgacttgtttttagacaagaggttagaaattttttttcctcaaagggccagacaataagtagattaggccagggtttctcaacctcaacagtattcacattttgggccagataattctttgttgtggagtgctttccttttcactgtagggtatttaactgcatccctgacttctactccctaggtgccaataacatcttattctcagttgtgacaataaaaacattttccagacatttctagatgtcccataggaggtaaaattgccctgaggtgagaataactggtatagactttgcattccatatgctatctgtcacaactactcagcagtgccattatagcacaaaagcagccatagacaatatgaaaatgaatggacatggtactttcccaataagtactatggaaactgaaatttaaatttcatataattttcacatgtaataaaatattcctttaaaaatttaagcatttagagatggaaaacccattgttagcttgtgggacaaacaaaaacaggtggtaagccatagctttccaactcctatttgttttatttttgaaagtttaataatatatgtaatttaaactactgtatccaaataatattattttaacatgtggtaattataaaaatcaattcataaattcagtatgtattttacatttataatacatctcaatttgtactagccacattttaagtactcaatagtcatatatggctagtagctaccatattgggccatgatgccctagagtatttgcttttaattattaggcatacttcctctcaagaggccctagtcattgggaacatgaggtcactttctctttgaaggtaaaagcctctaagtcctgttattgatctaaactcacacaaaaaaaaaaaaaactgaaagtaaggtttaaaagaccaccatgacaatatttatccaatttgtgactgtatttctgattggcaattcaaaattttgtttggcttagtaatttttcttgctatcttgaatagaattaatcccagaaggtctggtagacaatgagtgttttggtgtaactgggtttctttatgtacaaagctacagaattccccttgaagacactggccttgacatccctgaaatagcaaaatagacttttttgtttactccacgtgtagtatatgacagttagtgcattgtagatagggccatctattgaaatctacatgtgattatactctatcgaacatctactttaaaacagcaaacatgagagcctacaattgacatctcactgtttaaaaaaaacaatttcacatatatattcacaaacatactaaagtggtcaatattcaaagtaaagactcagatattcctcactttgcaccatggtttagttaaataatacaagtaccccaacaacacagtttaaatttcagttaccatggtatattgactgtgatattaaataaagtacaaatttcactgctaggttttcagtatgtaaattactatataactaacagatgtgcatcatgatcaattatgaatcacatcacttctttcacagtctttggtgactggtcacttatcagctattcagtacatgtgcagagaacaaaccatgtgtttgtgttgcctctttgtctgccagtgataaacccaagtgacatttaacaaaaacatataatgaaagagggaattggccaataaaaatgaaagctcaagaaagaaactaaagtcacaatgctggaaatgaaattcaaatcaaaggtaaatgaagttatagaggaaacagctgactgtgggaatgttgacactttcactggttggaaaggctatatagatatgaagccaaaggaacttagttaaagcagacattgacataaatgaggaatttggttgtgacaagcaatgcctattttagaccaatggcttgtatcctcattagggactgtcagtataccaaaagaatgggtgttaagtctaggaaaattataatcatcattaagttgacttttagttcccaagatttcctataattactgttttcagtatttagatattactgctaatggtaaaatggcctatgagtagaaaatatgaaatttacatttctctttatccaaatttcctagtggaaccctgcccctaacaatgtttaccacttcttactgtccattttcacagatatgggggacatgattacatgccctcaacccatatgttttctaggtaactctaccacagaataaagcggtactcaaattactctcagcttgcttaatatccactttaggacactgaaaaacaaacacaaagggactaaacaagatgaacagtacgtatcccatttcttttaagtccactatcttgatatcatgaggccccctcactggttttatgtagatgggctactggaatgcataagctagtgccaattcttattttccaaagatgttaaaagattaacataggatgggaggagagtgaggatcaaaaaatctacctatcaggtactatgctcactaccagtgtaatgaaatcatttgtacatcaaagcccatgacacacaatttacccatggaaatttacccattggcttttgctgcaaaagtaccccttgaacctaaaataaaagttggaagaaaaaaacttaacatagcaaattcttagacattgttctgacttgtttgcaagacctatgctttcttcctaagctggtgctggatagttcttttgacttttttcattattgatcttctctctccctagcattgccaccaagggaaactatttcatgtaagacattcttttccatccagccatctggttggccctaatttctctgagcacatctttcccacctgtattgtgaaccatagagcaggcctaagggaaggttataaagaaggtaaggttggtctgtattgtctcagtctcttttaatatctattcccttctgtatggtactccttcttctcagagactcctgttctctagcttcttcataatcggctttcaaaataggatctgctgtcagcgatttatccctttagtgctaggatggtaaataaattttatcttgcatgccaactctaaattattagtagcagccacctgaaatgctacgtgaaggattctggggatgcatccagttgaattagttatgagaagaaaaattggctactataggaaagagaatcaacaattcaatggattaaacaaaaagagtgttaattatttcttacatgacagtatcaatgtaaaaagttcaaatcagagagggaattctgtttcttagtcattcagggacttgatttccttccaagtcattgtactttcatctcatagggaatcactcccatctgtatactgaaactgggtagccattacatctgagttgcagctggtgggagaaagtatggaaaggagagcataccctatgtcttaggacccaggcatggaaatggcatacatcacttctactcacattttattgatcataacaatcatttggctgcacagaactgcaaaagaagctgaaaaatgtaccctagctgggcagccacacatcaagcaagaatgggagaatgtattttggtgggcaacgagcatttttgtcccttactaggcttaacaggaatcaatgctatgattaattaatgaaattttccacgagttggaaaaaaactgtggcatccacccatattatggtattagctgatcttgccttaagtgtgaaatggaagtcttgttttctttcctagagggtcctgaagtttaaatataattccaaaaaatttgacaggcattttccactatgagaaaggtacttttgttaggtacaaaaataaacttgtccctgctttatcacttaatgtagaatcaaagattcgtctccagataacagaatttcagacatcagctaccaaggagggaaaatataggcttgggaaagaaggccttcttgtatgaaatcacaccacacaggcactagacagctctacttatataaagtttagctctataaaaatgagattggggtgtttcagagattttattaggaaatgtacagagaaaacagttgatggggcaaaagctataaacactaaggtgagaaggaatcagaatataggcaagagttatagaagcatctaaatggcatttgtatctgtttaatcagcctatcaggtaaatctgcccacttttctccctaccagtgaacatctgttttgaacctctaggatatgggacctcttgcttgataccagtctttctgtgcctacctattctaaagcctgatgtcatcttctgtgccttcccttataggcttacttccttcaacgctgaccattcctccagcatttcttattctaaagaggaacaggtaagaaacttcgttggagggaaaattaagcaaggattggcattagagagggagctgtgcacagtccctgtctcaacaaaaatagcttaagatgagacaagtactttacttagcataatcttgctactgaaggggctattctaaatgtccccccgcccaacaccattatgtaaacattctctaatattcgctacttaatttagattatccacccttccttctggccattgcattccttatctagcaatgcaggaaaagggcaagaaatcaaagggaaggaataaagggacttctgtttccagactgtattttaaagggaagtcatggttggttagcgattttctttagcttttgctttgcgtttgcagaatagctaatattattgttttacctatgggaactggtatccaatctagtgcccaatggggctgttgttactagagctattttctgtgaacctcatagcagactctcttctgctgaaaatgagatttactattcattctgggttctctcaaaagccagcctgccatctacaattagcggtcacatccatttggctatagttcaggtaagtccaattcttcatgtcctgcttctcagctctctgctgctcagagccaaaaaccttatcttagaaccccaaaatacatgtctagttgctgtatcaaagaccaggtagcagcctttacagaaagtcccttttctcagaatctagttgagccaatactatgcagtgtccactatattcttcttggttcattctctttcttttggaggcaacagcttactatggtgaggacaactggaatccatctctacctattcaccactttttaagtagtaaaattggtagctcaaaagtaactttattccctgctaagtcttgctctttccaattattattcaaacatgagaggtgacagtgagaagattggtttggcattataggatggtaccatgcaaggtactctaacaaccggccttctgtctcatggtctatctccctgcagattcaggttgcatcagctgtcctcctatgtccacaatccaaatgctatgggatactatggcagacaagttttccagttcttcaggaagtagcaactgtgagtattctagctcacaatgggaggagcacaacgactggactccagccatgagcaaatacaagtaaaggtttaactgagactgtctgctccccagttctccaacccctgcctaccccaagcccctttttgtcttgatttatagtagaaaagtaatagtcggtcgggcgcgggggctcacacctgtaatcccaccactttggaaggacgaggcaggtggatcacccgaggtcaggaattctagaccagcctggccaacatggtgaaaccccatctctactaaaaatacaagaaaaaaattagctgggtgtggtggcaggctcctgtattcccagctactcagggggccaaggcaggagaatcatttgaacccaggaggcagaggttgcagtgagctgagattgcgccatcacactccagcctgggcaacaagggcgagacgtcatttcaaaaaaaaagaaaaagaaaagtaatagtcacaaaatggatataaaaagagaggtaacaatgggaaactacaggggggcaaattaatacttttatagtttcagcagacctgtagtaacagaagaaaaactgattttcacttggttcagactatctccctgggctagaaagtatagggccaaggtagaggaatcggaggtagatgaattatcttcctgtgtcttcctttaagtagttcacattgctcccatttaggtaccagttaatagtcataattactataatccctctctttggatattctctaagactttatttcctcgtgagcataaagacataaaatagtacactggaggttagctatgattaggaagagccattctaactgtaaattactcataatccaagctctttcctgatgagcatgtatccgttataaaagaggctatgataatatacagtgagaaaagaatttgtttagaaattaagtgaatttggatctagggtcacctcagctattttgcgctgcgacattgatcaagttattttctctgggtttcagatgcctcatctttattttgtgcatttagatacacaattctaattggcccaatgggaattacacagctaacaccatcatgcagcaaaacaaaataaaatacagtggaactgaagtgagggagtaaaaccaccacactatgcagatgagactatctgcctagtaacaagacatttcttggactctggtacttcagccaaatgtcctctgggagtggagaggcggggagacaatatagtccactgccagaaagaacccacatctgttccaccactctcattgtcattgcgtttcctgggatactttcagaataattcattagtaacaacaacaacaacaacaaaaaaaaaaaacagcaaggaaaaggctacaaggggaagggtttttctaggtctttgggatatatctaatcatttcttcacggaatattataaagtagggtccactcaaagctcatccctcacaagccactcaacctttgacattcttcttctatttaatgtgagtcagaattcctaagattttttgaaatcctgcctgcaaagtctgcttatgaatttttttccttaccacggagttcccataaagtgacaggttctgcctaagtagttagctacctgcaaggctgctcgaatccaactttctttcccactctactttgcattctgctctccctttgctctcctctccttaggccctcaagtgatgccagcttttgttctagcactctagaaaggagttactattttgatccagagtacacagagaagagaaactggagtgggtaaaaggaagctcgtcactgagaatgctggtactgggagcaagactgtggcaaacccaggaaatactaacaataagaacccctcaaaagttcacctttaccaagccaatggaaacaatatagctgagtggggtttgaattttgagaactaatgactcctcagctaccatgtaattgccttggtgctccatttgctataattcatgggaaaggtactaaggtccttcaactggttttccttgctacctccacctttttcagaagttggacctatgattagcacacttcctgcctatccattcacagtgaatagaatggctggctaaattttaaaccccatttaaattattccacttcgaaatttgaatgatagatgcttgcctaagtctactggcctcagtaacattaccttttctcatgaccaagggtaaaagagtaaattgataggaggcacaagtttttgtggatgtgggttgggctggcaccaaatccaactacaagcatacagtgaccacttcatacacaccacataaaaaatacaaaaactgaaaaatactatcaaatgctttgacattttctaaatatttctgctgcccctataaaattgccttgtctgacctttcctcactaaccaggagatacggtgtttttcatttcctctcccttcaaattttacaagagaatcaaggaatttgaggaccaaagcaccacaaacacaagagtaagcacagcaaatatgacaaggggactgaagtaagcccctatgggaataggatctgctgaaggaatcaagagggatggacaaaggaacagaagacactcaagaataacttcaggaagtctccttaccgcctcacctgctttccctctgtcctacacatccagccttgcaaagaaataagagtaaagagaaaagtccatgtagcaccatcccagttcagaagcaacccccaagatatgggtcaactttatcacctcaaactctactcatttataatgacaaaattcaactgttaacacataggtaagagttcttcaggcatcggttttaaaggtccatgtactgggacgggtgcggcggctcacacctgtaatcctagcaccttgggaggccaaggctggtggatcacctgaggtcaggagttcaagactagcctggccaacatggtgaaacccagtctctactaaaatacaaaagttagccgggcatgatggcgggtgcctgtaatgccagctgttctggaggctgggacgggagaatcacttgaacctgggagacagtggctgcagtgagccgagatcacaccactgcactccagcctgggtggctgagcaagacactgtctaaaaaaaaaaaaaaaaaagttcatatactgaataaccatctgggcccataacagcttaagactttctggagaaaaaaaaaaaaaccagtttccagtttaatttccaacaaagcagtaggaactcttgcctatagaatactgtgctgggggctgggcacggcgacttatgcccgtaatcccagcactttgggaggccgaggcgggtggatcatttgaggtcaggagttaagagactagcctggccaaaatggtgaaaccctctctctactaaattaaatacaaaaattagcctgctgtcgtactacacgcctttaatcccagctattcgggaggctgaggcacaattgcttgaacctgggtggcagaggttgcagtgagccgatcacaccaccgcactccagcctggagacagagcgagactctgtctcaaaaaaaaaaaaaatactgtgctggttcatttgcctataaagtcaccaatctaatgtttgggtatttgatcattcagaattctagaaacactgaagatcccttcacctactcagggtctgggcctctttcatgaatgcttaattcccacagccttacagtttatacccttctcctctcccacttttgatcctcaagttttttgcttctcacattttttactgggtttgtgcttctcagtatccttgaccaaagcaactgatgctgtaagaaatgagacttcaaaccatttacccacactgggtgattaaggtagtttaaaaaaagaaatgaggccaggcacggtggctcccgcctgtaatcccagaactttgggaggccgaggcaggtgtttcactttaagtcaggagttcgtgaccagcctggccaacatggcaaaaccccgtctctactaaaaatacaaccattagccaggcatggtggctcatgactgtaatcccagctactggtgaggctgaggcaggagaatcgcttgaacccaggaggcagaggttacagtgagccaagatggcaccactgcactccagcctgggcaacaaagcgagactccatctccaaaaaataaattaatttattaatttaaaaagaaaaagaaaaaagaaatgaagaacttacggtaattagtgtggttagggacagtgagttagaaattgtcacatcaaaatacaaagttttcaaaacagtatattttattttacaatagcaaccaactccccagtttgtttcaattgtgacatctagatggcttaagattactttctggtggtcacccatgctgaacaatatttttcaatcttccaaacagcaaagactcaaaagagattctgcatttcacatcagttcacaagttcaagagtcttccatttatcttagcttttggaataaattatctttgaggtagaaggacaatgacgaagccacttaattccttgtgtctgcataaaagcagatttattcatcacaacttcatttatgtgaataaagcagatgatgataaaatgttctcttattcttgtttaatcagtagtggtagtgatgccagaaactgtgaaaggaaggcttttagttactttcttctttccattttccaataatccattccccatccccagctgaagaaaggggtgttactgagtccagctgataccacacattgaaaggtaaacattaatatttcaaatctgatgtctaactaaaaatgtacagaatgaaaactagaaaatttcaaccccagattatcttcaaccttgctccctccaccaatcatactttgacatttatctatttccttctccacttatggatgtaattggcttgctatagaaactacagttcagatgctttgaatgtatgaactacaatgaacaataaagtcctcttcttttgaagcatattttggcttcagctttaagataatcttatgacaagaagggtcacactgattcacttaataaattccattcttacctaacacaaggtttagttgataagcacttggacaaaaataatacttttcaaaaatgtaaagcaaactagtgaggacaaaggattttgtcctcatctcaacaatgatcagctattggaactgcatgaaactgaacaatttaaacctggagctggtaatgttcttaagaccaattcagaacaaaggcaggttgcccttaaaacaggtttgaccttttccttcactcttcctcctgtcccaccctctgtgagtgatttaaaaacggaaaaggtcaaagcccagccaggcctacatttagagaaattttaaaaaaatttttcctttcaattttggccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagcagtggtcagtcatttttcatgagggatggactaggaaaatgaagtgtctattataaggagagttcctgtaacttaaggagcaagctcactacaaaacccagctacctgcttatcgtagtggccagagtggtagaagagatacggagtaggaattaaaccacacaatgttatttagggactaagccatgcccctaacaagaaaacaagccaaaaggaaagtattaggcattctctgggaaggcatgcatttttttcccatgtctctggggccaaaaaccttataccaagtacctattggcacccgaatatatttgtagaatgaatgaatacatgaaaaaaaataaacagtaacctttctcctatattctactttccaagccaattaataagcaagtgtcttttcgtcatgattttttttgttttctgtttaggatttaacaaaatggttgagataacagtcacttctgtttgatgaagagtatcacttcattccatttttgtgtttttgttgcatctccaagtcagaataaatgccttttggagcagatatatttcatttagcatttagtatcatcttcatcaatactcgtatgaacgaaaaaataaaaagccctctcttattcccactctacaacgcatgtcaaaggtgatctgtttagtttttccttagtatcgaacatatcacagctactcaatgaagtttcttctcaactaaagaaacacagtctcttagagaatttgttcctgtgtttccaccataagataaatgagataaagtgcactttggtttacgtctttcaagcacttaagaacagcactttattcagttttaataaatttttactaaattggtaaatgcaaaagaatcttttttttattgctcatatgtcttcctgtctctaagccagaccaatgagcaaatacctttaaaactagttgttacatcttgaaccatttaactgtaataaaagcagaatgtttagttaatgaattaaagaacaaaccctgagcccttttatcagtctcctggctttaaactaagccaatgaggaagtgatttgggggattcctgaaactaggaaaaatgtctctttattttgaaagaaacttgcatttttctttctttttttttttttttttaatctcaaaggcaattgagtgggtcttctgggccagacctatttaatttacgaaacatagtaccttgcagagaataggcattgaaatattatttaaacaatcaaaccaaagatgttcttctatcttcagctgtcagtgatctaatgccctcatctctcttatcctcaggacccagaatggtatattccacataaaagatgctttgtttatcaaatgaatcaaaaagcacgcctgaggcatttatttttactcctttacttctgtaggccaggtcaaggtgggtctaattcacttttatcatcagcacttaagaaactggatggaagaccacaacaccttgttttttgcaaaaattttccatctcctcaatcaggccaggaagcatgtatcttctggacaggactttatctctctactcagcttagtacactgccttatattagtccatttgtcccatgttttcatcactgaataaacttgttaaatgacttttggtctggatctcacacctatattacttcatttccttctgtgagcactctataatgataacatcatttttatatcctagggcatgtagttccgagccccacagaaagtaatcaccattcagtaagccaatagttcattcctatctgtatagaactgtaggctttgtaaatctacacatagatctctgttgtaggttcaataatgataataaatgtttgtgcccccagttgttatctctaaggataagagtaatcaatgatcattcagcagatatagcttatatatgggtggcagtttacaaattataaattgattttacacatattttcttctgctacccaagacacaataaagatggtttatctttgcatccccaatgcctagcaatgagattggcacacaatagataactactatagtggcattcttcagacaaccaatcccttgcgtatgcgtattcaaaagataatcattgttattcaaattttcctactttatttgcacaatataataactatcatacaattttataaacctagtacccagcaccaagtgagaaaatcaacagttacatttatatggtgccttagagttcacaaaatgctaacataggtattgccttatttttggctgtggctaaatgaaatatgataaattttcagtgcctttaacagtgagttcacatagtaggcaatcaaaattgatctatttaacaggtatttaaacccttggtttgtataactacttatagaacccttctcactgtggtttaactatacaatgagaattttgtagagacaatacctagcttacagaaagttttattcatacagaaagcatcaaatttttcatttacaagtgctttataatttagaaagcacattcgcaagctgaattaagtgactttcggtctggatctcacatctattacttcatttcctcatactagctctttcctggttacctggaaaaatgtatcagtaataatttaacttaacctcaccagtaaagtcttgattgtttaaaattaagcaatatatcattccttacatctgaatagtatagaggataaactttcctcttattacataggagaattaatcttgtattttacagtacccaaaatagctggtatgtaagaggcacttaatattcattcatccattcattcattcataaatatgtagcccattgacatttgtatcatgctttagtttacaaagcactttaatatgcacctttctgaaattttttgttctatgagaatacttttccccctttggtagctctagcacccagcatggtatctggcacattataggtgaccacaacaagcttagtcccttatgttttcagtatattttaaagtttaaaagcagtttccatgtgttttcgtttctgatacctggaatactgcatttttactcaaaattaccagagcagcaaacacaaattggcctcaaatatacatataatttattcatttatcaaacaattccttgtgtctgcatagtactatatccttttgaaagagcacttttttatgcttgctcctttctttgtatccacaacgcttatcacagtagaatacaagtgctttacagtttacaaagcacattcactattttttttcaggtcacctagatatcaataatcattgcatttttagtgcctagcacagggacaggcacagaaaaggaaactagtagtattcagaaattttctctgaataacaaataatacatcagggggtggtaagctatgaacagcaggccaaatccaattggctcaaaaactaagaatgattttgaccttataaaaacgttgtttaaaaaacaaatatgtaacagaaaccatatggcccacagtctaaagtatttatgatttgaccccttacagaaaaactgtggacccctgatttacataatgcttcacaatttacactgcactttcaaatgttaactgcatgattgccaatacactaattggtttttctcttatgttttacagtgctttcatacacattatcagtcatttaaatcaacttcccacataaacaggaagaaaaaaatcaaggaaagtattaaacatgctcaacagtcccaggttctctcatctttaagcctagagatgggtattaaacccaggagtagcgttggcacagtccaccaaattatttggccactactatgagcagggagttcaggctgtccccttgggacctcgctttgtcccaggcacagtcaccctttccataaccatcactagaaatcccaaaccccagaatcctgctcacctaagctcaaagaaggaagctgttgctggcaggtgcttctcagaagtctggcacatctgtgtatttcttgtctaattcttctcattggcctggagcatctcttcacatttttctctagagagcctggcacttttttttccccaacaacctgaccattttatcttctcagtctagggcttctggggtcaaaagaaaggactgaaatacagtatcacctatatgaatgtctgctcctgagggaagttaacaaaagccagattagatactgactggattttggtgtctctctcaagtggagaagatgtgaatagaaacagaagtttacaaaacactatagcctaacaaataggtaaaagctgtgatttaaagctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatagaaaagaggtagggtttagggttctcatcttgggatttccccaggtcttcaagcttctatccttcctgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgttggccttgtgtcacaagtctcagttcttaggccttccatgtgtcctgtcccaggtcttaagacttctaactcaagccttgagacttccatccaactcaggccttcggtccaattcaggccaccctctgttttcttggctcttgaggcttttgttggtttcaggcctgaggcttctatctatcttggaacatgggctttccatcttagtcctcgggtctcaagtctcaaaccatctgtcttatactttgggccttctatccatatgagccttccaccttctgccctacttgagttctgggttttactgcagtctagggccttgttttggtcttggatcatctcacatggcagcctggcataaggaaccgctccacaatgcttgctctgatagccgacgttctgcacctatcaggcaggggttaggaagcccctctgccacacatgacacacacacacgtacacttgcccacatatgcaaagaaatatttaaggagagattacatgaaatcaaagagagggagatagattcatgaagaggctgaaatactcaaaggtgagtagaaagggaagaagcagagaacaaatacaagccaacagagattaatactgaaatagaaaatcacaaacagcaagagatgctgaggcacgcaggggaggagagagagaatagcccaagagaggcagaaaggaaatgcagaaatgagaaatgtgagataaaaagtagaaacagcagaaaggaggccagactcagaaaaaaggtgaaatttaaaacgaacgagaaggggaaggggtaacaaataatcacagttcacaaagagaaaagagaggtaggcagagaaaggagaggtagacagaacaagaaaaggacaaaaagcacacagcatgtgacccaaaaaggagacatgaaataaagcgtgaaagaagagccacatctaggagagcaaagagaaatagcaacaaaatgaaaaatgagagatatgtctaagacaagacacagaccactcttgtgaacaaaaagagaaaatgaggcaaaggcacacacgaaagaaattagcaagagaaacatggaaatgggtaagacacactttagatagagaacaaagagcaaagacaagaaagaaagagacaaagaaatacacacttgagtgcaagagataagcaaaggcagacattcagaggaagtaagtagtagaagaggcaagatacagtgaggggcacaagaggcatgaaaagcatcacagaaagataaaaaaaatcaaaaagtgtcattagtaattataataaactattgttactacgaatactacttatagtactacaataataacaaccaccaataccaacacagatgctcttctatttataaacttttaccttagggatttcttacatagaaccaaagcatgccaactctgcctgctacctgatagtgctagtggtcacttatattgtgggaaatgaacttatgagtcttcttgggttaccttttacttgacatgtgccaggcactgcaataggtgagcactttacatacatgatttcatttaaccctcacaaacagagaagtctagagactttaagttgtcaaaggtcatatacctaatgagtagcagaggatttaaaacacacaatgtatgcctcttaacatcctgttacaactatttactaggatttctggaagagccaaatgggatgtcacagatgactaagtattttcataaaaggctctttgataggacttgctcaatcccctcctttagcatcacctttccccaactctttagaaaactgacttcattctcacacttttataatggctacttcagagtttagttttctttttacactaatcttaactgacgacagagtctctcacaaacggagatgagaaagggttaccctttcagcagaaagcagaaatggtgttttaagcttctcaacgtttaaggctctaagaatgacagagggcctatacagtgaagacatagaacacacaagcaaaggctaaattcttctgtgatacaactggtaagaagaccataatgtctttgagttgcttcagtgaacccagtcagtaatatggaagactggtcatctttccatctcacatttagccccacttcacattagaccaacacaccccatccaacaccagctcccaaaaaacagctgttataacagttctgaagtgatcctcacaggactgcaacatcaacaacttacttcattcagctatcctcaagtgctagagtgccaggcatgttgatcttcaggtgggaaggctgacttccttcagtgtgttcaaatttcttggacctgctgaagactcagctctctgcactgcttgtaggaagtataatgatttggcagataggaacaatgaagagctataaaaaaacatgagataaaccatgtaaatgccataaatattgagtactgtgctagagttacataagattcaaattaataagcaatagaaaatgtttccacagaactttgaaacctataaagtcaaaacttttaggtctttagagagaaaatttcctcattcaacagaataggaaactggcataaatgggaaaatgtcttgccaaatatcacttgatgagtcactagagacaccactaccagtcatagccttataccttagttaaagaccagaactgccgggcgcggtggctcacgcccataatcccagcactttgggaggttgaggtgggcggatcacctgaggtcaggagtttgagaccagcctgaccaacatggagaaacaccgtctctattaaaaatacaaaattagccgggcgtggtggtgcatgactgtaatcccagctacttgggaggctgaggcaggagaatcgcttgaacccgggaggcagaggttgcagtgagctgagattgcaccattgcactccagcctgggcaacaagagcaaaactccatctcaaaaaaaaaaaaaaaaaaaaagacttccatcctgttttaagtgccaatcagctaggaaagagtccctttaaatgattaataactgagatcacaaaaataatagatatgagagggaaaaacataaggtcttcccaatgtttaaggctcacttcgatgttttaagacccctcaagtttgctttaagtctcctggctcaggactaacaaaacacagccttagagcagcattttcaaaactcacaatattgctctttgagataaaggtgagtcactctggaaggcaaatattctcacaataagaaaattcacataggttgtttaacattgcagctaaaatacaaaaaaaaagaagaagaagaagaagaaaaagaaaattcacatagactactggccctaggagaatttatctaaagattatgagtacaatagatagatcttcctagataactctcaacttagctttctagttcctagactttctaacaatttgttagtaactctctatttctaaatctacagagatttctagtcaattataacatttcaagagttcttacccatgaaaatatttcatgaaatttatagctacccactatttacgaagaatgctgggcaaagcctatacgttcaggatttattgcaccgaatggtcacctttatctgccaattctcactcgctaatcagcctctcccaacactgacctagagaatgtagggtcctggttctttagctcctgcctgatgacagataactttgtgccatttttagtcaggtttccatttgtatttatgcggcttccatcaatcagcaaccatagcataaaaagacacacctctcacttgttgtattatacaccatggcatcccaagccatcctgaagtatgtaaatgattggcaaagttcttctgtaaggctttaagagagactttggggaccacatggaacagaatgatttgcccatgtgatcaatgtcactgatgtgacagttgtccatgttctcctaaaagaacaacttagctgtaagcctctgccacgtgctatagtcccactccaaacacccgaacacatgcaacccgctaccctctttacatcatcactttaaccagttaatctcacacccagttgcttcccaggttagttaggaagctgtttttaccaaatcatatgcagaataatgatgaatacgacctcagtgaaacactaagtgcaatgtatactggaaaacaaaatcaaaattaagactacttattatgcttttagggacagcttacgcaccttgacgtgtggtggttgtttttgagactttatcttcctatctgggaccaggaaagtatcttgacagaacctcctgacctagggttgttgcccagtggtagtgagcttttcccctggaggatcctcatgccccatctccacctagggatcgtcaaagggaatggatcactaacactgtaaaacaacaagcctattcttctgaggaagatctgaaaagagataaaagaaaaagtattgaaatgcagtacactgggaaagtctgttctaatgggcaactagtggttgagttcaaccatatttttacccttttcttcatgtggattgaagagtggacatttacagttgtgcggagctgttatattctggctaccaacttagcaaaaaaaaaaaaaattatcctattcattccagctctattctgtatgctttccctcatttccaagagaaatttagaactgagtaattgccaatattcccatgctgcattttattctccagtctttattactgagcgatcctctacaatgtgggttgttaatacccttgtgttctcagcacaaaatatagtaggggggtcaagaaatcaagaggttgaaactaatggaaggagaaactaatgctttctcaaccaagagagccatgaagccacacagaaaaggtcggatgtggtctaaccctatgagttatgtaagaattctcctccacaatgcctctggcttcctttataaagagctattttaagaactgagaaatccacctctatcaaagtgcctgtcagctagttctgtagcatccccctcttttaatttgtactttaagtagtgccatgccataatattgccaagataaagagaattgtttcctactcaatccacatggtaacatttcttcaacaacctgtataatagggcgccaccaaagttctaggatattcggagaaaccaagaatggtcacaagcacatagaactccagttataacaacagctggccaggcgtggtggctcacgcctgtaatcccagcagtttgggaggtcgaggcgggtgaatcacctgaggtcaggagtttgagaccagcctgaccaacatggagaaaccccgtctctactaaaaatacaaaattagcctggcgtggtcgcgcatgcctgtaatctcagctactcgagaggctgaggcaggagaataacttgaacccaggagacagaggttgcagtgagctgagattgcgccattgcactccagcctgggcaacaagagcgaaactgcgaaaaaaaaaaaatacacgccacaaaaacagttaagcaaatctatgcagaaggaaaaacaaggtacagaaaaccagggattcagtaaattccttatacaggcccccggggctctcctattccactttttaacaatttcaattgtttttcaagctaagaaattttgatttcttaaaacaaggaaatggcagtgataatggaattaggcctaccaaaactgagctaatacagatgaagttagtcttatttgtaaacaaatcctgagaacttaatacccatctgccaaaggaaagtgggaataatttaaaaggccactaatcaaaaggtgttaagttcattaaatctatcttgctgtgtggtgagaaaagaaataatttagtgctttgcatctctcattcttcattggggatcaagtatgcttgcccttacagacctcactggagcccagctctgagggataaatgaaacaggccgaactcattatgtaaagttaaaatgtatgtgtacatgcaaaagaaaaagtataggaattgatgaaaactggctcacgttctgcttttctttctttttaagagactgggtcccgctctgccacctaggctggagtgcagtggctaatgatggctcactgcagccttgaactcctgggctcaagcaatcctgctgcctcagcctccagagtaggtaggactacaggcacgtaccaccatgcccaactaattttattttattgtagagacatgggtcttcaactcctggcctcaagtgatccccccacctcaacctcccaaagccctggaattacaagcaggagccaccatgcccagctgtgttctgctttaaaaaggagagttgtgggaagttcaatccaaagacagaagcactacaacaataaattccccaaactacctttttctccagatagctggcaacccatccaagtagattagctggagcttggccagattctcaaagggaaagatatgattaatttggagcctcttatagctgtttgcagtcctcaggtctcacatgctcagaatgtccttaagaagaaagacagggttcagtaggctaccaaagcaccggtaggataccaaaagagttacaaaaaccccaatgaaaaaaacctaggaagtataaactgaagcattagacataggtatctcctgtctctactttctagcctgcttggtctccctaaagtcctctaatgacaagccctggcagtacacgggaagattagacaagtgaagaaaaagaactacatgaaaatatgggtcaaaccaataccgaccttaagggctgacactaaatttgtggctaatggtcatcctgttgctgaaaatacttcaagattcaaggtggtgtggcaactgctactactgcttagaggtgcaattgtcttgactgtttttaataattggctatctacctttactatagcataggagctcactaaaggggatctaagccaaatttgcagtcttgaaagcactttgcatggtactgtatagtatggtgtgaaaagcacccagtatgttaaacctgagtaccttaaatgaatacaggcttccagatccctgatcagggattactgtatcatgaggaaacctttatgtcaatgtcaaacaggaatatatggaacatcacttattcaacactattctctagctttaaaaaggccaaactgttctatgatgttctcaatataagcagaacaagcttcaaaatctcttgccaacatccttccccatcctaatttaatctaagattagatacttgacttccaaatgcaggcttccagttaaacatggcggttcatacatgtttatgcatttactctactgcttcctaaaactccattaatgagagtaaatgtgcactccatatgcaagcaaatacacctaaagaaattttaaataaacggatcctagctcaaattcatttatacactggcatctaaaagggaacaactattccagtctccccaagtcttcttaagcatatttatggagtatcttgctttagcatcaaagccctctagttttgcctgttactatggtgatgacatactcaaagagcattccctttcccttaacgggaatctaaggctagagaaaatggttacattttggaactgggaatctaaggctagagaaagtggttacattttggaactgatacagaaccatacatttcactagggttcaatattcactgacaagaattttgagaatccgtcatcttgcagaccaacaaaatatcaaagtcttatggagagaataactgagtggcacagccagccatctggttcaaatactccagcatcagacagaattgtcacagctagacgtgatattaataatcacataggccaggcgcagtggctcatgcctgtaatcctagcactttgggaggccaaggcgagtggatcacctgaggtcagaagttcgagaccagcctggccaacacggcaaaactccatctgtactaaaaatacaaacattagctgggggcggggggtggggggcgggtgcctgtaatcccagctacttgggaggctgaggcaggagaattgcttgatcatgggggaaggaggttgcagtgagtcgagatcgtgctacttcactccagcctgggcgaaagagcaaaactccgtctcaaaaaaaaaaaaaaatcacataattcaacattttcattctctaaggaaactgggaacccagaagatgaaactacctcaatgttacacaaatagaaggtaaccaagtgatacttaaacccatgtcttcccacaattcaaaggtcttttaactgtggggtctgtgcatagattctcaggacatatggggagctttctacaaaactttcacaatactctcatttcactgtaaggatagtttagatcagctatatgactacttcataatataggaccacgttgccagattagtggcaaatgttctagttttgttgcctggggattacagaaaagaagagaagcaaacaatatataaatgtgttttgtgccaaatgaaagtgaaatagcattgctatgtgctataatggcaggatttaaagcagtttgaaaacagcagtttggtgaagtgcatcaacacagcatgtgatattacagacacgccactcaaaagaaactataatactataatagtagtgccatatttgcattttagttatctattaactactaatttgtacatctgctatgttttatagttgtattatagatgtaggcaaacagatttcattccaggtttgttcatacactttaacttaacaattattcccataaacctaaatagtacataataatatttttcttttacagaaaacgtttaatcaaatatagcaaaatattaattgtagaatctaagcagtgattatgtaggtgcacactgaataattcttttcttgagagaaaacctccctactatcaaacttattatacagacttgagaaacactgtctcaaactaatatctaatataaaatattaaaattatactcaacataatttcatgttattttaaattgctgattaatatgcaatgcacatgacaatgctgttaatcagggcactttttgtaacagcacaccaactttcttgactaaaattgaaaggttaaaaattatatttgggttacaattgccaaggaagacatctactccttgggtcttaaataggcactttggaaggctagctggaggtcagtaaatgaacctttcctatcccacgtgtgaacatgcctttcccttcctttcccacctccagtgttctcagggtcctttagctcttagaaaaaaacggaaagaagaaatgcatacccaaggaacagcttacctggcgatatcagaataatttaatctgaaaatcaatgtcaaaatgtggattgaagtaaattctggttcttaagataaagtttgtttctgcaacctattttacgtttcaaaactggcagaaacatttagggcagaagggtcatttctagtttcaagaataccctacagctaaactctccctaaacttaaccatagaagcaaatgtcaaacactcactaccgtaatattaacagaaaaatttcccaaccaagccaggtttctcactgtagaaatgggaggtaacagataagcaaggaggtgagactataatgatccatgtggcaatgattagagttggagacgtaggtataaacacatttagtttaatatagatacagatggttatatatatttatagctatgtgcatatacacacgttagaatgcaaatatatatctccttgctcttgtcaactgaaaaggtcttgaaggaatgacactccagtagtaatgagcgcacctagcattcacttcttgatttctaatattactctccaataaaaagtatcaaggctccttgcagaaatacatcattttaggtccaggcaggagatatgcaaatgagtctgaagcatgttgtagttccaaaaataagaaagtgctcaaacaaaaaacccacattcatggggttatatcaaagccaaatgaaagacctcccaatggccaaagctggaacaatttgaacaacagaataaagtaatactgtattataacccagagtataaaatatccctgagatcatactgatataaatgactgaataaacacaatacattgtggagaaaagacatcctgtgcaaaagaattccaaataatttatgtaaatactctgccctcaatgaggtggaaggtaatttcccattccttaagtgctggctgcacatagtgacttcctatgtgaacagtatagtagggaaatggagaaataaagactaattttacgctggagaaacctgacaaatagtacctcagacaggtgattaaggataacataaacagtgataagtcatgttgatagtatgtactcttgataagtgataagaatggcactctacctttgtggtcttcctcctaaacactcataaacccaatctagtcatgagaagaacatcagacaaattccaatagagagacattctatagaatactggaccattagtcctcaaaactgtgaagttcatcaaaaacaaagagtctgagaaactgtcattaccaagaggagcctaaggagacatgactactaaggacacatgcagcgtggtatcttcaatgggatcctggaacacaaaaagaacattaaggaaaaactaaggaaatctgaataaaatatggactctagttaataataatgtatcaatattggtttgttgtgacaaatgtaccaaactaatgtaaaatgttaacactgggaaaaactgggtgtgaagtacacagaaactctatcttcagaatcattctgtaaatctctacactgttctaacattaaaaggttattttttctaaaaatctcccaaccagttgctgaagacttataagacacagtttttaaaaagcaagcaaaatggaacctaagaactggtaagtctatgttccagatttttctacagtacgtaccatcattgtttgcagatctgatctaaagacttactctctttcttttctgtttatatggatttataataggtaattttgatgttaaaatatacaaggcccaaataaccaggtatccgtaatatcaaaaagttattttttaaaaaaacattagcaattaaactttgtttttgtacatcaacagatttcctggaaagacctagtcaatctgctgtaaaaaataagtcgtaagttagtagctaattttcagtcaagggagatctataaggctggaaaactttaataacatatagattgtagagtgattatatcccatcactgttcaatgccaatcacactaacagcatactataaaatatactatgccactagttttcaaagctatgggtaaagtaacatagataattttataatgggacctggtaaagtacagtgatgttccagtcatatccctatttttaaattcttatacgcacttgattatgtaataagagggtattgcttgggtctactgcataacctctcatgtttccgggaacactagaagactagcattctaattggttaaggaaaataatactttaagtctacccataatttaagaagtctagcaccggtcaaatttacattttgtttcagtttctcatcctaacatgaaaaaaaataatcaaaagttatttctaatataaacatcaaaacagtaaaggagaggcttctttaccaaactcatttgtataagatgcagaagaagcccaagctccatgtatcagtactcaatttggaaaggtcaaggaagagctatcaagtaaagcctaagtcaccaacaaaaacatgaccaactcgacagcctaatacacatatatatagtgatatataactgtacatggccactgaagtttaacttgttaaattcagcaggccagctatgtcttaaatacatgagctccaacttgagttggatttttgaaggaaacctgtgtaaaatgctacttgcctacagcccaaaatatggtagtgagaatatcaattttctcccaatccagtctttaagacaaggcagaggaaggcattagctctgtttaactgacacatcattactctttgccatccaaactgataaggtttgggggaagagaagaggcattagctcagttcagatataatcattagtttctttctctttaagctggtaacgtatttttccaggatgctttcacatataagaatattttagcagtcaacaaaggtcaactcttaattcattactttaagacatgaactcccttcaagctgtacatttgataatcagggcacaaacaccctgaaaagaaattatgaatgcctaatcacagcagccctgggtctcacagtcttctgtaatttagggaggtggctagagaaatggaagttacagaaagataaagctgaaagaggatatgagaaaatggtcagaaaacttcctccaatcctacatgttaaggttttataaagggaaaagtcagaaaagaaatgacaataatcatttaaagaaatgccaaaaaagtttccttcattagacttttgaaaattttccaaatcacaaaatgtcattttcagggatttaggtatttgatataagcccctatcttatttcactagcagtctcgagatggtcagattgatggtgatctgaaccaaactcagagccaggactaaagtctaagcatttctgcccaaaaccataatgatttccttctgcatcctccataagaaagcaaattccttgatataaatcctgtctttggttttgctatttattccagcacctggtacaataatatttgttgaactaacacaagaattatctctattttgaagatgcccacatttccagagcatccctttttacaattgctagagatttttcttaagggtggaaattatttcaagcaatgaatttaaatacagcttcaagattcacctttggatgctatctagtataatcaatccacctaaaatcaagccatccttcctcttgacttaaggtacagaatcacctccaaattcattcatttaaaacaaattccaataataattataattgtatgttgacaatgaatgacaatttaattaccaatagaagatttcataagcatagaccagggtttctcaaattggggtgataaccctggggatttgtgaatatattctaatggatccccaagttctacataagttatataaaacacatctttgacaaagacaacgtgaaattggaaaacatatttacatttcaaatatctttgttaagtcagtgttcctcaaaacacatttttttaggatctcagaaaattttgttcctttagaaggtgtttcatcatgaagcattacttgggtttgagaaacaatggcacagaccatgtttccaagaaggttcaagaccatgatgtatataaccctcagtcagccagacaatgttgttaagcatatggagtggggctgggaggcatggaaacaagccctgaggaaatatggatatgaattaaaacgggctataagtgaagccagttcacttatatggttcttgttgctcctgctgtgatgcatgaatgtgcaccagaaaaaaagtttcgaatgttatgttaaacaatattttgtcagctggaaaacattaaggaggctaagcttcttttagctttacgaaaggtgggaggaaagaaggtatataaactacagcataaagtaggcaaggaaggtcaaggttttgacttcacttctccactaccctcttggcaaaaaggttccaaacttaaaaagtatctacgatatgcattatccatggtcatctgttcttgggcagaaatgtagtaaaattgtggaaggagccgaagtattagatttatgccctcaatctctgaactttaaaatactcaagcttatgagatttagcaatcactaatttgccaaccttcgcaaatagccaaacacaatggctatgctctatccctttcatctctttccatggctccaaaagaggtaaaaaacaaatgaaattaaaataaaccaactggactatccagatggctgcaatattaatcctatcttggcttaaagagaaaaagcaaacccacttccttaagtttattctatcaacttcaaatccttgtgggttcccttcctaaaactactacttatgattcacacaaaacagcacttattattttctaaagttatttcaaatgtgctcacattagctcctcaacgataaaatcatctcaggaatgaaattatataggatgatatcattcctacccaggttatcagtgtaacctagcatagagctgggtccacaatattaattctacagttctgctggttaactcacatatgtgtatttatgcatgtatgtatgtatctatttctctctctatatatatatattgcagatgaggtgggaagaaggaaagaaacttactggaccctctgacttttctataggtggcatctaagagaaagaaaatagaataggaaaaagattacttaatagctacgaagtagtacttacagtattctaaagagccagagactcttctttacagctgtccgaggagctagtagggcaaactgctccctgagctgggccgatcttttgacatccttctccgagaaacaatattctttttcagttattacaaagaactgctgttgtgatgactagttatttgcttgagcagttccatattacataatcctgtgccacaaaacaccctgtacactagtggctgggatattattcatttccactaggcagctatctcactgttgaaatttatatccaaaagaatatttaattttggcttatttttcttataaaatagggaactcgtcttatcatttttaagtcctcacctcagtgtggtacttcaaactacttcaaattattactataattaaatgcttcattttatataataattaataaaaaaggtggcatatgctttttaaaagcacctctgcatatgttccctcatttaatcgttttactgcaatcttcttgaaataagtaggggcaggtgctccagatgaagaaattaaaggattataaaatttaggtagtttttctaaaagtgaatgctggtaaagcccacacaaagatactggtcttaagagttccactctagaatatctttgatattaaaatagcaagagtcagtgttctatccacagacccaccaccctcagttaaaatgagagacactggtcaccaggtacatagtataaatggatattttggcttcaaaaaaataatgaccaggttatcgagtccaccctacaatccagatgtctttcttaaaaaaatttttttaataataataagcaatttttctggctgtatcctggcatttggcactttacaataacaatatacaaaggggacaacaagagattcttaaccaggcaatctgctctggaaagaagaatgcagagaaagtgccaaccttccttcctggggagacaattttatagtgtacactggaaacacaaaataaaggatggcaatccagctccctgggtctgacttgccttcagtattttgcacagtaaagcagtaacacaggtgggcaagaatggttcttgtccccagaatctgacaataattgaaactaggatcattaataaatgaaagaaaatgagtgaaggcttatccacctagttcaggcctgcttttcatagtcaacactgcaccaacacaccaaagtggtagggagatcttggactgatgggctgaaaaatgggacaatcagtactgtgtttattaataacacagaaggggctttgggtagtcagcatactcagaagcaatgcgaaaggaagtagaggggttcatgtataatgggtgggaccaaggaaagtgcaactgagaattgtttaagtccaagagaaagggccttgtctggtcaacattacccagcaaagaggcaaaaggggcagggcagagggaagggaagagggagacagcacaatcttacctaatagctgcaaatatggacacctgagattgtgagcaatagtctgtaaaaaggggccaagggcacacaaggggcagagagagggaagacttcgtatataaagcatgacaccatggctacctgtgattttacacactggcgcaatgcaaaagggttgggagtatggaccactgtttgatagacaagtgcatggaatactccaatgcttatactttattatgccatgggaaactaagggtggggtggggcgcttgcttaacaaggtcagggagggagaaaaccattgataactgccattgtgcctattaacagtcccaggagaagttttgagtagtcagcagcccctgcagtaatgcaaaggggatactagggcataatatcccactctaccagaaggagacatatataattgcaaatattcacattaacagtacaaggggccttagtgggtcagtacccccgatgtaagcaacgaggaagcaggagtcttatctaatgatcagtgcccttgataattgttattaatgctattaattgtccaagagctgagattatgagtagttaacacttctcagcagcaatccaaagggtaatgggaggaacatagggtctttttctcctacacaggtccacaaatacaattatgacattaatattaaaagaaaagggttcattcataattaacatgcccctgatgcaaggggaatatgtggagatcaactcttagtctaaaagaagaggtggacaattgcattaatgcatattaagtccaaaagaaggggcacttagtgaatatcatccccctgctctaaagcaaaggtggtacaggaacatgcttagagaattgagtttgtgcacatgaacattccaagtgacagtcttgagtagtgggcactacctgctaaaaacactaagaaagtaggtaggatccttatctagtgcacagatcaggagcaaatgtaattgcacatattaacagtccaaaacaacaggactttggttgatcaggacaccctgttgtactacaaaggaaaggtgatggggtatgaccttaatctactgacaaagacaaaagaaaatttcaattatatgttgatagtccaccagaaggggccttggagggaaacagtataccccacagtaatgcaaaagaggtataatggtcctagaagtgatagggttgtggacaactgcaattattcacattaactgttcaaatgtaaagatcataaggagtgggcacccactattgaaaagaggtggggcatccttgtctagggcacaagaaccaacataaatgcaattatgcatgtcaacaagccaagaaaaggggacttagggggtcagcaaccctggtatactgcaaatggagggtgagaaggtagaactttgtttaattaggatgaaccatgtggtgattacatacattaatgtccaagggacattgttgtggtcaattaaaaccatgtactttggacaaatataagaatcttaaaaagtagtgggtactccttgttgaaaagcaaagggagtccatgagaaggtgcccttatctagtacacaagaatatagacaagccaagcaaagaggcctcagtgatcagcaccccagctatactgcaaagggggtctgagagtaggactttattcaaataggataagccatgtgcagttatgcacataaatttccaagatgcatggttgtggtcacttacaattgtgcaccttgattgtccaaatgtaagggtcttatggagtgagcactccctgctgggaggaaaagaaagattatgcgtagatgggatggggcagaggaggcttccttgtctagtacacagaaacctggacaaatataatcacacacataacaggccaggaaaatgggccttggttatcagcacccctgctgtactgcaaaaggggtctgagagtaaggccttattcagatgagataggccgtgtgcagttacacacattattgaccaaggtgcatggctgcggtcacttagaattgtgcaccttgactgtccaaatgtaaggttcttatggagctggcactccctgccagaagggaaaggaagattgagggtggggtggggcaggggaggcttccatgtcttatacactggaacccagacaaatataatcacatacgttaacaggccaggaagaggggccttggttatcagcacacctactgtactgcaaaaggggtctgagagtaggaccttattcagatgggatgggccatgtgcagttacacacatttatgtccaaggtgcatggttgtggtcacatacaattgtgcaccttgactgtccaaatgtaagggtcttatggagcgggtacttcctgccagaagggaaaggaagattgggggtggagtgtggcaggggaggcttccatgtctattacacaggaactggaacaaatataatcacacacataacaggccaggaaaaggggccttggtgatcagcacccctgctgtactgcaaaaagggtctgagagtaggaccttattcagatgggatgggccatgtgcagttatgcacattcatgtccaaggtgagtgcctatgctcacttacaattgtgcaccttgattgtccaaatgtaagggtatatggagtggacactccctggtggaagggaaaggaagattggaggtggggtgtggcaggggaggctttcatgtctattacacagaaactgggataaatataatcacacacataacaggccaagaaaaagggccttggtgattcagtacccctgctgtactgcaaagggcatctgagagtaggaccttattcagatgggatgggccatgtgcagttacgcacattaatgtccaataatgtccaaggtgcatggctgtggtcacttataattgtgcaccttgattgtccaaatgtaatgatcttatggagggggcactccctgctggaagggaaaggaagactgggagtgggggtgggggcggggggaaggcttccttgtctaatacacaggaacccagacaaatataatcacgcacataacaggccaagaaaaggggccttggtgatcagcacccctgctgtactgcaaaaggggtctgagagtaggaccttattcagatggaatgggcaaagtggttatgcacattaatgtccaaggtgtatgcctgtggtcacttacaactgtgcaccttgattgtccaaacgtaagcgtcttatggagagggcactccctgccggaagggaaaggaagattgggggtggagtgtggcaggggaggcttccatgtctaatacacaggaaccgggacaaacataatcacacgcataccaggccaggaaaaagggccttggtgatcagcacccctgctgtactgcaaaaggggtctgagagtaggattttattcagataggttgagctgtgtgtagttatgcaaatccatgtctaaggtgcatggttgtgttcacttaacaattacgcaccttgactgtccaaatgtgagagtcttatggagtgggcactccctgctggaagggaaaggtgagactgaggtatgtggagaggaccctccttttctagtgcataggatcccagacgattataatcacacacaacatgccaagaaaaggggactgcgttatcagcaacccttctgtattgcaaaaggggtcggagagtaggaccttattcacatggaatgagcagtgtgcgattacgcacataaatgtccaagatgcatgcttgtggtcacttacaattgtgcacctagactctccaaataaaagggtcttatggggtgggcacttcctgctggaagggaaaagtggggatgaggggagcactttccttctctagtgcatagcaacctcgacaaatacaatcacacatattgggaggccaagaaatggggccttaggtgtcaccaaccatgctgtccttcaaaaggaaggatactgatgtaattgtcattaggcacattaacagtttgagaaaggggccttaagtgaatagtaccccatgcaataaagcaaagagggtgtgataggtcagaaacccaagtctaattgaaggaccattgacaactgcaattacatgccatctacagttcgaagagaagggcttaatattgattagcactctctgctttgataagtacaggagtcctgataaaaggcacaactgtatgcaactgaaaatgtgtatataacacctaagattatgcacgctaactttactagtctaagggtcttaagtagtaggtacttccagctgggatgtaaatacagtgggtggggtccttacatggtaaaaaagtacagcagcaaatataagtatgcacattaacagtccaagagagtgaattcaggctagttagaagctcctgcagtaatgcaaatggagcaaggaagcgggattctactctaacataggggcacatcaactactgctaattatgcgcatttaagcagtataagagaagaagcactagctagttagcactcctgctgctttgccaaggaggtgtgagggggatgggattccagggcaattgtcttacttttttttttttttaatgttggccaggctggtctcaaactcctggcagtaagggatcttcccacctcagcctcccaaagtgctgggattacaggtgtgagccaccacacccggcctcagggcaattttgcataatagaaattcaagaaagactttaggaaatcagtacccccttctatgatgctgagaagtcaagatattagcttgatataaaagctagatattagcttgatataaaagactcagttctaatcaattagacatttgaaatgtcttagacaattgaaatcaattaggcaattgaaaatatgcacattaagagtcatggataattagaaatacacattaagagtcccaagagaaggactctgggtttccagcatccctttctataatgtaaaaggggtagaatataggtttaaagggagagaccatgaacattggaattttgcacattcatagtcccagggaaaggtaacataggtaattaatatcccttgctgtaaaacaaggaggataaaatggatctgatctgaaagacattgttgtgatcagttgccatggttcacattaactatcctagtgcaaaggtcttgactagaggtcatccactgctgaacactagggaagtgagtggggtctttagtgcacaggaagagggacaaatgcaagtagcacattaacagtacaaaagaaatgtccttgtgattagcaccctctactgtaatgctaagagggtgtgagcagttgggatcttaatttaatggaaaagaccataattgcaattatgcgcattaacagtcccaagtaccccctgctgtaagacaaaaggaatatgaggggatgagaccccagactaacagcagatagggaaattgcattttgcacatcaataatttctggaggaggggcattaggtaaccagcaccctcttgatgtaaagcaaagatgatgcagggaccttgatataaaagactcagttctaatcaattaggattgtgcacataaactgtcctagtacagaggtcttgagtagtaagggtcccctgctggaatacaaagggagtggaagggttagtgcacaagatcgtggacaaatacaattatgaacatcaatgcacaagaagagtccttgggtgatcagcccacattgtagcgtgcaaataggatacagagtccctttctaatggacaggactctggacaattgcaactgtgcaaattaactgttcaagagctgttattgaataatctgcactcgttagcaacatcccacagaaggtgggatggggtgagaatccatttttattgcacagaaccatgaatatatgcaattatgcatatcaactgtttaagagaaggaaacttgggtagtcagaactcagcagcaatggcaaagaggacatcctagactaatgagtgggactatgggcaattagtgttttacatattaatgcaaggtggtaggtagttcacactatctaggagcaatgataaaggcatacacataagtgggtcttctctgttacgcagaaccatgaataattactattgtatccattaatattccaagggaaggggctctaagaatgagtcagtcccactgctgttatgcaaagatgtttgcaaaggccatagtgtaactaacagaactatggataattgggattttactcaataatttaagaaactcttaaatctcaggtagtcagcgctgcctcaaggcaaatgcaagggcgactggtagtcttcatgattaatgggtgagacaattagcaattactactttgttctttaattgtccaagaacagcaggattctccagaagcacagcaaaaagcgcagtagggtgcctttgtttaataggcaaagctatgacaattgggactgagcattttaactgtccaacaaaagacgggttgtctgcgaccccctgctgaatgcaaatggggttcagagtgctgtctaatccaatgggtaggattattggcaattagaattttactcaatgcaaagagttttaggtggccaacacagtacacaagaaaagatcactactcaaaattgggactgtgactacagaagcaatgacagagaaatggtttctcctttaagggcaggggatcgagaaaatgataagtaactcaaattgtgggcaataatgctctgatagaaagctctcaattgacattccctaacttcaacgtaccgagtaaggaaattctttgtcctgagatcacagacaaatgggattgtatgcattaactgaaaatggtcaaggagtcagtactgaagatcagcaatgccaagggtaaacggaatatcccagtataataggataagcaatggacaacttattttgagcactgaatcaatgaaaattagagtgactttcgagagaagctgggcgggactgaggaactaggactgggactggggctagggctggggggttaggggactggggctggggcagggctggggcggggtgggagtagggctggggctagactaggggtttgctgggagcagggctggggaggaactggatgctaggcaggcaggatacaacgaaaaattgaaatactccaatataataagtctgaatagaggacaccagaccacagcaattcaagtttcctgtctgataagtaggtgattagtcaattagtgcagcatcaaggatgggaacaaagcaaggcctggacctgtgtaaaccttcaaacactcttttttacattaggtcatgaagttaaattttttactgtttctgtgctacagactcttcaaaggaaaatagttaagtcaatttcaaagaaaatgaccagcacatttttaaaacattagaaatgatttgactttgactatctactgccaaaaaaaggttaaggaatttgtaatgagaagctaaaaactttaaggaattttaaggaactcaaaacaaaaactcattaaatgtaattaaagtgaattctacaaataaagcctcttaatacatttctataatagtcacttaagacttaaattcaaacactagcaaaccacaaaatcagactgtatgactgacatccaaaagataaatataaatcaaaatccgaccccagcattagccaaggggtaggtgttcctcttgaggaaggcaggaattcctcttctgccacctgttggccaacgatcatctgtgatccattctggtccttgccacggctcaccaccatgtccacaccaagcaggcctggagcactgcccatggcaacagtgcagtgcagggcagaccagaggggggtaggggggtaggggggtaggggggtggggaggtggggggtggggggtgggggtggggagttgggggggttggggggtggggggggaggtatacttagccttaggtgaggcaccaatacagaggaatggagggaggttcagaccacacagccagatatccagcactgcaagaggcagcactggacaggaggggacaaataagaggggacagaggtggaaaggctaaatgtccttgaaaagaccttgaaaacacctggtgtaccgcccactgggagacatacacgtggcccctccacttctttctcctgactggctaaagacagctgcgaagtgccatgctaattcacccaggtcttcgctgagtagctggacagtgtgtcatcagtctaattccatcttctgctctaattggctgtgatcaattccacccccatttctaattggttgggttatgcagcaatccagcactgtccatcccaccttttctcccgctctgcgtggcactaggcggcaaaacccgccatctttaacaatgcggcaagcccgccatgatgtccacgtgacaaaagccatgatatacatatgacaacgcctgccatattgtccctgcggcaaaacccaacacgaaaagcacacagcaaagacaaagaggcccgccatgttttacactgcggcaagaccttcagccgccatcttttcctgtgtgaccgcacatgtccaccaccatgctaaccacttaacaaagcctcgcccatcatgatgtggccttcccgccacttgaacactgcgacagaactggatccgccattttggacaacctaacaaagcacagcccgccatgctgagcaatgccgcaatgtcaaaatcgccattttaagccctgcaccttagtctttcctaaccttccatttttaactagtcccttgtactgataaaagatgattcttactgcctcccgatacaacaatcacgcaaagctcctaacaagccccaaatcaattcattcagataggtttagctcatgcaatgcacatgacttcctctgcctgacctgctatcatccatcttgcctccctagtttaacttagcacaaacgactagccctaagccgagttatgcggcaagtctaaaatggcggccacttttcctccacaatctgaacacgcccttagcttaactgcagagtcattctctgccaaagcggtaggtacactcacacaccaccaaatgatcagcagcaaaaaaaagtgtagatattccagagagtgcaacaacccacaaaaccaacattttttcatccataaaaagcaccgatgggcgatgaaaaaaaaaaatcaaagcaggtatccgcggccccgatgggccagaaaaacaaaaattaaagcaggtatccgaggccccgatgggcaaggaaaaataaaaaaaaaaaaagcaggtatccgaagccccgatgggccaaaaaaagaaaatttttaaaaagcagatatccgtcaccccgatgggccagagtgttgggggttcagaggggaagggaatcagcaggtatccgataccccgatgggctaaggaaaaaaaaataaaaagcaggtatccgcggccccgatgggcgaataaaaaagaattaaaaggcaggtatccacggccccgttgggcaaagaaaaaataataaaaccaggtatccgcagccccgatgggcaaaatatagaaaagagagtggaagagtaaaaaactgatccacaaaaaacagagatgtcaaccaaaaatgattccaaagaaaaattccttaaatattaaaaattgcctcaaaatattccaaatactttctttaaaaaaatatggaggacgtgtcaagaagacactaggagaaagtatagaatttaaaaaaatattttatggaatttaggtgatttttttaaagaaatacgccataaagggtgttgggggactagaaaatgttctagaaagaaccccaagtgcagagagatcttcagtcaggaagcttccagccccgagagagtaagaaatatggctgcagcagcgaattgcagcgctttaagaactgaagggggggctgagggcggagagagcataagaggcgtggcctagaagattgaaagccggacatctttgtgatttggttggttcaaaatttacccagtaaggacaaaaaagggaaatttcaagaaagcaaagacataccagaaagaacattaactggaagtagacttcatttctagaccaggagtcacaacttcaatgggttttccagttctcatctataacatggggacattgagtaaatcaagcaataattaatgctaaaatcctccataaactgcataataaatgtaaagatgttaattcagcttggttttgagaatgggggaagggataggtagagctttgatgtgttgataaagtatccaaatatatcattcaaaccagaatttgtaactcctccaccaaacttttgaaccaaagaagctagaaaggagtaatacattgaggttagtaccatcttcaagggacttcccattccattatcccatgtaatagataatggaatatgtattgcatagataataataaaggattattcctgttttatacattaaaatagagtcctatagaggttacatcatgtgcccgaggtcacacaccatgattcagagtcaatgtagtttttactccaacactctaccttgtatggctcccaaccataagagaacggaagtgcttacgagtcaattggtgagcaagagagaaaaaggaaagaaagacatttcatagaatggctatttggttcctaaataatcaagaaagagtactgtttgtgacctgtttgtaattttttaactatgactccttaatctttactattttcctatttcctccatgaatctgaggaacccaacattggaccaaccatatgacacagtagtgaagttgaccctctgtcagtaactgataagtggtaggaagaaaaagctcatataaaagccaaagc

SEQ ID NO: 356 - DNA, 29211 bp, Homo sapiens
caaaatacctgtcaggcattttgggattacagtgcccagccccgtccctcatcaaagtaactgctccgtgagctgttgtgaagccaagctgagtgggaatgaggttgccacagctctacactgggcgctacacagcccctggctgacctcagaccctgtccagatctcctcaaactccagccccttggagccccctggtgttgggaacaagaccccccaaatctggccataaactggccccaaaactggccataaacaaaatctctgcagcactgtgacatgttcatcatggccataatgcccacactggaaggttgtgggtttactggaatgagggcaaggaacacctgacccacccaaggcagaaaaccgcttaaaggcattcttaagccacaaacaatagcatgagcaataactgctgcagttaactagcccaacctatcctttaattcggcccatccctttgtttcccataagggatacttttagttaatttaatatcctatagaaacaatgctaatgactggcttgctgttaataaatatgtgggtaaatctctgtttggggctctcagctctgaaggctgtgagacccctgatttcccacttcacacctctatatttctgtgtgtgtgtgtgtctttaattcctctagagccactgggttagggtctccccagacgagctggtctcggcacctgggtagcccaaacttctcttgctgtgtgaaaggaagggctgttccctccccaagcccacagtggtcctcacccaccttgggggtttgggccacctgagagtgcctgcccagggcctgggtctccatgaacttctgtgtctctgtctctgtaggtgcttgtttctgtgactgaggttggggattcctaaaaaagaaataagacccccccatctctttctggcttcttttttatttcttagagacaaggtctctctctctgccacctagggtggagtgcagtggcacaatcatagctcactggagcctcaaactcctaggctcaagtgatcctcccacctaagcctctcaagtagctgggactacagatgcacatcaccacacctgctaatttttttaagttttttgtgcagatggggtttcactgtgttgcccaggctgttctcaaactcctggcctcaagccatcctcctgccttggtcggtcaaagcactgggattataggcatgagccacctcatatggccttctgtctccttctttaacagccagcagttggtgcatataattagtcctcaattcttcctcaaagaaaacaagtttgaagctcagcccagttgccccagcctgcacccaaagaaaatgttacttttcttctcactgcacagccccacataggctcggccaaaggggaacaggatggagtctccccagggagtgtgggctgcctccctgagggagtgctggaaagagagacatgtcctcttcggtaggagatagctggtgagagagcgatcctgggaaccgtcccctggatagttctgtgcagctgacctgaggccagggagccctagcactgtcttctccctcatggcccagagacagggaaaaaaatctgtaagaattagctcagggtaattttttcagtccccatttaccttctgagccaggtaaccttatgcaatgcacaacgtgcccaactgtatatggcagaaacttacatcctcgcgcttccataggaagtaagatctcagactgtaaagaagactgcgaccaggcaggtgtccacttgtccacccttgctctctggggccatcaggggaaggtggtggtcaatgttcctgtgaaaaaatactgcttactcctgtcagtggacccacaattcccttgttgctccttccagagcagctgcttctgggcctgatggtgtctacagagcagtttcaggaaacctgtgtcctccctttccactgcctggcacgtcccagccaacatggctgactacccacctgtgctcagcattgtctcctggcaactgtccttattacctaactccagcttcaatgtctcttcctatttctcaaatcaggaacacttctcagtgatacctattttcctcccaaactgtggtctctgactgagtccctggtctccaccacagacttgatgacactcttacatatggctaaatatggcgtcctcaaacacgcatgctaaactaaaaacaccacttctaaaaatttatctgaagaaattctggcacaagtgcaaagatgtatgtttaaggagggttatgggagaattcgtttgtggtagtgaaaaacctctgaagactccagatgcctattaatagggaaatggcttaatactttatgggtcactcaagctatgcacttccatgcagctgataaaaagctttccaagacgtttaaagggctggaggttgggagggttggaaaacaatacgaacagtcagagcccttataggttttaagaaaatagaggactacatgcagctaaatgcatagacctggaaaagccaagggccaataagcatttgggtggatgctcaagatcattggtaatttccagagatgtggaaattagagcaacaaaatatcccttgatgcctagctgactggcaaaaactcaagagtgggaaaataccaagttgacagtggaggggatgtgtggatacacaaaactacgtgcacattggtgagtgtagactggagcagccattctggacagcaagctgacaatatttaggcaagttagatgtttctagtgacccagaaactctactcctggtatagatcccaaagatattttcccacagatgcttagggaaacctgtacaaggaagtttgttgtggctttttttttttgaacagggttttgctctgtcgcccaggctggagtgcaatggcaccatcttggctcactgcaagctccacctcctgggctcaagtgattctcctgcctctgcctcctgagtagccaggactacaggcacataccaccacacctggctaatttttgtattttttgtagagatggggtttcaccatgttgcccaggctggtctcaaactcctgaactcaggtgattcacctgcttcggcctcccaaagtactgggattacaggcatgggccaccatgcccagcctgttatggcattatttgaggaggcaggggagttattggaaccacctagatatctaatcttgggagagcagagaagtaaaatgaagtggttgcacaccatggagagttatacagccatctgaagcaacagagatggatctttaaaaatataacatggggccaggcgtggtggctcgtgcctgtaatcccagcactttgggaggtcaaggcaggcagatcacttgaggtcaggagttcaagatcagcctggccaacatggtgaaaccccgtcgctactgaaatacataaattagctgggtgtagtgttgcacacctgtagtcccagctacttgggaggctgaggtgagagaattgcttgaacccaagtggcagaggttgcagtgagctgagattgcaccactgcactccagtctgggtgacagagcaagactccatcaaaaaaaaaaaaaaaaaatggccgaataggaagagctacagtctgtagctcccagcatgatcgacacagaagatgggtgatttctgcatttccaagtgaggtacctggtacatctcattgggactggttggacagtgggtatagcactcggagggcgagctgaagcagggcggctcacccaggaagcgcgaggggtcgggggatttccctttcctagccaagggaagccatgacaaactacctggaaaaacgggacactctcacccaaatactgtgcttttcccaaggtcttagcaactggcagatgaggtgattctctcccgtgcctggcttggcagatcccatgcccacggagtcttgctcactgctagcgtgcagtctgagatccatctgcgaggtggcagcctggctgggggaggtgcatgcaccattgctgaggcttgagtaggtgaacaaagcggtcaggaagctcaaacttggtggagaccactgcagctcgacaaggcctactgcttctagaccccacctgcatggacagggcatagctgaacaaaaggcagcagacaacttctgcagacttaaatgtccctgtctgacagctctgaagagagcagtagttctcccagcacggcgcttgaactctgagaatggacagactgcctcctcaagtgggtccctgacccccgtgtagcctaactgggagacacctcgcagtagggaccaacacgcacctcatataggcagctgcctctctaggacaaagcttccagaggaaggatcaggcagcaatatttgctgttctgcaatattcactgttctggagcctccgctggtgatacccaggcaaacagggtctgcagtggaactccagcaaactccaacagacctgcagctgagggacctgactgctagaaggaaaactaacaaacagaaaggaatagcatcaacatcaacaaaaaggtcatctacaccaaaaccccatctctaggtcaccaacatcaaagaccaaaggtagataaaacaacaaagatggggagaaaccagagcagaaaagctgaaaattctaaaaatcagagtgcctcttctcctctaaagaattgcagttccttgccagcaacagaggcaaagctggatggagaatgactttgacaagttgacagaagtaggcttcagaaggtctgtaataacaaacttctccgagataaaggaggatgttcgaacccattgcaaggaagctaaaaaccttgaaaaaagattagacgaatggctaactagaataaacagtgtagagaagaccataatagcctgatggagctgaaaaccatggcacaagaactttgtgatgcatgcacaagtttcaatagctgattcaatcaagtggaagaaaggatatcagtgattgaagatcaaattaattaaataaagcaagaagagaagtttagagtaaaaaggtaaaaagaaacaaacaaagcctccaagaaatatgggtctatgtgaaaagaccaaatctacatttgattggtgtacctgaaagtgatgaggagaatggaaccaagttggaaaacactcttcaggatattatccaggagaacatccccaacttagcaaggcagaccaacattcaaattcaggaaatacacagaacaccaaaaagatactcctcaagaagagcaaccccaagacacataattgtcagattcaccaaggttgaaatgaaggaaaaagtgttaagggcagccagagaggaaggtcgagttacccagaaagggaagcccatcagactaacagcagatctctcagcaaaaaccttacaagccagaagagagtgggggccaatattcaacattattaaagaaaagaattttcaaccagaatttcatatccagccaaactaagcttcataagtgaaggagaaataaaatcctttacagacaagcaaatgctgagagattttgtcaccaccagacctgccttacgagagctcctgaaggaagcactaagcatggaaaggaacaactggtaccagccactgcaacaacatgccaaattgtaaagaccatcaatgctaggaagaaactgaatcaactaacaggcaaaataaccagctaacatcataaagacaggatcaaattcacacataacaatattgaccttaaaagtaaatgggctaaatgccccagttaaaggacacagactggcaaattggacaaagagtcaagacccatcagtgtgctgtattcaagagacccagctcacatgcagagacatacataggctcaaaataaagggatgggggaagatccaccaagcaaatgtaaagcaaaagaaaaaaaaaaaaaagcaggggttgcaatcctagtctctgataaaacagattttaaaccaacagagatcaaaagagacaaagaaggtcattacataatggtaaagggatcaattcaactggaagagttaactatcctaaatatatatgcagccaatacaggagcacccagattcataaagcaagtccttagagacctacaaagagacttagactcccacacaataataacaggagactttaacacccaactgtcaatattagacagatcagtgacacagaaggttaacaaggatatccaggacctgaactcagctctgcaccaggcagacctaatagacatctacagagctctccaccccaaatcaacagaatatacatttttctcagcaccacatcacacttattctaaaattgaccacataattggaagtaaaacactcatcagcaaacgtaaaagaacagaaatcacaacaaactgtttctcagaccacagtgcaatcaaattagaactcaggattcagaaactcactcaaaactgcacaactacttggaaactgaacaacttgttgcagaatgactaatgcataaataacgaaatgaaagcagaaataaagatgttctttgaaaccaatgagaacaatgacacaacgtaccagaatctctgggacacatttaaagcagtgtgtagagggaaatttatagcactaaatgcccacaagagaaagcaggaaagttcaaaaatcaacaccctagcaacacaactaaaagaactagagaagcaagagcaaacaaattcaaaagctagcagaaggcaagaaataactaagatcagagcagaactgaaagagatagagagacaaaaaacccttaagaaaatcaataaatccaggagctggtttcttgaaaagatcaacaaaattgatagaccactagcaagactaacaagaaaagagagaagaatcaaatagatgcagtaaaaaatgataaaggggatatcaccaccaatcccacagaaatacaaactaccatcagagaatactataaacacctctgtgcaaataaactaggaaatctagaagaaatggataaattcctgcacacatacaccctcccaagactaaaccaggaagaagttgaatctctgaacagaccaataacaggctctgaaactgaggcaataattaatagcccaccaccccaaaatagtccaggaccagatggattcacagccgaattctaacagtggtacaaagaggagctggtaccattccttctgaaattattccaatcaatagagaaagagggaatcctccctaactcattttatgaggccaacatcatcctgataccaaagcctggcagagacacaacaaaaaaagagaattttagaccaatatccctgatgaacatcaatgcgaaaatcctcaagaaaatactggcaaaccgaatccagcagcacatcaaaaagcttatccaccatgatcaagtcagcttcgtccctgggatgcaaggctggttcaacatatgcaaatcaataaatgtagcaaggctggttcaacgtatgcaaattaatgaacataatccgtcacataaacagaaccaatgacaaaaaccacttgattatctcaatagatgcagaaaggcctttgacaaaattcaacagtgcttcatgctaaaaactctcaataaactagatgttgatggaacatatctcaaaataataagagctatttatgacaaactcacagccaatatcatactgaatgggcaaaaactggaagcattccctttgaaaacaggcacaagacaaggatgccctctctcaccacccctattcaacatagtgttggaagttctggccagggcaattaggcaagagaaagaaataaagggtattcaattaggagaagaggaagtcaaattgtccctgtttgcagatgacatgattgtatatttagaaaactccatcatctcagcccaaaatctccttaagctgataaacaacttcaccaaagtctcaggatacaaaatcaatgtgcaaaaaccacaggcattcctctacaccattaacagacaaacagagagccaaatcatgagtgaactcccattcacaattgctgcaaagagaataaaattcctaggaatccaacttacaagggatgtgaaggacctcttcaaggagaactacaaaccacagctcaatgaaataaaagaggacacaaacaaatgaaagaatattccatgctaatggataggaagaatcaatatcatgaaaatggccatactacccaaagtaattcatagattcaatgccatccccatgaagctacaaatgactttcttcagggaattggaaaaaactgctttaaagttcttatggaaccaaaaaagagcctgcattgacaagacaatcctaagcaaaaagaacaaagctggaggcatcatgctacctgactttaaactgcactacaagcctacagtaaccaaaacagcacggtactggtaccaaaacagacatatagaccaatggaacagaacagagcccttagaaataacaccacacatctacaactatttgatctttgacaaaaacaagaaatggggaaaggattccctatttaataaatggtgctgggaaaacaggttagccatatgtagaaagctgaaactggatcccttccttacaccttacacaaaaattaactcaagatggagtaaagacttaaatgttagacttaaaatcataaacaccctagaagaaaacctaggcaataccattcaggacataggcatgggcaaggacttcatgactaaaacaccaaaagcaatggcaacaaaagccaaaatagacaaatgggatctgattaaactaaagagcttctgcacagcaaaagaaactaccatcagagtgaacagccaacctacagaatgggagaaaatttttgcaatctacccatctgacaaagggctaatatccagaatctacaaagaactcaaacaaatttacaagaaaaaaacaaacaatcccatcaaaaagtgggcaaaggacatgaacagacacttctcaaaagaagacatctatgcaaccaacagacacatgaaaaaatgctcgtcatcactggtcattagagaaatgcaaatcaaaaccacaatgagataccatctcatgccagttagaatggcaatcattaaaaagtcaggaaacaacagatgctggagaggatgtggagaaataggaatgcttttatactgttggtgggagtgtaaattagttcaaccattgtggaagacagtgtggcaattcctcaaggatctagaactagagttaccatttgacccagcgatcccattactgagtatatacccaaaggattataaatcatgctgctataaagacacatgcacacgtatgtttattgcaacactattcaacagcaaagacttggaaccaacccaaatgtccatcaatgatagactggattaagaaaatgtggcacatatacaccacagaatactatgcagccataaaaaaaggatgagttcatgtcctttgcagggacatggatgaagctggaaaccatcattctcagcaaactatcacaaggacagaaaaccaaacactgcattttctcactcataggtgggaattgaacaacgagatcacttggacacagggtggggaacatcacacaccggggcctctcagggggtggggggttggggaagggatagcattagaagaaatacctaatgtaaatgatgagttgatgggtgcagcaaaccaacatggtacatgtatacctatgtatcaaacctgcatgttatgcatatgtacctagaacttaaagtataaaaaagaaaaaagaagtgaagcctgaagatgcgactgaattgctgcaatctcatgataaaacttgaatgaatgaggagttgcttcttatggttgagcaaagaaagtggtttcttgagatggaatctacttccagtgaagatgttgtgaacattatttgcaatggcaacaaagggtttagaatattacatacacttagttgataaagcagcagcagagtttgagaaaactgattccaattttgaaagaagttctatcgtgggtaaaatgctgtcaaacagcatctcatgctacagagaaatctctcataaaaaaaagagtcaattgatgtggcaaaaaaaatacaattttttatatatatatatagttgctcttcccttcctgaaaatgtcatccaaaagccattaggtagggccaagcaaggtaagcatccccataagggagagtgtctgccatggtgaatccgcatgggtgtgttgggatccaagcagggagacatccacacagtgtcagcatcagatacctcagccacagtggggtgagcagagtctcctcagtgggggtggggcacagagaggcaatgcagccacaggaaactcgttacacaccaggaaactgatcaaatatacatactgaggaaaataggagacagatttctcactgttcgagaaggtagcataaatacagaaaagaagaaaactagaaaaagctcttccagcctgggcaatataggaggactctgtctctacaaaaaatgggaaattaactgggcatggtggtgcacaccagtagtcctggctcctcaggaggctgaggtgagaggatcacttgagcccaggatttcgaggctgcagagagctatgattgcaccactgcactccaacctgtgcaactagaggactctaccttaaaaatataaataataaataataaaactcaataatataaaaacaaataacccaatgtgaaaaagagcaaaggacataaatagatatttctttacagaagatatacaaatggccaagaaacacatgaaaagatagacaacatcattagtcatcagggaaatgcaaataagaaccacattgaaatacaaagtcacatccactaggatggctataattgaaaaaacagacaataacaagtgttgccaaggatgtggaacaattggaattcttattcattgctaggggaaaatgtaaaatgggacagccactttggaagacagtgcggtaggtcctcaaaaatttaaagatagaattagttgtttgacctagcaattccactcctaggtatgtacccaagagatatgaaaatatatggccaccgaaaacttctccaagaacattcacagcaggatgtattcataatagctaaacagtggaaacaacccaaatgtccatcaactgacgaatagataaactgtggtatgtccatacaatggaattattcatccattaaaaatgaagtactgatttatgctacaatacggatgaaccttgaaaacattatggtaagggaaagaagtcagtcacaaaagaccatatattgaacaattccatttatatgatatgttcagaataggcaaatctatagagacacaatgtagatagttacctagggctggcagggatgggagaattgggaggtgaaagctaacaggaatgggatttcttttggggatgatgaaaatgttctaaaattgattataggagtggttgtacaactctgtgaatatacatattaaaaaacattacacagtgtattttaaataggtgaagtgtatgatacatgaatgatatctcaataaagctattacccccaaaaaaggacatttgggacaattcacaaattaaataaataatatagtaacaaaatatagcctattgaatacattaggaatccatttgttgatattgatctaaacaatgcacaaagagcttgatgaggggcaggatatatagatagtctaaaagttcctccctgcaaaatacttattaaatgcaaagggaaaaataaccttacagggagaaacttaattctcactcaaatgatcaaagttaacatcaccagtacaggatatatcaaaatcatgtaccatctgataggacacaatgagaagaattcaatatcacttctgtgatattcctgccaaagatgcatagtctgaattgaattgtgaggaaacatgagataaatccacaccgaggggctttctacataataactggccgtgaaagtcaaagactggaactaactgtcacagattgaaggagactaaagagacgtgacaactgactgcaatacatctttactgcatccttttgataataaaggacatttgcagaaccattgacaagggggtctgaggagtcaattgtgatagcattaattttctaattttgatgattgcattgcgatttcaagggagaatgtccttgtttgttagaaatacaaaataaagcattatgtcagcaacttgagttcaaacaggtaagtggaggagggggtttctttgtaatgctcttgacaatttctctgtaagtttcagactgttcaaaataaaacaaggaactccaatatatacaatctaactaactggtccatattcttcaaaaatatctgttacaaacatacacaaaaaaagctgataaactgtttccaggtaaaggaggctaacaagaacttaaaaactaaatgcaatgggtaatattgaattaaatctgggaccagaaaaaaataataatattataaaggatattattgggacaattgatgaaatttgaataagatctgaagattatatatcaatgttaagattcctaattttaatcactgcaatgtggcatgtaggtgatggccctcaggaaatgcacgcgaaagtatttaatagtaaaacggcatggtgtctgcaacttatcctcaaatgcttccataaaaataattttaaaagagaatgataatgcaattgcagcttaaagacaatactagagttttgtaatattcttgcaactttcccataaatttgaaattgtttttaacaattttaaataatatttaaaatgaaatataaaactcaataccatgtacatacaataaaaacgcacaccaaaaaaaagagcttattttgtgagaatatatgacaacaaagactaacagcaaatacaacccagtggtttggaggagggggttgtgaaattcagggaggagaatgtgagtgcgtgagtgctcagtctaaaaagattaaacacacaattttttttttaaacggagcttcactcttttcgcccaagctggagcgcaatggtgcgatctcggctcactgcaacgtccgcctcccgggttcaagcgattctccagcctcagcctccggagtagctgggattacaggcgctagccaccacgcccagctaatttttgtatttttagtagaaacggggtttcaccatgttggccaggctggtgatctcctgacctcaggtgatcggcccacctcggcccacctcggcctcccaaagtgctgggattacaggcatgagccaccgtgcccggcctaaatacactatttttaaaacagactagggaggggagctgccgaaacaatccccaaacttctcacttcacacttctgaggaatgagatggggtagaagtagggacaagcatgaagggaggtgtcatgttttatctttatcttttggcactgtttgaacttttattatataaaatacaaccacataaacaaatatgtaattttttaatacagacaaaaaaatgatggaacatctatataatgttaccaagacagctgctaggaatgagatagagctacttccattaacatgtaagaaaactatgacctatttttttaaggcaatttgcagagtggcagggaatataaatcattgttgcaaaaaacatctaaatagttcacatatgcaacgtagtaactataagccatgctacttctgcacagaggattaaggaaggacttgtagacacttgtctgattattttatgagtttgtgttcacttataatctttaaattaatcttatgtgaatatattcttattaaaaaatcaaataatatatgtattgcttttatgatttaaaatacatattactgtggtttagagaagaaattgtttcttaaaggacaattcctatttctttcttcagcctcaagagtcagaaagcaagacaattagtatttttaaataaggaaatgtaaactagttttcagtaaaacataatttacaacaataatgattatgtaatcatgcctctattaatacagcaaccgtttaaaataatgcaaatgcacaataaccaggctgtctgtttccaatttccttggactggatggcgagaatcccactttcctggacttttccacccacatttatgatccctcgcagcgtataaccactacgtacctctccaaacccaacaaactttgcagcctgcgcagacaaaggtttctatgtttctctctccatttctacttggcaaacccctgcctggggctgtactcgggagtcaccttcacttccttgctaagtcaggtgaagccttacctgactttctccaggctggggaaagaacccccacacccctcacccactccccggctcccattgcctcttctttcctctccctaccgtgctgcccactttgcgcggtaatttttgctccaagggcctgcctcccagaggcttggggtgcagggaaagtgctctaagggtgggactgatttagtctggacattcctgaccggtagcaccacgcccataatgacccgaaaataaatgcctgcgtaaattgctttgggaagcggttgggcaatttattaagagtagtgaaaatgtccccttcctgctgaaacagtaagaatcttgaagaaataatcctccccaaaggagaaaactatatacacgaagattttaggttgtgtattattttcatacagaaaaactggacacggaagaatatcaagtaattgaacggttaagtaaattacacagtaacataatagagcattactcggccattgaaaagtatacttatgaggatcatagcacatagcaaatactgaagtgtggcctcaagtagaaaagactgaatacaaaactacatgttcaccaggactaacattatgcaaaataaagatgcacatttaaaaaaaaaaaaaaaaaagactgagtcttttaggggtagcacggggatatttttcctgctttcaattctattattgctgttctagccatgcgaacagtgcacagaggttggaagtggcgtcaagaggagtcttaccattgtgtatatgactgtaaaactgagaaaaagaaggtaatatcagcctggggaatgcatttctaatggcgggacttcctgcaccttgacctgccagtcggggttgtggcccggcagtggcattcccagggggtctcagaacaaaacgacggccacagagtccacctggacaaaagggcagggaaggggcccctcgcccttgacccttgggctctgctccggccaccctgagccgaaggctgtttgggtgaatgcgtggggtttctccggcgatcgatccctttggactggcttccccactagcaacctgcgcgtccccaccagaaccagccggctggccgagcgaaagcccggtttcgggagaccttgcggggagagcagctggccctcgcccaccgggccgcgctttgtctagggcgcgagtccgcccgtttccggccccgcccctcgccctggtcccagtccgcccctccccctacccggcttccgcgtctccgctcccgcgctgccggcttccgcggcttcccccacttctcagcctgcttctctctcccctctccttcctttcctgtcctttcacactcgcgccccagcccccgtcaccatctaccccaaggacttgcaaacttcgcccctgaggagcggactcttcggttctccgtggaaaatcaaccagacccaaaacagaggtcccgggtttggggataccacgccgcgcgcctgagcatccgggctccatttctccaggcgacatctgcgggaagggagacctaaaggccaaggctggggacgagaggcaggtgcctggagtagtggacggtggaaatggcgacggcggcctgcacccagcgatcccgaaagtgcccatgtatccgtccatctgggtttttttttttcttagatcatccaccaaggccggggtttccgagtgaggcgcccacttcgcatcccacagtaccgccaggtgtgtttcccatgagctctttaagagagaacccaagagctctttaagagagaacccaaataatgtgtgaataccttctccaataacttcaagtcagaggctcagacacacacacacacacacacacacacacccctaaaacatatttatttcgtggaagagcgtgtatccctcggctgtccttccagctctcccttggtgcgtgtgcaggacgcacagaagggtggagtgtgggttgcgattatttttacacagaaggtgtcacactctgggatctgttccgcagggaggccacaggtgccaggagacgcgggagagactggctcctgccaagaacatttctttgcattgttcagtgcggttttttatttttatttttgactgtttgtttgcctaagagatgacttcccttgccagaaaaaaaaaagtgttgtaaaaataaaaggaaacgggattacgatgtaaaagacgaatagataaacccggttccgcagatctgcggcgcgcgcgcctggcgacctcggatacattcattgaagttgccgcgcactcgtacccgggttcacctcgcccctcgctcattcctcccgaccaaggcccatggtcagaggtgtcctcgccccgcggccgtcagagggcgcggcctacactcgaatgccggccgagccctccacgcgctcggaacttgggcttcccggtgcagcctccccgcgatcgcaatgcccgctgcctttcccgagcccagtccggaacccgcctctctcggggaccttgacctcgcgcggacctcgtcgccttgcttagctctccctgacctgcttttgaacccgctaatcccgtcccgaactctcgccccgcggcaatccctcgccccggccctggcgcgctaattcccgctgaccccgccgccccgccgcctctctccgctcgcgcggctgtgaccaggataagggcttcccgcctctgagtgcaggtgtgatctggagctcaggcaactactgcccccgcattgtccccagcccgcgctcgcacccccaggacccaagcaaagcgtctcttgcctcaaacattctgcccttctcttgcttcctcttgtttccctagcataattcatgtctttctttaagaaacccatcggacccacaaagatcaaaatcttcggtaacacaccaaactggcgacgctgtggggaagcaagcactctcccaagtggctggcgcgcagtgagggcgcaggaaaggtaagcaggagacccgccgctaggagccagagccaggccggcgaggcgggcaggcaggaagaaccgcggacagggcgacttgatctcatttttaaaaccggagagtgagatgggacgagagcttgagcttctagggatggggctgagattctggagagacacctggtagtcatttcttaatcttttgtgctgcttagaattttttcttagatgcatgttttccttttaaaagaaaaagaaaaaaaagaaaaggcagagcggggtggctcacacctgtaatcccaacagtttaggagaccaaggagggagaagccctagcggccaggagttccagatcagcctgggcaacataacgagaccctcgtctctgcaaaaaaataaaaaataaaaaattaggcgagtgtggtggtgcctgcctgttgtcctagctactcaggaggttgaggcaggaggatagcttgtgcttaggagtagaaggttgtagtgagccgtgatcgtgtcactgcaaccagcatgggcgacagagtgagaccttgtctcttaaaaaaaaaatagtaaaagtcattattttaaaagttgatgaaattagttcacactacacacatttacaaacacaggtcacacacacacacaaacacctccaaggcaagggtctgcacatttgtttggggttgttttgttttgttttgtaagcaaactgaacccaacacaaagcactgtactccccttcttggtgtttattacaggaccatggaggcttagtaaaaagcatttatttaaggggagttattttcagaggctgttttctagccaggaaaaaaaaaaatcggatacttagacttatcccctggtatgtgcaacatgtaaacaaccaggtagcatgcttctcccacccccaaagatcaaactccagggttccagccttggccctgtatcagtctgactgcccctggaaggttggccatctccagtgatataggctacatgaccgactattcgagtctgtttggctcacagctgtcccctagtgcctggcatattttaggaactcaataaacatttgttagatgacaaatatttcaaagaatgtgcaacagctcctggagaactgtttccagtagatataaattcctagcagcatcttggggtaagaggacgggcccccgaggctgccacctctagagggccttggatagtggccagtgccttcccacacaggcccaacagtcacccaaaacaggctgtcattcagctcctcacccttgcattttgaaagtcctctcccagggtcaagagatagagaattcctctagcctggtcccacccaggccagtggctcctagagactcagtccctaggtaacccctcctattcaccatggacaataggccactcagcagacaggccttggatgcttgttgggacccacctgagcccgagagcagagcttctggctcacatggtgaaggggaaaccagagagagggtgacctaggaagaggtgccagagatgcctggctcctgattgccaaggtcagtctggaacccgcttgcaggtgacacagatcactgatcgcaaatgattattgcttgaggcaacagggccctaaacctgagggtttcctagcactggggacatgggagacaggtggttagtgaccttgaatgtacagtgttctggcttgcacagaaggcatggcaaagacaaaaaggacaaaaagatgaaaaggagacctgcctactttgtagtgactagtggcaaagacgaaaagaagacctgcctaagtggtaagtcactgtaggcaacctctctgaggcacagtcaggaaggaaaggtgagccactgcccttgatggaaacacagaaacgaaatgcttcaaatccattctaacaatgacatttaaatttgtgttttactggatttgtttgacttttaacacaccacaaattcaaaaggtatcaaaggatataaaggccgcccatgctgacctccaggcccctccccaaagacagtccagagagcagtcccagtgatccaaactgcaccctgagctttccaggagcatcacgtgggaaatgcctgggaaatgatgcctgccccctcccgtgtctcccccgcgacacacaaacacacacacacacacacactcacacacagcctttgcaatctccgtttgcctctttgccagaggactcagatctttcttgggctcgagttgctgttccttccctgaattgttcttccctgggcctcaggaaaggctgatgaataggctggggttctcaggttgggaaaaatgcaggatctggctttgggtatgagactggaatgataaactcagaatgctccccagggtctgtgccagggccgagttggatgaagacagggctccagcctgggcctcacagcacactgtcctctgagcccaatggccacttttgggaaaaagagggttgagccaacctgggaggagaattgctgtcctcagccttggcagccagttgcatttctcctgcacccaccacctgggacaggcactaaggtagtcagtgtggagggccctggaatctgggttcacaacccgcatgctggacagtctcccgctgctccccttgggcatggctaacctcctcatttcttcattcaccctggcaggaggaggagagggagcaattagggctacagtgtgttcttggctctaagccttaaatgatacaagcttaaatctttccttcagcacccacagagtgccaggtaaagtgcactgggttaagtgctctgaatatattaatttactcctcttaacatttccagaggttgatactaatattactcccacttaatggatgagaacactgaagcctagagaggttcagcagcctgttagcaactagttaagtggtagaaccaggatctgaacccaacctagccaagagccacgactctgaatcattgctccagagactgtattcctataaggctgcagtccaggtggctcctccccattggacaaaaccagaaagaatgcttccagaaggtgactgattagctggggacccatagccatccagtggcatttcccaagccttgccgggctcatctagctgttcccaagaaaactcccccactcttctggtcaagcgctgacctgaaggctgaaaaccagtttgggagtcacagacgtgctcacacaaaaggtagaaataatccaaatttccatcaataatgaatggatagacaaaaagtgagctaatcatacaatgaaatattcttcagtcagaaaaagaaatgaagtactgatacacgctacaacatggatgaaatttgaaacattatgctaataaaagaagctaggcacgaaaaccacagatgatatgattccatttatatgaagtatccaggatagggaaatccatagagacagagagtagattagtggttgcttagggctgggggtttgaggagatagaaggctgggggatcgagatttctttttgaggtgatgaaaatgttctaaaattgacagtagtgatggttgcacatatctgtaaatacacgaaaaaccattgaattatacactttaaatgggtgaattttatgatatgtgaattacatctcaataaagctattaccaaaacacaaaatcaacacaacatacacacatagttctagaacttaaggccaccacccagtcaaggtagatccaggctctgccctgcaagtgtccatgtccttgcagtccaagtttccttcagtctctgtagaggccgcagctcccctgcagtgaatgatactgcccctcaattcaaaaggcccctcctgggctgtgccaggagcctgaatccagcctaccgagaacctcttagactgggagagagctcccttcacagagtgaaattggagggaggggaagagatttttgccttggcagggcccttggggtcccacacaaaccagctatatgaccttggtctcagtatcctcttctgcaaattgaaacaactgagcccccgtcctaaatagtcttgtgagtatttcattaaattatgagtctagcacagcttccggcactagccagtgtattccatgttagaaaacagatgaaggattgagtgaatttaggggatgacatagataaaatcagagtggtaggagtaaagggatttaatttgttaagaaagaagaaaaagttttagaagattgtctcaagtctcttgcatctcttttgttcattccaactctgcacccagtgggattgtaattgtccgaaatggacaagtgaaagagggcactcctggagaaggcagaaaagaagaggggaaattaagaagcaagaagagggagatggaggaaggagagagtgttggtggggaggttaccagggaaactgcctcaaagactcaagggacaggaaggacagaactgcccagggaaggggtggctgaggggagggagaaaggctaaagaaaagaaggagaagcggaggcaaagggagggggaggtggccaaatcatcaggtgagaggggaggaggaggaagagtcacagagaactactggggagaagaaggaagaagccagctagtctgggatcaatctggagacgagaagattaccaagtcaggagtccaaaagccccccttccagaacctggggacactggtctccactggctgccgactgggacctctctccctattctggcccagccatcctctccctgcccttgggcagccctggagaatcctgagtcctgtggatggagaggcttttcagattaagctggacacctggaggttgggtccagtcgtgtcctgcccgggtctgttcaaccatccccgaatgaacctcctccccgcaaaacttctcccatctcccagactccaccacccctggcttgcctcctcctccctgaccccacctaaagtcctgaccatttctcatttcctgaaccagagcatgctgatcaccactggcctttgctccagcaaagtgccagcttccccagccctcaggtggttcctaaccaggcttcacctggaaggcttttaaatatatggatggccactaggaaccactaaggagccatttggtcttcagctgagcaccagtcattttaagttgtctgggtgatttaatatgtggcaagtgttgagaactccagtttgcctccttccttaagcttcctgaccctggaccaaggccacagccaaggcagtactgcctgatatatatttgcctggttaggtacctaaaggatctcctcaggtctggcatgttagcagtggtcactccggtgtggccttctttacagcccagcctagacccacagcctccctggtggaagccctcctgggtaggccctggggctcagcagatcaggaaagttgccagcaccttgcatcgggcctggcacacaggcagcaaatcttgacgggctctagagctcccaccacttggctggaatccctgctggggcagagaagatggagcaaaggggcgcaaaccaggtaagtgctgccttagggggctccctgctgtgccctagaggtgtcttaggggaaactaggtccagaaacccacactgaggtggcagagggaaggattcagcagcagctgaagctactgtcctgcagcccagagcacacaaggccaactgaagaccctgtgggcctaggccagagaaggtaaacgccaggttggataggtggtaggtccagaggtggtgcagtggctggagtctttggcttctcaccctgaaccagtcagattcagcacagcaaacttgggttccctgttccccactaaggggtaacctctcacccatgctcatagagagtgcccctacagcccacgggtccttctcctgcataaaccccagagtgcaacactggcatccagcacagacatgccacgggtcattttgtgttgtctgaaataagcagtgactgagcctgcaggggccagtgatccaggaggggcctacacagtggaatttgaggagctctcccacctctctggacaccccaaggaactgcctgtggtctcactgttggagctacctccttcactttcagtgctgctacttttctcagaaataaatatatttttattattttatgaaaataacaatacttactgtaaaaataccaaaatccaataccatcacatcttaaaatgtcaatccttccctagcagcgggtgggatagcgggtcactcccaaacaggctggtgccgaggtcaggatcccaggcactagaggtggggcacaggcagggggctggagaaggaagcagggtgcagaggctttctgccaactcacttatgctccctgagtggtttctttgaggattgttcctctctgctcatcccaagctcccagctctctttagctgcagaactcccattcctgcatgatggctgagcagaatggcaggcaaagactggatttttggggaggagggcaagtgccactgaggatttcccaagggccttaaggtgggccccaaaaccagcgaggagagaggagggcaggagacccaaaaagaaagttagtggagcagagctgaggaacccaggctgcctgagcctctggggctctgggtctgaaatggctggggggatgcgctagctgagagaggcaacagggtcgtagaggcagaggggtcaaaggggaggacaggaaagaagcaggaggaacccgggaaggcacccgacgcctgcgcaccgccggagagaggccaggccccaggctcagctagaggcaagcgcacccgaaggagccaagctgagcaggacagagtccaggcctggaaagccggcctggagagccggcctggtgcaccggccagagcaccccgagggatacgaaagaagaaagaatgctggacacaggttctgagcacctgaaccggatactgaaggctctgccagccctccagagcgctggcagtgaaggacagaacggctccgcagaaaggtactgggtagtgtctgggggagcctggcctacgaattccacccactcacatacatcccttagctcccctagcacccagcacaggcctcacattgccgaccctagagagggctgctgcgggtcgtggtgttgggggtagggggcaggggagtgtatttatccacaggcaccagggatccagttcctagcaccacgaaggctcgggaggtcagtccctcccgctgagcggccaaaaggcaagaaggcgggtggtgcgggtctggagggtcccgggggaatgaccagaatgggcccacgccccgaaaaggcggcaggaattggagggtggcggaggatgctgagcaaggttgaatccagagaggatggcctctttacccgacttcagccgggctttggagaaaccccaggggattccagttctaaggggagctgggagcaggagtgcccctccctgccgaaggtcttgccattcctcccactgagaatgaaggacctgaaccaccattgccctccccccaccgtctggcatctcccttccaactcccctaggttcagtttctcaatcatcttaccaaaaaagagaggaagtaaagagtcgaaagaaattatctgggctcctggggtattggcgggttgagatcacagtgaggccgcaggtggagactgaaggtgaagaggagagcagcaggcccgggacaggtcccagcttcgaatgaggaatccctgatcccagtgaattcgtgccaggcggactcaccactcctccagctctgcgtccgtcttgcactgggcaggaagtttcctctagacccaggcagggacccaacttacgcacgctttgttctccaacccacgcacatactctgaaggcgcggtaccgcacccctacatcccccagtacaccctcaccatgtgtctgtacccgggcacatgtggcccagccttcctcaccaaggacccgggggacttagcgaggcaagatgtcctctgtctctaggaaggggaggacgccggtgggagcctagtggctcctgcacaaagcgccttcttggtggggaactagaccgcccaggcagcgagctcagggaggctcgggggccgaagcggcctggggttcaagaacctgtgttccagaggctggccaggctcccagctcggcctgaaaggggtctgactagtcagggaagggctcggtgaggagacccagtcctcctctccactcctcctccatacacaccccggcgcctccgtacacagaaaccctggtttccttactccatccccgcatgcacgtgcaccggggctggcgccccactgcccagacctgcccagaagagaaagccaggattcctgagggaggccgaatcttatacctccaagagagaacgtgagaaaggaagaataaagggtgcaggagaaaggagaagactggaacacccaagagtcaacacctagctggcttggagctgggcagtgctccctgcaaggctccccggggcagacagggaagagaaagctgccagaacctccggggtcctggctccgaaggactctatgggaggcttctgacttttcccaggagtgtgctgacacctaggacctcatccatgggccctggaagaggactccgggactaagacccgagttactggtgtggaaagatgccatttgtgaaatgaaaaattaaaacgatgacaacaaacaaagcctggcacggtccagcaagtgctgtttttctgtttttgtctgcacagaaactggggtctcatctgcagcaagcagaaccgctagagctgggggtaggggtgcagtgtccaggcaagccgagtgtttgcttatatttctgtttataatttttgtatactagatgcatcttactcaagtaataaaaataaacttgagagagccagagaggcaaaaaactgaagtgcagagtagaagtggtggttgggtgagagacaagacttttggggagcttggcggatggagagggagagggtctgacctgcatggcagtcattaaggagttcactgccactcccagggcctggccgggaggaacagagtgcagagctcaccgcacatcatgcaacatggattccttcagccgagctcgagctcggttccactggatcacactttccccaggaccctcctgaaacctctttctcactcctccctcctacatacatatacattcctacagccccgtgccccaggcccacaaactctcagcacctacaggtagtccacgctgctctccctctgaaccgtaacttaagccttgggctcaatcccacctttcctgcccccccgcccaaatcactttgtggctgcatttcccttccttccttccttcctttttttctttccttccttccttccttccctccttctttccttcctttcttcccctcttctttcctcccttcccttctttccgttagtattaccagcaagacctcccgacctgccctttttaccctccccttttcctaggttccataccctaagtggagtagttgttaatcactcaattaaataattggtgtgtgtcccccccaacctcaccttctgccgggaacatctggcatcggaaacacacaaccattcacatgcacattggacacacactatgccactgaaacacgcacacactcatacacctgctttcccactcacagggataatggaggctgcaccagggacacactcagccatgctacagccactttcacgggcatatccacgccagctctcacagacacccttaaccagattattggacagaccaaagcaccctgctcacgccagcaggtcagaaaaacgaaggaaagtctgagattgtagtgctttaggggaagggtcacaggccttgttgctcgtgcacacatttgcacacacaccttcgttctcaatctttcgtccaggcccccttctgagtcaaagaaggccccttctggtgcgttgagagagacactaggctcgggagagcgctggcctctccagtaaatggtggggatccgcacgcctcaaagggctgcgccccgggaccccagctgctccgctcctcacagcctgaccctgcttcacttccagccgtgctcacctccgccctttacctctcctcagcctcggagaaggcgggacccgggacagcgacagagcacggagaaagctccgcgggggaaacaaggaaatccccaccttctatccctgtctcgtggtgcggtcccctgtgacggcctcagacctgcggggaacccaggactttgccgcctaccacggtctcagccttattctcgagcctctgggcgcctgcaaccggctgtctgtctgtgtgcctgttcactctcccccggggatgcgggtgagtcggtcttcttgcctcactttgctagccttattcgcccactcttgccttgctcttccaggagggccgggggagggggtcctccggtctgggttcatgagtgtgggtgtgggtataaatctaggggttggcgcactgagcctaggcctgcgcccccgcctccagcacccccaccgaccccaccccgccaagcgcccgagcaaggccaacctcctgttctctgctaggtctctccgaggtcgccttctttgcgcactttggttattgatcctgctgaaccggccggagcgcagcggctgcgcttctctgggaaagaacggagtggggaggtgagtaggctaggggaacggtggaggggaggagaggttgatcaactttaggagggggtgtagggcgttcctcagggccgccccagtctccctctgccgggcttggagcagggctagactaggggtggagcgggaccaccgctcccctccccctctccccctggcgcggagccccggcgcagctgggagtcttggaaacctgactcccgcccaatcagcagggaggggaggagcagcggccaggagcggggcctgaggaggaggagtcgagcgggggcgcgaggggcggggagcggcgctcccggccagcgtaggctggctccgccgtagaggggttggcagtggcggtcagcatgggcgatgggggcgccgagcgcgaccggggccccgcgcgccgggcggagtctggtggcggcggtgggcgctgcggagaccgcagcggagcgggggacttgcgagctgatggcggtggccacagcccaacggaggtggccgggacctcagcctccagtcccgcaggctccagggagagtggagccgacagcgacgggcagcccgggcccggcgaggcagaccactgccgccgcatactggtgcgaggtaaggggacagcccgcggccctgctccactggaccctcaccctacccatactggggcccccgacctagctgcagctgacacctctcaattcatatattcattcattcgtcatccagtcattcattcagcaaatattattttgagcgtctattgtgtgctggacattaagctgagtgcaagggacaaagcagcgaatgggaccgaagcggtccccgtttctccgcctctcgggccagtcccctagttctaggcccattcggaacggctactgtggcgggggcagaaatggagtgcgggatgctgagagcctggactccgtcccgtgaccctcaaggcaagtgcggagaaaagcgtcttgcgcgctccgcggggacaggacgtggagggagcagcgtcggcaaccgcgggaggaaaaggccccggctctgcagggcggccggggtgcttcctcgcctcctgcctagccgcgtttcccgtccccggcaatcgggacccgcacggattgcccaggggagacggcgcgggacgcggagggtggcgtgcgcggcgctagcccgctgtgcttcactctctcggttcccacttcctcgcggcgcctgggcccagccggctctcggcgccgccttcccgcggcctggcctttcacgtccttctcttt

SEQ ID NO: 357 - DNA, 32054 bp, Homo sapiens
caaaacagtatattttattttacaatagcaaccaactccccagtttgtttcaattgtgacatctagatggcttaagattactttctggtggtcacccatgctgaacaatatttttcaatcttccaaacagcaaagactcaaaagagattctgcatttcacatcagttcacaagttcaagagtcttccatttatcttagcttttggaataaattatctttgaggtagaaggacaatgacgaagccacttaattccttgtgtctgcataaaagcagatttattcatcacaacttcatttatgtgaataaagcagatgatgataaaatgttctcttattcttgtttaatcagtagtggtagtgatgccagaaactgtgaaaggaaggcttttagttactttcttctttccattttccaataatccattccccatccccagctgaagaaaggggtgttactgagtccagctgataccacacattgaaaggtaaacattaatatttcaaatctgatgtctaactaaaaatgtacagaatgaaaactagaaaatttcaaccccagattatcttcaaccttgctccctccaccaatcatactttgacatttatctatttccttctccacttatggatgtaattggcttgctatagaaactacagttcagatgctttgaatgtatgaactacaatgaacaataaagtcctcttcttttgaagcatattttggcttcagctttaagataatcttatgacaagaagggtcacactgattcacttaataaattccattcttacctaacacaaggtttagttgataagcacttggacaaaaataatacttttcaaaaatgtaaagcaaactagtgaggacaaaggattttgtcctcatctcaacaatgatcagctattggaactgcatgaaactgaacaatttaaacctggagctggtaatgttcttaagaccaattcagaacaaaggcaggttgcccttaaaacaggtttgaccttttccttcactcttcctcctgtcccaccctctgtgagtgatttaaaaacggaaaaggtcaaagcccagccaggcctacatttagagaaattttaaaaaaatttttcctttcaattttggccaattatttccaatttttattttattcttaaaacttaagcatggtaaaatgttaagctgttttcatccactgatattattctactataaaaagcccttcttgagcagatttgatgataaaaaggagaacatttctaaggtataattagagaagctgttgcatgagaaatcatgtctccatctccattttgctatgcgttatctgaggattgtttctgaaagagatctatttaggcagtgtatgtatgtgtcagcatgtaaaaagtaaagaactgaaaatagacaaaccttgtaaatgcacttcaaaaccaattgtggctcaagtgtaggtggttccccaaggctggtaccaatgagactggggtttgggaattagttggtcatcatccctcctgctgcccagcagtggtcagtcatttttcatgagggatggactaggaaaatgaagtgtctattataaggagagttcctgtaacttaaggagcaagctcactacaaaacccagctacctgcttatcgtagtggccagagtggtagaagagatacggagtaggaattaaaccacacaatgttatttagggactaagccatgcccctaacaagaaaacaagccaaaaggaaagtattaggcattctctgggaaggcatgcatttttttcccatgtctctggggccaaaaaccttataccaagtacctattggcacccgaatatatttgtagaatgaatgaatacatgaaaaaaaataaacagtaacctttctcctatattctactttccaagccaattaataagcaagtgtcttttcgtcatgattttttttgttttctgtttaggatttaacaaaatggttgagataacagtcacttctgtttgatgaagagtatcacttcattccatttttgtgtttttgttgcatctccaagtcagaataaatgccttttggagcagatatatttcatttagcatttagtatcatcttcatcaatactcgtatgaacgaaaaaataaaaagccctctcttattcccactctacaacgcatgtcaaaggtgatctgtttagtttttccttagtatcgaacatatcacagctactcaatgaagtttcttctcaactaaagaaacacagtctcttagagaatttgttcctgtgtttccaccataagataaatgagataaagtgcactttggtttacgtctttcaagcacttaagaacagcactttattcagttttaataaatttttactaaattggtaaatgcaaaagaatcttttttttattgctcatatgtcttcctgtctctaagccagaccaatgagcaaatacctttaaaactagttgttacatcttgaaccatttaactgtaataaaagcagaatgtttagttaatgaattaaagaacaaaccctgagcccttttatcagtctcctggctttaaactaagccaatgaggaagtgatttgggggattcctgaaactaggaaaaatgtctctttattttgaaagaaacttgcatttttctttctttttttttttttttttaatctcaaaggcaattgagtgggtcttctgggccagacctatttaatttacgaaacatagtaccttgcagagaataggcattgaaatattatttaaacaatcaaaccaaagatgttcttctatcttcagctgtcagtgatctaatgccctcatctctcttatcctcaggacccagaatggtatattccacataaaagatgctttgtttatcaaatgaatcaaaaagcacgcctgaggcatttatttttactcctttacttctgtaggccaggtcaaggtgggtctaattcacttttatcatcagcacttaagaaactggatggaagaccacaacaccttgttttttgcaaaaattttccatctcctcaatcaggccaggaagcatgtatcttctggacaggactttatctctctactcagcttagtacactgccttatattagtccatttgtcccatgttttcatcactgaataaacttgttaaatgacttttggtctggatctcacacctatattacttcatttccttctgtgagcactctataatgataacatcatttttatatcctagggcatgtagttccgagccccacagaaagtaatcaccattcagtaagccaatagttcattcctatctgtatagaactgtaggctttgtaaatctacacatagatctctgttgtaggttcaataatgataataaatgtttgtgcccccagttgttatctctaaggataagagtaatcaatgatcattcagcagatatagcttatatatgggtggcagtttacaaattataaattgattttacacatattttcttctgctacccaagacacaataaagatggtttatctttgcatccccaatgcctagcaatgagattggcacacaatagataactactatagtggcattcttcagacaaccaatcccttgcgtatgcgtattcaaaagataatcattgttattcaaattttcctactttatttgcacaatataataactatcatacaattttataaacctagtacccagcaccaagtgagaaaatcaacagttacatttatatggtgccttagagttcacaaaatgctaacataggtattgccttatttttggctgtggctaaatgaaatatgataaattttcagtgcctttaacagtgagttcacatagtaggcaatcaaaattgatctatttaacaggtatttaaacccttggtttgtataactacttatagaacccttctcactgtggtttaactatacaatgagaattttgtagagacaatacctagcttacagaaagttttattcatacagaaagcatcaaatttttcatttacaagtgctttataatttagaaagcacattcgcaagctgaattaagtgactttcggtctggatctcacatctattacttcatttcctcatactagctctttcctggttacctggaaaaatgtatcagtaataatttaacttaacctcaccagtaaagtcttgattgtttaaaattaagcaatatatcattccttacatctgaatagtatagaggataaactttcctcttattacataggagaattaatcttgtattttacagtacccaaaatagctggtatgtaagaggcacttaatattcattcatccattcattcattcataaatatgtagcccattgacatttgtatcatgctttagtttacaaagcactttaatatgcacctttctgaaattttttgttctatgagaatacttttccccctttggtagctctagcacccagcatggtatctggcacattataggtgaccacaacaagcttagtcccttatgttttcagtatattttaaagtttaaaagcagtttccatgtgttttcgtttctgatacctggaatactgcatttttactcaaaattaccagagcagcaaacacaaattggcctcaaatatacatataatttattcatttatcaaacaattccttgtgtctgcatagtactatatccttttgaaagagcacttttttatgcttgctcctttctttgtatccacaacgcttatcacagtagaatacaagtgctttacagtttacaaagcacattcactattttttttcaggtcacctagatatcaataatcattgcatttttagtgcctagcacagggacaggcacagaaaaggaaactagtagtattcagaaattttctctgaataacaaataatacatcagggggtggtaagctatgaacagcaggccaaatccaattggctcaaaaactaagaatgattttgaccttataaaaacgttgtttaaaaaacaaatatgtaacagaaaccatatggcccacagtctaaagtatttatgatttgaccccttacagaaaaactgtggacccctgatttacataatgcttcacaatttacactgcactttcaaatgttaactgcatgattgccaatacactaattggtttttctcttatgttttacagtgctttcatacacattatcagtcatttaaatcaacttcccacataaacaggaagaaaaaaatcaaggaaagtattaaacatgctcaacagtcccaggttctctcatctttaagcctagagatgggtattaaacccaggagtagcgttggcacagtccaccaaattatttggccactactatgagcagggagttcaggctgtccccttgggacctcgctttgtcccaggcacagtcaccctttccataaccatcactagaaatcccaaaccccagaatcctgctcacctaagctcaaagaaggaagctgttgctggcaggtgcttctcagaagtctggcacatctgtgtatttcttgtctaattcttctcattggcctggagcatctcttcacatttttctctagagagcctggcacttttttttccccaacaacctgaccattttatcttctcagtctagggcttctggggtcaaaagaaaggactgaaatacagtatcacctatatgaatgtctgctcctgagggaagttaacaaaagccagattagatactgactggattttggtgtctctctcaagtggagaagatgtgaatagaaacagaagtttacaaaacactatagcctaacaaataggtaaaagctgtgatttaaagctggctcaagactggcccaggcataatactgtcaatctaaaggtaaccggcaacatcaaaaagtacatctcaaaagaatcaggcttaaagataaacaggagaactggaaatatctaagagtaagaagtgtaaacaatagaaaagaggtagggtttagggttctcatcttgggatttccccaggtcttcaagcttctatccttcctgggttctgggtcatgggcctccagattccggccgttagtcttgagatacctttttcgcttgggtcctctatccatctaggtaggctttgtgacaggggccttccatccttgggttgtaggtcttccagctacaaccctgggctaatcttaggtcgttggccttgtgtcacaagtctcagttcttaggccttccatgtgtcctgtcccaggtcttaagacttctaactcaagccttgagacttccatccaactcaggccttcggtccaattcaggccaccctctgttttcttggctcttgaggcttttgttggtttcaggcctgaggcttctatctatcttggaacatgggctttccatcttagtcctcgggtctcaagtctcaaaccatctgtcttatactttgggccttctatccatatgagccttccaccttctgccctacttgagttctgggttttactgcagtctagggccttgttttggtcttggatcatctcacatggcagcctggcataaggaaccgctccacaatgcttgctctgatagccgacgttctgcacctatcaggcaggggttaggaagcccctctgccacacatgacacacacacacgtacacttgcccacatatgcaaagaaatatttaaggagagattacatgaaatcaaagagagggagatagattcatgaagaggctgaaatactcaaaggtgagtagaaagggaagaagcagagaacaaatacaagccaacagagattaatactgaaatagaaaatcacaaacagcaagagatgctgaggcacgcaggggaggagagagagaatagcccaagagaggcagaaaggaaatgcagaaatgagaaatgtgagataaaaagtagaaacagcagaaaggaggccagactcagaaaaaaggtgaaatttaaaacgaacgagaaggggaaggggtaacaaataatcacagttcacaaagagaaaagagaggtaggcagagaaaggagaggtagacagaacaagaaaaggacaaaaagcacacagcatgtgacccaaaaaggagacatgaaataaagcgtgaaagaagagccacatctaggagagcaaagagaaatagcaacaaaatgaaaaatgagagatatgtctaagacaagacacagaccactcttgtgaacaaaaagagaaaatgaggcaaaggcacacacgaaagaaattagcaagagaaacatggaaatgggtaagacacactttagatagagaacaaagagcaaagacaagaaagaaagagacaaagaaatacacacttgagtgcaagagataagcaaaggcagacattcagaggaagtaagtagtagaagaggcaagatacagtgaggggcacaagaggcatgaaaagcatcacagaaagataaaaaaaatcaaaaagtgtcattagtaattataataaactattgttactacgaatactacttatagtactacaataataacaaccaccaataccaacacagatgctcttctatttataaacttttaccttagggatttcttacatagaaccaaagcatgccaactctgcctgctacctgatagtgctagtggtcacttatattgtgggaaatgaacttatgagtcttcttgggttaccttttacttgacatgtgccaggcactgcaataggtgagcactttacatacatgatttcatttaaccctcacaaacagagaagtctagagactttaagttgtcaaaggtcatatacctaatgagtagcagaggatttaaaacacacaatgtatgcctcttaacatcctgttacaactatttactaggatttctggaagagccaaatgggatgtcacagatgactaagtattttcataaaaggctctttgataggacttgctcaatcccctcctttagcatcacctttccccaactctttagaaaactgacttcattctcacacttttataatggctacttcagagtttagttttctttttacactaatcttaactgacgacagagtctctcacaaacggagatgagaaagggttaccctttcagcagaaagcagaaatggtgttttaagcttctcaacgtttaaggctctaagaatgacagagggcctatacagtgaagacatagaacacacaagcaaaggctaaattcttctgtgatacaactggtaagaagaccataatgtctttgagttgcttcagtgaacccagtcagtaatatggaagactggtcatctttccatctcacatttagccccacttcacattagaccaacacaccccatccaacaccagctcccaaaaaacagctgttataacagttctgaagtgatcctcacaggactgcaacatcaacaacttacttcattcagctatcctcaagtgctagagtgccaggcatgttgatcttcaggtgggaaggctgacttccttcagtgtgttcaaatttcttggacctgctgaagactcagctctctgcactgcttgtaggaagtataatgatttggcagataggaacaatgaagagctataaaaaaacatgagataaaccatgtaaatgccataaatattgagtactgtgctagagttacataagattcaaattaataagcaatagaaaatgtttccacagaactttgaaacctataaagtcaaaacttttaggtctttagagagaaaatttcctcattcaacagaataggaaactggcataaatgggaaaatgtcttgccaaatatcacttgatgagtcactagagacaccactaccagtcatagccttataccttagttaaagaccagaactgccgggcgcggtggctcacgcccataatcccagcactttgggaggttgaggtgggcggatcacctgaggtcaggagtttgagaccagcctgaccaacatggagaaacaccgtctctattaaaaatacaaaattagccgggcgtggtggtgcatgactgtaatcccagctacttgggaggctgaggcaggagaatcgcttgaacccgggaggcagaggttgcagtgagctgagattgcaccattgcactccagcctgggcaacaagagcaaaactccatctcaaaaaaaaaaaaaaaaaaaaagacttccatcctgttttaagtgccaatcagctaggaaagagtccctttaaatgattaataactgagatcacaaaaataatagatatgagagggaaaaacataaggtcttcccaatgtttaaggctcacttcgatgttttaagacccctcaagtttgctttaagtctcctggctcaggactaacaaaacacagccttagagcagcattttcaaaactcacaatattgctctttgagataaaggtgagtcactctggaaggcaaatattctcacaataagaaaattcacataggttgtttaacattgcagctaaaatacaaaaaaaaagaagaagaagaagaagaaaaagaaaattcacatagactactggccctaggagaatttatctaaagattatgagtacaatagatagatcttcctagataactctcaacttagctttctagttcctagactttctaacaatttgttagtaactctctatttctaaatctacagagatttctagtcaattataacatttcaagagttcttacccatgaaaatatttcatgaaatttatagctacccactatttacgaagaatgctgggcaaagcctatacgttcaggatttattgcaccgaatggtcacctttatctgccaattctcactcgctaatcagcctctcccaacactgacctagagaatgtagggtcctggttctttagctcctgcctgatgacagataactttgtgccatttttagtcaggtttccatttgtatttatgcggcttccatcaatcagcaaccatagcataaaaagacacacctctcacttgttgtattatacaccatggcatcccaagccatcctgaagtatgtaaatgattggcaaagttcttctgtaaggctttaagagagactttggggaccacatggaacagaatgatttgcccatgtgatcaatgtcactgatgtgacagttgtccatgttctcctaaaagaacaacttagctgtaagcctctgccacgtgctatagtcccactccaaacacccgaacacatgcaacccgctaccctctttacatcatcactttaaccagttaatctcacacccagttgcttcccaggttagttaggaagctgtttttaccaaatcatatgcagaataatgatgaatacgacctcagtgaaacactaagtgcaatgtatactggaaaacaaaatcaaaattaagactacttattatgcttttagggacagcttacgcaccttgacgtgtggtggttgtttttgagactttatcttcctatctgggaccaggaaagtatcttgacagaacctcctgacctagggttgttgcccagtggtagtgagcttttcccctggaggatcctcatgccccatctccacctagggatcgtcaaagggaatggatcactaacactgtaaaacaacaagcctattcttctgaggaagatctgaaaagagataaaagaaaaagtattgaaatgcagtacactgggaaagtctgttctaatgggcaactagtggttgagttcaaccatatttttacccttttcttcatgtggattgaagagtggacatttacagttgtgcggagctgttatattctggctaccaacttagcaaaaaaaaaaaaaattatcctattcattccagctctattctgtatgctttccctcatttccaagagaaatttagaactgagtaattgccaatattcccatgctgcattttattctccagtctttattactgagcgatcctctacaatgtgggttgttaatacccttgtgttctcagcacaaaatatagtaggggggtcaagaaatcaagaggttgaaactaatggaaggagaaactaatgctttctcaaccaagagagccatgaagccacacagaaaaggtcggatgtggtctaaccctatgagttatgtaagaattctcctccacaatgcctctggcttcctttataaagagctattttaagaactgagaaatccacctctatcaaagtgcctgtcagctagttctgtagcatccccctcttttaatttgtactttaagtagtgccatgccataatattgccaagataaagagaattgtttcctactcaatccacatggtaacatttcttcaacaacctgtataatagggcgccaccaaagttctaggatattcggagaaaccaagaatggtcacaagcacatagaactccagttataacaacagctggccaggcgtggtggctcacgcctgtaatcccagcagtttgggaggtcgaggcgggtgaatcacctgaggtcaggagtttgagaccagcctgaccaacatggagaaaccccgtctctactaaaaatacaaaattagcctggcgtggtcgcgcatgcctgtaatctcagctactcgagaggctgaggcaggagaataacttgaacccaggagacagaggttgcagtgagctgagattgcgccattgcactccagcctgggcaacaagagcgaaactgcgaaaaaaaaaaaatacacgccacaaaaacagttaagcaaatctatgcagaaggaaaaacaaggtacagaaaaccagggattcagtaaattccttatacaggcccccggggctctcctattccactttttaacaatttcaattgtttttcaagctaagaaattttgatttcttaaaacaaggaaatggcagtgataatggaattaggcctaccaaaactgagctaatacagatgaagttagtcttatttgtaaacaaatcctgagaacttaatacccatctgccaaaggaaagtgggaataatttaaaaggccactaatcaaaaggtgttaagttcattaaatctatcttgctgtgtggtgagaaaagaaataatttagtgctttgcatctctcattcttcattggggatcaagtatgcttgcccttacagacctcactggagcccagctctgagggataaatgaaacaggccgaactcattatgtaaagttaaaatgtatgtgtacatgcaaaagaaaaagtataggaattgatgaaaactggctcacgttctgcttttctttctttttaagagactgggtcccgctctgccacctaggctggagtgcagtggctaatgatggctcactgcagccttgaactcctgggctcaagcaatcctgctgcctcagcctccagagtaggtaggactacaggcacgtaccaccatgcccaactaattttattttattgtagagacatgggtcttcaactcctggcctcaagtgatccccccacctcaacctcccaaagccctggaattacaagcaggagccaccatgcccagctgtgttctgctttaaaaaggagagttgtgggaagttcaatccaaagacagaagcactacaacaataaattccccaaactacctttttctccagatagctggcaacccatccaagtagattagctggagcttggccagattctcaaagggaaagatatgattaatttggagcctcttatagctgtttgcagtcctcaggtctcacatgctcagaatgtccttaagaagaaagacagggttcagtaggctaccaaagcaccggtaggataccaaaagagttacaaaaaccccaatgaaaaaaacctaggaagtataaactgaagcattagacataggtatctcctgtctctactttctagcctgcttggtctccctaaagtcctctaatgacaagccctggcagtacacgggaagattagacaagtgaagaaaaagaactacatgaaaatatgggtcaaaccaataccgaccttaagggctgacactaaatttgtggctaatggtcatcctgttgctgaaaatacttcaagattcaaggtggtgtggcaactgctactactgcttagaggtgcaattgtcttgactgtttttaataattggctatctacctttactatagcataggagctcactaaaggggatctaagccaaatttgcagtcttgaaagcactttgcatggtactgtatagtatggtgtgaaaagcacccagtatgttaaacctgagtaccttaaatgaatacaggcttccagatccctgatcagggattactgtatcatgaggaaacctttatgtcaatgtcaaacaggaatatatggaacatcacttattcaacactattctctagctttaaaaaggccaaactgttctatgatgttctcaatataagcagaacaagcttcaaaatctcttgccaacatccttccccatcctaatttaatctaagattagatacttgacttccaaatgcaggcttccagttaaacatggcggttcatacatgtttatgcatttactctactgcttcctaaaactccattaatgagagtaaatgtgcactccatatgcaagcaaatacacctaaagaaattttaaataaacggatcctagctcaaattcatttatacactggcatctaaaagggaacaactattccagtctccccaagtcttcttaagcatatttatggagtatcttgctttagcatcaaagccctctagttttgcctgttactatggtgatgacatactcaaagagcattccctttcccttaacgggaatctaaggctagagaaaatggttacattttggaactgggaatctaaggctagagaaagtggttacattttggaactgatacagaaccatacatttcactagggttcaatattcactgacaagaattttgagaatccgtcatcttgcagaccaacaaaatatcaaagtcttatggagagaataactgagtggcacagccagccatctggttcaaatactccagcatcagacagaattgtcacagctagacgtgatattaataatcacataggccaggcgcagtggctcatgcctgtaatcctagcactttgggaggccaaggcgagtggatcacctgaggtcagaagttcgagaccagcctggccaacacggcaaaactccatctgtactaaaaatacaaacattagctgggggcggggggtggggggcgggtgcctgtaatcccagctacttgggaggctgaggcaggagaattgcttgatcatgggggaaggaggttgcagtgagtcgagatcgtgctacttcactccagcctgggcgaaagagcaaaactccgtctcaaaaaaaaaaaaaaatcacataattcaacattttcattctctaaggaaactgggaacccagaagatgaaactacctcaatgttacacaaatagaaggtaaccaagtgatacttaaacccatgtcttcccacaattcaaaggtcttttaactgtggggtctgtgcatagattctcaggacatatggggagctttctacaaaactttcacaatactctcatttcactgtaaggatagtttagatcagctatatgactacttcataatataggaccacgttgccagattagtggcaaatgttctagttttgttgcctggggattacagaaaagaagagaagcaaacaatatataaatgtgttttgtgccaaatgaaagtgaaatagcattgctatgtgctataatggcaggatttaaagcagtttgaaaacagcagtttggtgaagtgcatcaacacagcatgtgatattacagacacgccactcaaaagaaactataatactataatagtagtgccatatttgcattttagttatctattaactactaatttgtacatctgctatgttttatagttgtattatagatgtaggcaaacagatttcattccaggtttgttcatacactttaacttaacaattattcccataaacctaaatagtacataataatatttttcttttacagaaaacgtttaatcaaatatagcaaaatattaattgtagaatctaagcagtgattatgtaggtgcacactgaataattcttttcttgagagaaaacctccctactatcaaacttattatacagacttgagaaacactgtctcaaactaatatctaatataaaatattaaaattatactcaacataatttcatgttattttaaattgctgattaatatgcaatgcacatgacaatgctgttaatcagggcactttttgtaacagcacaccaactttcttgactaaaattgaaaggttaaaaattatatttgggttacaattgccaaggaagacatctactccttgggtcttaaataggcactttggaaggctagctggaggtcagtaaatgaacctttcctatcccacgtgtgaacatgcctttcccttcctttcccacctccagtgttctcagggtcctttagctcttagaaaaaaacggaaagaagaaatgcatacccaaggaacagcttacctggcgatatcagaataatttaatctgaaaatcaatgtcaaaatgtggattgaagtaaattctggttcttaagataaagtttgtttctgcaacctattttacgtttcaaaactggcagaaacatttagggcagaagggtcatttctagtttcaagaataccctacagctaaactctccctaaacttaaccatagaagcaaatgtcaaacactcactaccgtaatattaacagaaaaatttcccaaccaagccaggtttctcactgtagaaatgggaggtaacagataagcaaggaggtgagactataatgatccatgtggcaatgattagagttggagacgtaggtataaacacatttagtttaatatagatacagatggttatatatatttatagctatgtgcatatacacacgttagaatgcaaatatatatctccttgctcttgtcaactgaaaaggtcttgaaggaatgacactccagtagtaatgagcgcacctagcattcacttcttgatttctaatattactctccaataaaaagtatcaaggctccttgcagaaatacatcattttaggtccaggcaggagatatgcaaatgagtctgaagcatgttgtagttccaaaaataagaaagtgctcaaacaaaaaacccacattcatggggttatatcaaagccaaatgaaagacctcccaatggccaaagctggaacaatttgaacaacagaataaagtaatactgtattataacccagagtataaaatatccctgagatcatactgatataaatgactgaataaacacaatacattgtggagaaaagacatcctgtgcaaaagaattccaaataatttatgtaaatactctgccctcaatgaggtggaaggtaatttcccattccttaagtgctggctgcacatagtgacttcctatgtgaacagtatagtagggaaatggagaaataaagactaattttacgctggagaaacctgacaaatagtacctcagacaggtgattaaggataacataaacagtgataagtcatgttgatagtatgtactcttgataagtgataagaatggcactctacctttgtggtcttcctcctaaacactcataaacccaatctagtcatgagaagaacatcagacaaattccaatagagagacattctatagaatactggaccattagtcctcaaaactgtgaagttcatcaaaaacaaagagtctgagaaactgtcattaccaagaggagcctaaggagacatgactactaaggacacatgcagcgtggtatcttcaatgggatcctggaacacaaaaagaacattaaggaaaaactaaggaaatctgaataaaatatggactctagttaataataatgtatcaatattggtttgttgtgacaaatgtaccaaactaatgtaaaatgttaacactgggaaaaactgggtgtgaagtacacagaaactctatcttcagaatcattctgtaaatctctacactgttctaacattaaaaggttattttttctaaaaatctcccaaccagttgctgaagacttataagacacagtttttaaaaagcaagcaaaatggaacctaagaactggtaagtctatgttccagatttttctacagtacgtaccatcattgtttgcagatctgatctaaagacttactctctttcttttctgtttatatggatttataataggtaattttgatgttaaaatatacaaggcccaaataaccaggtatccgtaatatcaaaaagttattttttaaaaaaacattagcaattaaactttgtttttgtacatcaacagatttcctggaaagacctagtcaatctgctgtaaaaaataagtcgtaagttagtagctaattttcagtcaagggagatctataaggctggaaaactttaataacatatagattgtagagtgattatatcccatcactgttcaatgccaatcacactaacagcatactataaaatatactatgccactagttttcaaagctatgggtaaagtaacatagataattttataatgggacctggtaaagtacagtgatgttccagtcatatccctatttttaaattcttatacgcacttgattatgtaataagagggtattgcttgggtctactgcataacctctcatgtttccgggaacactagaagactagcattctaattggttaaggaaaataatactttaagtctacccataatttaagaagtctagcaccggtcaaatttacattttgtttcagtttctcatcctaacatgaaaaaaaataatcaaaagttatttctaatataaacatcaaaacagtaaaggagaggcttctttaccaaactcatttgtataagatgcagaagaagcccaagctccatgtatcagtactcaatttggaaaggtcaaggaagagctatcaagtaaagcctaagtcaccaacaaaaacatgaccaactcgacagcctaatacacatatatatagtgatatataactgtacatggccactgaagtttaacttgttaaattcagcaggccagctatgtcttaaatacatgagctccaacttgagttggatttttgaaggaaacctgtgtaaaatgctacttgcctacagcccaaaatatggtagtgagaatatcaattttctcccaatccagtctttaagacaaggcagaggaaggcattagctctgtttaactgacacatcattactctttgccatccaaactgataaggtttgggggaagagaagaggcattagctcagttcagatataatcattagtttctttctctttaagctggtaacgtatttttccaggatgctttcacatataagaatattttagcagtcaacaaaggtcaactcttaattcattactttaagacatgaactcccttcaagctgtacatttgataatcagggcacaaacaccctgaaaagaaattatgaatgcctaatcacagcagccctgggtctcacagtcttctgtaatttagggaggtggctagagaaatggaagttacagaaagataaagctgaaagaggatatgagaaaatggtcagaaaacttcctccaatcctacatgttaaggttttataaagggaaaagtcagaaaagaaatgacaataatcatttaaagaaatgccaaaaaagtttccttcattagacttttgaaaattttccaaatcacaaaatgtcattttcagggatttaggtatttgatataagcccctatcttatttcactagcagtctcgagatggtcagattgatggtgatctgaaccaaactcagagccaggactaaagtctaagcatttctgcccaaaaccataatgatttccttctgcatcctccataagaaagcaaattccttgatataaatcctgtctttggttttgctatttattccagcacctggtacaataatatttgttgaactaacacaagaattatctctattttgaagatgcccacatttccagagcatccctttttacaattgctagagatttttcttaagggtggaaattatttcaagcaatgaatttaaatacagcttcaagattcacctttggatgctatctagtataatcaatccacctaaaatcaagccatccttcctcttgacttaaggtacagaatcacctccaaattcattcatttaaaacaaattccaataataattataattgtatgttgacaatgaatgacaatttaattaccaatagaagatttcataagcatagaccagggtttctcaaattggggtgataaccctggggatttgtgaatatattctaatggatccccaagttctacataagttatataaaacacatctttgacaaagacaacgtgaaattggaaaacatatttacatttcaaatatctttgttaagtcagtgttcctcaaaacacatttttttaggatctcagaaaattttgttcctttagaaggtgtttcatcatgaagcattacttgggtttgagaaacaatggcacagaccatgtttccaagaaggttcaagaccatgatgtatataaccctcagtcagccagacaatgttgttaagcatatggagtggggctgggaggcatggaaacaagccctgaggaaatatggatatgaattaaaacgggctataagtgaagccagttcacttatatggttcttgttgctcctgctgtgatgcatgaatgtgcaccagaaaaaaagtttcgaatgttatgttaaacaatattttgtcagctggaaaacattaaggaggctaagcttcttttagctttacgaaaggtgggaggaaagaaggtatataaactacagcataaagtaggcaaggaaggtcaaggttttgacttcacttctccactaccctcttggcaaaaaggttccaaacttaaaaagtatctacgatatgcattatccatggtcatctgttcttgggcagaaatgtagtaaaattgtggaaggagccgaagtattagatttatgccctcaatctctgaactttaaaatactcaagcttatgagatttagcaatcactaatttgccaaccttcgcaaatagccaaacacaatggctatgctctatccctttcatctctttccatggctccaaaagaggtaaaaaacaaatgaaattaaaataaaccaactggactatccagatggctgcaatattaatcctatcttggcttaaagagaaaaagcaaacccacttccttaagtttattctatcaacttcaaatccttgtgggttcccttcctaaaactactacttatgattcacacaaaacagcacttattattttctaaagttatttcaaatgtgctcacattagctcctcaacgataaaatcatctcaggaatgaaattatataggatgatatcattcctacccaggttatcagtgtaacctagcatagagctgggtccacaatattaattctacagttctgctggttaactcacatatgtgtatttatgcatgtatgtatgtatctatttctctctctatatatatatattgcagatgaggtgggaagaaggaaagaaacttactggaccctctgacttttctataggtggcatctaagagaaagaaaatagaataggaaaaagattacttaatagctacgaagtagtacttacagtattctaaagagccagagactcttctttacagctgtccgaggagctagtagggcaaactgctccctgagctgggccgatcttttgacatccttctccgagaaacaatattctttttcagttattacaaagaactgctgttgtgatgactagttatttgcttgagcagttccatattacataatcctgtgccacaaaacaccctgtacactagtggctgggatattattcatttccactaggcagctatctcactgttgaaatttatatccaaaagaatatttaattttggcttatttttcttataaaatagggaactcgtcttatcatttttaagtcctcacctcagtgtggtacttcaaactacttcaaattattactataattaaatgcttcattttatataataattaataaaaaaggtggcatatgctttttaaaagcacctctgcatatgttccctcatttaatcgttttactgcaatcttcttgaaataagtaggggcaggtgctccagatgaagaaattaaaggattataaaatttaggtagtttttctaaaagtgaatgctggtaaagcccacacaaagatactggtcttaagagttccactctagaatatctttgatattaaaatagcaagagtcagtgttctatccacagacccaccaccctcagttaaaatgagagacactggtcaccaggtacatagtataaatggatattttggcttcaaaaaaataatgaccaggttatcgagtccaccctacaatccagatgtctttcttaaaaaaatttttttaataataataagcaatttttctggctgtatcctggcatttggcactttacaataacaatatacaaaggggacaacaagagattcttaaccaggcaatctgctctggaaagaagaatgcagagaaagtgccaaccttccttcctggggagacaattttatagtgtacactggaaacacaaaataaaggatggcaatccagctccctgggtctgacttgccttcagtattttgcacagtaaagcagtaacacaggtgggcaagaatggttcttgtccccagaatctgacaataattgaaactaggatcattaataaatgaaagaaaatgagtgaaggcttatccacctagttcaggcctgcttttcatagtcaacactgcaccaacacaccaaagtggtagggagatcttggactgatgggctgaaaaatgggacaatcagtactgtgtttattaataacacagaaggggctttgggtagtcagcatactcagaagcaatgcgaaaggaagtagaggggttcatgtataatgggtgggaccaaggaaagtgcaactgagaattgtttaagtccaagagaaagggccttgtctggtcaacattacccagcaaagaggcaaaaggggcagggcagagggaagggaagagggagacagcacaatcttacctaatagctgcaaatatggacacctgagattgtgagcaatagtctgtaaaaaggggccaagggcacacaaggggcagagagagggaagacttcgtatataaagcatgacaccatggctacctgtgattttacacactggcgcaatgcaaaagggttgggagtatggaccactgtttgatagacaagtgcatggaatactccaatgcttatactttattatgccatgggaaactaagggtggggtggggcgcttgcttaacaaggtcagggagggagaaaaccattgataactgccattgtgcctattaacagtcccaggagaagttttgagtagtcagcagcccctgcagtaatgcaaaggggatactagggcataatatcccactctaccagaaggagacatatataattgcaaatattcacattaacagtacaaggggccttagtgggtcagtacccccgatgtaagcaacgaggaagcaggagtcttatctaatgatcagtgcccttgataattgttattaatgctattaattgtccaagagctgagattatgagtagttaacacttctcagcagcaatccaaagggtaatgggaggaacatagggtctttttctcctacacaggtccacaaatacaattatgacattaatattaaaagaaaagggttcattcataattaacatgcccctgatgcaaggggaatatgtggagatcaactcttagtctaaaagaagaggtggacaattgcattaatgcatattaagtccaaaagaaggggcacttagtgaatatcatccccctgctctaaagcaaaggtggtacaggaacatgcttagagaattgagtttgtgcacatgaacattccaagtgacagtcttgagtagtgggcactacctgctaaaaacactaagaaagtaggtaggatccttatctagtgcacagatcaggagcaaatgtaattgcacatattaacagtccaaaacaacaggactttggttgatcaggacaccctgttgtactacaaaggaaaggtgatggggtatgaccttaatctactgacaaagacaaaagaaaatttcaattatatgttgatagtccaccagaaggggccttggagggaaacagtataccccacagtaatgcaaaagaggtataatggtcctagaagtgatagggttgtggacaactgcaattattcacattaactgttcaaatgtaaagatcataaggagtgggcacccactattgaaaagaggtggggcatccttgtctagggcacaagaaccaacataaatgcaattatgcatgtcaacaagccaagaaaaggggacttagggggtcagcaaccctggtatactgcaaatggagggtgagaaggtagaactttgtttaattaggatgaaccatgtggtgattacatacattaatgtccaagggacattgttgtggtcaattaaaaccatgtactttggacaaatataagaatcttaaaaagtagtgggtactccttgttgaaaagcaaagggagtccatgagaaggtgcccttatctagtacacaagaatatagacaagccaagcaaagaggcctcagtgatcagcaccccagctatactgcaaagggggtctgagagtaggactttattcaaataggataagccatgtgcagttatgcacataaatttccaagatgcatggttgtggtcacttacaattgtgcaccttgattgtccaaatgtaagggtcttatggagtgagcactccctgctgggaggaaaagaaagattatgcgtagatgggatggggcagaggaggcttccttgtctagtacacagaaacctggacaaatataatcacacacataacaggccaggaaaatgggccttggttatcagcacccctgctgtactgcaaaaggggtctgagagtaaggccttattcagatgagataggccgtgtgcagttacacacattattgaccaaggtgcatggctgcggtcacttagaattgtgcaccttgactgtccaaatgtaaggttcttatggagctggcactccctgccagaagggaaaggaagattgagggtggggtggggcaggggaggcttccatgtcttatacactggaacccagacaaatataatcacatacgttaacaggccaggaagaggggccttggttatcagcacacctactgtactgcaaaaggggtctgagagtaggaccttattcagatgggatgggccatgtgcagttacacacatttatgtccaaggtgcatggttgtggtcacatacaattgtgcaccttgactgtccaaatgtaagggtcttatggagcgggtacttcctgccagaagggaaaggaagattgggggtggagtgtggcaggggaggcttccatgtctattacacaggaactggaacaaatataatcacacacataacaggccaggaaaaggggccttggtgatcagcacccctgctgtactgcaaaaagggtctgagagtaggaccttattcagatgggatgggccatgtgcagttatgcacattcatgtccaaggtgagtgcctatgctcacttacaattgtgcaccttgattgtccaaatgtaagggtatatggagtggacactccctggtggaagggaaaggaagattggaggtggggtgtggcaggggaggctttcatgtctattacacagaaactgggataaatataatcacacacataacaggccaagaaaaagggccttggtgattcagtacccctgctgtactgcaaagggcatctgagagtaggaccttattcagatgggatgggccatgtgcagttacgcacattaatgtccaataatgtccaaggtgcatggctgtggtcacttataattgtgcaccttgattgtccaaatgtaatgatcttatggagggggcactccctgctggaagggaaaggaagactgggagtgggggtgggggcggggggaaggcttccttgtctaatacacaggaacccagacaaatataatcacgcacataacaggccaagaaaaggggccttggtgatcagcacccctgctgtactgcaaaaggggtctgagagtaggaccttattcagatggaatgggcaaagtggttatgcacattaatgtccaaggtgtatgcctgtggtcacttacaactgtgcaccttgattgtccaaacgtaagcgtcttatggagagggcactccctgccggaagggaaaggaagattgggggtggagtgtggcaggggaggcttccatgtctaatacacaggaaccgggacaaacataatcacacgcataccaggccaggaaaaagggccttggtgatcagcacccctgctgtactgcaaaaggggtctgagagtaggattttattcagataggttgagctgtgtgtagttatgcaaatccatgtctaaggtgcatggttgtgttcacttaacaattacgcaccttgactgtccaaatgtgagagtcttatggagtgggcactccctgctggaagggaaaggtgagactgaggtatgtggagaggaccctccttttctagtgcataggatcccagacgattataatcacacacaacatgccaagaaaaggggactgcgttatcagcaacccttctgtattgcaaaaggggtcggagagtaggaccttattcacatggaatgagcagtgtgcgattacgcacataaatgtccaagatgcatgcttgtggtcacttacaattgtgcacctagactctccaaataaaagggtcttatggggtgggcacttcctgctggaagggaaaagtggggatgaggggagcactttccttctctagtgcatagcaacctcgacaaatacaatcacacatattgggaggccaagaaatggggccttaggtgtcaccaaccatgctgtccttcaaaaggaaggatactgatgtaattgtcattaggcacattaacagtttgagaaaggggccttaagtgaatagtaccccatgcaataaagcaaagagggtgtgataggtcagaaacccaagtctaattgaaggaccattgacaactgcaattacatgccatctacagttcgaagagaagggcttaatattgattagcactctctgctttgataagtacaggagtcctgataaaaggcacaactgtatgcaactgaaaatgtgtatataacacctaagattatgcacgctaactttactagtctaagggtcttaagtagtaggtacttccagctgggatgtaaatacagtgggtggggtccttacatggtaaaaaagtacagcagcaaatataagtatgcacattaacagtccaagagagtgaattcaggctagttagaagctcctgcagtaatgcaaatggagcaaggaagcgggattctactctaacataggggcacatcaactactgctaattatgcgcatttaagcagtataagagaagaagcactagctagttagcactcctgctgctttgccaaggaggtgtgagggggatgggattccagggcaattgtcttacttttttttttttttaatgttggccaggctggtctcaaactcctggcagtaagggatcttcccacctcagcctcccaaagtgctgggattacaggtgtgagccaccacacccggcctcagggcaattttgcataatagaaattcaagaaagactttaggaaatcagtacccccttctatgatgctgagaagtcaagatattagcttgatataaaagctagatattagcttgatataaaagactcagttctaatcaattagacatttgaaatgtcttagacaattgaaatcaattaggcaattgaaaatatgcacattaagagtcatggataattagaaatacacattaagagtcccaagagaaggactctgggtttccagcatccctttctataatgtaaaaggggtagaatataggtttaaagggagagaccatgaacattggaattttgcacattcatagtcccagggaaaggtaacataggtaattaatatcccttgctgtaaaacaaggaggataaaatggatctgatctgaaagacattgttgtgatcagttgccatggttcacattaactatcctagtgcaaaggtcttgactagaggtcatccactgctgaacactagggaagtgagtggggtctttagtgcacaggaagagggacaaatgcaagtagcacattaacagtacaaaagaaatgtccttgtgattagcaccctctactgtaatgctaagagggtgtgagcagttgggatcttaatttaatggaaaagaccataattgcaattatgcgcattaacagtcccaagtaccccctgctgtaagacaaaaggaatatgaggggatgagaccccagactaacagcagatagggaaattgcattttgcacatcaataatttctggaggaggggcattaggtaaccagcaccctcttgatgtaaagcaaagatgatgcagggaccttgatataaaagactcagttctaatcaattaggattgtgcacataaactgtcctagtacagaggtcttgagtagtaagggtcccctgctggaatacaaagggagtggaagggttagtgcacaagatcgtggacaaatacaattatgaacatcaatgcacaagaagagtccttgggtgatcagcccacattgtagcgtgcaaataggatacagagtccctttctaatggacaggactctggacaattgcaactgtgcaaattaactgttcaagagctgttattgaataatctgcactcgttagcaacatcccacagaaggtgggatggggtgagaatccatttttattgcacagaaccatgaatatatgcaattatgcatatcaactgtttaagagaaggaaacttgggtagtcagaactcagcagcaatggcaaagaggacatcctagactaatgagtgggactatgggcaattagtgttttacatattaatgcaaggtggtaggtagttcacactatctaggagcaatgataaaggcatacacataagtgggtcttctctgttacgcagaaccatgaataattactattgtatccattaatattccaagggaaggggctctaagaatgagtcagtcccactgctgttatgcaaagatgtttgcaaaggccatagtgtaactaacagaactatggataattgggattttactcaataatttaagaaactcttaaatctcaggtagtcagcgctgcctcaaggcaaatgcaagggcgactggtagtcttcatgattaatgggtgagacaattagcaattactactttgttctttaattgtccaagaacagcaggattctccagaagcacagcaaaaagcgcagtagggtgcctttgtttaataggcaaagctatgacaattgggactgagcattttaactgtccaacaaaagacgggttgtctgcgaccccctgctgaatgcaaatggggttcagagtgctgtctaatccaatgggtaggattattggcaattagaattttactcaatgcaaagagttttaggtggccaacacagtacacaagaaaagatcactactcaaaattgggactgtgactacagaagcaatgacagagaaatggtttctcctttaagggcaggggatcgagaaaatgataagtaactcaaattgtgggcaataatgctctgatagaaagctctcaattgacattccctaacttcaacgtaccgagtaaggaaattctttgtcctgagatcacagacaaatgggattgtatgcattaactgaaaatggtcaaggagtcagtactgaagatcagcaatgccaagggtaaacggaatatcccagtataataggataagcaatggacaacttattttgagcactgaatcaatgaaaattagagtgactttcgagagaagctgggcgggactgaggaactaggactgggactggggctagggctggggggttaggggactggggctggggcagggctggggcggggtgggagtagggctggggctagactaggggtttgctgggagcagggctggggaggaactggatgctaggcaggcaggatacaacgaaaaattgaaatactccaatataataagtctgaatagaggacaccagaccacagcaattcaagtttcctgtctgataagtaggtgattagtcaattagtgcagcatcaaggatgggaacaaagcaaggcctggacctgtgtaaaccttcaaacactcttttttacattaggtcatgaagttaaattttttactgtttctgtgctacagactcttcaaaggaaaatagttaagtcaatttcaaagaaaatgaccagcacatttttaaaacattagaaatgatttgactttgactatctactgccaaaaaaaggttaaggaatttgtaatgagaagctaaaaactttaaggaattttaaggaactcaaaacaaaaactcattaaatgtaattaaagtgaattctacaaataaagcctcttaatacatttctataatagtcacttaagacttaaattcaaacactagcaaaccacaaaatcagactgtatgactgacatccaaaagataaatataaatcaaaatccgaccccagcattagccaaggggtaggtgttcctcttgaggaaggcaggaattcctcttctgccacctgttggccaacgatcatctgtgatccattctggtccttgccacggctcaccaccatgtccacaccaagcaggcctggagcactgcccatggcaacagtgcagtgcagggcagaccagaggggggtaggggggtaggggggtaggggggtggggaggtggggggtggggggtgggggtggggagttgggggggttggggggtggggggggaggtatacttagccttaggtgaggcaccaatacagaggaatggagggaggttcagaccacacagccagatatccagcactgcaagaggcagcactggacaggaggggacaaataagaggggacagaggtggaaaggctaaatgtccttgaaaagaccttgaaaacacctggtgtaccgcccactgggagacatacacgtggcccctccacttctttctcctgactggctaaagacagctgcgaagtgccatgctaattcacccaggtcttcgctgagtagctggacagtgtgtcatcagtctaattccatcttctgctctaattggctgtgatcaattccacccccatttctaattggttgggttatgcagcaatccagcactgtccatcccaccttttctcccgctctgcgtggcactaggcggcaaaacccgccatctttaacaatgcggcaagcccgccatgatgtccacgtgacaaaagccatgatatacatatgacaacgcctgccatattgtccctgcggcaaaacccaacacgaaaagcacacagcaaagacaaagaggcccgccatgttttacactgcggcaagaccttcagccgccatcttttcctgtgtgaccgcacatgtccaccaccatgctaaccacttaacaaagcctcgcccatcatgatgtggccttcccgccacttgaacactgcgacagaactggatccgccattttggacaacctaacaaagcacagcccgccatgctgagcaatgccgcaatgtcaaaatcgccattttaagccctgcaccttagtctttcctaaccttccatttttaactagtcccttgtactgataaaagatgattcttactgcctcccgatacaacaatcacgcaaagctcctaacaagccccaaatcaattcattcagataggtttagctcatgcaatgcacatgacttcctctgcctgacctgctatcatccatcttgcctccctagtttaacttagcacaaacgactagccctaagccgagttatgcggcaagtctaaaatggcggccacttttcctccacaatctgaacacgcccttagcttaactgcagagtcattctctgccaaagcggtaggtacactcacacaccaccaaatgatcagcagcaaaaaaaagtgtagatattccagagagtgcaacaacccacaaaaccaacattttttcatccataaaaagcaccgatgggcgatgaaaaaaaaaaatcaaagcaggtatccgcggccccgatgggccagaaaaacaaaaattaaagcaggtatccgaggccccgatgggcaaggaaaaataaaaaaaaaaaaagcaggtatccgaagccccgatgggccaaaaaaagaaaatttttaaaaagcagatatccgtcaccccgatgggccagagtgttgggggttcagaggggaagggaatcagcaggtatccgataccccgatgggctaaggaaaaaaaaataaaaagcaggtatccgcggccccgatgggcgaataaaaaagaattaaaaggcaggtatccacggccccgttgggcaaagaaaaaataataaaaccaggtatccgcagccccgatgggcaaaatatagaaaagagagtggaagagtaaaaaactgatccacaaaaaacagagatgtcaaccaaaaatgattccaaagaaaaattccttaaatattaaaaattgcctcaaaatattccaaatactttctttaaaaaaatatggaggacgtgtcaagaagacactaggagaaagtatagaatttaaaaaaatattttatggaatttaggtgatttttttaaagaaatacgccataaagggtgttgggggactagaaaatgttctagaaagaaccccaagtgcagagagatcttcagtcaggaagcttccagccccgagagagtaagaaata

SEQ ID NO: 358 - DNA, 139640 bp, Homo sapiens
gtgtcatgcaagaaggaggcggcggcggcggcggcggcggccggagctggagggggaggaggggaggaacctgatcctccggtagcgaagggctagaggcaaacaccgagctcctccagagccgcccgggagcagggagggctccgctagcccggggggccctccccgcggggcagatggtaagtggggcggtgcaggtggtcgccttgggaagggagcgcgcaggggggtaaggtggggcggcgggaagtgctagaagtcaccccagccaaactgaaggagcccagtttccagctgagagggacccaggccgtaataaggatgtccagccaaacgcagcaataattactattggagtgacgccccgaagttgaccccaagctacacagagggtggagtggtgcatcctgaacccaggacagagctggaggcaatgattcagggtttgagaagtatcagcccatcggcctggcgctttaaggtgcagctgagtaggaaaagccaacccacatcatattcccagagccttgctgcgctttctgggttgtcttgttcaaaactagtgaaagggatgggaaacctgcccaacctcactttagccacgaaaataatgctcttggccagtggccttggacaaacagcctctggtgcaacaaaacaatcaataggaagaagaacttcattcccctcaccatcctccttccccaagttcctttgaccagcatacctcattcggcttaaaggagaaagaaaactatgtgtgacattccctcccagcctacctgcagccagcctcctcaccacacaaactgcccatcccgcttctctcctcatcttcagagccatgattccaagagacattgcaatactactcactttaggtgagaagactgcctgaaactctgaacaatttcacctcccttgccctttgccacaggggattcagaaacctacaactgagagcagggaaatatacggacaggcttggcacgtaggaacattacttccttcactggagtgtagttctccagacaactttttaattatgattattcccttccattgcactcctggaaatttcaaagcactttctaaaacatcattttttttatgtcagtcatacatttagaggtaaggggttgatgggattaactgaaaggctaatgactgtctcaaaagcacatgctgttgctagggaacccaagctcctgctgctctctaatcaccagcgtgttccgtggaaatcaaactgctcagggtgttattaaaatgaatggcatcgggttaaaggcattcttgcttatgttgtagcatcctggattattatcgattgcctcacacccacatatcttgttttcctaatttgatttctgtatttgcgtcactgccagggacactcagactagaccagtcagttcacttcctgtttctcagaactggtttatatttggtctcgtagcactagctggtaaaacattatcaaactgatcctcttggaaagaaatctttgcttcccattgaaaacaaaatattccaattaaattgtaattcctgtggaaaacgtcatcatttgaggagtagactgccagttgccatttgagaaacaatccttgaaatgtaaagcctagaaaaaaaaaacatcatcttgatttcttttacccagaatcttcattcctcagcactagaactaagacaaactcgagtaaagagtagatttaagtatacttctaaaatgaaacgcataaataaataaataaataaataaataaatacatgtcgaagctggggaaatcatttagactaaacaaggcataaaattgaatggaatccaggcccaggaaggacaagtaattttgggttagcattgtggcattcggagaacacagtgtgactacaaggctacactacaaataggaaaccccatcactttgtgtactaattgtcttttttaccaattcctctatgtccctggacaagacaaccttgttttgttttgtttgttttcagttccttcctctttataacaaggatattgcaaaggcaatatcagaaagataagccctatgtaaataggtggattctgatgtagataatttgtttagatggaaaatgaagccctttgaaaaagatgtataatggcatcgatagcctggatgaccttgagtgagccattgtaggtcttatgtcagtttcttcgtggaagcttaaatgaaagtgctggactaaaggatttctaaggttcctcccatttacaaacttctgtgatgagattgaactcactacataaaaatttcaattttagctggattttgcaatgttaaatttaagcactgaacctttaatatctatccataggaaccttgagggaaatgatgggaaatgactttctattgatgtatccatttttagtgtctgttgacagaaaaataaaatttaccttgctccccatgtacttagtctctccctgcctcagtggtattatggaagcaacaggataagagttacaaaaggatataaaagtatagagaaagttctttcagtctactcacttatttattatgacaacgtgtcactgtgttacccaggctggcctccaactcctgggctcaagcaagcctcccacctcagcttcctgagtagctggggctacaggtgcactcaaccatgcctagcctttcagtcattttagatataggtaatcctaagtactctgatgatcaaagtggtggaatgatggaggaaggggtgtacaaaaaaataatcaactgaatcctcatggaactaataataatctatttgcctgtgttttaattagtgctaggcaaaaatagacctagctcagctcttggaatttttcaaattcacagtattgagaagtagcatgaagaaatgtgagatttgtgccagagagaaaagacctgactttgaaacccaactctgccactttattcattattgagtgcttgctgtgtgtcaggtactgtgctgggtgctgggaatacaaagatgaataagacacagtttctgctctgaaggacattatagtatcatgagaacaaagatgaatatacagttgatcacgcaacagtgagatgatatcaacaggggagctcataagaatggtgcctaaccctgaccacgcatagggtctctaaccacacaaggtgaatcttgagatgcgttctgaaggataagtagaagtaagccagacaagtgggcaggttacagggaaagatattccaagcaaagaaagtactatgtgtaaagaccttagggaaaaagctgtgtgcagggagttgagggtgaagaacagagcctggcaagtaggttctaaataaatacattgtataaatgcatggcagaagtcctggaggagaaatccagaaagattagcatggttgagtatgttatcctaaaaagtttgaacttattctaaggccagtggagaaccactgatgaattttaaggggcatagtgaactgatcaaatgttcattttagaaagatctctcagctgggtgcagtggcacactactgtaatcccagcagtttgggaggttgaggtgggcagattgcttgagctcaagagtttgagaccagcctgggcaacatggtgaaacccctgtctctacaaaaatacaaaaaaaaaaaaaaaaaaaattagccaggcctggtggcacacacctgtagtcccagctcctcaggaggatcacttgaaccacagaagcggaggttgcaatgagcagagatcatgccactgtgctccggcctggggaaacctacaatcatggtggaaggcgaaggggaagcagccaccttcacaaggcagcaggagagagagagcttgcgggggaaactgacacttttaaaaccgtcagatctcatgagaactccctcactatcgtgagaacagcatggagggaactgcccccatgatccagtcacctcccaccaggtccctccctcagcacgtggggctaacagtttgagatgggacacagagccaaaccatatcacattataagaaagaaataatgatgcatgtctaaactaaggtagcaagaatggacatggagagaggaagcattgaaagggtttaagatatattaaggacatagaaccaacagaatttgattattgatggtatcctccatcaatgctatccttccattttcataagccataaatctgctcccattatatcctgcagatatatcctgaggtccaagatagggacctcaggaggaaaagcaggttgtggagtgaaggtaattagtttagttttcaacatgttgagttgaagtgtccatagaatatcaaagtgaagctgtctactacataattgaacagggaagtctagaactcaggagagagatctatgctggagtcatcagaataaggaatagttcatggaagtagatgaaatccccaagagaaggcatagagaaaggaaagaagaggatctactttggaaccctatgaaaaccctgatatttaaaaagtgaggaaagaaaaaatacaggggaaaaatatcccaagaggtaggaggaccaggaacaagtagtttcaaaggagccaggggaggaaacatcagcagtattaaatgccagctagaagtcaagaaaaagaggattgtggccagctgcagtggctcacacctgtaatcccagcactttggaaggccgaggtgagcgaatcacctgaggttaggagttcgagaccagcctggccaatatggcaaaaccccatctctactaaaattagccgggtgtagtggcacacacctgtagtcccagctactcaggagctgagacacaagaatctcttgaacccaggaggcagaggttgtgatgagctgaaattgcacaactgcactccagcctgggcaacagagcaagactctgtctcaagaaaaaaaaaaaaagcaaagcaaagaaaaagaggactgaagtttttggatttagtaaggaggtcattgttgtgttcggcaagaaggagtttattagtaaaatggggatagtagccaaactgcagtgagttcaagacaggataagagtagaggatgcagatagatgaagttcttttatataagaaggactaaagggcaagtagggaaggaaaataaaagagagtggtgtaatccatggtctgcaagcttaaggctgcacaaggaaagaaggaaatactacactaatagaattcttcattctctcaggcttcaaattaaatggcattaccacccaccaattgctcaacacaaaaagcatgtagatattcttgattcttctcttttcctccgttttcacaatcctcagaattcaggtcaactttacctccaaaacatttccaaaatgtctctttcggtctccactgctaccaccctaatacaaaccatcatccctcttctgtgctcttgtaatagctttctaaatggttttcctgcttctgctcttgtcctcattcaccacagcacagctagagtttcataaatcataagtcttaagacataaatcagatcatgtgatttctcatcttagaatccctccatgtctgctgatggcacctgtgataaagtccagactcctcctccatgcagggcccgtggagccctgtacggcatccccgaccacctcttcaacctcatctcccaccactctccaccaccgcagtgacaccagccttatttctcttcctcaaacttgttgaatttgctcttgtattataggatttaccctatatacttccttttcctggaatactcttttggtcattctgatctttgcttatatgtcacctcctcaaagaagccctccctgaccacgccacctgaagtgtccttctctctccacgtttccaaccatcctagatatatttttttcatagtaatggaactttatttctatttgtttttatcacatacggttgaaaactcctctaaaatgcaaaccttgtgaagattactggcatatatcaggcacttaaaaaatattaattagggccgggcacggtggctcacgcctgtaatcccagcactttgggatgccgaggcgggcagatcacgaggtcaggagatcgagaccatcctgactaacatggtgaaaccccatctccactaaaaagacaaaaaattagtagggcatggtggtgggactatataatgaatatatatatatattcattgggtgtttgtagtaggaaaaggagaagagcaaccatttattagaaattagagacatcaagaatcagtcttagtgtaattggaatggctagtggtgatgattactaggattttaagattttggaagtggaagagttaccagctgtgtgatcctggacgtttatattctctgagcctcactttgtagttaacaatactatatgcctcacaaggctgttaggaaaatgaaacgaaatggaataggtataggcataaggcagtcttgtgaaattattttcaggaattcaagacttctgcaaatcaattcacacattctacatatgcactcccttgtaatggagttagcccttgatgattacttattattagaataaaaaaattgactaaatcattactttgaaaagatagtaggatatctgatagaacatggaaattaaactatttaagaagaaatcagagtactcccacaaatccataaaaaaaaaacctttaaaactctggaaaattgggtaaagggtatgacaaacagattgtagtcaaagaaatacaatggatcttaaaatatgtaataataaaaggcatgtgcatcacaactgcagtgacatctattttttactgtcaagttgacaaaaataaaaaagtttaataacatacttggctggccaggctgggaagcaggcactttcttatactgtcagtgggagtgaaagtgggtatcacgtctatggagggcaatctggcaacatttatcaaatttttaaatgtacaaagcctttaccctggcaattctacttttatatatttatccaatagatatactcacacaggtattggaggatgacttttctaggaccttttctaggactgaagcacgatttatagtagtagttaaagactgaaaacagccatcaatagagaagtggttaaataaattatgtgaaagaggctgggcgcggtggctcaggcctgtaatcccagcactttgggaggctgaggtgggcggatcacgaggtcaggagatcgagaccatcctggccaacatggtgaaacctcgtctctactaaaatacaaaaaattagctgggcgtggtggtgcacacctgtaatcccagctactcgggaggctgaggcaggagatttgcttgaacccgggaggcagagattgcagtgagccaagattgcgccactgcactccagcctgggcgacagaccgagactccatctcaggaaaaacaacaacaacaacaacaacaacaaacaaacaaacaaagaaaaaataaaaaacaggtgaaagataggcagctgttaaaagtttgagacaattctaggcatacttatgtgaaaagatcttcatgatacattactaagtaaaaaaaattacaatgaagaacaacgtgtattttgctagcattgcatttctttttaaaagacagtttacattttttggtctgaaaaacattatttgtggggagataaaatagagcagagaatgagcagatgtggagagaatagttggaaggtacattaatggttcctgtgagagatcatggttgcccagattaaggcagtgaaacacacagggagagaaatgatgagagccaagagttattttaaagaaactgatgattgattggaaatagtgggttatggagagggagacattgtcatagttgacttctctcccaagatcaggtacatgaatagaggtgtcaagaccatgactaagatggagaatcctaggacagaaacagaattgcagggtgatacagtttggatatttgtcccatttaaatctcatgttgaagtgtaatccccaatgttggaggtggggcctggtgggaggtattggatcatgggggcagatccctcatgagcctattgatgatgaatgagttctcgctcaattaggtcataagagacctggttgtttcaaagagtctgggacctctgccttttctctcttgctcctgctcacaccatgtgacttgctggctgcccttcccttctgccatgattgaaagctcctgtaatagtcaattctcacactgctataaagacatacctgagggctgggtgcagtggctcatgcctgtaatcccaacactttgggaggccgaggtgggtgaatcacctgaggtcaggagttcgagaccagcctggcaaacatggtgaaaccccatctctactaaaaatacaaaattagctgggcacagtggtgggcacctgtaatgccagctactcaggaggctgaggcaagagaatcgcttgaacctgggaggcggaggttgcagtgagccaagatggcgtcattgcactccagcctgagcaacaagagcaaaactctgtctcaaaaaaaaaaaaagaaagaaagaaaagaaagaaagacatacctgagactggctaataagaaaataggtttaattggctcatggttctgtgggctgtacaggaagcatcgctggggaggtctccggaaacttacaatcatggcgaaaggtgaagaggaagcaaacacatcttcacatggccagcacagaagaaagagaatgaagggggaagtgctacacacttttaaacaagcacatatcttgagaactcactgactatcacgagaagaacaagggggacatctttccccatgatccaatcacctcccaccaggtccctgccctaacattgggaattacaattcaacatgagttttgggtgaggacacagagccaaaccatagcattccatcctggcccctcccacatttcatgtccttctcacatttcaaaacccaatcatgccttccaaacagtccctcaaagtcttaactcattccagcattaacttaaaagtttaagtccaatatctcatctgagacaatgcaagtttcttctgcctatgagcctgtaaaatcaaaaacaagttagttacttccaagatacgatgggggtacaagcattgggtaaatactgccattccaaaatggagaaattggccaaaacaaaggggctataggccccatgcaagtccagaactccagagggcagcattaaatcttaaagctctaaaataatctcctttgactccatgtctcacatccaggccacaccgatgcaagcggtgggctcccaaggccttgggcagctccaccactgtggctctgcagcatacatcccctgcagctgctttcatgggctggtgttgaatggctgtggcttttccagggcatagtgcaagctatcagtggatctatcattctgggatctggaggacagtggcccttttcttacagctccattagtcagtgctctagtggggactttgtgtgggggctccaactccacatttcccccccacactaccctagtagaggttctcaatgagggctctatttccacagcagacttctgcctggacatccagacatttccgtgcatcctctgaaatctatgcagagactcccaaaccttgattcttgccttctgtgcacccacaggcccaacaccacatggaagccaccaaaacttggggcttacaccctctgaagcaatggcctgagctgcaccttggccccttttagccatggctggagctggagtggctgggatgctttctgccttgtcttggctattcacatttggctcttctttacttatgcaaatttctgcagccttaaattcctcctcagaaaatggggctttcttttctgctgcatggtcaggctgcaaattttccaaacttttatgctctgctttctttttaaatataagttctagtttcaagtcatttctttgtttatgcaaatgaggataggcttttagaagcagccaggccacgtgttggcaggcgcctgtagtcccagctactcgggaggctgaggcaggagaatggtgtgaacctgggaggcggagcttgcaatgagctgagatcgtgccactgcactccagcctgggggacagagtgagactccatctcaaaaaaaaaaaaaaaaaaagaagcagccaggccatatcttgaatgctttgcagcttagaaattttttctgtcaggccagttgcaatggctcacacctgtaatcccagcactttgggaggccgaggcgggtggatcacgaggtcagaagatcgagaccatcctggctaacaacggtgaaaccccatctctactaaaaatacaaaaaaacaaacaaacaaacaaaaaaaaactagccaggtgtggcggtgggcgcctgtagtcccagctactcgggaggctgaggcaagagaatggcgtgaacccaggaggcagagcttgcagtgagctgagatcacgccactgcactccggcctgggagacagagcaagactccctctcaaaaaaaaaaaaaaaaagaaaaaagaaaagaaaatttttctgccaaataccctacatcatgtctctgaagttcaaagtttcatagatcttgagagcaggggcataatgccaccaatctctttcctaaagcatagcaagagtgaccttcactccagttcccaataaattcctcatctccatctgagaccacctcagccaggacttcactgtccatatcactatcagcattttggtcacaaccattcaacaagtctctaggaagttccaaactttccctcatcttcctgtcttcttctaagccctccaaagtgttccaacctctgcccgttacccagttccaaagttgtttccacatttttgtatatctttatagcaataccccaattctggtatcaattttctgtattagtctgttctcacactgttataaagacatatgtgggactggataatttataaagaaaagagctttaatcggcacatggttctgtggagctgtacaggaagcatagctggagagatctcaggaaacttacaataatggaggaaggcaaaggggaagcaaacgcatcttcacatggctggcacagaaaagacagggtgaagggggaagtgctacacacactttcaaacaacagatctcgtgagaactcactcactatcacatgaacagcaagggggaaatccgcctccatgatccagtcacctcctaccaggtccctcccccaacattgggaattacaattcaacatgagatttgggtggggatacagagccaaaccatgtcagcttccccagactctcatcagaaacagatgcagcaccacgtttgtacagccagcagaaccaagaaccaactaaattccttttctttaaaaattacccagcctccatcctggtgaacacggtgaaacctcgtctctactaaaaacacaaaaaattagctgggtgtggtggcgggtgcctgcagtcccagctactcgggaggctgaggcaggggaatagcatgaacccctgggggcggagcttgcagtgagccgagatcgcgccactgcactccagcctgagtgacagagcaagactccgtctcaaaaaaaaaaaaaaaaaaaaaaaaaaaaaattacccagcctcagatatgtctttatagcaatgcaagaaatgcaagaatggactatcacacaggggaagatcaaaagttctaagtgcagatgtcccctgcagagttgtagatatgggtgtgaggttcataagagctgctggaactgggtttataaatttgaaagaagattgcctaggagggtagatagaaagactcaaagaaaagtgggtccaggtctaatccttgatcatttaagactgaaaagaagagaaagagctggcactggagactgagaatcagaaaccaggagactacggggccaaggaaaccaagagaagaatctgttaaggaggatcagctctttgttaaacactgccaaaaggtcaagaaagattattttaatttgtttctctcgtaagcgttaagctccttgagagttagtattattttattatttatttttgtttccctggggcttgccctgtgacccacacataataaatgatcagtaaacttttgttagattgaagaaagagagaaagatgcatggcaagaaaggcagacatgcagaaagacagtagaatttatgcttgggtctcaaaaaataaataagtaaaacagattcccttgaagttgactgcaaacccagcttgatcttaggaaatgtaaggaggttctttctgctccctgtgttttactcttgagctaacacattgatggggctcccacagaaccatattgttgccatgtaagtaccttcagaaaacattttgagaagtgatattcacctgtgtctggtcaatctgagtcatttttatctttatttaggtcctaggtgatgacgaaaagggcaatttgcttttcctcgtctatgactccaccacatcaccctgaatgagttgatggaaacgggggcatccatttctgtgccactacagttctgtaatacactgtaatcactcataacgctgcccagccccagtttcccatgagagagaaaggtgactactggcaggaagagacgtctaacctcttagagaaaccaccagcttcttagtctgttattgtttctgcattaaagtgttgctgcgggccgggtgcggtggctcatgcctgtaatcccagtactttgagaggccgaggcgggcggatcacgaggtcgggagatggagaccatcctggctaacacggtgaaaccccatctctactaaaaatacaaaaaaaattagccgggtgtggtggcccgcgcctgtagtcccagctactcgggaggctgaggcaggagaacggcgtgaacccgggaggcggagcttgcagtgagccgagatagcgccactgcagtccggcctgggcgaaacagcgagactccgtctcaaaaaaaaaaaaaaaaaaaaaaaaaaagtgttgctgctatcagggccgctgtacagaatatcaaagaaggacatgtttgactctgttctaagaacgtggagctcttctacataataaaagagagtgtccttgaactggaaattttaggaaatacagtaatagatgtagttgaaacaatatttaaaatgttatgccatcctgtatcatttagttataccaaagatcagcaaactttttccatttctataaagggccagaaaggaaataatctaggccttcctggccctacagtctgtctcagctactcaattctgccattgtagtgcaaagcagccacagacaaaatttaaatgaatgaacctggccatattccaataaaatgaatttgaatttcaaataatttttatgtgtcataaaatatcattcttcttttcacattttccaatcatttaaaaatgtgatggcctgggaaatagcaagaccttgtctctacaaagtacaaataaaaatagctgggtgtggtggcctgtgacgaggcaggtggatcacaaggtcagaagttcaagaccaacctggccaacatggtgaaaccctgtctctagtaaaaatacaaaaattagccaggcatggtggcaggcacctgtaatcccagctacttgggaggctgaggcaggagaattgcttgaacccagaaggcagaggttgcagtgagccgagattgtgccactgcactccagcctgggcaacagagcaagactctgtctcaaaaaaaaaaaaaaatctacttcttacatagtacagtactgggtattatggagttgaagataaaaggatagataattcataagtaggtaggtaggtagactgacagacaaaagatctagtgactgataagttctgtgagaattgttcaggtgtatcacagtatcaatgtataaatgcagtcttttaaagcaacaataggcagtcagacaaaactaagtttaaatctgagctcttttgcatcccagctgcatgaccttggggtgattacatacaccatataagcttcagtttcctctttttgaaatgaggataataacacctacctctcaaggaggttgtgagaattaaataagatcatgtatgtaaatcagcaggtgtagtacctgggaaatggtagacaatgagtaaatggtagctgttgttgtagtattacagcaatatgaaggtaggtaacttattcaaaagaagcacacaaccaaaggcaaagcagagtaagcttgtaagtcaagaggtcacagacacatatagaaacccgcaaacctgggggctgaacacctggccgagaacatttggctgaaaataaaagcagaagtgacattgtcacaggagcatacaataaggcacctggccagttgtcttgcttttgtcttctctagcaaccagctgctgggttgtctaaggagccctacttatgggtccaacccccagcctccccagtacttaaacgctggctcagactggagaaagtcaccattagtatcggccccaccattgtgcttcctttcagttaggtcagccatggggcctcagacatctgtagctccctcctattgtgcctccccacccctctgcccaatatgggtttccaccttgccctcaacacctcagtctctggtcctcctgccttgtatcccagtctccctttggatgtgggtcccttgtcttgaaccccagcctactttaccatgatcctgatgtcttctttagcttagttctgaccagtcatctttgcagagggctgtattctgctgcctacacccctgctgtgctctcctcaaaccatgggacatatgcgccttcccctttatagataacccattgctagggtaaggctaaactgcctggtattaacagcttcctgaactttatgtgattaagagacacaaggttttgcagaggccagctgcccagatccaagctggtttctgtattcatagcccgtgctctagggagcatcccccaaccctggtcttggctcataccctctctccactggctgtatgcagtcaactactcctagcatgccttgtgatcctgttatggcaacatcagtaatgctttcccaatacaaatgacaaaattattggcacagggacacgatataggggtaatggagaacttcagcttatctgatatctactgacagtctcattctgctgaaaagtgatcgtcaaataaagttggcatgacttaaatttaaactaattgcttactgaagaagtactattctgtgcttaattctaaccagctaagaaaaatatgttggcaaagtagaagtgacaaacaacttaaaataagtgaccagggcagctttgaatttgtaatagccaaagaaggcaattctgcacctgctaacctgacatgaacgagaggagcaagttaagagaaaatatggacacaagactccctctggccaggaactaggaaataaagggcaagaggagtcatatgattggaagtgtacatttttacaaaatcagtggtttaaatgaagaaaagacgagcatccaaaaaaagatcaggctaggcactgtggctcacacctgtaatcccaacactttgagaagcccaggcaggaagattccttgaggtcaggagttcgagaccagcctgggcaacaaagtgagacttctgtctctgcaaaaaattaaaaacagcctggcacggtggctcacgcctgtaatcccagccctttgggaggctgaggcaggagaatcacgaggtcaggagatcgagaccatcctggctaacacagtgaaaccccgtctctgttaaaaatacaaaaaaaattagccgggcgtggtggtggccacctgtagtcccagctactcgggaggctgaggcaggagaatggcgtgaacccaggaggcagagcttgcagtgagccgagatcacgccactgcactccagcctgggcgacagagcgagactccgtctcaaaaaaaaaaaaagataaatataaataaataaataaataaataaattaattaattaataaataaaaatccagaagaaaaagattaaaaagatcaatctggttgttctggaagtgttcaattaagcttgtacgtttgaaggacatgtacaaaaggcaggagaaggggtatataacgaggcttccttcaaaaaggagggctcagatccgtgagacccatgagaataatgccagaagggctaatgaccagagacagctgaggtctgggaaaagtattgaagacaatgaattatgaacttttatttttgcttatgtttatagtaaagaataataaagaaggaaggatagtaccattgaatggggcagactgtcatatgtgagtagttaagtgaaaaatagagtcatttaactatagcatgtcctagattctaaggtacagatatccccccatgtttttaatatttctaaaatgagaatgtaggtacatttaacacggcggtgttttttgggagggctctcaaaacagccattaaatggtggtgcatcctaccatatatatttttttttcctgatggagtttcactcttgtcacccaggctggagtgcagtggtgcgatcttggctcactgcaacctctgcctcccgggttcaagcaattctcctgcctcagcctcccaagtagctggagttacaggtgcgtgccactgtgcctggctaaattttgcatttttagtagagatggggtttcaccctgttggccaggctggtcttgaactcctgacctcaggtgatcctcctgccttggcctcccaaagtgctgggattacaggcatgagccatcgcatccggcccatatgttgatcttagaatagaagaaatatggccgggtgtggtggcttacgcctgtaatctcagcactttgggaggctgaggtgggcagttcacctaaggttggtagtttgagaccagcctgaccaacatggaaaaactccgtctctactaaaaatacaaaattagccatgtgtggtggtgcatgcctgtaatcccagctactcgggaggctgaggcaggagaattgcttgagcctgggaggcggaggctgcggtgagccgagatcatgccattgcactctaacctgggtgacaagagcaaaactccatctcaaaaaaaaaaaaaaaaagaaagaaaagaatagaagaaaatggaattgtttttcacttagttctgctggtatcaaccacactcagcagatgaagggtctacttgggatcttggaagtggcagtgtagccagtgaccactaacaggtgggaaagagtcagaaaggagtttggaggccacacgcagaggcatattatctcatggagcacacagaggagagtgggcgagtacgactgaagaacaggagtgcagcaaatattagagacaggacaagaaggaaaaactgatcaaaacctctgagaaggggtagagagagcccattgccggcccacagaagccacgtcactgaacatgtgtgtcacagaagaggatggaatggagacaggggatatgtgttgaaaagatcaggcatggccaagatgcaagaaggaataaaagaactgctgtgaagatactcagaacagtgtctaacatgcagtcagatgggaatggcttgccctgggcaggacattttgaactgtgcctggagcatagtatgtgtctaccactgtgtcctacctcttctgaatcaattaaatgattgacttaaagccctggtgctccaggttccaactatgtggcttcgattaaccacatagaagtctcctctgggaaggtatttagatcaggatgtgggtttgggatcacagatcaggaaaagacattgtgaactggtataagcaagatgctgagtatatttgtttttgtttgcttatttaaaaaatgacaaggaatggtccgaataagtaaccagggaaaaagggagccaaaagccagaaacattaccagaataaattcaggggagagttggagctgtggtctgtttctactaggtctgtggaactcatgttgaagaaggaatttagaaaacctatagatcagttggctgtggaggaaattgttccaaccatatatgagcaggcccctagacactgtgatgtgtccaagtggtccatatgcagcttgaacataaagagaagggaccgaagtatcgcctctgattcaaaaaaaaaaaaaaaacaacaaacaaaaaatggaaaaacatgtggccaggaagaatggaatgcatttcagatggattaaagaattaaatgtgaaaagtgacccatataataggggtgatatgtgctgaaaagctgaaagtagtgtaagcattttttgaccttggagtggtaaaggccttcatgagcaaaaaagcaatggtttatggtttataaaagaaaagcattgtacttgagaggctgaagcaggagaatcacttgagtccaggagtttgaatccagcctgggcaacatagcaagactttgtctctaaaaaagaagaagaaagaaaggaaaacattgatatatttcattgcttagaacttttagcttatgtagataaggcagtagcacaaacaaaattaaaagatacatgagaaattctagattttttttcatagggtcttgttctgttgcctaggctggaatgcagttgcacattcatagctcgctgtaaccttgaactcctgggctcaagcaatccttccaggtagctaggacaacaggtgtgtgccaccatgtctggataatatttttttttagagatggggcgtccctatgttgcccagcctggtctcgaactcctggactcaggtgatccttccccttcagcctccggagtagctaggaccacacgtgtgtgccacctcacctattttttttttttttttttttttggtagagacaggatcttgctctgttgcccaagctagagattctaggactttatgtatatgacaagcggtagtgtctttaacatgcaaacaactcatacacttacaagaaaaagacaagatctcaaaagaagaacgggtaaagaacaacaaaaggcaaaaaggaaaaaaaggaattcaactggtcaatgaaaatgaaaatggtccagtttcattattaattaatgaaaatgcaaatcaaagtaaaacccagatgtctttgtgcctagcaaattgtaagaactttaaaatgatatcttacatggataaagagtcagggaaataagcactctcataccacattgggaatataaattggtataaaccttctgagagcaatttggtattgtgtgttaaaaaccttaacatacacaaaccacttatttaacacagcaatttcacctttaagacttcatcctaagaaaataactacaggtactaagaaaatttaatgtagaagaatatttagtgtagcattctttataatattaaatacttagagataacaaatgtccaaaaagaattattgcataaattttgtgtattcccatgatgaaatctatgtatccaataaaaagcaggttatggaagatatcatgacatcagaaaaagttggtcatttattatttattatttaaagacagggtctctctctgtcacccaggctggagtgcagtggcctgatcatagctcactgcagccttgacctcctgggctcaagtgatcctcctgactcagcctctgaattagctgggactacaagaatgtgccaccataccctgtgaattttttaaaactttttttagagacgaggtcttgctatgttgtccagattggtcttgaactcccagcctcaagggatcatcctgcctcggcctcccaaagtgctgagattacaggtgtgagccaccatgcccagctaggtcatttatttttaagtatattttctcagaaaaaaagaaagactgaccacagaaaaatattaacagtggcaatattgtggtagtggatttataattgattttattttatgggtgtgatttctatagttaagttcacttcgatagacatgtgtgttcttatagtctggataaagaagaaatttaagatgaaatgggagccaaggtgaatgatgaaaggatacatttaaattagacaaaatttaaatttagatgagattcaaatttcaatgagcttcaaatcttctgatccatacaaactgtatctagggatacaaaaggaacttccaggtatgattatagacatgctatgaggaattgctgaggatagaacaaataccatatgcctagggttgggcaactatgccaatttttaaaagggaaaatggtggattccagaacctacagcctgataagcttagtttggttagggaaagaaagttggtatcaacgagagccaacctgggttcacttaagtacttccaaaccactctcatttccttatctaccatgtgctttaagtcacgtaatcctcatgccagacctctaaggtagatattactaccattacccccatttcacagaagtggagcctgaggtcataaatgtcaagtgatttgcccaagatcctctagctggtttagttttttctgtcgataatgttaatacgtaagaagatgacagacatatttgtcatacctgtcattggacacaggttttcaagggatgctggtgaataatataatggaccatggaacagtattattcagtattattagtagatgaaatgttttattattacatttattactaatgtattattagtagataaaatgattacacacacaaatgtggattggatgagatggctcatgcctaaaatccaagcactttgagatagactgaggcaagtggattgcttgagtccaggagtcctaagaccagcctggacaacatagtaagacctgtcactacaaacaatacaaaaattagctgggtatggtggcatgcaagtagcctcccagctacttgggaggctgaggtgggaggattgcttgattccaggaagttgaagctgcagtgagctataatcatgccattgcactccagcctgggcaacagagggagaccctgtctcaaaaaaaaaaaaaaaaaaaaaaggttgggtgtggtggctcacacctgtaatctcaggactttgggaagccaaggtgggaggatcgcttgagctcaagagtttgaaaccagtctgggaaatatagtgagacctcacctctacttaaataaataaataaataaataaataaataaaatttagctgagcctggtggtgtgcacctgtattgccagctactcgggaggctgaggagggagtatcacttgagcccaggagttcaaggctgcagtgagctatgatcatgcaactgcatccagcctgggcgataaagcaagactgtgtctcaaattaaaaagtgcagattaataggacattgcttacctggagttttctaagcggtaataataacaccacttcccaagtacttatgtgcaaggttctatgcaaaaacgcttttcattcatcatctcagttaatcttccccagcagctggagaaacaggtattgttatccccattttacagatgagcaaaccaaggctcaggatggtttatgaacttgcttgtaatcaccagatagctagtgattagaagagctcagattcggtcacagaaagtctggtttcagaagccatatgcttaactattatactaaagtatcttcttttggttattggctcctgttatgctcaaatttttttattaaaagaaagatgtattaatcttgaggaatgacttaaaaggcatacttctgctaaggaatcaaagttgagagaatcaaagaaaaggaaggcaagaaaaccaacatttattgagaacttacatcaggtattatactgccctggtttcagactcaggaccacttcgcagtgcaggtagtattagccctattttcactgataagcaggttgagactcagagatcacatgacatgttctaggttacagggctatgtaataaaaccagaattcgaatacagatctgtctgactcctaaacctttccactttttactactggctcatgaaaagccaatgtaaaaatacataatagtgggaaaaagtgtaaaatcttgcaattggcttttaaaagtcaattgtgtaaatgttagatttggaagacatagtatatcaacatttcaagtgcaaaagatctcaagatttgagttgatcataaaacaccatgagtcagcagtgtggctgtgagaacactcgtacaatctcaggtggcattcacagaagcactgtgtcctggaaaagggaaagaatgtgcctactggtttctaactgcttataccagatggagagaattgtgattaattctgagtgccacattttaaaagggactttgacagactagggtatggttatccagaggagagcagccaactggtaacaaaagacacatatacatacatacatatatccatacataacgactggattatttcacagaggtgaaatgattgggaaagccccagaggtggctggaaaccattctcagttagctggagggctgtcgtatggaaaaaagtcttcttatacttgtgtggctccagaggacaaagctatgtttggaaggaggtagatttgggccaataaatgaaaaaccaaaggccgggcgcggtggctcacacctgtaatccagcactttgggaggccgaggccggtggatcacaaggtcaggagatcaagaccggcctggcctggccaacatggtgaaaccccatctctaccaaaaatacaaaaattagccgggcgtggtggcagcgcctgtaatcccagttactcatgaggctgaggcaggagaatcgcttaaacctgggaggcggaggttgcagtggaccgagatcaagccactgcactccagcctgggtgacagagtgagactctgtctcaaaaaaaaaaaaaaaaaaaaaaaaagaaagaaagaaagaaagaaagaaagaaagaaaaaccagagcatgactgtgccttgcatatatttttaggccctgaagtaccaagcccgatgctttagacatcacaggcactcaacaaatatatattgaatggaattgatgtgttgctgtacaaaagcccaaccagctgtcttgtggggtagcaggctcactagagattttgagcagaagctagatggccacttgtactcaggactcccattccataaaataattcctactccttgcccaattccaccttctttccagccttacctgcttccctcctggcaacttcaaagacgagtcttcactcaagccactccaggctgacttcttttttattttttattttaattttaattttttttttctttctttctttctttttttttttttttttttgagatggagtctcactatgtctcccaggctggagtgcagtggcgtgatctcggcttactgcaacctccgctcccaggttcaagccattctcctgcctcagcctcctgagtagctgggattacaggcacatgccaccatgcccggctactttttgtatttttagtagagatggggtttcaccatgttagtcaggatggtctcaatctcctgacctcgtgatccgcccgcctcggcctcccaaagtgctgggattataggcgtgagccaccgcgcccagcctctatttttaattttttttatagatggggtctcactatgttgaccaggctagtctcaaaccctgggctccagtgatcctcttgcctcagccttccaaactgctgggattataggcataagccactacacccggcccaggttgacttctttttttttttttttaatttggttttttttttttttttttttttttttgagacgaagttttgctcttgtcgcccaggctggagcacaatggtgcaatctcggctcactgcaacctctgcctcccaggttcaagcgattctcctgcctcagcctcccgagcagctgggattacaggcgcctgccaccaagcccggctaagttttgtatttttagtggagacggggtttcaccatgttggccagtctggtcttgaactcctgacctcagttgatccacctgcctcggcctcccaaagtgctgggattacaggcatgagccaacgcgcccggccagctgacttctaattctctagaaactgtgctcatcaggtcttctaattactaagccttatcttatacctggtctgaccccagagaaagctgttgatcattttctctgggaaggtctcatgtctctttccttgcagacctccctctgtcccactctcatgccccatcttttctcctttccagtctattgccagggtccttctccactgacagctgcctcaggctttttttcagtgttcttcgcttggtccttttcattgtttgtctgcccccaagatatcctatttattacgaggactgagccactgatgggcccggactcctgaacctatgcattcagtccagacctctctcctgatctgcagacctgtcattcatttgcactggatatcccacaattactgtgagcttcatatcctgttcagcatcccctctgcacttgctctccttcctgcctttagcttcgtcagtgtcattgcacttcaacctcggcccgtctctcctactcccaaacctctatctaattgataactgtgtcttcagtgctacttttaaatcccccttggacttgttactacccttcaccccactgctgctatggtgactcagaccttaatcccttctttagactattacagtagtcttctaattggctttgctggctcagtcttcatcctgccactaaagtttttaattttttaaaatatgaatgagcacatctttccactctttaagaaatgctgatagttactgtcttcagtatcaagtccagattccctagctgtaatcaaggttcctcgcaatataaccacaacataccttagcattgatttctagcccacatcagacttctctcttttcttggaacagttttccctctccacacctttgtgcctgttttcatcctattcctcttacaaaaaagccactcttctctccttgccaactcatctcctccttcagtggttctaggaaaagaatccacttcctgtttcttgttttttgtttgttttgagatagcatcttgctctgtcgcccaggctggagtgcagcagagcgatctcggctcattgctacctgcgtctcccaggttcaagtgattcttccgcctcagcctcccgagtagctgggactacaggcgcccaccaccacgcccggctaatttttgtatttttagtagagacggggtttcaccatgctggccaggctggtctcaaactcctgacctcaggtgatctgccctcctcctcccaaagtgctgggattacaggcatgagccactgcgtctggcctctcttccacttccgcgtcaggagtttagggacgcatcagagtgagaaatatggtatttaaggcaatggactggattgacaattgcagagggacaagcccaatggggctgccaatattcagacattgggaagggcccagccaaagagactgcgagggaacaatgaggtaggaggcaacctagtgaggtgtgatggaagataagggtagaaagtgttttatcagaaggggtgaacattgtgccaagagtctgctgagaggagtaagatgaagactgtgaatttggatttgatgtcatggaggtcattgcgagcttcatcggtgtgttttcagtggagtaataggggcaaaaggctgactggattggcttcaagagataggcagaaatgatgaagtagatgcttgttgaacgggtaaaagtcggataaatgaagaaataatgtcttcgagaggatcccatgatagatcatgaaccaaaatagataaatgagttattctgagtctctgaaaaactcctgagtagaaacaatgatgtgatttcagggtgcaaagctttgcgtaagtgacaagggaattcaggtgggattactcaggcagtagggtgagtctagggagggctgtttatgagttctgttgtgcttgcaattttatctcctcctggcctcagttcatgaaggccttcatgcaagacttctcagaggggggcctcagggacgagctgtccctgcagggacttgggtgtaggattttgagagattattttcaaacacctcttgcaggcatgtggggttcctgagaataagcctttcaggctgacttccgccctttttggggagtgagcagcaccaagtctgcctggtcaggaagaggtgaatgtggaaaacctgatccatccaacatagtgtatttgaaaatgctgtacttcaaaatgtttctctataaaaatgttatattgaaataataatggagatggaccaagtggtcgcctagatttgatgaataagcaggctgtttatagcagttccccactggagtacaacagtaatgaagtatgaagaatacaaacctgggtagaccagacccagactttgattttgtgttgttccctgtgtcattttcctcaaatggtcaaagcttcaaaaggcactttggtaccgattccatatagaatgtgtttttacttacatgactgaggacaatacatttcccttcatagaagcatttttggggatgtccagggcccagactgtgaaacagaaccagccataaagtaactgaacaactcccgttgcaccacatgtcctgccgttctccaaatgcattgtctgctcttatttgttggtgtctttgcccacgctgttccctggaacacccaaatgcccttcgtcctggcatgcttagctctgggaggaccttctgcaggaggccttcctcacccactcatacaaagacagagccccaaaccacatttgcgtgtagttcaatcgccacacctaccacagtgaacttcagtggttttctcttctggctttcccattggactgtgagtttcttgaagcctgtgactttgtcttaattctggggttcctaggttatttttttgcatgccaccacacccagctacggggtctccctgtgttgcccaggctggtcttgaactcctgggcttaagtaatccacccacctcggccttccaaaatgcaggggttacaggtgcgagccatcacacttggcccttgatcctatttctatcctgtgcatctagaatagcgcctgtacagtttgagcacattatcgtgtttattgaatagttgcatgaaggctggagagtgtggatgaatgaatatataaaaagatcagaaaaatgttaccccccaaattgaagctaataaaagaaaaagagtgtcaatgactttacatatatgcagaatttgtacctataatggttttttccacatccggttgagacaagattattgcaacgtaatgtgtatggaaaggggagtgatccatcctgtgacttgtactgtgtgtggcacaagattgtggaatcatgctgatgaacatcagagttgggtagtagggattgattggtttaattctagatttgtgagagagatgtgatctgtgaacatgaactttttttgttgtgttttggttttgtttttgttttttgagatggagtcttgctctgttgctgaggctagagtgcaatggcgcaatctcggctcactgcaacctccacctcctgggttcatgcaattctcctgcctcagcctcccaagtagctgggattacgtgcatgcgccaccatacccggctgatttttgtatttttagtagagatggggtttcaccatgttggccaggctggtcttgaactcctgacctcaggtgatccacctgcctaggcctcccaaagtgctgggattacaagtgtgagccactgcacccggccagaacacatgaacattttggtccttgtcttgtcttttctttctttctttactttttttttttttttttttgacagagtttcactcttcttgcccaggctggagtgcaatggcgtgatctcggctcaccgcaacctccgcctcccgggttcaagtgattctcctgcctcaatctcatgagtagctgggattaaaggcatgtgccaccacgcccagctaattttgtatttttagtagagacaaggtttctccatattggtcaggctggtctcaaactccaaacctcgggtgatctacccacctctgcctctgcctcccaaagtgctgggattacaggtgtgagccactgcgcctggccagaacacatgaacattttggtccttgttatttcttttaagcaaaatattttttcttttaaaattggagcacaaggtacaccttaataaatatgtttatttgaagcatcatttcattattcacggtttttaaatttttcataaaaaattttaaaaataaaccagccgtaacacctctgaagtggaagttacactgaaccaggcatttcatttccaggtgccttggtctctttcatgcataatttgtaaaatgataatagcccttactagtatttacattgtaaaagtgttgttactgtaaattagatagtctaaaatgggttatgatgccttctttgaaagacaagcattacacacaaatgaggtattattatttagttttgccttttcaagctcgttaaatgagaattagatgaaaactctgctttaagcaatattcagcgggtaagtgactattgacttgagtgaaatgaaaaaaaaaattcttcagctgaaaactcagtttgtacagccttgcctatctgtgcacaggcagaaatagtgtatttatatgtgatgtttaccaatgttctttatctcctctctgtgctataatcaaaaactgaagacagttaagcctttcagttcagtcattgtatgcgtcttggaaaacctaagtcatctggaatgattacaacttagaaataatgtttccacgaatcaagtcatgctgctagctttcttactgatttagggcctaaattaactgtgccaggccttcgcttccactcctggttcttaggatgggggacctattcctgcagtgtttcaggttagttaccactaaggcctatgtgcacctcattatcacccccaaccaggcccagggctttcctatcttcttcctggaatacagggataggatggcaggagaaggggtgtttggaaataatatttgaggaattgtggatatcagaaatttcatgggaaggtctgaggtctgaaacagtaccctgggaggattcagggtaacagagagccggtggtgagggacccatccgtacagcatcattgtggcctctgtgtggtctattggctctaacccatttttggcccctgctcttggactccccccgtccctcccctctcattcaaaccccttctggtgtccatccattaggccttgactcaccttcgctccccagggccaaccttcagcattgcttgcagttatagtcatctgctttccacctgacccatttattttggcttctggattttgctcctagagaggccccctgcttggatagctgcctggccagctgcagagccagctgtttgttccagactccaaggtgactacactcctctcttctccctctgactggtcctgatacatgggctgtgacaagaagtgagagatagtgacagtgtgacaattgtgtcagaacagattcatccctctgtaggtcatctcagcagtggactgctcagagttcaggtacacattcatgcttcacagtgggccatggaccaggaagtctgtgtggacctcagaggcctagggacaggggtgggtacagaagaagagttaggaggaggacacaaaaggctaatttggtttgctctgcagttttggccaagaccagtactggtttttgggctactgttcaacagacaggccatgtccttcaagagcattggcaggaggtcagctgagctgacacgcaggtggtaagggacctcagagatcctctgaggtgagcctaatggtggcccaccttccttgcccttgcaaggaaatttagggattatgtcttccacttttaaggcaaactttttgaaacaggtgtctgcatccattggttccatttactcttcaactcactctgacctgactgctgcctccccggaccctgctctctgccaaactggtcagatatctccatggtactcacctgtgggtgcttcttagtctttttcttgctcgatctcttgatagcatttgcctttgtggaccacagcctactccttgaaacatgcttttcccttgttctctggatacctcacaattcttttttccctacctcactggctacaccttctcgctctttttttcaggggtcctttctctgctcatgtcatatagcttggatatttgtgtcctccaaacctcatgttgaaatttcatccccagcattggaggtggggcctggtgggaggtgtttggatcatgggggtggatccctcatgaatggcttggtgcctttcttgctgtgatgagtgagttctcgctctattagttcacatgaacactgatgttcaaaagagcaacacctcctcttctcactcgtgctctctctctggccatgtcatgtgacatgcctggtccccttcaccttctgccgtgagtaaaagcttcctgagatcttgccagaagcagatatgactgccatgcttcttatacggcctgcagaactgtgagccaaataaaccttttttctttagaaattacccagcttcaggcattccttttaagcaacacagaatgaactaacacaccatcctttttttttttgttttgttttctgagacagagtctcgctttgtcgcccaggctggagggcagtggcacgatcttggctcactgcaatctccgcctcccaggttcaagcaattcttctgtctcagcctcccgagtagctgggactataggcgcgtgccaccatgcctggctaatttttttgtctgtatttttagtagagatggggcttcaccgtgttagccaggatggtctccatctcctgatctcgtgatccacccaccttggcctcccaaagtgctgggattacaggtgtgagccactgtacctggcctacaccatcctttatttaagctttggtgttattctgtcttctctctttttctctgctcctacacaccctcccagggcatctcattcatcgctgtgaagtctcttgttgtctgtcatgtatagatgactcctaaatggatatcctccgatttctagatcaaactgcttgctgttgctctgaatgttccccagtcatcacaaaacaaacacgtcaaaggcttaactcagcaccttctctccaaaatctcctcaatttcctcttcatatttttgctgtcttagtgaatgatatccactatccaccaagttgtctaagtcaaaaacctgatctccagtccggactttgccctcttcaaaactccaacatgtaatctatcacgactttcagtagattctacctcctcgagaatgtggcttgtacatttctccataatttggtgctgctcacctttccagtctcatctctgaccactctgagactctctaaactacttttagtactcacatactcagcatgcataatcattcatgttctttccaaaatgtacgtatgttgtgccctccacccaaaacagacttccccacctctttatttggttaactccttcacaccttgtaagtgtctgtgtacaagtcactaacttccaattttccctaaatctgggttaggttacctcctagggctctcagtacttatctcttcataacacgcttctctatcacagctgactttcctgtttctaccgtgccctgtcctgtgaggttcctgtaagtgcttacggggaccttattttttctattcacctttgtattcctaacaccaacaaagtatttggtacaaaaaacagatgctcaagaaatgaatgaatgtgaatgtcaaaggtatcattgtgaaaatataaattaaatttccggctgggtgtggtggctcacaacagtaatcccatcactttgggaggccagggcagcagggttgctgcagcccaggagtttgagaccagcctgggcaacatggcaagtctctctctacaaaaacaaaaaaaaggcagggcacggtggctcacgcctgtaatcccaacactgggaggtcgaggtgggcagatcacctgaggtcaggagtttgagaccagcctggccaaaatggcaaaaccctgtctctactaaaaatacaagaaacacattagccagatgtggtggtgtgtgcctgtaattccagctactcggggggctgaagcaagagaatcgcttgaatctgggaggcggagcttgcagtgagccaagatcgcgccactgtacttcagcctgggtgacagagcgagactccatttcaaaaaaaaaaaattaaaatgataataataatttaaaaaaattaggccggtcgcggtggctcatgcctgtaatcccagcactttgggaggccgagacgggcggatcacaaggtcaggagatcgagatcatcctggttaacacggtgaaacctcgtctctactaaaaatacaaaaaattagctgggcgtgtaggcgggcgcctgtagtcccagctactcgggaggctgaggcaggagaatggcgtgaacccgggaagcagagcttgcagtgagctgagatcgccccactgcactccagcctgggcaacagagcaagactatgtctcaaaagaaaacaaaaaaggaattgcaagcagagggcaattaatagaggtagacttcacatctgtcccttgtgggcttcttttccagagttccatatccagactctcaaaccatgttttgggatcatccaaacattccatcctcctgactccataaactattggattcataacctgctccatgcttgaaaacatggggattggaattcggtaagtgttgatgttttagttttttctttctttagttgtcaaaaaagtactgtacctatatagtaatgcttttcaaattcttctctctggagtcttcatcagaagatgtgactggagtcctcactagtctagttgttttcacaatgtttgaatatgctatgtgtacaaagaaatgttgtgaagtcttctgaggaattccatcctttcacattttctcctctgtttcatgagtatttaaattctttggctgggcgcagtggctcatgtctgtaatcccagcactttgggaggccgaggccggcaaatcacgaggtcaggagttcgagaccagcctggttaacatggtgaaaccccatctctactaaaaatacaaaaaattgctgggcatggtggcaggtgcctgtaattccgctacttgggaggttgaggcaggagaatcgcttgaacccaggaggcagaagttgcagcgagccaagatcgtgccactgcatgccagcccaggcgacagtgcgagactccatctcaaaaaaaagaaaaaattcttcatcattgctctattgatattttctaaagtgacttcacatagagaaaagtggatttttggctgggcacagtagctcatgcgtgtaatcctagtgttttggaaggccaaggcagaaggattgcttgaggctggaaatccaagatcagcctgggcaacatagcaagaccccatctctacaaaaatttaaaaattatctaggactacaggtggcatgtgcctatagacccagctacttgggaggctgaggcaggaggatcacttgagaccaggagttcaaggctgcagtgagccatgatcacaacactgcactctagcctaggcaacagagcaagaccttatctcaaaaaaaataaaaataaaaataaaagtggattttgagaatcagaaagacttgctgcccactctgggccagtttaataatgcaggacatgtgtagttcaaccatactccaaaaacaactctgttttagccatactgcctatcgtcaaccccactgcatccccactgtcaaatttctctagccccataactgattttgtttttcataacacttctttgtttgttgtctacctcctttcctagaatgtaagcattatgagggcaggcaatttttttgttcagcactagatgctcagcacttggaacagtaactggtacacagaaggcactcagtaaatattttttgattgaatgaatgatgtattttaaaagtttttcttttggccgggctcagtggctcacacctataatcccagcactttgggaggctgaggcgggcggatcatgaggtcaggagatcgagaccatcctgtgaaaccccgtctctactaaaaaaaaatacaaaaaattagccgggcgtggtggtgggcgcctgtagtcccagctactcgggaggccaaggaaggagaatggcatgaacctgggaggcggaacttgcagtgagccaagatcatgccactgcactccagcctgggtgacagagcaggactgtgtctcaaaaaaaaaaaaaaagtttttctttttaatttttatacttttaaaaatagagatgaggttttgctatgttacccaggctggtcttgaactcctggcctcaagcaatcctcctgcctcaacctcccaaagcgctggggttacaagtacatttttgagccaccacacctggcccttgtgttttgtttgtttttttctttttaaagaggctgatgcaggccgggtacagtggctcacacctgtaatctcagcactttgagagggcgaggtgggcggatcacctgagatcaggagttcaagaccagcctgaccaacgtggagaaaccccgtgtctactaaaaatacaaaattagccaggcgtggtggcacacgcctgtaatcccagctactcaggaggctgaagcaggagaatcgcttgaacccggtaggcagaagttgcagtgagccaagattgcaccattgcactccagcctgggcaacaggattgaaactccatcccccaaccagcaacaacaaccacaacaacaacaacaacaacaacaaagaggctgatgcatattcggatctccagggatctaatgaaaatctgctttttccccgaacacttatatcgatgactaagacaataacattgatggcctgccgaacaaatttacagatgacacacactagaaagaattacaaataggttggaggatacaatcagattctctccccacccccaatcctgacaaaatgtaataatgaatcatatcaaacaatatagagtttaatgtgtaccaatataaagtactcaaagatcctcgaattgtacaggtactgagtgggggcgaggtggcttacagctacacacggcacgaagatttacagtctcctgttgattgtaagaagatgagtcaacacagtgggatgtagctttaaaaaaaaatcaatcttttgttgtattaatagaaatgtaacgttcgagaggggaactagttctctagtactcactgatgatcagaccacatttattgtgttttatgaattctgggcttcagacattcagagacattgatcaacaaaggattatatgggaaaaataaaaatgataataagaaatctggtgcacagagttattcagaaataacaaaaagatccaaggttttatgtaggtgtgtaagggggatggtgataactagcatatgtagctacctttcaaagtttgaggtctatccggcagaggagagatttgatctcttctgggtaatcccaaatggcagattgagggccaatgagtggagatgtaagcacgtacatttcaacccattaacattggtcaactgttagatttgcctagcagacaaatggacaaccactggaggtagtaaattccctgaccctggtgcccggaagtggggcagtcatgccccattcactgggtacatttgtgacagaagttcaaacactagagtgaggaagtgaggagaatagatttgtttataatagcaaacacatagtgagtgtgtactgtatggcaaacaccataatacgtgattaatgaggttgtcatttctaatacatcaatcccactagctcattttacagatgagaaagtgaggcttagagggattaagcaatttgcccaaggtcttacaccttggtacaaagcagatctaggatttgaacccaggcagtcagatcccaaaccttaattattattctatgaggaccctaaggtgggcatggtggtacacgcttatagtcccagatactggggaggctgaggcaggagaatcactagaatccaggagttcaagactgcagtgagctatgatcatgccactgcactccagcttgggcatcagagcgagacattgtctctaaaataagtaaataaaaataaaagtaaagtataaggactttcacttctagaaagccgttctttcccaccttgagatcctatcactctaatgaaataatcaaaccgaggagtttatctcaaagggtggatgattctatagtacatagattccctctatatgtaatatgcaggaactgtattagtctggccatttgccacttgggtatactgtatggagcccagcataggacttggcacacagtaggtgcttgctaattatttattaagtgaaaagaatgaacaaatgcaacaaatacaacattggcgggatctgaaatgacagaacctcaatatattgtgcctgaagaaaagcacatttctgggtggtctactgaggaccctcagcaaaagtgataatccgtcactcccggcaaaggccttgagaattcctgtgcaattgtttgaacaatattcatttaaacaaatatttattgaatactggtcctgtaccaggtatgtccaatgtgtgaaggatgcagaggtgaattggaggatgtgctgtcagtgggggagaagacaggtgggcaaatccttacagtaccttgtgacaaatgctatagcagttgcgtgtatgttttttaagtatgatggaagcaaagaacagaaaggaaatgattctgctaggttaaaggagtcatctgatatttgattatgttttatttatttatttacttttattattattaattttttttgagatagggtctccctctgttgcccaggctggagtgcaatggcacagtctcagcaaccttcatctcctgggttcaagcgattcttctccctcagcctcccaagtagctgggattacaggcgcctgccaccacacccagctattttttttttttttttgtatttttagtagagacagggtttcaccatgtcatgctagtcttgaactcctgacctcaggtgatccacccgcctcgacctcccaaagggctgggattataggtgtgagccactgcccccagccgttgatgatgtcttaaaaatagcttccacatgtatgttacttgagtttattcagtcttcataaagaccatgtgagattgtgaccccttcttgtacagaagatgaaatagagtcttacagagcttaggtgagctccccagggtcatatagctagtaataataattgcccacattgattgagtgtttagaatatctgcgactctgttctaaaccatcttaagacatttaatcttctaaggtagttattgacatcatcaccattttataaataagaaaaccaagtcacaagatttaagagacttgcctacagtcacatagctagaaagtggaaaaccaggatttccacccacacagtctgactttagcaggcagacactgatccactgcactaaattgccttgtctggttccccaaagagctggaactgacacacttggactctgattccaagttcagttctctttcaagtgaccctgctcattagcagatactgcatccaaatgagaagaaatggtcatgtggatacaaggaggcttgtgtagttcctgcatctgtggtatggtgctgtggtgggagggctatggtgaagtctgtaacatgcatgaacttaagcactgacaagcattatggcataagctttagattttctatgttttaggtattcagggttttttcagggcagtcagatttttttctttcgttttgtttttgagacagagtttcgctctgttgccctggctggagtgcagtggcataattatgggtcactgtaacctggaactcttgggctcaagtcatcctcccgcctcagcttctcgaagagctgggattacaggcatgaactaccacatctgcagaatttggcctgttctccaggccagcatcctaggctctatggactatgacttgttactcataggaactagccaccaacacttaccctgcagccttttggctggtttaaatttttctaaaaagaagacaagacataaaacattaagaatgaaacaagttaaattcaatacctatatattaacaggaatggaataccgaaatggagaaataaagcacataattgtttaaattgcccagctttctctccataataaaaattattggattgaaaaaccattcagggatggacacggtgactcatgcctgttctcccaacactttgggaggtcaaggtgggaggatcacttgagcccaggggtttgagaccagcctgggcaacatagcgagaccctgtctctaaaaaaatttagaattagccaggcgtggtggtgcacagctgtagtcccagctacttgggaggctgaagtggaagaatcacttgaaccccaggaggtcaaggctgcagtgagccacgattgtgcaactacactccagcttgggtgacagggtgagacccagtctccaaagaaaaaagaagaaaaagaaaaatagttcaatctaatattattgtgccttaacaattaagttggtctggctctgtggcgaatctgagaaagaattggtttttaaaacgaatgaaggagtttccttcttctttaataattactacttatattaatgtggacatgacctatatgatcgaagatattgtgtctttaaaatggccatctctcagaatttttggagatttggtcattttaaaatcagtcgcaggctcggatttctggggcaggcggtggggcagaaaaggtcagtgttgtttggtattcaacgcaggtggggttttggtatggcttggtttttggcattttgttttgccatttatggagatttagtagattcaactgattatcttggcctttgtgtttgtggatttctattttcttggcttcagttccttggaaacgtttgttttgatggtggcaggagagctggtttagtcatgttttatttttgttgttcctatttatttctaatatcctttacttcaagtccacttacaaagtatcatgtaacctgtctttatgtctccacaaatgaaatgttcctagtagcaactctagtgtaaccttataggaatagttaatttgatgcccatcgagatggttctgtagtattagaacaagggtatgttttggaaattatgtttgaaatttatcattggatttagcatttagcaaatgaaatttcaagtgtctgagatcaacaagtagccatattcatataaacatattttccttttcattgctgagtcaacaaaagttggaaaattattttctcacacatattccattcttcaactaaacctgaaggtaaattacttttaaaaaccacattccaaacaaacagtttttcataaagctatgagtacatgaatagagtgggccccactggcatttgggatgtacatgtaattagaactctcagtttttcaaacatgtaatttactacagttgaggtttttaattcttaactttgagtccattgggatgaaacaagtgacccttgttggaagtatgtcaagaatcaactttctcaggttgacctttagtttgctggtcatcaaattaaaacactgtgtattcccaggcttgaagatgttggaagcttcctaagtttgttaaaagatcaaggcagaaggctagcgctgctttgctgctgtgaagaacagacttccctcttccttctcctttaagttggtttctgcctgagagagagcatgctccacctcagctggccccgtctttgctctgatagttgccttgtacttgttttcgcaactagatagatgtctatcatcctttgaactgatttgacatcctttctagtacaaggctcagtactaggcaccaaggactgttacaaacgctctcaatcaccattgttcataacttaaaagtggcaacaaaatctggaataactcaatgactgcgtgaccttgagcaagcaacttaatctctctctaaaataatgatttcaagcctaggcaacatggcaaaaccctgtctctacaaaaaatacacaaattagctgggcatggtggtatgcacctgtagtcccagctactaaggaggctgaagtgaaaggatcccctgagcccaggaggtcaagactgcagtgagctatgatggcaccactgcactccagcttgggtgacagatgaagaccctgtctcaaacaaacaaacaaacaaacaaacaataataaaatagctatttcacaaagtcattgtactaaacacttgggattgcatatgaaaatacttagcacaaagcttggaacataattgcaagtgtagattgagtttatgtgcagtatataataatccatggaaactcaaatggacagatggacccaaatcaaaattgtctgcttctagccatttgttaaatcaaagcttcactttcaaatgaataactaaatctacccatgatttctctttaaagtctacattcagagcaaaaaagtgcttccatgataatctgttcatagatttcataacaggagctgacgagggtttatttaggagaaaacgtgaacaagcagaagaaggaagattagataaataaaatgtctttcaaaataaatgaagaagggacaattatctgataatagaacattcagatggtgatgtaattataaaatagacttgtttttgtaagtggtttaaaaaatgtttattgaccttaaaggaataactttttcataattgaatgataaaacatgcagtatcttgtattaactagtaataaactacaaatatccgttaactatatttttctttaagtgcatctgctgtcatggccttacatttatttcagtgatacaaaaagagtgatttgatttgataactgcctgtcctctctgcatatccgaaaatcggaaggagcagccttccctctgactcacttagctgtgaaaataggactctgccaaattactgggaactaacactgtagtaaaaccataagaaaattttgctaagaaaccttttctcatctgcaaattacttgactgaaacctgaggtgctggatttcagcacaaaggtgactttggaggggaaattttgtgccaaactggatctgttgtttttgtgttatgtaaaaaggagaaaaaaaatgaactgtttactcctaagctataaatttaagattatcctattacaccaaatgacagaatttccgaacctcaaaccttactttagagctatattttcataaactatgatctgtacccaatcaaaactagatgtaattgaatgttaaataattagccttgcccaattatatttaaagagtactggacaaagttattttattcactgcatcagaagtgaattatagttgaattgcagaaatggcaatacatgtgcagtataaaaatatagaatacagagtagtaaaaagaagaaaataaaaatcaccaagtcacccataattctatcactcagagatatcatcattaaaattttgttttaaatttatgcacgcatacaaacacacacatgcacactcatacacacaccagaatattcacgatatataaatgcatgttaatggtttattatagaaaagtgaaacataaggaaaagtagacagaaagcataaaggaccccatgtcaagttggacctcatgtctagcccatcaatatcccattcctctccccatctcattttattttgaagcaagttccagatattatattatttcatccataaattttgatatggctgggtgtggtggctcattcctataatcccaacactttcagaggctggggcaggaggatcacttgaggccattagtttgagcccagcctggtctacatagcaagactttgcctctacaaaaaattaaaaaattagctgtatgtggtggtgagtgcctataatcccaactaccaggagaataaggtgggaggatcatttgagcccaggagttcaagactgcagtgagctacaattgtgccactgtactccagcctgggtgacagactgagaccctgtctaaaatgtatatatttcaatatgaatctttaaaagataaggacttgtaaaaaacataaccattatcatatctacattaactaatacaattttttagtagtatgaaatattcagtgttggaattttaaattgtcttacaaattttataacttacttttgttgttgttgttgtttctttttttctttttttttttttttggagacggagtctcgctctgtcacccgggctggagtgcagtggcatgatcttggctcactgcaacctccacctcctggggtcaagcgattctcctgccttagcctcccgagtagctgagattacaggcacgctccaccatgctcggctaatttttatatttttagtacagacagggtttcaccatgttggccagggtgctctcgaactcctgacctcgtgatccaccctgctcggcctcccaaagtataacttacttttgtagtttgcttgttgaagcaagatccaaataaggttcatacactgaagttggttgatatgtcccttaaatctcttttaatttaaatcccttaaatctcttttaatttcatttttttcctcataacttatttgttgcaaaaaccaagttgtttgtcctgtagaacttcccacagtctggatgtttctgattgcattcctatgatatagctcaacatgttcctctgtacaggcttaatcagattcatatatatatatatattttttttttttttggcaagactgcttcctagggagtggagtattttgccattaggtggtacataaaaatctcttcttttgtgatgttacctagatccattagttcattaaggattgtaaaaatggtaatattttaatcctatcattccttaagttgattttttggcatgtgccaatggtgtttgctttgtcttatttttaagtaacttttgttttctctattgtaattataatttgaactcattcattgaaatgtatttaatgtgcttctgtacatattatttattattcttattaatgcttaaattatcctcattggtctgtgatagcatcttcaaattggttcctgacatcttttgactcaacccaagcagtttttgatagctttcctgctatttggtacaagatggcataggctcatcttgaatatttccacatagtagaaattacttatatttaagatgtgaatatatatacatataatacaaaaccttagggcagaaactatttatgataccaaaagagtagaaataaccccaatgtctattaatggaggactggttgaataaactatgatacctacacacaatggagtctgtgtagctacaaaatgaaagtaggttttttttggttttttttttttttttgagaaggagtcttgctctgttgctgaggctagagtgcagtggcactatcttggctcactgcaacctccgcctcctgggttcaagtgattctcctgcctcagcttcctgagtagctaggattacaggcgtgcaccaccatgcttagctaatttttgtatttttagtagagatggggtttcaccaggctggccaggctggtcttgaactgctgacttcaggcaatctgcctgccttggcctcccaaagtactgggattataggcatgagccactgcacctggccagaagtaggatctttaaatatatttattatggattgatctgtaggatatattacaaaaaaatggggggaggaatgtgagtctacgatgctaccatacaggtcagaagggatatatatgtaaatgtatatacatacacgcatatatgcatgcatacacacacatatgtaaatacatttgcttatattagaaaacaaagaataggaggattcacatcacaaaatattaatagtagttacctgtaaaaaatggaggaaagaaagtggaggggatagggatagaaactagacttcttagaattcaccttgttttgtagatttgactttggccaggctggtctcgaactcctaacctcagatgatccacccgccttggcctcccaaagtgccgagattacaggtgtgagccaccgccccggcctaattgtggtaattctaatcttactatgcctgctgtccttgagaagcaggattctcagcatgagaggaagggaatatagatgtaacatggaggaggttaggcagaaatcctgtggtcctgaatttgaattgagagttgatataaatttagggtgtctatgtacatgtatagacatgtctcctaggtcctctgttcactgaaaaacctagacacaatgactaagccagaagcaatgagcactcttgttatctatattatgatatgatatatgatatacatacacatgtatcataaatatatattcatatatacataaattccatgtatgtgtagcatcaattatttagctattcttctatttctggtcatttagatgttcccaattctttacacttatatataataagtgtggcaaagcaattgtgtatttatcatttccttcatacacttttttgtaagtagaattacccgactagagggtaggaacatgtttaaactcttgattagttttgtcagatcacctccagaaaggttataccaggttacatggtaagtggcagtgggggagagagtgactgattcactgcattaatagttatagacattttagacatttacactgacatagttctgccaatctatgtcaggtagaactgtgccttttttgtttttccctttttgatgttcttatagagaaatttaaaaaatcaataataccatatggaaaaattacactgctgtaacattttcatatttacattaataactgtatatttggctccttaaaagtcctacttatttgccctttatatctcaagaaaatcctgcgaagtgctcctttacttgtacaattttatgtgtatatggaagagctatttcatcaccaagctattctgcatttgaaacgaaggaggaaatagtttatccctccatgaagtggtattgacaggaagcaatccacaaagattagaatgggcttgtcaaacttaatgtattccttataattaatgcactgaattataaatcctttagttgtaaacatacatatatcgtgaatgtattaagatctgaatttttatatctttttggtaattttggcagctatctttgaaattcctgggattttttattgtaaccttaccttcacagaactcattatatgtgaaactttattttccaaacatagtttaggaaattaactaactttgtaaacactattttacatgtaccttctatatacaactgaaccatgattatgaaagaaaaaaaaagtagattataggcaaaatcatagactgttacagctagagcgatcttaaagatcgtctggcctaaccccttcattttatactttagaaaacgaagacaaagggcagttatgtaacttcattaaagtcatacagctactttgtgagagtgtgacaaaaacccaaactgatatggtacagtgtctcctttccacgtcgcttctcagagttagcaaaagttgaaggcaatacgcaaaaccaaaaataattgtcgtgttagggaaatgggatttggcgtgtctaccttcaaaatttgattatgtcacttttttgataaaaattctatagagaatggatcaacaactacattataaaattaggtaaaagagcacctttgttatttgggaagctagaaataaattatgggttttccaatacttagcagggatttgtagcaatcaaaatgcagacaatcagtgacttgttagggatgcaaaagtcattgcgggttttgctattattttaatagcaaaaaatgcaattatttttgcatcaacctaatacaatagtttatcatgattttttgactttacaatggtgtgaaagtgacaagtattcgaccaggcgcggtggctcactcctgtaatcccagcactttgggaggccaaggcaggtggatcacgaggtcaggagatcgagaccatcctggcaaacacggtgaaaccccgtctctactaaaaaatacaaaaaattagccgggcgtggaggcgagatcgcgccactgcactccagcctgggtgacagagcaagactctgtctcaaaaaaaaaaaaaaaaaaaaaaagaaaagtgacaggcattcagcaggaaccatatgtcaaatttggaatcttcatcttttcctgggctagcgatgtgcagatactactctctcgtgaagctgggccaaatcacctaacgcaaagcccattttataataaagtgttgaatttctcatgtaatttactgactactgtattgcaagtgttctgaacatgtttcaggtaggctctgctaagccgcgatgtgcagtaggttaagtgtattacatgcttttttgacttttgttattttcaacctacgatgggtttatcaggacataaccccattgtaagttgaggagcacctgtacacagcatctgagtgcttcatgtatgtattcataggcactgttttaagtactttgtttgcattatcttgatgagttctaaccataatctcaaggacagagagagtgtgtgacttgcccccaggtaatcttaagaatgtcagactcaagatttgaacctaggcagtcacagacacagtgggttatttgaagtttcaagcctcaactgtcattgtcgccgctactgagggttgctgtggttgtctaactccccccagctgtcttcctacaggatcaaatgttctacttgagaaattcttacatagccaggcatgatggcttacgcctgtaatcccagcactttgggatgctgaggcaggcagatcacttgaagccaggagttcaaaaccagtccgggcaacatggtgaagccctgtctctacaaaaaatacaaaaaataaaataaaataaaaatgtagctgggtgtggcagtgtgtgcctatagtcccagctacttgggatgctgaggtgggaggatcacctgaacccaggaggtcaaggctgcagtgagccatgttcacaatactgcactccagcccggctgacagagagagacactgtcttaaaaataaaaaaattccttagagcaaaaatttttagagacagtctgccttcacctgccacttgctatatgatttttcattcctcatctgtaacataggtgtgatatctacctcatagaattgttggaggactaaatgagagaaatcgtatccattttttggtggaatagctgacacacagttatcatcagctatggtcatcattattagtattattaatatcatcaccaacattatcattattgtttctttctctccttttgacctcttttttcatgcaaaagctcctgaaaaggataatacattacccgagaagctggtgactcatcagttgtttttttcctaacagaagagagcagagaggtattaaggcagaaggaaagaaagaggtagagagacctcaaagacaacttagagcagagttttaccccaaattagttgggatacatttacaaaacagttcatttggagtctagtctcgtatttggcatctgtaatctttattgggtttccggagcctattaaggaatgagcaagggcactgctagcagtggtgacagaccttctgtccctgcccgaggaatcccgtccactgtggccacctgcctatccatgctgcagtgggaagtgggcaacaatcctccgcaagctcttctgtttactgtgcctggaaacgggcgttttgccatggaaaaatttctcattgtacccgtaagtacagaacacatattgcacaatacgaaagatcttattgagacttcttgttaggccaggcgctcaagcctgtaatcccagcacttggggaggctgaggcaggcggatcacctgacgtcaggagttcaaaactagcctggccaagaaggcaaaaccctgtctctactaaaaatataaaaaaatcagctgggcatggtggcaaagtcccagctattctggaggctgaggcaggagaatcacttgaacctgggaggcagatgttgcagtgagctgaggtcacgccattgcactccagcctgggctacagagtgaaactccatctcaaacaaacaaacaaacaaacaaacttcttattaacctgtgtacatactgtgcttcaagagtaggactgagtgccattcctgaggtgtcattccactctttactcaggggttaaaagtctaaaggtgacccgcagtcacatcctcacttttttctctagatcacacactttccactgatgcctaaagtcttactgtttaatgccaccagcttctccctcaggtcaagtattcttattttctgtatttcatttttcacttttcacctttatgaaaaggactgagcacatggtagaatagaaaatggtgcaaaaactgttcagtgaaaggtgcatctcatttccatccaggctgcccagtgccattggccagaattgccaaccatttgttcattcactcagaaagtgtgatggggtgcattgtctgtgctagccactgtttggggtgcttggaatctagcagcatacaaatagattagatccctgccttctagtaggggttgatgggctacaagcaacatatatgagcaagttattatagggtaggttagaaagtgatgaatgcagcctgggcaacatggtgaaaccttgtctctacaaaaaaatttaaaaaaaaattagctgggtgtggtggcacacctgtagtcctagctactagggaggctgaagtgagaggatcgcctgagcccggaggtggaggttgcagtaagccgagatcgtgccactgcacttcagcctggacaacagagagaccctgtctcaaaaagaaaaaaagaaaaagaaagtgactaatgctatggacagaaataagcaagggtgggggacaggctgatcaggttcacttatgaaatatctatcacacaagctaagtgtccatcaacagatgaatggataaagaaaatgtggatacacacacacacacacagacacacacatacaatggactattattcagccatttaaaaaatgaaatcatgtcatttgcagcaacatggatggaactggaggtcattttgttaagtgaaataagccaggcacagtgagacaaatatcaaatgttctcactcatatctgagagctaaaaatgtggatctcatggaggtggagagtaggatggtggttaccagaggctgggaagggaagggggagtgggggaggaagggatgttggctaatgggtacaaacatagaattagatagtagaaataaattatagtattcagcagtacagtagggaaattaaagttgactataatttattatatatttcaaaatagctatcaggtttcaaaatatcacatgtaccccaacaatatgtacgactattatatatcaattttcttaaagtcataaacattataatgggaaaaaaaatagtatataccactggccagaaattctcctgagcactttacatatgttaactatctgaatcctcataacaagcccaggcactcttatcatcgtcattgtaaagggaaactgaggcacagaagaggtaggaacatggctcaaagtcacaaagcgaatgagtaatgagacctgggctttcacacaggctgcctggctccagagcccgagcctagctccagaacacttccgtcatcctagaaaaaaaaaactcccatgcctggtagagtcactctcaattctctcctaaccacagaccctggcaaccacttatctgctttctggctctatggatttgcctaatgtaaatattcatataaatggaatcatgtaatatgtggccttttgtgactggcttctttcactgagcataatgttttcaaggttcatccatattgtatcagtccttcattccttgttgtggctgaaaaagattccattgtatgaatataccacatgctgtttatccattcatcagctcttgggcatttgggtggtttccatttcttggctattgtaaataatgctgctgtgtacctttgtgtacaagcttttgtggaaatgtacattttataattttcttgggtacatacctaggagaattattcagttgtaagggaactctatgtttaacttattttattattattattaattattattattattattattattattattattattattattttgagacagggtctcactctgtcactcaggctagagtgcagtggtgcgatcttggcttactgcaacctctgcctcccaggcttagcctattctcccacctcagcctcctgagtagctgggactataggcatgtgccaccacactgtgcttttttttttttttttttggcattttttgtagagacagggtttcaccaggttgaccagtctggtctcaaactcctaagctcaagcaatccacctgtctcagcctcccaaagtcctggtattacaggcatgagccaccgcacctggccctatgtttaatttaacaaatcaacttttgatcacatgtattacttagctaagcctctctactcagaaggggagaagtataggagcaagtggttgctttagcaaatgtcctatcctgtcctatcaatatgatggtgtctccttcttggggtttcataagtcagtaccctgaaggtcattgacactccatgtgtgtattttctatgcagaacccccacggaggccacttttggtcgccttctccatacaatagatggggagtgaccataaggaagtaccccttaaagtaactaaagagctcaagcttgagcagtggaacctctccaggtacttctaagagcaggacagacagggtcagtctagagaagtgaatgctttgagaagattacacagtcctctaacaataacatccatgatgattttgtagaattctctatgcctagcataatgctaaatgagtcacagcctttttcctagacttgcactctccggtatggtagccacgggtcacatgtggctatcaagcgcttgaaatatggttagtctgaattaaggtatgctatacaggttgagtatccctaatctaaaaattcaaaatataaaatgctccaaaatccaaaactttttgaggactatgatgctacaagtggcattgttggtggtgacaaagcctgctgttctctgctattgctgctgtttagcaagtgatacaggtattctttttttattttttattttttttgagacggagtctcgctctgtcgcccaggctggagtgcagtggtgcgatctcggctcactgcaagctccgccttccgggttcaggccattctcctgcctcagcctcccgagtagctgggactacaggcgcccgccaccacgcccagctaattttttgtatttttagtagggacggggtttcaccgtggtctcgatctcctgacctcgtgatccgcccgcctcggcctcccaaagtgctgggattacaggcgtgagccacaatgcctggccgtgacacaggtattctaagggatgctgctgtgctgattagtaactctgaacacattgtttttttcactattttaatagtatgttatatatacatatatacacatatatatacgtgtgtgtgtgtgtatatatatatatatatatatatatatatatatatatgtaacagagtgatatacaaatatatatatatatatacacacacacacatatatatatgtatatcactctgttacctaggccggagtgcagtggcacgatctaggctcactgcaacctccgcctcctgagttcaagcgatcctcctgggttcaagcagttctcctgcctcagcctctggagtagctggaattacaggcgtgcaccaccaagcccggctaatttttgtatttttagtagagacggggtttcatcatgttggccaggctggtctcgaactcctggcctcaagtgattcagccacctggacctctcaaaatgctggaattataggaatgaaccaacacgctcatggtgtgttatattttttactgttaagtacttatgtctaaataaacgtgagaaaatgattgcttatcagtagcacataaatgagcgtcaggaatgatgttgccaaacaagcacagattgtcccatgggtggttgagatagtgacacctttggtttctgatcattcgattgataaaaactttgtttcatgcacaaaattattaacagtattatataaaattaccttcaggccatgtgtataatatgtatatgaaacacacatgatttttgaatttagacttgggtcttattcccgagatatctcatttatgtatatgcagatattccaaaatctgaaatccgaaatacttgtggtcccaagcatttcgaataagagatgctcaacctgtacgtgtgaaatacacattggacttcgaaaacttagtgcaaaaaacagaatgtaaaatactcatgaacattttttacatgttgaaatgatattttggacatgagttaagtaaaatatagcactaaaattaattttgcctatttctttttacttttcttaatgggctactagaaaatgttaaatcacacatgtggctcacattgtggcttccattatgtttctattggacagcactggttctagacaagtcctcacagttatcttatcagctggatggtattatcatccttctattatgggtgaggaaattgaagcttagagcgcttaagtcaattacctatgatcatacagctgtggcttaagcgcaactctgtctccaattctgaattcttacccattgctctaggctgtctccccatagtccagaaatgtaacccaagtgatagaaaaatggttaggatcattagctgtggcaaaaggctgttttcatatcttcattgtagagcacaggaaaaatggtctatgaagttctgtaaagtagaatttagggtgcagttggaggaaattgcctatgagaaagtttcttaaatactaactcctgtttgtaatggttcggggctcacccactgaggatcgaaggtagaaggaactatttcagagcttgctttcatttctacgattctatcacaattgacattagattcacaggtcagcctctgctgtaacattcagattgagatggagtagactgagatgaatgagtgcttcattttcatcccttttccctgtaaagtggagggttttaatttcatcccatttcattcgaatttgtgaaaacctcaataggacattcttcacagcaatcctgccctcttctaagtttcagtggagaggagagacaaaactgtcaaggagagaaaccattctctgaaatattaagccattctctaaaatattaaaccattctctaaaatatatattttaacttggtaaaatcttctttttcctaagggcatcagtgttcttcgctcacaagtaactctcgtgtgtatatcattaatgctaacgattactagttgttaaatgctatgacaattttatttgcattttacatatattatacttgtatataacatgtatcacgggtataatttactttttaaacttcaaataccgaagaggatgcccagtttagaacagtagctccttgggctatttttccaagttgggaaggcagggggaggattggaataattgcaaattaagctttgccacagggcctcgttcccaaatgtttaaaccctctcatattattaggggctaaaaatgttgctaagagcttttaaacagaaaaatagacttacttgctttgtttttgtttttgttttttcttgagacagggtctcactctgtcactgaggctggagtgcagtggcaagatctaagctcactgcaacctctgctccttgggctcaagcaaccctcccaactcagcttcctgagtagctgggactacaggcacacaccaccatgcctagctaatttttgtatcttttttggtagagatgtggtctcactatgttagccaggctggtctcaaaaccttgatctcaagcaatctgcctgccttggcctcccaaagtactaggattacaggtgtgtgctgccacacccggccacttatttgttttttatttcttcccccagactacaactttatagcttaccaagaaacatggcaactggactcctataagattaatgcaagccaaaaatcaagccctaagaagctaaaacgtttctagacatatatgtgccattttttttgttgtttgtttctattttattttttattcaggatcagatttttagtgccccttcattaggttcactttggcttaaatagctacatggaaaatacattccagcatttgttttttgtttagtcactcttccataaaattccttagcggtttcaaatgtcattcagatgagatgacaatgaatcatagaaggaagacagagagagaatggtattgggaaagggatagggagctgggaatcagatgacctgaattctagttctgttgcaagaacaaattggcaacaaggccctggagaattcaagtccacaaacctttcttggaaacctactatgttcaaggcattgaaataagtgctgtaggagcaacaacgatgaacaagacacggatcctcaaggagcttatcacctggcaggaaggaaagtatattcacaaaatgatagtataatgtggtacagaatgtgtgagtagtggaatagaacttatggggcacagaagaaaaaaaacatcattccagccagggagagtggggatggcttcatgaagaaagtgatatttgggatcccggaagtgtgggtaggatttctgggtggggctttgagggaagggtgttttcgttgttgttgttttcttttgcttttttgagacagagtttcactcttgttgcccaggctggagtgtaatggcgcgatctctgctcactgcaacctctgcctcccaggttcaagcgattttcctgcctcagcctcctgagtagctgggattacaggcacgcgataccatgcctggctaattttttgtatttttaatagaaacagaatttcaccatgttggccaggctggtctcgaactcctgaccttgtgatctgcccgcctcggccttccaaagtgctaggattacaggcgtgagccaccacgcccggcccaagggaagagtgttttacacagaaggtgtagggaagtggagacgatgtaagcaaaaatgtacagtaataaagtacagagctggttcaaggaacttgttaggaaggcacagttaattctgaataaaacaatgggagataagttttgagcactagattaagatcaaattgtggtagggcttgaattccagtctgaagaatttagaccttttgagtggtgaagagcagggagacaaataagataacacgagtgatcagctttgctaggaagattgttctagcggcaccgggtggtacgagggtgagcagaaaggtagaaggccgggagatgagttagaaaacggttatggggctaggcacggtagctcatgcctgtaatcccagcactttgggaggccaaggcagtcagatcgcttgagcccaggaattcgagactagccggggcaacatggcgaaaccccatctctacaaaaaatacaaatgttagctgagagtggcagtgtgcacctgtggttccggctgtgcaggaggctgagatgggaggactgcttgaacctgggaggtcgaggctgcaatgagctgtgatcatgcccatgcactccagcctgggagactctgtttcaaaaaaaaaagaaaatgattatggtaggcttttggcggtaggaatggacagagaaggcaaatgcaagagacattccagagggagtattgacagagcttggcgacaattggttttgggatgtaaaagattactatggttttgagcattggtgagtcagaggatggagatgctgagactgtaggaggtttgccgggaaagatgctgagtttgatttcgagcacatttagcccattccgaacacactggctaacgtaatcatataaaacacaggccaattcccaaatcccctctgctcaaaacccttcaatgccttctcatcttactcagagtaaaagaaacatccttacaatggctgataaagccttcaatggcctggctgcccacattgcctctgagctcatctccttccttacccgcttctcgctgggcactgccaccctggccttcttgctgttccccaaacattgcccgacatgggtctgtcttagggcctttcttagtgttttctctgcctgaaaccctctttcctcgggcagttcttacaccttaatccctcacttcttttggctcttattcaaatatgttttgttttgtttttgagacagagtttcgctcttgttgcccaggctggagtgcagtggcacgatctcggctcactgcaacctccgtctcctgggttcaagtgactctcctgcctcagcctccccaatagctgggattacaggtgcccaccaccatgctgggctactttttgtatttttagtagagacaggatgggattttaccatgttggccaggctgatctcaaactcttgacctcaggtgatctgcctgccatggcctcccaaaatgctgggattacaggtgtgagccactgcgtccggcctaagtatcatctttttagaaaggcctttcctgatcatcctgtacagaacagcaacacttcccccgccacatcccctctctccagtttcctcttccccattgtactgatcagcatctgacatactatttgtttacttgcttatatcacaacctggaaactgaagctgtaaaaaaaaaaaattaatgaaatgatccactgttttcaagggtatgatgaggtttgctacctcatgagtacaccattacaccattcttgggactgggcattgttataatccctttgaaaagcaatttggcagtaagtataaagagtcataaaatgtccatctcctgcaacgttttatgttttgaaaattctgaaagtcaattctaagaagataatctaaaatgtggaaaagaaggccaggtatggtggcttatgcctgtaatcccagcactttgggaggctgaggcaggaggattgcctgagcctaggagttcaagaccagcctagggcaacatggtgagactctgtctctataaaatataaaaaattaaccaggtatgatggcacatatctgtggtcgcagctactcaggaggctgaggtgagaggatcacctgagcctgggaggttgaggctgcagtgagctgttatgggaccactgcactccagcctgggcaacagagcaagactctgtctcaaaaaaaaaaaaaaataatgtggaaaagaaaacacacagaaaaatgtatactaatgtgatatttatgatatcaagaaattggaaagattctaaacatctaacaatatacagagatagttaaattaagtaaattactgttcatttacttaatgatatattattcacttgttaaaaggatagttatgaaaggctggttagcaacaaggaaaatgctatgagacaatgttatacttaaaataacaggatccacaactgtatacagtgtgatttcacgtatctttaaatatacacctgaaaaaggactaggaggaaattaacccaaatgctgatattaaatgaattaggctaatggaattattggtgacttatttttcctaaatcttttcagttttctgtatttaggttatatcctttctgtaatgtgctatttaattttttataataatcattttttaaaatactcaaaagaaactgctgttacaactaactcaccaccatctagatggcattgttgggtatcagtggtaagtgtgagtctccaggctgtggcttctacttttagttctgaggatcctgacatcaatggctggccctacagctcattagcctcccatgcctcattcctccgctttctcactcctgactccttcctctttgccactcttcctgtataattttaggctgtgtctgcctgattatgaaggacacaattatgaaacaataaaggctttaaaaaaaagccacacaacttgcccccatgcaccttgacaatctttatgcatggattgaggctaagccaccatattaatgtccccctctatttttctcatcctagctacccctgtccccactggtagacattaaggattcccactttgctgttctctgtagcgcttaccaccacctgacatattatgtatttacttatttattataatatcatggctgagaaactgaagtgacttaaaaaggaaaagaattaattcaatgtctacctactaagtgccagttaagcctttatgtatattttctttatgtatattttctttatgtatattacctcattttacccttgcaagccagcaaaataagtattacgttttagtgataagaaaactgaggcttagaaaggttaaataatttgtccaagttcacttatgtaggaagttaccaaattgaaatttaaatcgttgttttcttttttttttttttttgagatagcatctagctcttccacctaggctggagggcagtggtgcaatcttggctcaccgcaacctccacctcctgggttcaagcaattcgtgtgccttaacctccccagtagctgggattacaggcacccaccaccacgcctggctaatatttgtatttttagtaagacgggtttcaccctattggccaggctggtctccaactcatgacctcagtgatctgccctccttggcctcccaaagtgctgggattacaggtgtgagccacctcgcccggccagccaccgtgtctggctgaaaccctcattttctcatctaaagtcctatgtccttagccaatacactaacaaacacacatcaattattaagatagcctaagttaacttattatataggcattgcctaagtgaacaattgaataacagaataattcaatctgaaactcgtaatcaattgatgccccaaatatcgttgtatctgagttaaccagctcattgcttcagattttttctgcaatgtctacagtgtctcgataactatttgagaccacaaaattaacagtttgactgttaattttaactactttgattatctgcagtattctaagtatttatttagtaactaaaactaattttatctgctttgattaatggcctcttttgaaggatctggaagctcttttttgagacaatagaaaattttttgataaagcaaaattcttaattaagttagatcctttcaactggttagttagacttacgaattgagattattaatagcagacatgtaagatgtcaaaaggaatgtattatctagttaggactaataggattttagagaaaatttttcacaagaagagatttttccatttaataactcatttattttcaagcaatagtctgttgaataaagattctaagcaaattcactgtaatggggatgaaggaattaaatagaatttcccaagaaatattgttcataatgttcaccattattacagctcaacggtgttcttgtatgcctgctttggctaaagtctcacatagaaaaccctttcacctaggcatggtggttgacacctgtaatcctaactacttgggagactgaggtgggaggatcgcttgagcccaggagtttgaggctatagtgagctacgatcatgccactgcactgttggataacacagcagaccctatctttatgaaagaaagagagagggagagagagagcgagccattgtagctgctgacatagacttgaggagtcataacatgatcaccctcatcatagctaacaattttgagaatttactgtgagccagccttcactgcatactgcactaaattatctcattttaatgctcaaaattctataaagtaggcacaaatgttatactcatttttagataaagaaactgaggcatagaaagattaagtaacttgttcaagggacagcatttaacataaaacacggatatgttatattggctgttttgccttctctgtgatgctgagaaaataacattttttgaaggaatttcaagttcgactttacagctttaatttaaaaggaaaaatgaaaggccttttgaattgctgtggctgttataccagtgactaattccattggaaagctggttcagtgagagctgaaattttaaaagtctgaaacatctgagagagtgggttccccttggctagttggtgcttccctcacaaccttttcccacatcagcctgtgctgtaaacctccctttcactctgtgatgatttcatctctgagggtttgtaactcatggagctgtccttggtctgacaggtcagagaagaaaagtttttgcctggggtctctggcttctcacaaagttgctgcacttctcaactgatttatattaatagaaatccacaaacccaccatgtacaacagattgagagaattcttaggagagtgcatgaaaacgctgaagtacttcatcatagtacattttaatttttccctgcattggagcagagctttcccatcttagatcaggaaatgggaaacctaaagttcacttactcaataaaatcaggctggagacccattttgggcagttctaaatgctgcaaaagatcaagataacattcctcccctcaaagattttacatgtcagtgataagacacacataaaaaagttaaacaacccgacatcataaagagatgaatcagaagccaatagggttccaaggataccaagtgtttgaaatccaaggcagggttacagggaggaggtcattggatgctgaaatggtgagggaggtttctggggagagagaggaaacttaatataggtcttgaagaggagaaagctagccacaggacagagtgtatactgtaaccccacttacctaaaaatgaagcaaaacaaaaactgtataggtttattaaatgcagtgaaaaagagtcggaaggataactagcaaattggaagaagggcaatacagttggcaggtgggagaggggaagggctagaattaatagggactttcagtttttactgtatgtatacttctttattattgtttaaatatttttctttcttttttttttgggatcgtgtttcgcttttgtagccaaggctggagtgcaatggtgcgttctcagctcactgcaacctctgcctcatgggttcaagcgatttcctgcctcagcctcccaagtagctgggattacaggcatccaccaccatggccagctaactttttgtatttttggtggagacagggtttcaccatgttggccaggctgatctcgaactcctgacctcaggtgatccacccacctcggcctcccaaagtgctgggattacaggcatgagccacctcgcctagcctgtttgaatatttttctaatgaggatatactcatacattgtttggtataattaagaaatacaacattgacaaagaacagatagaacttgggtttgtagagcaaaagaaagaggatattttagttgagaagaacagcttaagtacatgcctgaagttggaaatgtccagggtgtattttgggcaacaatgaggagaccagtgggaccagcacagaagggacatagtagcaggtagattggggccaggtggagaagagctgttaatgaagacctagtgtgagcctttcaccttccaccaaagcaatgaagagccttcgaagagttgatctggagtccattaatctgtccacacaagaatttatttatttatttatttttattttattttatatatacttttttgagatggagtctcgctctgtcgcccaggctggagggcagtgacacgaactcggctcactgcaagctctgactccggggttcaggccagtctcctatctcagcctcccaagtaactgggactacaggcgcctgccacaacaccaggctaatttttgtattttttttttttctttttgagatggagtctcgctctgtcacccaggctcgagtgcagtggcgtgatctcggctcactggaagctccaccttctgggttcacgccattctcctgcctcagcctcccaagtagctgggactacaggcacccgccaccacgcccggctaattttttgtatttttagtagagacagggtttcaccatgttagccaggatggtctcaatctcctgacctcgtgatccacctgcctcggcctcccaaagtgctaggattacaggcgtgagccaccgtgccggccaagaattaatttattgatgagcatacctgaaaacctagcaaagttagataatagaaattgaaatctacctttcttgtacaccatgaaaagccacggaactgtctcctatagtaactgcagcaagaaaggttctgatgtatacaaacctgatgttggacttttcaagaaacactgaaaatagaaatgctgtcagatgcaactggggaacaaccacttatacttgatccatagtattaattccactgtaaatctctgtgtaatgcttgatagctatgatgaatgacttaaatgtagtagagagattttgatccccagcatatgagaaatgactgagtcaaatttgtagaagttgattaaaaattacttgatttaaacaaatgaaaatcaggtggattctgtaacatgatatttgcattagtgaatatgtgttttccttgaatgaattgacaaaaatcaatattttctttaaacttgcatttataacactattcaaatacttatgtatacatcatattttgtatatacaaacacacacacacacacacacacacacattcatacaacagacataataaagcaaaaatctgtagctatctgggagtgacgaagtacctgacgtacaagcccatcttgaaggaaatattaaatctaataagggaaaaacactacagatagttgaaccttgagtcagtcatgcattctgactcatgtgaaatgattggattctgggtgagatgaatttttttattgacaacaagtggaagagggacatatcggagtcctagaatgataatgcaaattagctttataaaaacatagtcttggccgggcgtggtggctcacgcccataatcctagcactttgggaggccaaggtgggtagatcacctgaggtcaggagtttgagacgagcttggccaacttagtgaaaccccatttctactgaaaatacaaaaattagcctggcgtggtcatgcatgcctgcaattccagctactcaggaggctgaggcaggagaattgcttgaacccaggaggtggaggttgcagtgagttgagatcgtgccattgcattccaacctgggtcatagagcaagattccatctcaaacaaacaaaaacacacacacagagaaacatagttttcagctgactcggtgctgctccacgaggagcagcttaaaaaaacaaaaacagccttctcctgtaggagctgaattaaaaaaacaaatcaaaacaaaacaacaaaacaacatagtcttcatttactacagattttcttgtaaccagaagtactgacaaattgaattgagttttcagttttcactttgcttctccagagtttaaagacctttttctttttcttttttttttttttttgagacgggagtctcggtctgtcacccaggctggactgcagtggcacgattcggctcactgcaagctctgcctcccgggttcacgccattctcccgcctcagcctcccgagtagctgggactacaggtgcccgccaccgcacccggctaattttttgtatttttagtagagacggggtttcactgtgttaaccaagatggtctcgatctcctgacctcgtgatctgaccgcctcggcctcccaaagtgctgggattacaggcgtgagccaccgcgccccaccctttaaagacttttgatgctcatttatccctcactccaccgtttccttttcattccacaatatgtgtcttttttcagagacacagatggcactcttaatcggaaaaactgaactttcttgcctggtgatgggaaaacaatagcggggacaagaaaggttttaaaagccttcgaaagttccttggaaagggagattcctgatttcatatgttgcattttcctcagaacccgttttctcttcttaatccttctttatcctacaaaattactttgtggtatctcttcccgacatgaggtgagggcagcacaaggcatctgacctccacatgttgggagaaggcaggaatgcaagatgatcctgtgcctgacgtgattaaacagactcacacacattttacaataaccaattttggaataaaaaatgatcctttaagaaaaatctcctgattgttttaatatagttctcagtaccaatcttgatgagaattgataattcaaaccagtaaatatttactgctacctgccaagttgaattaaaaaaattcatttggttctaacaatattgtactcttgagtagagttatagaacaagagcaagtacagactaagtttccagtacaattcagacagggcaagtctgttctctcctccccacttgtctccctccctgataactggtagatgatagatagatagatagatagatagatagatagatagatagatagatagatagatagggtgggtatatagataggcagatggatggatggatggatggatggatggatggatggatggatggatggggagacagagagatagggtgggtggatggatggatgggtggatagatggatagggtggatggatgggtggatggatagatagatagattagattagatagatagacagatagatagatagatagatagaatggatggatagagagagagagatagaatggatggatggatagatagatagatagatagagtaggtggaagaaacttcttcctgattttgttgttctcccacatatgaaaagatggagcttctgtgactgacaatagcttaagcaaagacagggaaataatatttatgagtgcagaagttagtcaggtcattctaagtagaaagatgacagccaattttgtaatcccacaacattttttaaaagagaggaaggattaggtattggtgaagaattgataccctaaaataatgctaagaaaaaataggaacatctagagagttaggaaagattttggacacccaaataactaccctccatttctttatttgtacatcaacatgtttgagattaaacatacaaaaatacaaataggccgggcccagtggctcatgcctgtaatcccagcactttgggaggccaaggcaagcggatcacaaggtcaggagtttgagagcagcctggccaatatggtgaaaccccgtctctactaaaaatacaaaatttagctgggtgtggtggcacacgcctgtagtcccagctacttgggaggctgaggcaggagaattgcttgaacccgggaggtggaggttgcggtgagccaagattgcaccattgcactccagcctgggtgacagagtgagactccactcaaaaaaaaaccaaaaaacaaatattactctgatgatgctattacatatctccaaaagcaaacgaacaaataccccatttactcccagttgacattgattattttatccctggtttgtgacctaaaatgaattgaggaacttactatattcagttcatttctgccttccctctaagttcagggataaacttcaaagtttattatttttattaaagtttattttatcaaaacattgaatatttgtaatttgtaacatatcctatatatttttaatttatacgaaataataatttcctaaaatatgcaattaatggtattcttaacagattcacatatttgtatatattgaagtactaatttatggaaatctatctttcctttatgtatttttaagtttttcatgtgctttaatattttgattttgtgatactaaaaatattttattttgtgggtttttaaaaagatttatattattgctttcctttttttaaccaacagctaaatttggaagttctatcttacgtctcaaatgatccttgttggtacaaaaagtgtatcttttggggagctataaagatttcttgtcttttaagcctcatttacaaagtttttgtcaattgttttatactgactttctcattagcttgccagcaataagcaaaaataaagctaggactgtgtcaaaaatattcactggcccacattcatccttcttcagcaggtttactccatagtgttccccattcagctactgtgctggccaatggaaacagcgagtcgttgtctgaaatgaagaataattggaaacatggtgcctgtttcttttcctgcaaataacaattcatccatttaacattcttttggtgctcttgaattctgtagtagacagccttgtgttcactgttcagttgaggcccattcgagaaaagctaaccttctagcctgctgttgaccctccaatgggaaacagtgacagccatcaatggcttctacatagagctagtgacatgtggcactagcagcttcatataggtaaatgggcctcaggctggaaaatgctaggctgggagggatggtaataatgataaaagattaaaattctggctatgatgatctccactttccaaagaaacaaagcccagaaaggttaagtaacttgcacaaggtcattttgccagcaagctgtagaacagactgtttccagcatctttcttttgtaccctacacaatcttttatggccacatatgtgattgattttgtaaatgttccatacacatataaaaagattgggcagggcgcagtggctcatgcctgtaatcccagcactttgggaggtcaaggagggtggatcacgaggtcaggagttcgagaccagccaggccaatagtgaaaccccgtctctactgaaaatacaaaaaaattagccagacgtggtggcgcgtgcctgtagtcccaggtactcaggaggctgaggcagaagaatcgcttgaacctgggattgcggaggttgcagtgagccaagattgtgccactggactccagcctgggtgacagagcgagactccatctcaaaaaaaaaaaaaaaaagattgcatattccctttttgcaaggtatatatatgtggtttttatgctatttactaatcacatacactcttatatatgtgtatataataagcctctgatgatatcattatagttgtctatattcttgcttgtttttgacttcatgttccatcaaattctgaaagggatgtattaaaatctaccactatggttataatttcatcaaatgctccttgtcttttgatttttattttgcactgtttttaagtgcataatagctgataacttgtatatctttgtcacatttctattcatatcacaggcaattgggctggctgcataaatgcacacatcatagtggcttaaatacatgaagctgtatttgtctcatataaaagatgtttggaggtaggaagtccaggactggtatagtagctctatggtaatctggaatgcaagctgcttctgtcttcctactctgtcacctttagtgtgtggtacccatatttcaagtcatggttgcaagatggctcctgcagctctagccatcacatacatattccagacaggaaggaggaaaaagagtaaaaatgagtaatccaggtgagttagatttcagcaggccccatccactaacttctgcttacaacttactgttttttggtttttgagacggagtttcgcttttgtcacccaggctgaagtgcaatggcgttatctcggctcattgcagcctctgccttctgggttcaagcgattctcctgcctcagcctcttgagtagctgcgattacaggcgcctgccacatgcccggctttttttttttttttttttttttttttttgtatttttagtagagacggggttttgccacgttggccaggctggtcttgaactcctgacctcaggtgatccacctgcctcggcctcccaaagtgctgggattacaggcatgagccacctacaacttattgtctatccctaagtacaaaaggagatggaaaaattaacttaaaaaaaaatctggacacactgctgctccaaattaaattgaagttttgttagcaaggatgaagaggaatggacattgtgtaagcatctagcaatctttgccacagtctgttcaatcgttccagactcttgttcctatttaatgcttctggccttgaatttgctcatattggcactcctgcttttgtttattttgttttgcttttttccttttttgttgttatttttggcaatcagctttctcaggttaaacactcctgcttttggagttccctgacatatatctgcccagtcatttatttgcaaactttcatagtcactttcttagaggtgaattccttagacatagcttaattttgttttggcccaatataaaagtttgccttttgacacagagattcaactcatccacatttttagtggtaactgatatttttttattctttccattttatttttactgtgtattatacttcattattgtttcctttcctccctttccttagacttactggcttgatcattttaagaaggtattttcttctgttgttaagtaggaagttttcttctgaagcacttgcttctcttatataaataaatacctttcttgactgaataagcatattcctgtatctcagagattcattgtgaatatgttgaagaagaaatacaatttatttctttactagtgaaataataaataaggtcatgggcaccatgtaataattaaggaagattatattcctcacttccttcaacatcacacatagactgcaacaaatatctcactactcccttaagcagggctggaaatgagccctgtcttgatggaggtgctgtgtggtcagcacttcctagattcctttaagggtctacctattgaaggaagaaggtcagctgttatcctaaaattctaaagtccacatggagaagaattatgatgagtattcatccatacacttctctaactctactgaatgcaaaataagttatcaagagtgacaaggcaaataattatgactaatactgtaatacgctttgtggcttgctatctccattgcatttgttttttaaaagagacattattattattattattattttgttgttgttgttttgagatagggtcttgctctgtcaccaggctggagtgcagtggtgcgatctcggctcactgcaacctccacctcctgggttcaagcaattctcctgcctcagcctcccgagtagctgggactacaggtgcatgctgccatgcccagctaattttttgtatttttagtagagaaggggtttcaccgtgttagccagggtggtcttgatctcctgtccttgtgatccgcctgcctcggcctcccaaaatgctggcattacaggcatgagccactgcacctggccgattctgttatttctaacatttattttttattttttagagacaaggtctcgctctgtcatccaggctggagtgcagtggcacaaccatagctcacagcagtttgaactcctggtctcaagtaatcctcctgcctcaacctcttgaagtgttaggattacaggcatgagccaccatgcccagccaaaagaatttttataaccttttttccatggaaggcttgagttctacaaagtttgtcatagctctgtgaagaacttacatatgaaatgtagctctagattacttggtgaaattattaatccttttctgatactcttacatgtacataaatatattgcttctgaaagaaaccttttttcttgtgtctggctccaaattataccttccccttcacgctacagcaggactcgttcccaagagcaatcacagatcctaaaatgaagcaaatggtgcaaatgttaccatttatgtagaaatgttgctgtttttaccatgaggaacaatataaaagaagaaaccaatgttttatgaaagctgtttaaggccgggcgcagtggctcacgcctgtaatcccagcactttgggaggccgaggcgggcggatcacctgaggtcaggagttcgagaccagcatggccaacatggtgaaactctgtctctactaaaaatacaaaaattagccgggtgtggtggcaggtgcctgtaatcccagctactcaggagaccgaggcaggagaatcacttgaacctgagaggtggaggttgcagtgagccaagatcccaccactgcactccagcctgggcgacagagtgagacttggtctcaaaaaaaaaaaaaaagaaagaaaaagaaagctgtataacttttactcaatgtcattctaatttatttctttcttaaaattattattttagatcccttttgggaatggtttggttacaaactggtaaacattttcataaatcttagaataattccatacagaaaattatttgtactctacaaaaatatttattaaaatatacaatacataaatgactttctatgtacaagaaactctccatcttgaaacatttgtgttataatatctgtccctcgtgctctctctcaatatcaagagtacagcaacacccttacatgtctgccactcaccatatattttgggggtaaattgacaaataattaattctgcagttggacgttttccccttcccatcaccattattttcctgcaacttttcaggcaaagggagcagagcatggtgtcacaggaagataatgataataattaatgttaaatccactacttcctcctcctcttaggtattttccctccagtattgattatgaaagaggcttagcctcacatcagccctagaagaagtgggagaaatttgagaataagaaagaaaagcatctgatgaaaataaaattattatagaaaactatatatgcataaacatgttatcaggtttaaacattaaaatgtattggtatttagtatgagtttaatgttactagctactaacatctattaaaaattaggcttcaggccaggcgcagtgactcacacctataatctcagcattttgggaggccaaggcaggaggatcaagtgaagccaggtgttcgagaccagcttgggcaacacagggagacttcatccctaccaaaaagaaaaaaaattaactggacttggtggcgcacacatttagtcccaataactcgagaggctgaggcaggagtttgagaccagcctggccaacatggtgaaacctcatccctatttttttttttttttttgagatggagtctcgttctgtcacccaggctggagtccagtggcacgatctcagctcactgcaccctccacctcctgggttcaagcaattatcctgtctcagcctcctgagtagctgggactataggcgcaagccaccacgcccagctaatttttgtatttttagtagagacgagatttcaccatattggtcaggctggtctcggactactgacctcaagtgatccacctgccttggcctcccaaagtgctaagattacaggcgtgagccaccacacccggcccccatccctattaaaaatacaaaaattaactgggtgtggtggtgcgtgcctgtaattccagttacccgggaagctgaagaaggagaattgctggaacccgggacggggaggctgcagtgagccgagatcgcaccactgcactccagcctgggtgacagagtgaaactccatctccaaaaaaaaacccatcataaatatgttcatcaatagagttaatagagttcaaaactggtctggattcaatatgttgacaaaatgcttcaaacctggataccagtcctgcagttgacactgtatgattgaatttgggaaaaacaggttcccatagctttcaggaatagggtttgaaaatactggaattgaaaagcttcagtaagagaagacaatgcttaccacagccaagctgtcactctctaattatttttactttcacgttatttgggcccaaagaactagatgaggaatcaggagtttacataaacaaatccctggaatatacaatttagcttatcctttagcatctctatttttcctccagttgagtgagaagaaaccctaagaccaaaccttatatcttccagaagcattttaaggaataaccatgtttgaaagatttctctaatgagtcatatagaattctgttactatagagagattgtcttctttgctaagaacaaatagagaataaagacttacaaataaatgagttgttttaagagtctgttttatagtgtcacctttttgtgaaattccccattatactgccacattttaatgttctttttctctggcctgggcttagagcaatgatctgccactctcatgtatgaactatgcactagagtacagaaatatacataatctttgcctagggtataattttagtgggctgacgcagcagcacaagaaaggctctgaaatgccagtgggttacacatgcattgatcttgacaaattctatgtgatcaacgtgaccatggcataccttgtgacttttttggttggtttgcttaaatgtcaatcaaattttaagataattatgagatgaaatgcactaggggacctaccacacagcatcaggtggatgtggagtggttttgctactcatataaagtgaaatcctgcaaaataacaccctcaaaggagctgaatgtaaaggagaaaggggaagacaatatcttatcattaaaaatcaatcagatatttactaagtgcctcttctgatgacttcttacatttcagtggctagcagatcttggttcacaaaatactttcacagacattatcttatttgatcctcccaacaaccggtaaggtaagagaggtaatctgaaaatgaggaaatggcaactctgagacttaagtgctttctgaggacctatactcagcttgacgggggtggggagcattggaactgcccaggtctccaaatactctgtcctgtaatcattccctcttgatcacccactattgtactccttcattctctgtctggtcctgtggaggagtccaaagaaattggaaggcgtaaatcttgccctcagggagattctgctctagatgagagaatgcaagttttcgtaataaaaacaacagagaattattaagtgttaaaccgtatgaaacaggctacaaatatagtaacagattattttcactggaaaataagatgctataaattgtacccaatggcctgaaaaatgtatgtgcaggtgcctgagaatagtggtcaactcaatgtttctgaagttttccagccaggcaatcaatgttttcctagagaagtctcatggttaattcttgactaggagaaaagccaacaagcactatcttgcccagctctttggtgacacatggttgcttctaagagccaattcttgaatctttgaattctttttagcctctgttgtgcctcagactgagaacaggaagcttgtgggaaccagtcctggccctggtaccttgttgcatcctctaaacgatcagtggaggccaccgaggaaattgcctgttcacctcctcctagttatctagtttgcaaacggagtaaagaagaagagttactttttttttttaagctgccttgaggtgggagaatggacacatttgttctctactcagagagaccatagacttcaagggtctgcagggactctgtgatcacttttctttctttttttagtttttttagagacagggtctcactatgtgactattcacaggcatgatcacaggcatgactacagtgtcaaactcctgggctcaagcaatcctcccaactccgcctccctagtagctgtgactataggtgtgcaccactgtgcctggctttattttctaatgtcttaatgctcaaacctaaaattctccaaatccatatttgtttcagatgcaaaattctattccaaatatctgttctttgtttttttcagcagagcaagcctgtccttagaaacagctgcaggccagtcactgtctctccctgtctttatcttccctgctgagtggcatgttgcttgcaaggccccatggggacttccaaagccttccataaatgactggcagtaatactttttttttttgagatggagtttcgttcttgttgcccaggctggagtgcaatggcgtggtctcggtttactgcaacctccgcctcccgggttcaagcaattcacctgactcagcctcccaagtagctgggattacaggtgcccgccactacatccagctaatctttttgtaattttagtagagacagggtttcaccacattggccaggctagtctcgaactcctgacctcaggtgatctgcccgccttggcctccaaagtgctgggatcacaggcatgagccaccatgcccggccagcaatacttttttaaagatgcacacacccagccaggttcaccagtattatggatgtttctgtgtagtcttctccaaaatgctaatttgctgaagtgtccatgggaataggccaacacggatggatctactgtataacttgcctgccatcaggaaagagtcaacacggcagacacatgctggcagaaaccctgctggagttgcccctgagcattgatgcataccacccgagaggaggagagggtggtgggagaaatcagatcagagttcagaatgcaccgtaatgctctgtaaatgtaagactgcaccttgcaggaactgtcaatgccactaccaatatcactcacttacatcaagcacttgagagcagctgcgaacacaattctctgactcctaaccttaagcacgtgactggtaccactggacaacctatgttctcaaagatgcatcttttaaactactttccctaggggcccggcacggtggctcacacctgtaatcccagcactttaggaggccaaggtgggcagatcacctgaggtcagaagttcgagaccagcctgaccaacatggtgaaacctcgtctctactaaaaatacaaaaaaaaaaaaaattagccagacacggtggcacatgcctgtaatcccagctactcgggaggctgaggctggagaatcgcttgaacctgggaagcagtgagccgagatcgcaccactgcactccagcctgggcgacagagcaagattccatctcaaaaaaaaataaaaaataaaaaaattactttcccaggagtagaaatggatttatgctgagtcactcaagctttcatttcatccaggggttgtgaacatagattctggaaccagctctgtcacatactagccgtatgaccttgggaaaattacctaaaaattctccatgccttcaattcccgtgtgtgaaatggtgataattataccagctaccccataaagttgttttgaggcttagagatgtaaagagcttagaacatggcctagcacgtattttgtaccatgtaagtggtattttcatttgttcttctaatattaatttaaaacatctgtgggccgggggtggtggtgcaggcctgtaatcccagcactttgggaggctgaggtgggcagatcatgaggtcaagagattgagaccatcctggccaacatggtgaaaccccgtcttcactaaaaaaaacaaaaattagctgggcatagtggcacgcgcctgtaatcccagctatcaggagactgagacaggagaattccttgcacccggaaggtggaggttgcaatgagccgaaatcatgtcattgcactccagcctgggtgacagaataagactccgtctcaaaaacaaacaaacaaacagcctctgttctgaccaggtatgggtggctcacgccagtaatcccagcactttgggaggccgaagtgggaagattgcttgaggccaggagttcaagaccagcctgggcaacatagcaagatactgtctctatacaaaataattttaaaaatgagctgggcatggtagcacacgcctgtagccccagctgctcaggaggccaacgtgggaggattgcttgagaccaggagatcacggctgcagagaaccatgatcgtgccactgccctctgggctgggagatagttagatcctgtgtcaaaaaaaaaaattaaaacaaaacctctgctctggacgctgctaggtgttgagaggtaaaaacaaataacatgcagtaggttccctcagtgggcttacggtctgttttattactttactgtcactgttttatttactttgcctagcacgccagttgcaaagtactcaataaatgtttctgaacgtatgattgtcttgtggaaacaggcaagcataccaataacttcaatgaaatgacaggatgtaactgtgcctggcccatagtaagtgtctggtaccatataagcattagctatcttaattatgagtttagtagaataaatgctgagattgagtgtgcgggctgaaggttgagggtgaggaggtagaagtgcactcagggaagtcttccaagaggcagtatcattgagcttagttttgatcagcgtgtaggcgttagccagtaagagaagagggctaagtgtgttccaggcagaaggaacattgtgtgcagagttagagaggcgtgaaatagcacaatacattcagggaactccgagtaggcaagaaggactggagcgccatccttattgtgacatccagcatgcatttgttaaatgagtgtttgagattagaagctgtgggatgaaacaaaacaaatgagacattgcttgtgttattctggccttcagcattgaactaaataagcagtcatggacgaagtggccagaggatttgttcagtgtcatacttgctctggtacaaatgctatatactttcctaccgcacagtcagcctcttcttgtcctctgctagaggaagtaaattcacttcatttgtctttttttttttttccaaaacaactgagataaattacaataaagttgaggagactgtagtgtaggtgaagatgtttttgcatagtaacgtattgctctagagcagaggtcagcaaactatggcctgagggccaaatctgatccaccgcctgtttctgtaattaagttttactggaatacagccatgctcatttgtatacaggttgtctatggctgctttagtgctataacagcagagttaggtagttatgacagagactatacagcctgcaaagcttaaaatatttactggctggccctttacagaaagtgtttgccaatcctaggccaggtgcggtgactcatgcctgtaacctcagcactttgggacgctgagatggaaggatcacttgagtccaggatttcgagaccagagtccaggagtttgaggccactctgactgacatggcgaaaccccgtctctactaaaggtacacacaaaaaaactagccaggcatggtggcgcatgcctgtagtcccagctacttgggaggctgaggcaggaaaattgcttgaacccaggaggtggaggttgcagtgagctgagattgtgccactgtaccccagcctgggtgacagagtgagactctgtctcaaaaaaaagaaaaagaaagtgagtgtttgccagtcctcactctagattcttctcttctaatctgataaataacaaccacctaaatatttaaaacaaggtattgggttggttcagagtcaatgtggtaaacaataggttatcgaattttaaaaattcaccattaaggagagagaagattgcacatacgttacccataaagtgtgtgataaacatgaataaataaataaacatagtttctacgattggcttttgaatttggctctgagcttcctagccatggggggcgttggggggaagaagataattgatcacctgtattagttacctgttacttcataacaaaccatcttaaaattgcatggcatataacagctaccatttactatttctcgagtctgtgaattggctgagaggttctgctgatctgggctgggcccagctgaccacagtgggcttgctcacacatttgtgatcagctggtatgttcgcttggagctggctggtctaaaatggcttcagctggagtggctcatcttgactccacaggatgtctcatcctccagccggctagcctggacttgttcgcatagccctggcaggtttcagaggagagccgaagcacacacttgaggcttaggcttggaactggaacaccattatttcaattacattctagtggccaaagccagccaaaaggcaggcccagactcaaggaatgtagaaacagactccagctcttgatgggaggagctgcaaagtcacattgcaaggggcagggaaacaggagggacagaattgaggccatgtttgaaatcacaaacaatcaatcatcatctaaaacagcgtgtattccaaccacaaaattttaaaagtcatctctgtggtctaaagcggaaagaacgagtcatcatacatcagtctattcagccccacccacagatatgaatcatcagtgtcttcagctaagaggaccactatcttctagctaatgacaaatacagaggaggggtggaaagaagtctgttggaaatgtgtacatatcacatgagacccagacccatattcaaataccacttgatgaatttcaccagggaatcagactcagttttaatgggttaaagggatacggaaaatcattgtcacagatgtaagcaataactcaactaaacatcagcttttgaggctcaaccctaaacagacctacaatattctggctgattcccatttgcctccacttttatcattgggtggtggtaaaattggtcactgtattcaaagatcatatcactacctatggatatggatgtgattgaaatgacagacaggggagaattttttttaacttactagccatgtaatgattttttaaaatttattgctagaaaatcttcactattaccaaacttgcctcaataaatgatgttacgtataaatagcaacagcgatgtcagaagacctccttagcatttcttttcctggtatgatatggctgtctgtaagaagagagtaaacatagatagctcttgcttcttacggtatttcagaatccccctagaagttttttatattaaaaaacaaacaaaaaaaaaaacacaaaactcccaaaccacccagacaaacccacccagcctaggtatgagaatgttctttcaggcctagagccagtcagggtccttagctttgtttgcaagatgccagtgcctttatactcagacttcgtggagctgccaccatacttctgtagtaatagcagtagtgagtggggaggtacatgacagaatttagagaactattagacgcccgttgactcagacatcaggaccacctgtgaatggaaatatctttcaacttagatataataaaaaggaacggagctgttgatgttattgaggaggtggaaacaaaaccttcaggatgcttgaagataactggtttataggagggctgggggcaatagggctgtcttaggaagaacaaatgatgcttccaaaatttgagtgcagaaaatcagaagttaaccttgggtgggtcacaaggttaaatgtaatgaaggctaagtgtgacaaggttaaatgacataacatatataaaatacctggtgggttacttagaagagtacacctcaaaaatgttggttccctccatctctctggatcccccacccccttaaggatttcttaaaaaacgaaaaacctgccagccagctgccactggaaagatgtcaagtaggataagctgctgataggtggtaacaacaaaatccacatccaggtggatggagcagggggatgtcacctctcctgcccctcccctaattacaagttggaggcagcataaagacattccttccttcctgcagaggaagtatgtgttttctctcagacctaccttggcattccttgatgtcttagagaagcagatgaccccggctgagcaagacagtcagcagaacagcagccctcgatgctgcaattggaaatttccattctttgcttgcagctctgaaaaaaaaaaaaaaatctaaagagcccagtagctgggaaatttccatgatggaaaattttaacatattctttagctctaaactatgcaggtttatagagactatttttttttcttttggtaattttcttctttaacaataatttatgatcattgtaacactacagctgtgggaataaggagaacaaaatgagttggaggggaatgggtatggttcaggctagtgggaggctgtgctatctacttgtgtgaccacccaaataatagaaatgcagattgctataagacccactggttgggaattcatccaaaatagagatagcttgccctggagcgctgcagagaaatctgtgtagagactggtagtggaaaatggatggataacaacttcagaccaggacatggggagttctgttgctggaaaaagcaactcaggcaggtctgttagaccactgctatttaatcctaaaactgcatacaaatcacctgggaaccttgttgagctacagattctgattcaatagccctggagtgaggaccgagactctctgctcccaggtgacgctgatgctgcccttctgaggaccacgctgtgactagctaggccatagatagcaggtcttcatcagtataaggtcagctcgccttgggtagcaaaacactgcctaagggcagctggaggtgagcccccgtggggttgtttgctcagattacaaagctaaggtctaaaagtagaactggatgttttctggagagatgctccacgcaagtctggataaagtggatctcttgagatgtgggaatgcaagcagttgccagaaggctgcttactccagcagattcaagttgggggcttctagaaatcaatgcctttccagagaaactcttgcatcaagccggcgaagattcctaagttggtcctgatttctgagtgattctccagtgttgtggtgtgtgagtgaaacaccaatgaaccagctccaaatattgagggaagactgttggtcaggatgatgtgaaggagagaaggagtacagagaataaattacttccaccctagctagaatagctgcctcatttttattgagataaaataaaaaggaaattgaagaattttccatttacttaacagttatcttgccttcgtgttaccaattttacaaggagagagaaagataaaaatctgtggcatcttcatttcagggtgttacctccaattggtctgtaatgtatctgctgtatatatttccttttttttccttttttttttttttgagacagagtctcgctgtatctcccaggctggagtgcagtggtgcaatctcggctcactgcaacctccgcctcccagcttcaagcaattctcatgcctcagcctctcaagtagctgggactacaggcagctgccaccatgcctgactatttttttttttttgtattgtagtagagatgggttttcaccatgttgcccagggtggtcttgaactcctaagctcaggcaatctgcctgcctcggcctctcaaagtgctaggattataggtatgagccaccgcgcccagcctgctgtgtgtgtatgtgtgtgtgtatatgtatacatgtatatatatattatatatatacatatatattatatatatatgtatatatatattatatatatacgtatatatataaaaatatatatacgtatatatacatatatacttatgtataatatataaaaatatataaaatataatatatacaatatataaatatataaaatatatacaatatataaatatataaaatataatatatacaatatataaatatataaaatatataatatatacaatatataaatatataaaatataatatatacaatatataaatatataaaatataatatatacaatatataaatatataaaatataatatatacaatatataaatatataaaatatataatatatacaatatataaatatataaaatatatacaatatataaatatataaaatatataaatatacaatatataaatatatataatatatacacatataaatataaatatttacatatatataaatatatatattatatatattttttgagatggagtctcaccctgtcgcccaggctggagtgcaatggcacgatcttagctcactgcaacctccacctccaggtttcaaacaattctcctgcctcagcctcctgagtagctgggactacaggcacccaccaccacgccctgctaatttttgtatttttagtacagatggggtttcaccgggttggccaggctggtctcgaactcctgacctcgtgatccacctgcctcagcctcccaaagtgctgagattacaggcatgagccactgtgcccggcctgctgtgtatatttttaaagcaacatttgtcctatgttttttgtcttccattcacttgagttttggatgggtggttactactacccaaagtacacacaggagcatatgaagaaaaggagagggatattatgaaaatgtgatgttgaaatcagtgtaacaagcatagaattaatttgagtatataataaaaagtattaaaatatatattggaagtaaatgagtattctaatatgctaacttccatataacagttacaaaatttaaatggcttacagaattgtttagggatttggacctccagaaattggttaatattttcccttgcaaaaatcttcactgtggagtcaaggtatgattcagcaatgaaacagtctttctgattacttatgtaaggcgatcagtttgcttgtttttttccttactatatgtcttgttgagcaattatttatctaggaaccatcttacaacctatagtcaacccaatggaatttactaaatccatctaaagtcacatttttaaaaattattattattattattttttgagacggagtctcactctgttgcccaggctggagtgcagtggtgcgatctcagctcactgcaacctctgcctcctgggttcaagtgattcttctgcctcagcctcctggagtagctgggactacaggtgcgcaccaccatgacgagccaagttgtgtttgtttgtttattttagtagagatgaggtttcaccatattggccaggctggtctcaaattcctgacctcgtgatccgcccgcctcggcctctcagcctcccaaagtgctgggattacaggcgtgagccactgcgctcagctaaaaattattatttttgagacaggctggaattcagtggcaccatcatggctcacggcagcctcaactccccaacccccaccacccacccacaatgcccagctaattttaaaaatttttaaattttttgtagagatgtggtttccttatgttgttcaggctagtaacaaactcctgggctcaagcaaccctcccaccccagcctcccaaaatgccgggattataagcatgagccacaggaccttgtcctttttcaaaattattgaggtgaaattcacataacataaaattacctaggttatttatttttcttgctttgttttgtttttttttttttttttccagaaacaggatctcattttattgccccggctggtcttgaactcctgggctcaaacaatcctctccccgccatccacctcggcctctcaaagtgctgggattataggcatgaaccactgtgcccagacaattacctattttaaagtgaacaattcagaggcatttagtatatttacaacattgtacaaccaccacttgcatctagttccaaaacatttggatcatacccaaaggaaaccccatgtccattacgcaattgcttccaacttcccccggcagcccctggcaaccaccaatctactttctgagtttgtgtatttacctgttcagggtatttcctatgaatggactcaaatggccctttgtaaagtcacatcttcttaataaacatcataattataaaaatctaatgttaatgagtgcatataacaggtgagatatttaatccttacaagcttataaatgggtatcattattagatagacaagaaaactagaatttagcttaaatcaatacattaaatccatatgcttgagatccatacttacggccagagaataacctttggccagacccagttactctagtgctctttccaaatgccacagccgcatctcaattttcatttcccttatcacaaacagatggatagatactccttctcaagcttaacaacttcacagagcttgattcaaatactgaatgtgttgctagttgcttacagctgctatttctctagcagtgcagtaagtccaggcaaactcttttgaagagctcattaaaactgctaaaataaagtcttagaagcaggtgcattcattagctgaaatgcagacgattatgttaatatcgcattcaggtgacaaatttaaaggcaccaaatcatgaaggataaaaggattttcaaagctaaagttaacttctccctttgtagagctctttgttctggtaagcatgtgactgactacagctgtcaacacgggcacctccaaagttatctcgcaaaaacaaaggtgttttgcagtatcatacttcttttacaatttcctgggtctctactgaggaaaagaaaggtaaggaattacctacaaacctggtgctatttttcaaataggagatctggcaccccatttacaatttatcatcagattggtctcaggggaagaggagacgcgttaaagaaggtgattaaaatatgtggacagtgggccgggcacggtggctcatggctgtaatcccagcattttgggagaccgaggcgggtggatcacttgaggtcaggagtttgagaccagcctggccaacatggtgaaaccccatctctactaaaagcacaaaaagtagccaggcatggtggcacgtgcctgtaatcccagctactcaggaggctgaggcaggagaatcgcttgaacctgggaggtggaggttgcaacgagccaagatcgtgccactgcactccagcctgggtgacagagtgagactgtctaaaaaaaaaataaaaatgtgtacagtggttcccaatttggaaaagatgggctaacaactcttttactttgcctttttttcctcctcaatattttgagcatgaaatatatatgtaaccacatacatatttcatatgtgtttgggagactgttaatagtagtttcggctgggcccggtggctcacgcctggaatcccagcactctgggagcctgaggtgggcggatcatgaggtcaggagattgaaaccagcctggccaacgtggtgaaaccctgtctctactaaaaatacaaaaattagctcagcatggcagcgcgtgcctgtaatcccagctacttgggaggctgaggcaggggaaccgcttgaacccaagaggcagaggttgcagtgagccgagattgcaccactgcactcagcctggagacagagctagactccatctcaaacaacaacaacaacaacaaaaaccagtagtttcatcaggataattttaattttcttttttgtgtatatttttatatttcccaaattttctacaatgaatatgtaaattttttagaaactttaaatgtaatttttttattaaaatttatttttgaatttgtaatttttcaagttattaaaaattatcacttagcctctccacattcagttgttttacctataaagttgggttactactgaattgcatagcacatggaagctggatgagatgtttccccatattccattcctcctctcaaatccaggatgtctgtggaaatgtgggttcctctttagaaggcaatataagaaaatgcagctaggtatccaaccatttataagaatatataaacaagcttaaggatttttatgtctttcttcagaacgtcaatcaagtgggcattcatcaaagcgaatgtgtctgtcactcgcaaaggaaaaaaggctgaacaacctttttaggccaaatctacttatttatttatttattatacaaaaaagtctgtgaaggctttgtaagctaatactcgacacattcatttttttttttccaaaacggtgtgctaaaatgactgctgactgcaaaatgtaaataatgaagctgccatagagtggcacctacttatggggcatgtttgcatagaatgtgtgtgtgtttgctaaatagcttgtaattaacaagctgaaaggctgcttgtacagtgtagtagtcctatttttgcctgctgtcctcttcagctcttctccttctagcttgctctgtacattatcacttgctcttttctctatacaatttagaagcccattggcccccatttaaaaagaaaagcaacatgtaaatcaggaaaaaaaaatccccattgggaatgggttgggtaagcaaagaattctatatagatgtatacatatacacccctctccctggtcaagaatggcctcgctgaatccctgttccaaatgccgtgacaagtctcattagctggagctcattgtgtgcagctcctttgactgctggacagctccgagtctcctaggaatacttttccacacgccccatcctcctctgtttaattctcagagctggcacacacacaaaggtttcagaatcaagacaaagtgaagaacatggccagaagagactcctgttcttccaaaatagtgcattactatcataagattagagggtaaacttcagagcacaggcttgattgtttgattgattgatttttttttgagacagggtctcgctttgttgcccaggctgaagtgcagtggcacagtcatggctctctgcagccttgacctcttgggctcgagcaatcctcccacttcagccccctgaatagctgggactacaaatgcgtgccaccatgcccagttaattaaaattttattattattattattattattattattattattattattattattattttgtaaagacagagtctcattatgttgcccaggctggtctccaactcctgggctcaagcaactcccacctcagcctcccaaagtgctggggttacaggcatgaaccactgcacctggccaagaacacaggattgaaagatgaacttgagaggtctccctagtcaagtttcctttaaatggatgctctcttctagagcatgcctgatagtcatccagcctgaccttggataatcatccagcctgaccttgaaattttccaatgacacaaactctctttcattttcccacttttatatagagtactaacagtaataacctaatagtataactaatagtataaccacaatgccaaaaaagaaaaaaaaagtatgagtgatttctaatctaatactgccagcattttaaaaatcagcatgttttttttttaagacaatgtctggctctattgcccaggctggagtgcagtggcaccatctcaggtctgcaacctctgcctcccaggctcaagctgtcctcccacctcggcctcctgagtagctgggacaacaggcccacaccaccatactggactaattttaaaaagcagctattttaaaatttctgttattgagccagaatccaggatgcagtgagagtgaatcattgactgaaagacacttagaaggttttattggtctgtggtattcatcacaccacaaaggccaggccctgaaaaggaaaactgtgtaaagaatgtataagcctcaacaccacagtgttgtccaagtctattcctaattcatcctgctttgttgctctgacacctgtaccacaaaagaaaatttctgagattatcttacctaggaaccttgtcttaaactatattccagcatgtacaaacactaagttgagcaaagtaggacacatgtcgtcaggacctcctgaggctgtgtcatggaaaaaaatttttttttaaagaaaagcaaagttgagcaaagcgttcccaagttacctaaattttgcatatgatggtattccttcggaatgctttgggaagttcagcaggattctgaaacaactaaatgtgacaacacaaagaacaaaaatagacaaaggaaaaaatttcaaagatagtgtgtcctgtgaaaacagtcagatatcctttctttccacactggctatatgggagagtcttttaaaataagttgtaatgatgaaagtggggttgaattttttaaaagcaaattttgaaaattacttagctaatagaaaaggtagaagactgtgaactataaattttgctaagtgaattgaacggagaggttttaaaaatgactattattttcatgaattataaaaaaaattcaaacaacacaaaatattacaaagaagaagaaacaaccttatgtcccgtcacctaaaaataatattatcatcataaatattaggggaatatcattctggatgtggaaatgagagataacttagaattttaaaaacaacttactcttaggcaactaagcctgatcgtattgttgatggcctaattgtgagagactctaaaactgacttttttatatgtctgttttatttgaaaagttatgagaggaggggaactaattagaattctcagtccataaccaatgataagaacgtgagttcaggctgggcagggaggttcacccctgtaatcccagcactttgagaggctgaggcaggagaatcccttgagtccaggatttgcccaaggaaacatatcttatgttttagatatagctgaattgagggttaaagcatggacatataaaataaaataaagatgtttgctaatttctattgaactcacattaaaaaaaaaaaaaagatagagacagggtcttaatatgttgcccagactggagtacagtagtgcaatcattagctcactgtaacctcgaaatcctgggctcaagcaatcctgcttccgaagtagctgagactactggtgcatgccaatacagatgatttttaaatattttaaatattttgtagagataggttctcattatgttgcctgggctgatctcaaactcttggcctcttcaacccaaactctttatttcaatactcactgaagaatattattcttgcttagccatacccacttcccttggagaagaaagggcatatattttcattataggtgaaggtggatgctactgagaaggcctttatatatcacatcaaggcccatttttactagttatacctctttttctgagcacgtgaaatattttcctgagtcttttaattttttaaaaaattgagacggagtctcactctatcacccaggctggagtacagtggtgtgatctcgactcactgcaacatctgctgccagggttcaagtgattctcgtgtctcagcctcccaagtagctgggactacaggtgcgtgccaccatgcccagctaattttttaaatattttttagaggagacggggctttgctgtgttggccaggctggtatggaactcctgacctcaagtgatcggcccacctcagcctcccaaagtgctggaattataggtgtgagccactgcacccagccttgtaattttttaaatgtgttgcttttttttgagatgaggtcttgctctgctgcccaggctggagtgcagtagcaccatctcagctctgcaacctctgcctcctgggctcaagccatcctcctgcctcagtctcctgagtagctgggactacagggcgtgccactgcacctgacctaatgtgttacttttaaccccagttatttgttaagaaactcccaccctgagattccttctcttactgaggtgaagtcatttttatttatttaattatttctttatgaaaaggaaagagtaaaattccccttcctcactcctaaacaaacttcattaaactcatatttgggcaaaaagtttaagtagaaattttcaaactcaaagaaaactttggtcctttatgttgcaaaaatcaagaacattacctgtgttaaattcaacagacattgatactgattatgcaaatggcagattattcattctttttaaaatgtgtatggtagctcccccttacttgcatttgactaatgctaatacaaaattagatgccatttcctgacttagtcaccaatttacattgagaaaatatgggtcaaataggtggaagaagaaagccaatatttccttggtaaccattatatcaaaattgaagataattacttaatcaaaagtacagattttccatgcaatggctctgtttatctcaaagtattagcacattggactacctgaccatttttcctgaaaaactaaagtgcaaataattttagtaaattaaatcatatttttccactgacgtgttctaatttaaagatagaattttacttttaattgatccttaactaagagtggcacttaactattctcttactattgatgcttatgtgtatcaagcaatagattaaagccagtgccactgctactttgttttactgttattgtatttaacgagaagccacgttgtatgtaaaggagttaaagccctacttccaaaacactacttcctccttccctaaattcatgaggtggccacctcttttttttggagacagagtcttgctctgttgcccaggctgatgtacagcggtgccatctcagctcactgcaaccttcgcctcctgaattcaagctattctcatgcctcagcctcctgagcagctgggattacaggcacccaccaccacacctggctaacttttgtatttttagtagaaacagggtttcaccatgttgtccaggctggtctcaaattcctgacctcaggtaatccacctgcctcggcctcccaaagtgctgggattataggcgtgagccaccatgcccggccccacttcaattttttaatgtttgaaacttcacacttcgttagcattcactaaggcatactgaggaagcaccaacttgaattagtgaaaattttgaatgctataatataaaactacatgatcatatctcttcatggtacaatatgcaattcttagcagtctatagtgaagaatttccaagaagaaggctactacttctaggcaccttggtaaactcataaaatgaataaggttactgggtaattcatctaacacatttttacaattagaatcatcatccgtcttgtatactgtatctactttggtgccaaatgcctgcatttgtttagggctttactacgtataaagcaaatttcacataatgctatttgattcagacacaacactaatcattttggctaccactgtttgtatgactactaggagtgccttaatgatatgactcttcttttagcttctgacaaatgagtgttgctaagttatctgaatatgttcagttcctgttcactgagcagttactatatgcttggcatcaagctagaaaatttttgtccttttgggttaacaattcactctaaattatcattcattttgcctggtgacactttatcttatgctttattcagcacctgtctaaatgtacttatgtattcaaaagatacttaacacttgtaataggttacaggcacaaatttaaaatgactagggtctgcgggtgaaagtcatttgccatgtggaacaacactagtcaagaaattagttaatcaatcagtgttttgctctaactaatatatctttttcggggtttctccactttggcactattgacttttttttttttttttttttttttttttttttgagatgttgtcttgctctgtcaccaggctggagagcagtgatgtgatctcagctcactgcaacctctgcctcccgagttcaagcgattcaccatgcccggctaattttttgtattttagtagagacaggggtttcaccatgttggccaggatggtcttgatctcctgaccttctgatctgccagcctcggcctctcaatatgctgggattacaggcttgagccaccatgccctgccaaattttttaattgttgttgttgttgttatatagattagaggtttctatgttgcccaggctggcctcgaatgcatagcctcacctccttatgcgccaggacaacaggcctgagccaccgcggctccctggcactgacattttagaccagatcattctttgttctgggggactgtcctgggcattataggatgttcaacagcagcacttgcctctttccattagatgccagtagtacctccacttccagttttgatcatcacaaacgtctccagacattgtcaaatgtccccatggtggagtggaggggagagagtgtccctggttaaaatcactgggctagtgtggagatcatgatttctttactagattttaaagatcttgaaggcagagacccagtctgattcattgctctaccacctcttccccaccaactaaatttagtttctggcgcagaaatgtttcttgatgaatgttctgaaaagaataaagtatctcctggagtcctccactgtcgtcagccctgtacaaggcaccttggtaaacccacaggatgaacaaggtaactggggtaattcatctaacaaatttgaatacaaatttacgatttgaataatcatctatgtcgtatactgtgcccacgttggtgcaaaatgcttacatttgtagagggctttaccatgtatgaagcacatttcacataatgttatttgattcagatatctaatcactttggctaccactgtttataatttaaactcccaagtccgagcactgtatttttaggcaggagtgggaggtattttgatttcagtggcattgccttcatttattaaaaggaactcttgggattggtttaataataattgaatttaaatttcagattcttttttgtcatgttagaagtagaacatctaaaaggcccttcatgatctaagtaattctggtttacttagattcctggaaattgccagaggattttaagggaggaggaaaaaaagagtgaggaaattttccctgtgggcaattggggaaaacaaaaatatttttgtgctgcggtgacttctcaggaaaggagggttggccagcagcggctgcatctgcacaaggggaatttccacatttgggaaaacatggtcataattaatgacttaggaaagccaagaaaacggaccatgttggaaaaatatgatcttcagtggccaagtcattgtcaactgattgggccagaaaattggattattttagaaagagatatttatttgtgaatatttgtctgtaggtccttccttctgtgaatctaataagtgccctgctcctgcctggagagtcggcttctcatagcctttcccactctctctgtctctccctgtcctaagggaagacttgctttagacttctagcctgaacactggcctgcagtcttttgctttgaacatgatgcttgggtctagccaccagagattgctggatcctaacatagccctcatttattgatgactccatgtcctgggccctgggcgaagaacactgaaaaactatcttgatttagacatgagaaaactgagtcttggggaatttaagtcacttacctaggaccaatacagctttaactaccaagctatacttcttgcatctcctcatcctgtatataaagtctacttcctaaattggaatgttctcactctgtatacaatctcttccccagaccgccttgtttaaactagatctggcctgggttgatgttcatccaagtacttcctggttacctgttctcaggaggataagtctgggttagcaggctcagcaccatcgaatcttggtctacttggggaatgaatatgtagtcagaacattcttgcccagctttggggttttcttttattttagtgatcaattttattaaaataggtatgatcatcttttgcttcttcttttcataattttctcaagatcagggatcaggaatagcttgccaaatttcaacaggtattcccaagttgaaggtcaattttttttagaaagggaaatatctctaagaaaaaaaatccttatatttgacatgtagatgtagtatccaatagaacatcaacaaaatgcagtactttgttttgtgaattgaaaaagctgcaagttaggccgggtgcggtggctcacgcctgtaatcccagcacattgggaggctgaggcgggcagatcacgaggtcaggagttcaagaccagcctggccaacatggtggaaccccgtctctattaaaaatacaaacattaggccgggcgcggtggctcatgcctgtaatcccagcactttgggaggccaaggcaggccgatcacaaggtcaggagatcgagaccatcctggctacaaaaaattagccaggcgtggtggcaggtgcctgtagtcccagctactcaggaggctgaggcaggagaatggcgtgaactcaggaggcggagctggcagtgagccgagatcacgccactgcactctagcctaggcgacagagcaagactccgtatcaaaaaaaaaaaaaaattagctgggtgtggtggtgggcacctgtaaccctagctacttgggaggctgaggcaggagaattgcttgaacccaggaggcaaaggttgcagtgagccaagattgtgccactgcactccagcctgggcaacagaacaagactccgtctcaaaaaaaaaaaagaaaaagaaaaagctgcaagttaaatcatgtccctctgcagcaacaattccatgctctagacctttatgatgaggcttctaaagttagccctgccctgtgactgcaatgaatcggagaaaacaaacctaactaggatttaacagtctaattgccctggattgaacctcaatggtattataattaatttaaaaatcacaacattgggaaataatgtaatacatttcttttctgttgaaattaaaacatattaattaaatcttattaatatttgttttccgatcgcttcttgggcatagtcagacattattacctttatttggtgatatgaaaactgaaggggtgtattagttttctactgttgagtaacaaattatcacacattcagggaggtggaacaacatttcacttattccataggttttgcagttctataggtcagaagtcctggtgggcttggctggtttctctgcttagggtcccaatgagtcagaaatcaaggtattcatcaggctagactcttacgtgggggctcgggggaagactctgcttccaagccccttcagatcgctggaggaactgagttccttgtggctgtaacaccgaggcctttttatctttcctgctgtcaaccaggagccactggctgctcctagaggccttgcatgttttccttctcatgcactttcccccatcttcaccttcaaagccagcaatcacccttaaatctttctcacctctggaatctctgtgactttcctcttctgcttccagctgagaaaaactttttttttttttttttctgaaacagagtcttgctctgtcacccaggctggagcgcaaaggcatgatctctgctcactgcaacctctgcctcctgggttcaagcgattctcctgtctcagcctcctgagtagctgggactacaggtgggtgccaccatgcccagctaatttttgtatttttagtagagacggggtttcgccatgttgaccaggctggtctcgaactcctgacctcaggtgatccaccgcctcagcctcccaaagtgctgggattacaggcctgagccaccactcaaaaaactatttttttaaaggactcactggtttgggccaagccctctgggataatccccatattttaaagtaaactaatttggaacttaaattacatctgcaaaatcctattgcagctgtacctagattattgtttcacaaaataaccaggggatgggaatcttgggcagcaatcttaaggactctgcttaccataaggaaatagttactcagttaacctgagatacaatctagaaacagatgagcagcagtattaaaccaaagaatttaattttgtatttccttcccttttttgtgttttttaaacatatatgtttatttgttaatatacctgtatgtatgtgtataattattattattattattgttattattattattattttagagataggctctcactctgttgcccggcctggagtgcagtgtcaaaatcatagctcactgcaacctcaaactcctgggttcaagcaatcttcttgcttcagcctccagggtagttaggactacaggcgtgcgccaccgtggccggctaattttgtttatttttttagagatggggtcttgctatgttttcccggctggtctcaaactcctggcctcaagcaatcttcccaccttggcctcccaaagtgctgggattatgggcatgagcccccatgcccttccttactatagtatattttgggaggcactcacccccatattttatttttattaatgcatgatttaaaatgttgccaaggctgatttgggacatgtgtttttaagggtctatggacgtctgagtggtactgtcgaggcttggagctaggtgtgggtgtgtatggtagaggagatggtgatggcaggtgaagaagggacagaggctaaggttttggtgaatacagaagaggcatttactcccatttttaatgtattcactgaagatatttgaagatgggaatccttttgttttctataggcaagtctagaaggtcaaaacccaagggattctatgtgtgttatttatttttatttatttatttatttttgagacagagtctcactcactctgtcacccgggctggagtgcagtggtgtgatttgcagcctccacctccccggttgaagtgattcttgtgcctcagccttccaagtagctgggattacaggtgtgcatcaccaggccctgctaatttttgtgtttttagtagagacagggtttcgtcatgttggccaggctggtctggaactcctggcctcaagtgatccgcccacctcggcctcccaaagtgttgggattacaggcatgagccaccgcgctggactatgtgtgttatttatgggcagtatttgaggatgttgccaaacaggcattttggagcatgtggatcagcatcactagcatgccatgcctttactacagattcaaacttcccaagtttttgctgcacggtttcaatgtaccatggcctaccagatgtactaaaggctagaacacaggctgagtccatgggcccagctaaccactgatccagaagcctgggcccacagagggtcaccttgggattgcaaaggtctggaaaaggctgagaggatcatagaaaggaagaggatctattaatttttctgatcttgtaattttacctggagaacagcctgatgaaaaatctaaaattctggtcaagggagtagagatggttttagcctttggaaagaacatatatagaaatatgaaaaacctaagaaaaaggcaaaatgtttcagaggctaaatatttctcacttcttcccagaatatttaggtttcccccttcttaaagtcctggccaaaaatggagggaggggggagatttcccagatgtttcttttcaattgtcccagaccttcggaaaagagtgagaaaatgctaccatattattgggcaaagagaagtaagtcagtggagagggcatttgataactgcactgaaagagtgatacaattagggtataagtggcatgtttacctttggaaaggaggacacaggaggaaagaggtagggtggaagatgttaatgttgcttattcattgtgatgtcttaaagcacaacacattgtatgttctttcactggcaaagaattttgctctataaagaataactctgctaggcatggtggctcacacctgtaatcccaatattttgggaggctgaggctagcagatcgtttgagcccaggagtttgagagcagcctgggcaacacaggaaaaccctgtctcaacaaaaaaatataaacaatagctgggtgtggtggtgcgtgcctgtggtcacagctacttgggaggccgaggcaggaggattgcctgagcctgggaggttggtcgaggctgcagtgagctgagatggcaccactgcactccagcctaggtgacagagtgagaccctgtcttgaaaaataataataactaaaggatactggtaatatgttacagatattacttttattcttaatacttctacttaaaaatctttcccttcatttattcaatcattcagaaatctttgaggagaacctgccatgtgccttcatctgggtgctaggaatacgacagcaaacacaacagatgaggtcccagctctcatggagcttatattctagtgtaggggagttggaaaatgaggaaacacttacttttcattacgtgatacataaagaggtaaatatgatgtgttagactgtgaaaggttagacagtgatagcaatgcagagcaatataatagagtgaagtgatagatgacaagctggctattttagactgggtggctgtggaagacctgtctgaagtgatgacatttgaacagtgatctcaatgacagggaggagctggtcatgaaaagatcagaatgaagagcactctacgtggagagaacagaaggttccgacatcctcaagatggcaagaaatttgagtttgagaaagagagagagggcctaggtggctggaactcagtggcaaatgcaaaagtggtacaagatgaagttggacaagtggacaggacctagatcatttaagcatggctggccatggtaaggaatttggatttttaagtgagatgggaagctctcagaaagttttaagcaaggaagtaattttctgtttgggcaatgaattgcagagagcaagggtggaagtccagagatgtttaggaagcaattacaggaattcaggccaacaatggcggcttggtctaggatactagcagtgaagatgaggagcgctgggtgtatggggtgtatgtggaaggcagagtcaatgggactttccgatggcttgtatgtaagatataagaaaaaggaaccaaagatatgtcctctgttatcagctcgggcactgggtggatggtgatgccatttagtgagacaggttggctgggaacaagaagtgtagaagactctgataaatccctcccaaatagctgttcctttcttcctccttgctaacacagccctgactttgtttaggatgacagtttgtccagcttcaagtgatgaattatgattgctgtcattcagtcataataatcccattcccttttgctagatactcaatcccctcatctcctttgcagctaggggtgactcatttctggctagtaagccctaagtgaaagcctctggggatagatgtggctgtccggaataccatcgcaatagttggacctatggcagccatcttctgactgtaagacaaaagacatgaggattaaagaccaatacatgaggtacgataaagtagaaaaaaaaatttacctgattcctgggtagtatagatgagcagctgggtcaacaccggaaatcatctattgccaaacatcttgtttatgaaaaaagtaaaactatttgtttaaatcttgttgtttgatataagaaggttaagggaaagaatcaggagtactcttctaaccatgttggtttgagatgcctattagatattcatgtgaaagtgactgcctaatttcttcctttctccaatggaataaaattttctagaccttttaaatcttagcataggattatagcactagaaaacatgaagcattggctgggcatggtggctcatgcctataatcccagcactttgggaggccgaggagggtggattgcctgagctcaggagtttgagaacagcctgggcaacacggagaaaccctgtctctactaaaaaatacaaaaaattagcaggcgtggcagcgtgcacctgtagtcccagctacttgggaggctgaggcaggagaatggctggaacctgggaggtggaagttgcagtgagctgagattgtaccattgcactccagcctgggggacagagtgagactgtatctccaaaaaataaacatacaaaaaattagccaggcatggtggtgcacacctgtagtcctagctacttgggaggctgaggtgggaggatcacctgagcctgagaggtcaaggctgctgtgagctgtgtttgtgccactgcactccagcctgggagatcgactgagaccctgtctcagaaaaagaaagagagaaagagagagagaaaggggaagggagggagggagggaggggaggggggaggggagcattaagcataaaagtgaatgaagttgaagtggccaggagggagaccaaattagaagctgaccatcaacatataagactgacttccctattattgataggttagcagggttgaagtcgttaaaataggaaatacagtatactgggttggtggggaaagctcagtctgaggaacaggcaggttcccacattaccaagtatcttccatcaccatggtggggcaacactgtcctggactagagtatacatttctatgaagataccttcttacctatatgacacagtgttcatgtactgctgtatttcctctcctgatatataacaaataatctagtgaaaatttcccactaacttacccagggaactataagtaggccaaatgaagcttttagcacactttctggttgctgataaaaatcagcaactataaacccaattgctcctatttccattagagctgctttccagaactaggtctccagttatgtacattaaaagtttgccaacccacttattttcttcctaaatactttattatatgcaggatggcttgggcttcatctacagcaaacaaatatatgtatatatttgccagtgggccatcagaaacatctattgattgtctatgtgtacaagtaactgagtctgcaaaattgccttcaaaggctaagtctcttgtattctgcccttactgagagtctgtactctcctaaggttaattggcttatcatattctgcttttgtgctccctagtttaccatgatgcttggggtttttgcccctacgcttttcactttgtcttcctgtaatttattacaaccaacccttgtgtttttttttttttaacagttttggatctgcattaattttttagtccccagaggaacactatgttcccaaacattatgttctgcactctcatgctcatatcactttgtgtagtgccagacacctcctgggatctcaagaaatgttgtttctttttaaaagatgggtgattactctaggaggctcataaaagatctttctcagttgagttactttcactgtttatgtatcccaagtggcttaggtcaaaatattggttaatagaaagactccaagtctttggagaagctttactagtgtctcctcatctctgtaaaagcaaagatgagtattgaatggtcttacaggagtgttggagagaaatgatgaaaagcattagaaatgagaaggcctttgttgaaaatatgaaatgccagagtgaagacagtatcattattcccaagcaggcctcagtgtaagcggagctctctccaccaattgaagctgttcatcactacaaagaatggctgtcctgcaggatcctttctgctgctggctcctactgcagagaatagaaacttctttctaaatactgtatccaaaatgtttcctcttctctcaacttctcagctctatccaggacacttcactgctttcctccaaggcaaacttgaaccttcctctaaattccttccctgaaggctgttttgaggcagagggataggaccatggacagaggcttagcctaccaatcactcacacagcaggaaagtcaattctcttcctaccaggaatccctgggagagggtgtttacatgaatagactcttctttaactataggtcacttttcccttctctaacttcctttggagtgatgctgtgtcttctagaaacactgactccttccagcaactctctgctccttagacatataagaaatactcattcttgcaaatgcagttcttaaaatatttcaaaacatcttcattataaaatatttcaggcaaacagaaaactatgaaaaatagtttaacaaacatctatgtgtaaaacagctaccttagctgggcgcagtggctcacgcctgtaatcccagcactttgggaggccgaggagggtggatcacctgaggttgggagttcgagaccagcctgaccaacatggagaaaccccatctctactaaaaatacaaaattagccgggcatgatggtgcatgcctgtaatcccagctactcctgaggctgaggcaggagaattgctggaacccgggaggcggaggttgcggtgagccgagatcgcaccattgtactccagcctgggcaacaagagcaaaactccgtctcaaaaaaaaaaaacaaaaaacacctaccttaacagatcttaattttgacttacttgatttagggtttgtttgtgaaaagtcttacaatacatttgaggccccttacctaccgccaatcacattcatttctctatttttctccttccctcttttcacaaaagtaaccattatctggaagttgcaatacgtgattcccatgcaacttttatacttttatattatacatatatatacataaacaatacaaagtattgttttgtgtttgtaaagtataaaggaaaactatattatgctgtatataatattctgccgtgtattttattcattattattttttagatgtgtttatattgcagcccaaagaactaagccattacttgtaattgttgtacattattctcttgcttgaatatatacaggttacttatccttcctcttgccttaaggatgtgaaggttgtttttagtttgttgtcagtgatgctataacaaacaatgctgcaattaacatttaaataccggtcttctggtgcacaccatgtgaggtttttctaggccagagtctgtcaaccttgtattattgacattttggactagataattctttgctgtgggaaggatgttgagcagaattcctcacctctaacagccaagaatatcttcaaatattaccaaatattcccttggtggggaaaatcacccttggttgaaaacgatgagtctagacaatttacctaagggaggaactacaggtcttaggattcatattaatatacagtaccattttgctttccaaaagttctgtttctccacattttgctaatttttggcattttcagaatttaaaaattttgccaatttataggtatgaaatagttgattatttttcttattgcttcgcatgagttctttataatttttgaatactaacacatggatggttttatgcctagcaaaatatctcctctcagtctgagctttctttttcttgatggtctcttttttaaagtggtaaaatgtatccatattttcctttatgttttatacttttatgttttatttaataagttcttccctaccccaaaggtgtaaacataatgtcttgtatttttttctagaagtataaagttttactgttcatatttaggtctttaaaccaacttaaacttactgtgacatgaaacaggaaatatgtatataattatttccacccgcctcagcctcccaaagtgctaggattacaggcatgagccactgagcccagccctcgttctcctttctagcctcaattattttcaagtattcatgggtcctctgccatagtgcatagtctaagcccgtcatagtaatcccattcctttgggattggttttggcacgggcttctgttgcatgtcttggcaatgagacctaagtggaattgtgctagagtggggttgggatggggtgggtaagttttcctcatactgaaaaaagtacatgagaaaaagacttgcccttcctatgtttgtacaaagttggagaaaaatgtgatggctgatactgtagcagccatcttgtcactctgaggggacaagctggaaaccagcacacagagattaactaagcagaaagatgaaaaggtcccaggtccccatgatgctgctgtgctgttgaagtaaccaatattggggctacctatcactggacagcctgtaatctgaaataataaacctcttattgcttaagccactctaagttgtatattattactttccaccaaatgcatgtaatttttgaccctttcgttttctacatggactttgtaatcactgtaccatgttccataatcaggttgggatttttcaaattgggtttgcattgaaattaaatattaactttgggagaactgacatctttatgataatgaatgttttaattcatgaatatggtatatgtttccatttattcaaatcttctgcaatgttttccataagaatattttatatacaaaagtacatgttatatttattcctagacactatattgtttatggctattaagtatgttatcttttgtttgctagtaaatgttgtatgtgataaatactgagatgtagggttacagtggaattttgtatgttgatcttataccaatcagcatacaagacagagtttcgctttgttgtcccagctggagtgcagtcgcttgatctcagctcactgcaacctccgccttctgggttcaagcaattctcccacctcagcccccaccaaatagctgggattacaggaatgcaccaccacaccagctaatttttgtatttttagtagagatggggtttcaccatgttggccaggctggtcgtgacctcctaaccataagtgatccacacacctcagcctcccaaagtggtgggattacaggcgtgagcctctgtgcccagacaattgttgtttttttacagacagggtctcaggctattgcccagcctggtatgcaatggcaccacaataactcactgcagcctcaaatttctggctcaagggatccttctgtctcagcctcctgggtagctgggactacagacaaacatcaccacacccagctaatttttagattatccggggatcttgcccaggctggtcttgaactcctgggctcaagcaatcctcccacctcagccttccaaagttctaggattataaatgtgagccactgagcccagcctgaattgtctttttaattctgattttattttcagatagtctgtatgatattcttcataaacgattacattatccaaacaaggagagtttgtcttttctttttctctactgtgatgatggagataccatggattcagtcatggaggcctgtagttgcttgatccagtttcctgtctgtgtcctttcttcctgccccatcattccttcatgtaaagcctattaccacatgcggtcagcttatttagcctaacaagccagtttgtttgggggggataggggctctcagtctagcccataggttcaagcagtgaacctggtttaccacccgctcccctcactccatgcaggtcactgttagttccctttaaggagtctagacgccccattctagcatcccctgcctcttttcagacctggaaccgaaccggcccatgtttttagccccatttattgctttgcatttccggtcaaaagaaaagtttatatttgggctgggcatagtggctcatgcctctaatcccagcagtttgggaggcagaggcaggcagatcacctgaggtcaggagttcaagactagcctggccaacatggtgaaactccctctctactaaaaatacaaaaaactgtactgaaaatacaaaaaatacaggagtgcgtggtggcgcactcctgtaatcccagctacttgggaagctgaggcaggagaatcgcttaaaaccaggaggcggaggttgcagtgagccgacattgcgccactgcactccagcctgggcgacagactgagtctctgactcaaaaaaaaaaaaaaagaaaaaaaagaaagtttattatatttggagaaaactgtgtcttttaatttttctcctttatattttaataaccattgctttgtgcttagagctgagcgagtgcctcaaaggttcagcaatgctaccttgaccagaaatcataatttcaatgtctattttgtaaaggattacagaactagcttctactactgccgacacttcatgcagtaattatcaccaaacacaatgctactcaatttctacaatgtctttcaggtccttgtgcttggtaaacactatacttgtgtctgtgtctgtcacctgggtaatgggaatggagataaatactattttctgcacccgaaaaaactgaggcctcttactaaccagacagccacaggactgtgagttcctccaatgatagggctgtgcctttttcatcctgtgcctcctcacgaaaataactcaaaccaaactctgggcccatacctggctttattcaacaagatgtcccatgaactgaggagaccccctattgagtgccctcaggatctatgcagtaccatggcttgaggaaatgagaggctaaaaagacaggaataagaaccatgatagttgattttaagcaaaataagtgagaaggaattgtcgatggcatttcatctagaaagtgaattttgattgagatttagatattttttatatgaatccccttatataaactagcttagtatataaatataatcaaaatagcattcattaaaattgcaaaacttatttattaaaatatgtaaaacagccagctgcaacagtagtgactaagaagtataaaaataaattatttttttcaacaaatacaaatatgtattgagttcctactatgtgcttacacagtacaggaaatggggatacaaagataaataaaacagatccctgtgcaactaaaaatccagttgggccgattgttgggcaaataaatcatccaaatatgatgggatagcttgggcacagtggctcacgcctgtaatcccaacagtttgggaggctgaggcaggcagatcacctgaggtcaggagttcgagaccagcctggccaacatggtgaaaccctgtctctactaaaaatacaaaaattaaccaggtgtggttgtgggcacctgtaatcccggctactcaggaggctgaggcaggcaaattgcttgaacccgagaggcaggcgttgcagtgagccgagatcgtgccatggcactccagcctgggcgaaagagtgaaactctgtctcaaaaaacaaaacaaaacaaaatatgatgggataggctccttaaaagagtgttagtttgaagaaatacttgtacccctgtgttcatagcagcattatgcacaatagccaagaggtggaagcaacctaagtgtccaatgacagattaatgtgtaatcgcccaaccgggttcttcttgcctgctgcccagaaaagtcaatgcaaaactagcaggttctgcagcaaagaaagagtttaataaatgtggggccagccaaatggaaggacaggagataattctcaaatccgcctccccaagaatgtgagggctagggtttttccaggatagtttggcaggcaggagctagggaatggggaatgctgattggttgggttgggatgaaatcataggggcttgaaagtgttttcttgcactgagtcagttctcgggtgcaggttatgggtctgagtggtgccagttggttcatacggaatacaaggtctgaaaaatatctcaaataccattcttaggttttacaataatgatgttatccataggggcaattggaaaagttataaatcttgttaccattcgctacatgactcctgagtagtaagtagtttttaaaggcaagttataaaacaatgactgattagagtttaattatgtgtatatcttagcagaattcagacctctgtcacaattctaaccttgtggacttacgttagttatatgaaagtggttttggtccctgagcaagtagagggggttagttcaggaaagaagtatcatcgtctttgttttgaagttaaactatgaactaaattcctcccataattagcttggaatgagcaagttagcctgtgaggttaaaacaagatgtagttagttatgctacatttccttcactgtcgtaatttttgtataggtggttcccagtggataaataaaatgtggtatgtgcatacaatggattattattcagtcttaaaaagaaaggaaattctgacacaggctacaacatggatgaaccttgggaacatgatgccgagtgaaataagccagtcacaacaagacaaatacctcaaggtctctctgaccttccaaccttccccccgacccccgacctctaccaaagaaattgaagttcctttatctgcctgagatcagtcttaccaaggagaacaagcattttcttcccctctccggaagaccaagaatgtaaccacagatgaacagaccctttcacaagatagtgcctgtctttcagactcatttatgagactaatttatgagtgtgattacactcatgtgaagtatctagaatggtcaattcttaggaacagaaagcagaatggtggttgccagaagctgggggaggaaggagaaatgagagttgtttaatgggtacaaagcttcagttttgcaagatggaaaattttggagattgatggtccaacaatgtgaacacacttaacacaaatgcacagtagacttaaaagtggttaagatggcaaattttatattttgggtattttttaccacaattttaaaaatgttaaaaaaaaaaatagtgttagcatccagagggcagaggcatttctaacatcttgcagaatgcctgatataatagtaggcacttgataaatattttgcctccccttggtttctgtgccccatcctgtgtcctacacaacaggacaaaggccaagtcgttctgtgagccaattcagcaaacaaaggcacttctctctccaaggcacagagaagaatttcgaatatttgtgatttgaaatttgtcctggtcacaccaactattctttacttctcagatatgcttatctgagttcttttggcatttaacttgtctaaagatagatactgtttctacttcccaaaacagaattgtgatggactttgtaaggaaaaaaaaaaagtgggaggaagtctgtgaaatgaaatcattattaggccatggtacaaatggctgtcgggccctgggttcagcccagcacaggaggaagggtgaggtaattagcatggatttgcaattctgcagctcgcttttgttccctccctccactggctgtgtctgattctagtcactgggtttattctcttgtgtttgtttttttcacttggccaaaaatagagagacaaaaaaagtttcctcatacttacttcagctttttacttttttccttgtgtgtttggtttcctcttacgtgatccttccttcttcctgccacctgctagtttctctatggtggggctcagaaaccaacatcccacaatatggcgcactgacatgccgcactgaggaatcctcaaggtctctctgaccttccgaccttcccccctcacctccaatctctaccaaagaaattgaagttcctttatctgcctgagatcagtcttaccaaggagaacaattgttttctttccctctttggaagaccaagaatgtaaccacacatgaacagaccctttcacaagatagtgcctgtctttccactcatttattattccaatgaaaactatttacaagttaatttctagtccccatcctatcattctccctagtaatcatttattgcccctcaacagaattctctttctccccactcccataacctgttttataaggatcaagcccccatttttttctgtaacctcaagacggtatcaaagcttctgtatctcattgggaagctggatcttcattctgaaggcccttgtatacatgtaaccgtaataggttcattgcccaatgcccacgcaagtcaatataccgagacacctggttggagcagagaaagaggtttaatcatagggtcactgaacaaggagatgggagaaaaactcaaacacatctccaggaggaatttggagttagggttattaagggttttggagtgggccagtgtggaggtcatcagttggtagaagagtgtagcgtgacatcatgggacagggagatgaagcagctattcgctcatgctgatcctcttcctctgtggggggtcttcaaattggttgctagaattagaggtctaaaaaacatcttaagtgatccttaaacaaaagccttatgattgattctgacgtcagatatcccgtctggaggaacagagagggtacaaatcttcagtatctagtgacttttagcaacaaggaagtgggccaaagtgcagcctgattaatgcttatatttaattaatgatattatataacatattatgtaatatattctatgaatgcactatgaaatacctgtatttctgtccagaacctggcatgcaattcttgtcaaccctgtgtgggtagtttcatgcatatgaagtcaatttgtataccttttctcccatgttaatccatctgcctcatatcagtgattttgcagcaaacctttatctgcttttcctacctttctcaagaatagcttttccttgtgttctgtaaccctggcttggtgcacagtatgcgtgatggacaggttgagttgcaacacttggtgacagtacagacatggagcctggaaagggcctgcggggtttgaattgagggatgcccatttctggtccaagccctgggtggagctccccattgttggttcatggccctgggcgtgcacatggccaagaagcagagtagagcagaggtgccctgcctagtgctggaggagaaaggtgtccaggcatcttccaacctcctcatgccagtatgctgagagggtaagtgcaggacagagccaatggaagacctccttagactgggtgaatcatggaaccaactgaggtttccattctggagatttgatcatgccacttttttttttttttttttttttaaagaccgaagtctggctccatcacccacgctggagggcagtggcatgatttaggctcactgcaacctccgtcttctggtttggatgattctcctgcctcagcctcctgagtagctgggattacaggtgtgtgccaccacacccggctaattttttttttttttttttgtatttttagtagaggtggggtttcaccatgttgaccaggctggtctcgagctcctgaccttaggtgatccacccaccttagcctcccgaagtgctgggattacaggtatgagtcaccatgcccggcctcttgccactttttaaatgtaacacttaaatagttcttgctgtgtgacagacactgttcagacactgttctaagtgcttttattttatttatttatttattttgacatggagtgttgctctgtcgcccaggctggattgtggtggtgtgatctcggctcactgcaacctccgcctcctgggttcaagcaattttcctaccttagcctcttgagtagctgggactacaggcatgcaccaccatgcccggctaattttagtagagatggggtttcactatgttggctagggtgatctagtgatcactttaagtgatctgcccacctcggcctcccgaagtgctgggattacaggccactgtgcctggcctctaagtatttttaaatattaactcatttaatccttacaacaaccctgtgagctaagaactactattgtctgaattttatggatgaggaaaaggaaactgaagcccagagaggttaaggacttgctcagagttacccagctgttacttctctggtttatagatggcaccttcctgctgtgtccccacgtggtggaagaagggaagacatctctctggtattagcatctttaatacccgaagtcatgcttttcactactccaccatgctgccactctggtttatgtagagtctcccaggatctcctttggagatttcatggctgcttttacaaagcatctcccctaaggtataacactctctgttgggtttgggcagtgtgtgtattcctctgaaacttctgtgtgcctcctggtgtatccactggcagtcacgtgttcacaggcttaattctgcagaagacatcagaatctgcccttctttctctccagggataagggcacaaggaagccatttctacccatataaacatttaaaaatacaatttcaggccgggtacagtggctcacgcctgtaatctcaacattttgggaggccaaggcaggtgaatcacctgaggtcaggagttcaagaccagcctggccaacatggtaaaatcctctttgctaaaaatacaaaaaaaaaaaaaaaaagaaagaaaataaaaactagccatgcatggtggtgcgcacctgttatcctagttacttgggaggctgaggcatgagaatggtttgaaccccggaggtggaggttgcagagatcacgccactgcactccacttttggtgacagagcaagactctgtctcagaaaaaaaaataaataaatacagtttcagcatataacaagcactatgctatcttcatggtaagaagtgctctgcccctacataggaaaggatactactttgggatctgttgccaatctgggtgagtttatagggattcttccccacattcccctttcagacccttgggaacagggtcatgaaatttttagatggttggctggagtcaggcaaccagttcagagctgtaggacaggttttctggtgagagtagcaaactggtctggagacaagcccaggacattggcttccttactctggaagaccgtagccatagctcggaacatcacaggtactctgctaatcctctgaaccttccatatgtccctctggctgtgccccagatgactttgcctagtaaaactgggttagcagagaagaaagatttacaggaagttaggatgagcttgggtttctgctgcctacactaaccctgacttgtgttgcgggaccaggcctcattgctacacagagatttttctgtggctctttcatgcctcctgtcagcttgccgctcttaattcccaaggcctctgcccattctccatctctaaaatgcttttcctggatcttcttcccacagggctctcatgctgagctggctggaactgatagcgaattcttgctaagaaatgagctgatcacttctgagttacagcctcagctctatacactgcatgtgctttttttgttgttgtttttgttttttttgagatggagtcttgctctgttgccaaggctggagtacagtggtgcgatctcggcttactccagcctccgcctcctgggttcaagcgattctcctgactcagcctcctgagtagctgggattacaggcacacaccaccacacctgactaatttttgtatttttaatagagatgggtttcaccatgttagtcaggctgatctcgaactcctgacctcgtgatctgcccaccttgtcctcccaaagtgctgggattacaggtgtgagccgctgaacccacctgcatttgcatcttaacagggacatcaaaaccaaaaagtttaaaaactcaaagcactggctggtgtggaggctcaaacctgtaatcccagcactttgggaagctattggggacaatcaatcgcttgaggccaagaatttgagatcagcctgggcaacacagagaaacctggtttctatacaaaaatttaaaaattagctggggctgggtgcggtagctcacacctgtaatcccagcactttgggaggccaaggtgggcagatccccttaggtcaggagtttaagactagcctggccaacatggcgaaaccccatctctactaaaaatacaaaaattagctgggcgtggtggcgagtgcctgtaatcccagctactggggaggctgaggcaggagaatcgctcgaacccaggaggcagaggctacggtgagccaagatcacaccactgcactttagcctggtgatagagcgagactccttctcaaaaaataataataataaaataaaataaagaattaaaataaataaaaattagcagggcatggtggcatgtgcctgtagtgccagctacttgggaggctgacgccagaggattacttgaacccaggagttggaggttacagtgatcatgccactgcgtgacagagtgagaccctgtctcaaaaaaaaaccctcaaaggagtgaacatctcaggttaggataacaggctccttgaaatactagagatttggctgggcgcagtggctcatgcctgtaatcccagcactttggggggccgaggtgggcagatcatgaggtcaggaaatcgagaccatcctggctaacatggtgaaaccccgtctctactaaaaatacaaaaaattagctgggcatggtggcaggcacctgtagtcccagctactcgggaggctgaggcaggagaatggtgcgaacccgggaggcggagcttgcaatgagccaagatcgtgccactgcagtccaggctgggcaacagagagactgtgtctcaaaaaaaaaaaaaaaaagaaatactagagatttgggggacggtgtcttttagtctgttcaggctgctgtaataaaataccatagactggatggctcatgaacatgtggaatttgtttgtcacagttctagagctgggaagccacagtcatggcagattcggtgtctggtaaggcctgctttctgatccataagcagcaccttcttgctgtgtctccacatggtggaaggagggaagatatctctccgaggtctcttttataagggtactaatcagagcccctcatgacctaatccctgctcagaggatccactcctaaaaccatgactttgggggttagattttcaatacatgaaatttggggagagacaaacactcagtccatagcagctggagtcccagccacctcatatttttatatgcatctaaaaccggccctaatgtcagtgtcaggtccatgggcctcctcaaatccaagataaaaacattcactttggagcaacagatctctctctttctgagtttgtccttaggattcagcaaattctaagacccagatcagggcatgctaaccagttccatttattggcaactggagtaggatcctttgtcgagttgggtatttcctctgacgtcactgggctactctcaaggctccccggtgggtctttgccaggaaaacctgcatggaaaaggaggcttggccttcgaggaagacggcctgtgtcctggcagactgggtgtgtctgctccaggctggcctctcctcatggctgctggttttctggactaatgcacttttgacccaagaagggaaaaaaggtataaacagaggagctagagcagtcagctgttactgggtgggacttgtgaactggtgggctggtggcagccccagcccttcctactccctcagagcctgctgtccttcctggcctctctaccccgcctgccttcccccctccctccctccctactttctccccagccacttctcataaagaccagctgcctaggtgacaccttttgcttctaaaaccttccttgttgttcttccttggcccctttctcaaaatacacctctctctttcctccttcaatgccagactgttggcatctgtctccctgtcttgtgcaggctgccatctctggctcaccatggttttataattgcctctggttaaagtttaaatagatgggtttcagcccaagagaaaaatgtaaacaagccctttctgcagtctttcagaactgctgacttctagtgcttttgagttctgtgctaggaaattcattttgctcctccctaaccaaggaactgagaaacgccattagggctttcagagccgtgacagcctctctgaaaccattgagaggcttttagatgatccgcacttttccttttaactcaattaagccatcaggatccagttcccatcctagcatgtttatctagtgtattcaggtgagagaatagttcagcaaatcttcatggcctggcttctgaacaggaaggaaatgaaaggaattgtcatttcactattggagttttttctatgtgggagcaggggattgtatttgttgtcccagggtttttggttgatgaagttgtcttgtgagtcatgagaatgggactattcctggccagtacagaaggaaaagggcaggctggatttgagctcatgcattctggtatatatcctctcatttgctgtgtgtttttgtttgttggggttttttttgttttgttgtgttttgtttttggaagtaagtgggccatttatttttgagtcttgatgaagaatattgattttctatatttttctgctttgtataccttgtgtacttgtgatctgatgtcagaatggattcagcaataatttgagatgttttggtcaaggatttgattggatctttgcctttcccactcaaaaatcttccagaattccccatttcatgctcagacttttcttcacaaccttctatggtcgacctcaaatctaccatcacttttcactattccaaccatacactgagttcatgtgagcttttctacccagctcctgtaacccgtttctttccctgcagtgtcctgacacctgggactccttccctgctctgctcagcgtcttatcagaacgttcttccagggttctatgaaaccttccttgcctctgggcacaaccggaaccaaccactcctccctttagttctccagcacaagacaatcccctttatgataaggagacttcctttcttcttttcttttcttttctttctttccttctctctctttctttctttttctttcttttttttctttctttctctctttctttccctctctctctttctccctctttctctctttctctcttttctcttctttgtttctttctttctttctctctttctctctttctttctctttctttctttctttctttctttctttctttctttctttctctctttcttttccttccttccttccctctttctttctttttttttgagacagaatctcactctgtcacccaggctggagtgcggtggagcaatcttggctcactgtaacctgtgtctcccaggttcaagcaattctcctgcctcagcctctggagtagctgggatcacaggaacgtaccaccatgcatggctaactttcatatttttagtaaagccagggtttcaccacgttggccaggctggtctcgaactcctggcctcaaggaatctgcccgcctcagcctcccaaagtgctgggattacaggcttgagccaccgcgcccggccttcactcgtatttcattgtttattatgcatcctttgctcatgtggcagcttcctgcattccatgctcttcccttccagcgcgggatgatttattctgtcccccagtagggcccagcttcgtgtgtggcccataatcagagctcaataaatatccaatctttgtttttcatcctcttttcaaccaaaagttaatgtcaacaattttttgttgttgttgagacagggtctccctctgttccccaggctggagtgcagtggtgcaacctccactcaatgcagccttaacctcccaggctcaagacatcctcccacctcagccccctgagtagctgggactacaggtgtgcaccaccatacccagctaattttatttttgtagagacaggtttctgccatgttgcctaggctggtctcagcaatagaacattcttatcagaacattctgatgttcttatcttaacattcttgagctcaagatctgggctcaagtgatttgaccacctcggcctcccaaagtgctgggattacaggcatgatgtgccaccttgcaccaaaccttatgtcaacatttaaaaaatagctcttgggaggaatcaagaggaataaagaaaggattttggagtcaggcagatttgggttcaaacctcagctctgctgctcttagtattaggggtttttccctaattcttatcctttctcagcctcgctttcttcatctataaaatgaagacaataagatctcttttatgggtttttgtgagaattaaagtgaaatcatgcaagtaaagaaccagacatagttacatctcatccttaccctctcttgatgggaaaacagttcaaatgttgaaacactgtactctggaacataagtcttatcaatcaatttaaaagatccatgctacattttcccatcattaacacaaccttccttgatagaacagtttcttctcacttgtactcgcaagttttttaaagccttatcttgtaagtaggattggacttgttcaccgaaaatccaaactctgtaaaatcttctaaagagttgattgtgagccagtagaagtgactgtagcccagagaaaacaaaaacccaagaattattgagtaagtggtcctaaggtggtcaggttatagtctggttttatacattttggagaggcaggggttacaggcatagacataaatcaatacatagaaggtgtacattggttcagcccaaaaaggtgtgacatctggaagcagaatgtagggggagggtgtggggcttaagccgtaggtgggttttagggattctttttttttttttaattatactttaagttctggggtacatgtgcagaatgtgcaggtttgttacataggtatacacgtgccatggtggtttgctgcacccatcgatccgtcatctacattaggtatttctcctaatgctattcctcctctagccccccacctgcccacaggccccagtgtgtgatgcccatcccccacccccacacccgattggttgagagagttaagctattatctaaagatctgaagttagttgaaagaaatgtctgagttaaggtagaggagttgtggggaccaagggctttgttacgtagaggaagcctcctatatcacagccctctgagagaatagatggtcaatgtctcttttcagacatgtgtgtgtgtgttgttgttgttgttgttgttttgagacagggtttcactctcttacccaggctggacacatgtggtgacaagaccacagctcactgcctcctcaacctcctgggctcaggtgatccttctgcttccgcatcctgaggagctgggaccacaagcccacgcctccacaggctgctgattttttttattcgtagtaatggggtcttgccatgttgcccgggctggtgtcgaactcctgggctcaagtgatcctcctgcctcagcctcccgaagtgctaggattacaagcccaagccaccacacttaggcggtgaatctctcttagatctaacaaaggctggctgcattaacagagattctctacagatgcaggtttccctgtttcgtgatggctttgcagggctacttcaaattatgtcaaagaaatatacttcggggtaaaatattttgatttccttcagggtctgctgtcctgtgatgctatattagagtcaggttggaaagtaagcctcattataccaggttaatttttaaaaacccatttaacaagattctgtggtttgtagggtgtgacttaacccttgcctggcatggccttgggtcttgtttataatttggtatcttactgccataaaaagtctgttttgacagtcttatggtctctattttaatattaatatgggtcagttgtgcccaaatccaaaagggaggaggtataaggaggtgtgtcccacctcccttctcatcatggctgggaattcagttttttgggattttctggggcccccttggccaaaagggggtctgtttagttggagggcttagtattttatatttgatttacaaacttatttattggtcaccagaagaaatcccagtggtggggatgatgaggaggcagctgctctgtttgctgctgagttactttcatatgtagtcccttgtaggggccaaagcaccttggatgttgatccgtcatgttgacttctgattaaccccagttctgggaaggcttctaagatttccagtttatctgttgttctttatgtaagagcatgtatttaccatacatcttgcccttaggtcaaaacaaccttaatcataaatcctaccattagtcaggttcacatggcattcttgcctttccctgcagggtcaatttcaattgccctgtgccttccttccctacagtatataagccctgactgagtctgggagagtaatggcatggggagcctccatctcatcttgcgactgaccgggacatcatggcttctgtttatatgtctcttttggccgggcacagtggctcacacctgtaatcccagcactttgggaggccgaggcagatggatcacttgaggtcaggagttcgagaccaacctggccaacatggtgaaaccccgtctctactaaaaatacagaagttagctgggcgtggtggtgacgcctgtagtcccagctacttgggaggccgaggcacgagaatcgtttgaacctgggaggccgaggttgcagtgagcggagatcgtaccactgcactccagcctgggtgacagagcaagactctgtctcaaaaaaaaaaaaaaaaaaaaaaaggttttaaatctgatgggcctggcagggcaggagaggagaagataaacatttaactacaggattgtagcggtacagaggagggacagttagcatgtcaggaaaagattcagagagttgatacttaggaactgagtcttaacctatcagtacatggctgtcaaaagatagttgggacaaagcacttcaggtacaaccccaattctcgtttcttccccctgtgtatcactacatgcagcctgaagcacttggctccatcgtcttgaacctgtacagctgtcttccccttggtccaggtgacgtaagggcttccttggaagcagcagcatttattagtgctggttccaatcagagaactgacattagaactctactgttgctcttgtggccagggccaggaaacagctggagtggtttgaactctctgcaggaggatggatgcgttgaggctgggcatgtgtgcatgctcgtgcgtgcagatctgcgtctgtgtgtctatgagtctgagtgtgtgtaggtgtgtgtccatttggatgggtggctagatgtttatatgtaggtgttgccaccaaaaacaaaagtagatattcagaaaacaaagtgacagctcaaaacctcagacaagctgaaagactgctcagagaagggggaggttgaaacaacttcaaccaaaacaaaatgaaacagagaaggaagttgcatcagaagaggaagaatgccaatgtcatgctgaagaaccacaaatgtcgcaaaataaaaataaaacgtgtgattcttattttacctagccaaatattattacaatattttctcctttagagtgttaaaaattactgaaattataatatttagttcagcgaacatgaaggacacagaaaaacacaaacaaaaaattcattcctataattttttaatgttatatacatcatattttatttatttggatcagtgattgattttaactttgcttcctacctccatataaaaatttttctccagcatttaaaaaatattaaaaacacgttctgaaattgacttattgaagaacatgtaaaaggtctcattattagcacaaattgagaaattataataaagatactctaatagcgaagtgattaaagatgtcagaacaaaaaattatagatcccagtgatgttattaagttttttcatttcagttcatgtagaaatgttagctcctttgccacaaagaaataaaagagtagttttccttttgattagattcttgtaactacacacatgaaaaatttataggattggtttaggtgagggggttttatatatataaactgttaatataacattggaataagcttggcaaccaggtctcagagaagtcttttgaatctattactttataattatagtgatattgattggctttccatcaccttcctagaattataatgacatccaatgattaactgatttgccaatctcgcaaatagttaaaagaatattgagtttttggcagtgaactagggaagtttgtgtgctttttgttaaaatgaaaaactgtactcctcaattgaatacatttttagtacatacacgagtttaccagcaaagataactagagagtgagcttggtgtgcacacagtgaaaggagcttgggaggttgagattgaagtgagctacgatgccactgcactccagcctgggtgacagagggagaccccatctccaaaaaataaataaataaataaaaataattaataattaggaagagaaaagcactgatcatgaggaaaggcaaccactgagtatgatgctcactttatgtgcttaaagcggggactcagcaaataattgtggaaggagggaatgagtgaaatgagtgcataaataataagtacaaagaaagtggcgtaagtgtttaattcaaaacgaagtttagaccgggcatggtggctcttgcctgtaatctcagcactttgggaggccgaggaggaaggattgtttgagcccacgagttcgagaccagcctgagcaacatagcgagattctgtcttggcaaaaaacaaacaaacaaaaaaacaaagcaaaacccaaaaatgaaattattagccgggcaagatagtatgtgcctgtggtcctagctattcgggaggctgaggtgggagatcccttgagctcaggagattgagattgtagtgatctacgatgccactgcactccagcctgggtgacagaaggagaccctgtctccaaaaaataaataaataaataaataaataaataaataaaaataaagtttatattttgcgtcatgacagggttataacatattttccctatgatgctgtcttggtgatacataagttgtatacttttcagaagttgtgaggcccttaaagaaaacatctaccaaattagtctggggaagaaatgaaaatctatgcaaaacaaagtttttagatattttaaaaatattttacaagactaaattcattgttactttaggaacataaaaatatatgaggtataaaatggtttactcgtagaattattaaatatttaaaattataatttattcaaataatatgaatgtactaattgagacttttaaaaatctttaaaactaattaccagtggggctatgacctactggactttaagacatcaaatatcctttagcttctgccaactgagaagaaaaacaacaaaaagaggagaagccacaaacatcatagtaaaaacacataccagagttatgttttttctagatcttccataaggcatttattttcagaaagggtataggaagaagcatttttttaaataaaaaagaaagcatttttctttccttttctttttattttattttatttttttgagatgaagtcttgctcttgtcccccaggctagagtgcaaaggcatgatcttggctcactgcaacctccacttcccgggttcaagcgattctcctgcctcagcctcccgagtagctgggattacaggcacctgccaccacgcccggctaatttttgtatttttagtagagacggggtttcaccatgttggccaggctggtcttgaactcctgacctcaggtgatccgcctgcctcggcctcccaaagtgctgggattacaggtgtgagacaccacgcccggcctttattttcaaaaaatagtctaagagagtggataggggaagaagaagaaaattaactaaattcattagttgtaactttttctcaagcattcacatttctgtttaacgtgtgaatgtccccaaatatgccagtttccctgcttcctaggcttccagtctccaggggttcttcagctgcactaatttcctgactcagaattgccaggggtctcaagtacactccagaggactcgtgtaaactggctaggccagcttgtgttctgggaagcctgtcttttctggtggtgttcccaagaaataggaaagagaaaaaatgatgtgtggacttagggatgatgtgtgatactgagttttgctttacattttaactctccagctctttccttcaatgaatggcaagccattctcaattccagctcttctgtactgaagaatttagcatcactttccctggagatccaaggaactttgctttttgcccaaaatacctctctctcccaaagcaatttcccctcctcagagaaatgctgtcgtgtcaggctgcactgcccttgaaccagacaactttctctgcttgtctttatctgtctaaataaagctaacctacatttgctgtctaattcattcggatgcttgctgatgctatttaaagcatcccgcaaggcccagtggaaaacaagatgcattatctccagtagggaacctttaggtttgctcatcgtttaaggaactcaagaatctaaagaatccattcagtcttccctggttcggacatgaagaacacggggctcttcacatatatattttttttattccaggcagtcttctttgacttataggtggctgggatcagttgatacaaaaagacgtagctagaaagtcaatctcaatcattctctctctttcactctatctctgtctctccctctatctctctatctctttctctctgtgtctctctctctgtctttgtgtgtgtgggtgagtgagcctgaagacaagaagacacacacacactgtgtgtgtgtgtgtatgtgagagagagagggagagagagagagagagagcatcttcagacttcatgaaattcaacttttctgaagattaatttctcagcagaatgtatgtttcattctgggctctgatgattgttagtccactgtgaattgcctcacaagaaacaaatttaaaagttcaaaagcggctgtcaccttcgtgaacagacttctggtgagtttttggcttgtttccatcacactctcttcagcctccatatgacgatttgttacagaatcctggtacttctacattccggaaaggaaaaggaaattctccaggcgtaggagcaaaatctcggggatgtaaataggacttcactgtgaacttatatatgactggggaaatctgttgtatcttttttcagttccggtatttctgttggcctgtcggcttgcttagtgggagggagagagagctggtacaatgggattgttttaaccattggtgccccgctgctaccttaggcacatacttattatcagcatccatttgttcagctacaattctatgacgtccattgcagtgagtgagtcagaagccacaagctaacaggtctattccttcccaccgtcaccttggaaaccaatgcatcatccacaggaaatgcaggccccgatggggagtgtgcccagatcgagttataaagctggcaatcagtttttcaaaggaagtcaaataataatttgtagaatcttagtctagggtgagaggtggatccagcctcttgggtatggattgagggctgtcaggcagaaatatcacgagaaattaatcagttaaaatgtaagtagtaagtaaaatgtaagcagtaagatgtctgcttgataagaatttgaccaaaggcaagaaatatagagatatgatttgatttctctagcaaatagcatttatttgcccaatagctgagggtcttttttggtatggttgtacagtgtgtgaaatgagataaggaaattgacaacacacaaaacaaagctttctgctgaatgaaatgtatgtcccctttctcgtggtcactatccccgctaaaaaagtgatggaggccaggcacggtggctcacgcctgtaatctcagcactttggaaggccaaggtaggcagatcactcgaggtcaggtgtttgagaccaacctgtccaacatggtgaaaccccgactctactaaaaatacaaaaattagctgggcatggaggtgcccacctgtagtcctagctaatagggaggctgagtggggaggatcacttgaactcaggaaatggaggttgcagtaagctgagattgcaccactgaactctagcctgggtaacagagtgagattccatctcaaaaaaaaattttaaaaaaagtagtgatggagagggccgggtgtgatggtgcagtggctcatacttgtaattccagtgctttgggaggcataggtgggaggatcacttgaggccaggagtttaagaccagcttgggcaacatagcaagtccctgtctctacataaaatatttaagaattagctgggcatgctggtgcactcctgtagtcccagctactcaggaggcctagatgggaggataacttgagcccagcagttcaaggctgcagtgagctatgattgcacaccattgcactctagcccgggtgacagagcgagactctgtctctaaaaaagaaaagacaaaaaaaatgatggagaaaaccacagtctggttccccccaagctctcactgattttttgtttgtttgcttattttttgcctatgcctgattttctcttttcttgatgactgagtatggtataatccatacactggccttagtgtatatatgcaatttatcacacaatgtccagatacctgtggatacaagtgtagtacagctgagaaaaattacctgtacagtttcatgttgtttgatgagtttaacgtttccaggcggatttacattcccatactcctatgagtgagagattttacatcaaagtacaacgtgaagtctcccagaacttcctgctttagacttaaagcatgttagaaggcagaaaaaagatctgaaaaatcacctggtccaactacctcatttttcacacaggaaatgattcccagaaaggtggaatgacttgtctaaggtgacatagtagatattaggatgtacgttagagccagaggaaaggagatagaagagataggaagtttgatcacaagctctaaattagtcaacaggtgatatggccacctcagagacaataaaaatattaggctgtataatcgaagtatgcagtcctgactaagtggggcaattggtccatcaagggctggtcagtgtgtgccacgtttatgatatgatgttctgttctgagtacccattgagtaggaagcaatgatagacctgggtgtgcccagaagcaggtaaagatggagataagagttctggtaactacaagctaagaaaaataattgacacatgttgactattcagcctggagaccaagggatttgtcatggaagggatgggagtatcatcaaaaataactaaagggtggctgggtgtggtagctcagatctataatttcagcactttgggaggccgaggcaggtggatcacctgaggtcaggagttcgacaccagcctggtcaacatggcaaaaccctgtctctactaaaagtacaaaaattatctgggcatggtggtgggtgcctataattccagctacttgggaggctgaggcacgagaatcacttgaacccaggaggcggaggttgcagtgagctgagatcatgccactgcactccagcctgggcgacagagtgagaccctgtctcaaaaaaaacaagcaaaaagctaaagggctatcttgaagaaggctcagactcatcttgtgtgcctgcaaagggcagtcctaaattggtactagataaaggatgatggatattagcttcatataagtaatgttctaataattcaagctgattgaagtatattacagtgactgatatagtagtgaattaattctttgcctcaggaggtgttcatgtcttcattcaccccgaaacatttattgagctgttgcattataccagtcttgctagacactaaagacacaatgatgactaacatggccacttcctgcaaagagttcagaagtccattggaggtcatgagatcacttatttgcagagacaggatgaccagtaatgtagaatgccaaggaagagaagcaggcactggaaagaaagaagtctggactacagggactctgaggttgctgtctgtgttaatgaagggaacactagctgctgtaataatcaaacctaaaaaatgtcttatggctgaagcctgaaagaaagtttatttcacacttatctgacattcaccatgggtgtggtaatagtggctgatagtggtggttctcttccaagtggtaattcaaggaactaggccacttctatcttgtgattctcccaccttcacgtcttcaacatgtggcactgacaggcaatgacatcctgctaacagacagggagagaacatggaggattgtgtggggaggtttttatgggctggaccttagaacagagaagtggtgcacataaactctgttcacattctatccactagaatttagttgcatggccaccatctagctgcaagggaggcttagaatttagttgagctgttttcctagcaaaaagaagaaccaggttttgacgtatcactagcaaatcttctaccacactctccaactctgagattctatgattatggtggcagaaccaagacaggaatttttaaggggtgctggggagggtggcagggtactccatttatttatttttaaaactttttatttcatttatttatattcataattgactaataaaaatcatatatatttgtggtgtacaatatgatgttttaatatatgcatacattgtggaatggctaaatcaagctaatttacgtattatgtgttacctcatatgcttatctttttctttttttttttcagacagggtctcactctgtcacccaggctggagtgtactgacacgatcatagctcatatctcactgcagcctcaaactcctgggctcaagtgatccttccacctcagcctcccaagtagctagggctataggtacatgccacacccagctgatttttaaattttttatagagacaggggtcttgctaggttgcccagactgatctcaaactcatgaccttaagctatcttcccacctcggtctcctaaattgctaggattacaggtgtgagctaccacacccagccctcattttttatggccagaaaggaattttgaagttttcttgtttgataccagagtcatcccatcccatgtttacattaaatgtcttcctggattggatacggtggctcatccctgtaattccagcactttgggaggctgaaatgggaggattgcttaaagccaggagtttgagaccagcctggtcaacctagtgagaccctatctcttaaaagaaaaagaaaacctttctgttgaaggtgtcctattaataatatattgttaacttttaaaaagcaaggtaaggccaggcttggtggctcacgcctataatcccagcactttgggaggctgaggcaggatgatcactcgagaccaggagttcgagaccagcctgggcaacatagtgagacccatctctataaaaaatttaaaaattagcaggacatgatggtgcgtgcttttagtcccagctacttggcaggctgaggagggaagatcacttgagcccaggaagtcgagactgcagtgagccgtgatcatgccactgtactccagcctgggtgacagagcaagatcctgtcacaaacaaacaaacaaaactaatggtgactattataagtaaagttcccccccgccagggacctgccacttcagaatactataaagttaaaaggctacctacaaattaaggggaggtaactctccttaatgtataaggagcagactgtgaagctgctctaggtctactagtaatcgtgtctaacaaatcaataattaaaaggcaaatactcaaatataaatattggcaaaggatataaatgaaaaatcatagaaagagatctcaataactatcatgcaaacgtttaaaaattttttctcctcaaaatgaagagagataaatgaaaaatactatctaatatagataaaagtacatggaaataggaacattgatatttttctgatggagatattagttggcaaaacctttccagaggtaaatttagaaatattttaaaacattaaactcattcatacgctataacctgtaacttcactctactaatttgtcctaataaaatattcagataaacataaccatttatggcaaataatattaatatcagaatttttatgagcccagcaaaaggtggattaaatgacacagtaggcaaatgggataccaagttgtcgttaaagaactagctaaaagctaaaggaaaatcttgctatctaatgttaagaaaaaagaatgattcaaaaatagacacagaaatgtgtatataccttacagacctggtgaatcctgaaagactcttgttaagacaaactggctaagagtgatttaagcttagaaagacaccttggtccttccaagatttagaactaggcagagccctcttcttgctgatattcatcccatgggccactttattcataatagatcctttcatacatactgaaaatcagtcatggcagcccttggtgagcaagtgtcataaagtactccttagcaggctaggctgtgatcccagcactttgggaggcagaggagggtggatcacttgaggccaggagtttgagaccaggctggccaacatggtgaaaccctgtctctactaaaaatacaaaaattagccaggcatggtggcacatacctataataccagctagttgggaggctgaggcatgagaattgcttgaacctgggaggcagagattgcagtgagccgagattgcaccactgcactccagcctggaagacagaaggagactctgtctaaaaaaaaaaaaaagaaaaaagaaaaaaaaaaaaagaacaccttagcagcccaggggcggtggctcacgcctgtaattccagcactttgggaggccaaggtgggagaattatttgagcccaggaattcaaggccatcctggccaacatagtgagaacttgtcgctacaaaaatttttaaaaagtagccaggtgtggtggcctgcacatgtggtcccagttgctaaggaagctgatggcatcactgcattccagcctgggtgagatcttgtctaaacaaaacaaagcaaaacaaaaacaaaaactccttagcactgtcacaacacctagcttttaagtacttgaacacaattttagctttcatctgaattaatgcttggatgataggcagtcaaagttgatgctagctctctaatcacatactcagtattgtttccatttctttgattactttccctcattttctgctaattgctgttcattgcatagaccccgccagcatttttcacattttgaacctttttgtctttccgaatcaccctgttgactaaggatccatctcttacccgcttgcaacacatgatttttcttaccacattcaatctgttaatctgttttattttcatcataatcctaaacctattctcaatagcacattgagcattctgaattgtttttgcaattatcagacactgaggttaataatgttgcaaaacacctaagattaaatacagcaaatctgctggtaatggaaaattagctggccaaggctaagatgaccacggccaacggctattgtcatctgttgagggcaggcgaagttgaaacacttttacttttggaggaaagtattttccatctccgtgaaagttcacagctggctaggtatggtggctcacgcctgtaatcccagcaatttgggaggctaaagcaggaggatcacttgaggccaggcatttgagaccaacttgggcacatagcaagactccatctctacaaaaaattttaaaaattagctggttatggtggggcatgcctgtagtcccggctactcaggaggctgacgtgtgaggatcccttgagcccaggagtttgagactaaagtgagctgtgattgcgccactgccctccaggctgggtgacagagtgtgaccctgtctcttaaaaagaaaaaggaaagttcctttttgctataggcccgaggggttgctgctgaaatgggcaagttcatgaaacctgggacggtggtgcttgttctggctggatgctattctggatgcaaagccatcatcgtgaagaacattgatgatggtaccttagatcgcccctacagccatgctctggtggctggaattgaccgctgtccccacaaagtgacagctgccatgggcaagaagaagatctctaagaggtcaaagatcaagtcttttgtgaaagtttataaccacaatcagctaatgcccacaaggtactctgtggatatccccttggacaaaactgtcatcaataaggatgtcttcagagaccctactcttaaacacaaggcccgatgagaggccaaggtcaagtttgaagagagatacaagacaggcaagaacaagcggttcttccagaagctgcggttttagatgcttcgttttggtcattaaaaattaaacagaaaaaaaaaaggaaagttcacagatggccaaacttttccacagccatggtaccgtcctagtgaagtacatttgagacaatagtcatcaaattacatataaatacgtaatcaaccaaaattatttttagatagttcagttggtttacgttgtctgaattggcggagtctgggggtttgatttctgtgtcagttacttgaagaaaaattgtgccactcaaatactctacacctatgtctagccatgtcacaaatacctgctcttcagggggcctagatacagtatgtcgggagacaatcatgtcatttccgcagtccgtatagaacaatgctgttaccggcctttgtaataatgtgtgaacctggactctgcaaactcaaaacctcatgtgttacccgcttgcaacacatgatttttcttaccacattcaatctgttaatctgttttattttcatcataatcctaaacctattctcaatagcacattgagcattctgaattgtttttgcaattatcagacactgaggttaataatgttacaaaacacctaagattaaatacagcaaatctgctggtaatggaaaattagctggccaaggctaagatgaccacggctaactgctattggccatgcttctatccattaacaggaaagaagacgctttagtcatatatttaaattttttaaaaattatgtcaggccctgcgaggtagctcacgtctgtaatcccagcactttgggaggccaaggtgggtggatcacctgaaatcaggagttcaagaccagcctggccaacatggtgaaaccccgtctctactaaaaatacaaaaaattagctgggcatggtggcacgttcctgtaatcccagctactcaggaggctgaggcaggagaatcgcttgaaccaggaggcagaggttgaagtgagccgagctgcaccgctgtactccagcctgggtgacagagcaaaaccctgtctcaaaaaaacaaacaaacaaaaaatatggttggatcacaagattctccaaatgtaaaacactaaagaaagtcaaaagaggcccatttttctaattgagattaaaaaaatcgagtggtacccgatttccctctactccccagggacctgatgaccattaatgcctattgagttagttttcgggaatttgccgaagagcaggtgggtgtcactagagaatactgcatatttctcaaagtagagaaggctacagattcacaactcagcttctggcttcaaatgcaattttctccctgttttcatgacccgctcctccctccaacgccagagctgcaggcagttctctgaataacactatgtccctggcctcctagctcccatttgaacgtttcagcagggctcctctgaagtctggcccccaccacctcccctctcacaggcttcttgttcgtctgagtcagcccgtgactcacctcactcattagcggaactcagaatgcctctccatcctctggatcccttttgtctccctgcttataactggtttcctggcagcctaaggtctatggacagccttgaagctagaaggtgggttgctactaggatggtctgctcagtaaagtggttggcagacagcaagtagagttacagtgacgacggtgatgacggtgatgacgatgatgacgatgatgcatgcagttgcctcaaaaggactttggtggccagatttggcatgtccccctgtgttggcacaggggtccttgattcttggccccttctttcctctttctagtcttttctttccctcttcatccgcccctcctctgcacatatgcccgaatgtacaaggtgaatgcttctgggctctgctctctgtggaaaggcagggaaaagagcgacacccctacacggcggcaccctttcctccagcctttgcagctccgttctcatttctactcatttgattttacatcccaatgctttctgttttgtaagaggtggactagaagggacgaatgagaaaaggctttacgccttgttggtgcctcctgggcatataaaaaagcccagtgacatgatactaataagaaactctaaattcacggtcaaaaatatcagaaccaaatcactgttattaatttgttaatcttacttaaaggcctttgtaaaatggtgatacagtcaagtgctgcataatgacatttcggtcagtgacagactgcatgtacaatggtgatcccataagattattatacggtcttttttttttttttttttgagacagagtctcgctctgttgcccaggctgagagcagtggcgtgatctcggctcactgcaacctctgtctcctaggttcaagcaattctcctacctcagcctcccgagtagctgggattacaggtgcccacaaccacgcccagctaatttttgcatttttagtagagatggggtttcaccacattagccaggctggtctcgaattcctgccctcaggtgatccgcgccccccgcccccggcctcggcctcccaaagtgctgggattacaggcgtgagccactgtgcccggccctatactgtctttttactgtaccttttctatgtttagatatgctttgatacacaaatactattgtgttacagctgcctacagtattcagtacaggagcatgtcatacaggtttgaagcctaggagcaataggctatgccatgtagcctaggtgtgcagtgggcttatcccatctaggtttgtgtaagtgcactctatgatgttcaaacaacaatgaagtctcctaacaatgcatttctcagaacgtatccctgtcattaaacaacgcatgactatagtttactcagctgaatcctgacagctttcattaagtctcatgatttattttgaaagggacctcagagaccatcctgtccactcttttgttcaatgggcagatgcgtgattgctgtgcacctgtgatggtcaaagcccaagccaggtgccctagggccgcacttctgaagcccctgagaggcagatcttgttctggacacctggggagggggcccaaggtcctgcatttctataacctccttggggatgtccgtgccatcagcccacagaccacactttgagtagcactgctgcaggcactctgcacaaagctagataggcttgacttgtcaccggagaacatccagggccataggctccatgaggcggccctctgcaccctgccttgtcggctgctgatgtttgcttgtgaggcccagggaatgccaaacaattcttccaagtgcacttggctttcttgtgtcttcacccccagccaggggtgttaaaatgagaagattcgggtttgggattaggacaagaaaaagggcccataaagcttcaccctagactatgaagtctagtctgggttatcttagaagagagctctaaacccacattttaggcagattctgtttaacaataaagtatttctttgattgctacagagatcttcttttatgatttgttcgttcatgtcctttgctgatttttctattgcagtctttgccttttaattattgaactgtaacagctcttcattacaatactaaggaaaatcccccttcctccaataaagtgattttagtctttttttttttttgactaattttttgtagagacggggttttgccatgttgcccaggctggactcctggcctcaagtgatgtgcccgcctcagcctcccaaagtgctgggattacaggtgtgaaccactgtgcctggctgtttttagacttttaactttatctattaaattctgagtttggaatcttggattctaggacaatcttgctaatctgagcaagctgctttgcttcttgtgatgtggtttctttctgtacctgtagatggagagggtaaagctgacctatctcagggcactgttgagagtggaatgtgtgtgtgtggtagtactgtacagatgtagggcatagttagcttgttttcagagcctctattaatctgatcactttattaaacctagtgtgggacatggcaaactggtgttgacaagtacaagttttgttttgttctgttgtttattttggttaaacaaacactatggagcacttccaagtactctgagttgtaacttctcattgtgttaagatacatgaagcagagttggaagatgcctactgagagcttttttttaccttttcttctttttcttttttcttttttttttttttgtcaccatggctggagtgcaatgccgcaatctcagctcactgcaacctctgccttccgggttgaagcgattctcctgcctcagcctcctgagtagctgggattacaggcacacgcaccaccacgcccagctaatttttgtatttttagtagagatggggtttcaccatgttggtcaggctggtctcgaactcctgaccttgtgatctgcctgcctgggcttcccaaagtgctgggattacagacgtgagccaccatgcctggcttactgagagctttatatgtgtgaaggtgcttgtgatttctgtttacctttgccccctcaaatacaattataccttctaagttgttgactgatgccacttccaccgctcctaaatgtccaatcaaaactgccccagtatgaggcaaatgactgggttgttccttggtttccacatttcctgtctcatctctgttagaaccttacagctgttaaaattatttatttctatagtagaagttattagactagtagtattcccatttgaactggcagggttttgtcttagcgttaagaaatagatttgtacatttcccccatttatgatgtttaatgcctttaacttctctctgctactgccttttttgttttgttttgttttgttttgtttgtgcgtgtgtgtgtttgagacagggtctcactctgtcacccagattggagtgcagtggcaccatcatggctcactgcagccgtgaactctcgggctcgagcaatcctcctacctcagcctcccaagtagctgagactactggcatgtgccaccacactcagctaattacatttattatttatttatttatttatttatttatttttgtagatatgaggcttccctattttgcccaggctagtctcaaactcctaggctcaagtgatctgcctccctcggcctcccaaaatgctgggattacagacgtgagaagaaaaaaaagaatataatcagctactaatagtaaaatagaaatgttgaagacagtgtcttgcctctaattggtatttgttttttaatagagtcaaaggaaagagtctctactggcaaaaatgtaactctcagccagctagagatagttacccctctatctctgctggtaccccagttatcctttctacaaacgaaattgccttatgggttcttatactgagcatagatgcaacaacaaaaaagtcaatattattgactctcatccatttgccaagcaccgtgctaagtgctttcacatacattttctcatttaatggatcttttgcttacttactgtagggggtagaagtgagattgtgcctttgtgttgctccgtcctctacctaaagggtttacctctgtgtaaaccctttactggtagcaagggaactcaatctgaagcaaaatccattttttttctcatctcgtccaggttcaccgtgaaaagttggttggtttctcatttctggagaagagatgtgttgctgatttaggaaaaagtggatggaacagggatgaaggctgaatgctgtttaataccacactatgtacccacatgggtgggcacctgcctctgctgagaggtctctcttgtcctggcttctttcccagataatctattatattctctgggaacaagaatccatatacattcaagtcttcctttgatttacttacttatctatgaacactggtcacttaccactttcctcaccttctcccaccccaagaaaccctctcctggagaaacataactggtcttttccattcctgagattacctgccattttctcctcttacaatgattccaaatcttggactccactaaggaaaacatagcctgagtgaagttacacaaccagtgagaaaggaatcttccctgggcaatgagatgagggctgactcacgatctcagctcttaggaatggctctccagctgctgacagaggccacatgggttcagccatgaggtcattaaggatctccctggtgactaacaaaattggggcagccagggatagccagagctgagctggggcaactgacccatttgttgaagtgccctccaggatggaggccagcagtccaagttgcaatgccttggcaatgtagcactcacagctggtgcaatctggaggatgattggcacccaacaaaagaagtctctggtaaaggatgtacttataatcactgtgtggagacatgtttattccagatgcccattcttcattctttcacttatacaacagacatttgaccttgctaggcactgagctggaggctggtatattccttgttctcaaggaactgacagtttagcagagaggcacaatggggacaagcacaggaagcattaggagaattcagaagagcacttacctcaaattggagagtcaggagcgctctcccaagaatg

SEQ ID NO: 359 - DNA, 88950 bp, Homo sapiens
agcataagcagcttttttgccagggcgaaggggccagaccccggcctggggatggggtgcaagtatggaccacacaggggctggcttggtcactcacggctgcgtcaggctgtcccggtaacggctgcgctggcagggcagtgctcggggccggctggtgtaggtgtaggtgctcggggcccgagaggtgcgatcagtcagcgctgaggccatgtccgggggctgactgcctcgctttcggtggagcttggctttgaagcaggtgggcgctaaggtgttgtgggacccggagagatgtaagtagtgccaagggcaaggattccgcgacgcgaggagaggcgacaacaagggaggcgggcgggacgggaggttaccagcgcaggaggtgggagctatactgggctcgctcccagcaccacagagaccagctgcgggggccgcatcggttgcccagcaacccagggttctgtctgggggcgggaactccgggcagttccggtccccaggtttcccgggaaggactgcggcacaagggacttccggctcttgactccgcccagccgcgccacccaggtaggtgcgcctgcgctttgcgaggttcctggctagggaggcggccttggctggcttgaccgtcatccttgaggcctgcggggcaacggtggctgtccttggcccggctttggaatgtggctttgcagggctggtgttggcgccattctcgcaggcccacgtgctcctgctcttccagggtgtcctcggctgtttctcctgccgcggcgcagcagcgctcccaggctgcccccgcgataacacgcccctggcagccaggctcccagctctgttacgtgcccgggcggggaagagcttcctggtgtctcccggctcctgcccttctcccgccccaggggcgggctgccgccgccctctgcagctgagtcagtgcagttcctcacctaccttctctgctcaccgctgtgtgctagcaatcggaggacccttggcacacggagcgacaggggcctcccccacagacacctcattttgggaaagaagtgagcaatttattgagtcttaaaaaatacaaaggcatagttccccttaatctatcaggcttccagctctaaagaatgtctctagtattgcggggtggggctgcgcttaaaaacgcagacgctttggttttagtaccagcaacgttaaaaatcttctatcttgtatgagtgaatgtgtatcccttgtgatcagttatttgcatttgcagttacaccttcattcagctaattgctgtcttgatttgaatccaggttctagaatgtactagctccgaaacctcaggcaagttaaatgtttttgtgcttcattttcctaatccacaaagtggcaatagaagaatttatctctttaggttttgtcttgaggattaaaaccgttaatacttagagctgtgcctggtaaatggcaagcctttatattaagatctggaccgttctgtgctttgaagtgtatgacctaaagcagatgtaggcattctataagtaacactagcataaaggtgtatggtaaattctagaggtgaaaacactcccaacatattttaggtctgatcatttaattttgaggtaatttctgaaagggctagaggagaaagtgacatttaagttgtgtttgataaatgatagtattttaactggccagcctcttgggggaagtgcattcggaatggcttgatcaaaggctcaagaagcccaaggtgcatttggaaaactgtaagcaaggtttgtgtagatgagttgtagaaatatatatagacaggctgacaccacatcgtggaaacagtaaacactagcatattaattagaatattttttccctcaagtaacaaaaaaccaattccaagtggctgaaataataaggaattcattattttacactccccaggttggttaacctggagggtaacttgggggctcagcacattatcaacaacacgttttttcccctacctttccactctgtcacctgggttgttggcttcaacaaagtagtaatagaagtatctgctcttttgtctttattggaagagcaaaaccccctcgtaaactcccaactgaccagaattacatcatattgatttaagcttaggatctatataagaccaccatatttggattagaccaggtaaccggtctttctaggcctccaagaaacacttggccagggaggaggagaacaaattctgttaggaggatgttggggcagaattgagtgggtattaagtgggtaaacaatagtgctataccagccacagtgggctttataaagaaattgatagccactataggttcttgtacaagtttctttctttttttttttttttagatggagtctcgctctgtggccaggctggagtgcagtggcgcgatcttggctcactgcaacctccgcctccccggttcaagtggttctcctgcctcagcctcctgagtagctgggactacaggcgtgtgccaccccgtccagctaatttctgtatttttagtagaggcggggtttcaccatgttggccaggatggtcttgttctcttgacctggtgatccgccctcctcagcctcccaaagtgttgggattacaggcgtgagccactgtgcctggcctgtacaagtttttatccacagcctgtttctcttcttgtactttctcccagggcagtcccatttcacgtctgtaatttctagtaccacctatatactcagggtagcaaaggatgtatctctaacctagacttctccctcaggtgacagtcctggatatctgactattttgtggacaactcttggatgatctgaaactgaaagattcattccacaaatagttatgtgtatctagtatgtgccaagcattgttgttttcttgtccctcgtccccactcccctggtgttagtggggatatagcagtgaaaaacaaaaacaaacaacagattaaaagtcctgccttgacagaatttatattctagtggaggagtcatacaaacaagaaaagtgagtacattatgggtgttacataattataatagctaattcgaaataaagcaggaaataaggctaggtgctaggggcatgggagacctatcaattttatagtggtcagagaaggcttcattgagaaggtgacatttgagtaaagacttgaaggaggtgaagaaatgaaacttgagacttgtgactaattgtcacagcattccaggtcaaggaagcagccaattcctcgttctaaggcaggaagtcgtgttggggatggcagtaagagtgagtggagcagagtgagcacaaggaggagcattcggagatgaagtcagaggctgggccgtgcgccctgttgtaggtcagtgaaaggactttaggttttactctagggttaaaagtccctaaagggttttgagtagaagcttgacatagtttgattaaaaaaatttgttttttctagttgtttggttgagaatagactgaagtggggcaaaggcagaagcagagagaccagataggaagctgctcccaataaggctggtgagagggtggcttggatctggtgtaggtgtggtgctcgggcccgagagatgcagtgagtcagtgccgaggccatgtcgggggacagactgccttgctttcagtggagcttggttctggatctgggacaaaagtggtgggaagatcccagctcaattttgaaggtagaacagattggacgtgacgtggtgcacgagagaaagaaaggcaaaagagatgaacctaaggtttctgattaaatgttagacattgtgtaggaaaaaaatcacatagaggctctggcaaaaaaaaaaaaactaaataaataaataaaaaataaataaataaattgcatagagactgtggctgatgttgtgtttctccagaaaggatttaattttattctggcaagcaattagagtaggaacggatgactttttttttttttttttttgaggcggagttttgctcttgttgcccaggctggagtacaatggcactgtcttggctcactgtggcctccacctcccgggttcaagcaattctcctgtctcacctcccaggtagctgggattacaggtgtgcaccaccatgcccggccaattttgtatttttttagtagagactgggtttcaccatgttgatcaggctggtctcgaactcctgacctcaagtgatccacctgcattggcctcctaaagtactgggattacaggtgtgagcccctgcgcctggcctcagatgacctttaattagggattcagactttgtgagggctgatcattttctagtttggccttatcccagagctaggcctttctattctttctcaacatgaacatctgtggtatttaacaggtccccatctttgggtgaccttgaactccaatttttgtactcccagctctgtgagactgttgaaatgtacacttagcattttagctatttagcaactgtttggtttcttgatttccagtgcccttacagcttagaattcagcaaatgcctcaaggataaaagccaaactaaatgtcagactggcttctctatgatcctcctttctttgggatctgtcccttcaagtcctatccgcagttttcaactccaattttttatctccccgtatctgaaagggccctgatacctccaggtcactgctttctgctcgccataaatgccctgcacaaaactcagcaaatgacccaatcagaaaaagcaatggagaagttctgtatcactttatgcatctgtcttctgggatcccagtctctcatgtcttgaccatcttggttgctctccagtgtcttcaaacagcctgtgtagtttttgttatgtgtgcttttttaaatgttcagctcttgtgcttattcccatgagaggactggtttaatttaaactattcaattacagctagaggccatgataaagttgttgactagagtatctggaagaatggagttgccatttagtgatagagggaacgctggggaggatccattattggagtgagcattagcagcttggtctggggcacatcaagcttggaaggcatgttagtcatccaagtggagatgttgagtagacagttggacatgggagtctagagtttcaggagattggtctgggctacagaagtggatttttgaatcaacagccatgagacttgataagattaccaagggagtgtagagagataaggccttgagtgttccaatatttagagtttggaaagatgaggaataatcagcaaaggagactgcaaaagagggccaacaaaatggtagaaaatgcggaaagcctggtcacctgggagttaagtaatgaaagtgtttcaaggagaaagtaatcagctgtatctaatgctatacatgtgctaagcaagataagaacattggatctagcagcatagaggtctctggtgatctgaaaaaaggcaactttcatgaagttgtagaagagaaagttcagttataatggatcctgaagagagtgacagaagagcgatttatgactcaaggaaagaaaaaacaaatgggctggtagttaaagggaaattgagtcaagaaaaggttcaatattttttaatggtagaattgaccgtatgtgtatgtgcttctagaagtgattcaggagagagggtggaatggatggtgtgggacggagggaagaattggtggaatgatgttggcaaaaaggaataggcttttgtgcataagttgagggattggccttgcctagaaacatggacaattcgtctatagtaagaagagaaaaggtagatctatgaccacagacatagtcagataatcattttaaaattctttaatcaatagatgtttctgatgtatggcaggcagtaagctaagcagtttacatacctgatttcatttagttattataacaatcccagtctaacaatgaggtagattctgatattattcccatttaatttgcaaggaactgaaatttagagaagttaaaatgacttaccaaagtcatatagcaagcaagtgacaggaccaagacttaagcccttgactgctggactctagaacttaagcaagaaagcatcagcttatgatgttcattgtcctcccactcccagatcccccatttcttgccccttttgcttgttccccctcccctcattctccatatcccaataatcactaagtcctgtccattttacttcctcagtgtttcttgcttctggatcctcttttttgtatccttcctattcctaccagcctttgacctcatcattctgacctcatgtagtctaaattaaatcgtctatggaaccaaacaataatcgaacagaatgtgatccttgatcatgcttgctccataacccactgcctaatgagttcaagtttcttaaactatgctataagcctgccactacccggttactgcgtatttttcgaatttcacatctcactgatttctgtcttgtactttttttctcagcagagctgagcgcttgcagtcccactgcatgaactatcatgtttccacgctgtgtttgtgctttatgatttttccttgtctcttttcctggattttttttctactcctcttttaaacctcagctcctgttgctttctccaggaaggcatttctttttttttttgagacagagtttcacttcttgttgcccaggctggagtgcaatggtgctatctcggctcactgcaacctctgcctcccaggttcaagcgattctcctgtctcagcctcccaagtagctgggattacgggcatgcaccaccacacctggctaattttatatttttagtagagacaggatttctccatgttggtcaggctgatcttgaactcccgacctcaggtgatccacccgcctcggcctcccaaagtgctgggattacaggcgtgagccacagcacccggccaggaggccatttctgatgcctctaacttgggttcatatagtttgcagccacaacgccatcttttacttgccacatggcttttataatgatttgctaacatgtttgcttccactaggccatgacttccttgagggtagggatcatgttccatttgtatttgtagtcctaccatattacttaatgtttggttataatagttttttgaatgagtgaatagcaggggtatacaatttatccaagaaaagaagcagcagcatattttccatttaagtgtgcaaaaagtgagtgaaaggctatggtttcagaaatgtttttaagtgtaggtaaatgtattagtctgttatcacattgctataaagaaataccagaggctgagtaatttataaagaaaagctgtttaattggcttatggttctgcgggctgtacagcaagtgtggcggcatctgtttctggagaggcctcaggaagctcccagtcatagtggaaggcaaaggagaagtgaggtgtcttacatggcaggagcaggagcaagagggagaaggggaggtgctccatgcctttgaacaatcagatcttggccgggcgcagtggctcacacctgtaatcccagcactttgggaggccgaggcgggaagatcccctgaggtcaggagttcgaaaccagcctggccaacatggtgaaaccctgtctctactaaaaatacaaaaattagccgggcatggtggtgtgtgcctgtaatcccaggtatttgggaggctgaagcaggagaatcacttgaacctgggaggcagaggttgcagtgaaccgagatcataccactgcactccagcctgggcgacagagtgaggctctgcttcaaagaaaacaaaacaaaacaaaattaaaaacccagatctcgcaagaactcattcactatcctgaggacagtatcaagtagatggcagtaaaccattcatgaaaaacacctccatgatccaatcacctcccaccaggcccacatccaacattgggaattatactttggcatgagatttgggtggggacacagatccaaaccacatcagtaagagaatgcaagggagaacttaatatagttcattatttgacagacactaagcaccttccctgtactgagcagtattataagagcttcggatagatgaagcttttgtcctactgtagggaagtagataataggcaaataaatcaaaaaagaaaaaaagaaaatttcatgaaatgataaaagctttggtgaaaacaaaacaaaaactttgtggtggtgttggggggcatgagtagctgccttcagttaagtagcagaaaaggcctgagaaggtaacatctaactagagaccttgtgacataagaagcagcgaaccacatgaagttctgggggagccgcccagacagagggcggtggctagtgcactgttcctaaggaaggaacaagcttgtatgtttaaggagcaaaaggaaggccagtgtggctagaacatggaatgacggggaagagtggttagacgtgagcttttagagcattttgaggaagctgggggcaaattggagggctttgtagaatggaggaggagttgggattatggggagccattcaagggttttaagaaaggatatcatctgagttatattttaaaaagatcactgattgctatgtgaagaatggattgtaagaggtgaagattaagttgctagttaggaaggtgctgagtaggttaatgagaggctctggcttgaattagggtgatagtagggaaaatggagagaagaggtacatttgggagctttcagagaacgaactaagtccctttattcctctactcctcactgccacttactaatagtaagtagtggaggactacagaatgactgctaagattttggctttactaaactgacaggatgatcatgttatttatgcgatgcagtcaattgttggaaagagtaggagaccaagagttttgttttggacagatgctattggacatccaaatacatacgtcacattggcaggttagagatgcgaatctgaagttcagtggaactagagatataaatttggtactcatgagcacttagatggctttaaaacattttaaaggagaagggaaactgattttgccaaatccaagggttttaggaacagtgtgttcaacctggtcagataccactgagaggttgagaaaggtgagacttgagaagtaatcattgagtttgccaacctggaagtcatctgtaaacttgacagtcacacagattctgtgaagaggaggggactgaagcccatgtagagtgattgaagagagaatctagttacagaggcagagttgcaaccctaggttattctttccaaaagttttgctcttgtcttcttagtgaagtgcacgaagcctttggacatctctgcaaatgggtagcagtagaacatgaattaataagcttttgccacaaggtgtcactaattcttcattagcttctagtaagcgaaataattgcagcccaggtataccttgtattagggaaatattatttttaaaaatcatatttacaaagtaggccaacttggcccggcgcggtgacttatgcctgtaatcctagcactttgggaggctgaggcaggcagatcacctgaggtcaggagttcaagaccagcctggccaacatggtgaaacaccatctctacaaaagtacaaaaattagacagacatggtggcaggcacctgtaatcccagctattcgggaggctgaggcggtagaattccttgaacccaggaggcagaggttgcagtgagctaagattgcgccattgcactccagcctgggtgacagacagaaagagacccagtctcaaaacaaaaacaaaaacaaaagcgaaacaaagtagctaactagaaggcagttacttacatggtggagaggtttcctttcaaaagacagtctctagtatgtttaacaaatgtgcatggccgtcaagtggtgcgtggagcactgggctagcaatcagaagaccagagttctgggtgtagagtattggatttggagtcagaagcttcgagttcatctcctgttttgttctcactagctatgtgacctcatgcaaaatttaaattattctttgtcttattttgttgttgttattttaaaacgatagatagtaaatgctgttctggccatctcaagcaattatttttgcataccaaaagagataatgtgtgtaacaatttagaaaattatgaagtgctatgtaaatataagatttaaaaaattttataaaaattatttataccgaactttacagcaatataggtattatgtaaagcagttgtattagtgagaacccccggttgcataagggagaaatccaatttgaatttgcttggcagaagggcatgttttgaagtttatggggtggttcctgtgccttcagggatggcagcattgtgggtgggctttaggcattgctggaatcagagattggaatgacggcagcatgtgtacccttcattcccctttgcttctgtctggtgcctttattctctttggcccaaacttacctcccctaccttgtgggggaacattttgatattgtgattgtagggcacctgcatgacaacatcctatagcttgagaaggtgagaagctggggctggagaagtagacgtagaattaccttgattttgatgaagagaataagaattttgaatttatgagtgccattgtcagttaatgctgaccttccagttttgaaaaataaaactcacatgctctgaaacagtttaatatccttgagtctgcatgtctttgcctgcctgcccgtccgcccgcccgcctgcctgcctgcctgcctgcctgccttccttccttccttccttccttccttccttccttccttccctccttccttccttccttccttccctccttccttccttccttccctccctctcgctctctctttctttcttttctttctttcttttctctctctttctttttcccttcccttcccttcttcttcccttcccttcctgacagggtctcactctgtcacccaggctggagtgtagtgatgcaaaatcatgactcactgcagtcttaacctcctgggatcaagccatccactggcctcagcctccagaatagctgatactacaggtagttgccactatgcccagctaatttttctattttaattttttttccagttttaaatagtttaaaaattagccaggcatggtggcgggtgcctgtagtcctagctactcaggaggctgaggcaggagaatggcgtgcacccgggaggcagagcttgcagtgagctcagatctcgccattgcactccagcctgggcgacagagcgagactctgtctcaaaaaaaaaaaaaaaaaaaaagtttattcaagaaaaagctgggagtggcccattcaggaggaaaagactccagagaaacagggtcagtgctccaaacgtcaaaggtaagttcttaattatagaggcagaaaacaaagacattaacaggattacaaaattttttatacaaggctggtttaagatgaaactctaatatataggacataaataagacttctaaagtgtgttctaagaacacctgccaaaattatcaaaattctgtcattgttcctgggattcatttaaaatgacagggctggggactcctggtttaaagtggcattgactgaagttggaatttcttccaattctaactaaatacccatggcagtaggacagggcatgtcccatttctgtctagaggagcacagtagctggaaatgggagggagctgggagctggacattgcagtctgttttttagcttgaagaggagattgacaggcacccaggtagatagaaagtgaggccgaggacaatatgatgtgtgtctgttggtgggcaccaggtctggatctgttctattcattggaggaggaggtgaggagaaacataaaatctgcgaaaaaatgctgtcaagtaggaggaagggaacacacatttgaataatcagaggaagacagagctctaaaaatgaaactcattggtatccctaaagatgctgtttggtaccacctttgaataaagccatgcagagaattcttaagatgcaaaaagacggatgtgattgaaaaagactgatattataggcaaaaatattttttaatgcttaccacatgccagcaatggcgctcggggctgaggatataatgatgaataaaattgccatgattcttgtcctctcagaatctagtgaggtaccagacaagggaactggcatttccaattcagtgtgaaatgtgtgataatagggttggcagggcacaatagaagcacgaggactccgagccatccttggcggtcgtggcaagcttcctacatgaaagctggagctcagagcatatgaagatgtaggagtttgccaaatgaaatgacatggtggtggagagtgtttatgaccaaagaatgccgtgtgtgaagccctagaggtgagaaaaaacccaagatgttgtccaggcccagtggctcatgcctgtaatcccagcactttgggaggccaaggcaggagaattgcttgagcccagaagtttgagaccagactgggcaacatggtgaaaccccatctttacaaaaaaatacaaaaatttgctgagtgtggtgacacgcagctgtagtcccagctgcttgggaggctgaggccagaggatcgattgaacctgggaggtagaggctgcagtgtgctgtgattatgtcgctgcactccagcctgggtaacagagggagaccctgcctccaaaagcaaatacaaaaacaaaaccctagaatgttgaggaattgagagaagttcaatgtgtctgaatcagagtatgaggcagggaatatcaagagataagtgattaaaaagcaattaaagatgaataatagcattcacatccacatagagagaatgctgttgaatgtcaaatgagggatgtgaagaaccacctaacgtatgttgccagaatgcagagaaaaggattaaaaatattggccgagtgtgggagatgagagctatctaggggagggaagaatgagtcaacgcaagaatcttaggtattcctatgggaaaatagaagcaacaaccaaagacctaattaaacaagtgtttcttgtgctgaaaagaacttgaagatgaagatcaaaagaatccaccacagggctgggcgcaggggctcatgcctgtaatcctaacactttgggaggctgaggcaggcagattgcttgaggtcaggagtttgagaccagcctggccaacgtggagaaaccctgtctctactaaaaatacaaaaattagctaggtgtggtggcgtgtgcctgtaatcccagctgcatgagaggctgaggcaggagagaattgctcgaacccaggaggtggaggttgcagtgagccgagattgcaccactgcactccagcctgggtaacagagcgaggctccatctcaaaaaaaaaaaaaaaaaaaaaaaaagaatccactgcattccaagaaaaaagaatgacaacattttcacattacaaagatataagaaatagaccatatgagcattcagatagaaaaaagtaagtttcctatgcaggaacaaaaatctctctggccataggcttttttttaaaattttttaatttttttattttttgcaacacccaagatcagaagacaatgaaaccacacgtagtagagttttcagggggaaatgttgggaacaacctcatgcccaactaagtctgttgtctttcaaggcaacagcatatactttcagatttgcaaggcctggtaccatagaccttcccgtcctttcattaacacatctcaaagatctgctactcaaaagagtggtcaaaatgaagatctcagtaatgaggagatcatgatccactttaagaccagcattgttcatgctggacccacacacaggtatttgattggcctccatgtggtctggtcagttctgtggccacgggctgtggtttggcctgcaagaacctccttgagctgctcctcttaaggtctccgtcatttcccggaaagtggatttcttgcatcacatgctttacctcatgtttcagaagaaatgtcatgattgatgaccacatgaaactgatttggctccagggtctgtaatattggccaaactatttacatggttgagagccaatgccgagaagaaccaaacacttcctcttcctcaaaaccagagctgtgtagtgcatcgtattcatcattagcatcaccaagagcttcacatgttttctatgtctttttttttttttttttttgagacagtctggctttgttgccctgggtctgctcttgaaatcctggactcaagtaatccttccaccttagtctcccaaagtgctgggattacaggcgtgagccactgtgcccagctgttgtctgcatctttaagacttcaatggttacctgatttctctgacttttaactaggaaggaatagtaaaaggtctaagcagccacgttgtcagaaagcttcagttcatactgtcctccacctgggacttgtgaatgtccctgtgttacctatggctggactcagtatattcattatgttcatataatgcaaatatttagaagtgaggctgacctgttttttatattttttaaagtaaatctcagaatcagagaaattatcatttccttttgatctaagaagttagtgactcactttagtaagagaaatatttttaaaggcacagaaaaaagactaagaattataataatataagaaaatatttctgactagaaatattacagtataactattgctgggtaattagccctccgcccacctctgaaattactgacttgaacaatgtatttggaaccttcagaaacaaagccaatagtgtataaatacatacattataagacctttattatagggaatttattatgaggaattggctcatggattgtggaagatgagaagtcccatagtctgccatctgcaagccggagacccgggaaagctggtggtacagttccaggctgagtcgaatggcctgagaaccaggggcacttgatggtgtaagccccaatttgagggcaggagaagactgatgtcccagctcaagtagtcaggcagagggagcaagttctacctttccaggccttttgttctggcctgcaatggactggggaaggaacactggggaaagcaatctgctttactcagtctatgattccagtgttaatctcatccaaacacctttacagacatacccagaataaggtttatctattcaggcatcttgtggtctagacataaaattaaccatcacaaacaacatgcatttattgtgctcaagggttctgtggatctggaatttcaacagggcacaggagggagggtttgtctttattccctggtgtctgagacctcagctcagtaagactcaagctggcaatgacttggtagctgggggctggaagcatctggaagctctttcattgccctgcctggtgcctgggttgtcatgacttgaatactaggattactgagcggagcagtcaccagcttgcccagattcagagaaagggggacacagaccccaacctcaatcagcagagtagcaaaagaatttctggccatactttccaaaacgacctggtaataacttgttaacatcggttttctttggctcataggatttgggatggtgttctgtgttgaactgtgtcccgccacccccttccaaattcatatgttgaagttctaacccccactacctcagaatgtgactatttggaaatcgtgtgttaattacttaagttagaatgaggtcatactggagtggggtgggcctcaaatctaataaaaccagtgtccttataagaaggggaaatttggatacagatttgcacactgggaggacaccatgtgaagatgaagggagaggtcagtgtaatgttctgtcaaccaagggatgccagagattgccagtaaaacaccagaagctagctgggaggtgtggaacagacccttccctcacagccctcagaaggaaccaaccagccctgccaacaccttgatcttgcacttctggccttcagaactgtgagacaaaaaatgtctgttgttaaaccatgcagtctgtggcactttgttatgacagccctcgccaacaaatacagatggttttaaggttttttatacttttcatatttttgacagggaacatatatttctttaataatgagaaaaatagatttgatttaatttaatgttttcaatttctttgttccgtaaaaacatgaaaatatgccaaaatctttccatggttgtgtctaggtaatgtgactacaggtaattaaaaaaatcccatctactgaaaacgttttctctaatgagtatgtgtcacccttattatggtgaggaaaagaaggctggaaaagccaccatgggaagtagaaagagcacctgccctgggtcccactccgctggggagtagctctgagtccggctcccagtgtgtaacagggggagtcttcctcagtgttgggagaggcaaatgcatgcatctatgcagacacacacagaatcccggaatccagtatctggcgctggggcctggtgagctgcactttgcctccattctccacagtgtggtttacagcctgtggctgtgattacgagtggtggtggaagatgtcagtactttaagatatacatatatatattttaaaatatctatatatggatatatatattatatctataatatatagattatatatcacctatatatagataatatatatatagagtactatatatatataatctatctatccatctatatgagagagagagagagagacagagagagagacagagacagagtcttgctctgtcacccaggctggagtgcggtggtgtgatcatagttaattgcagctttaaactccctgggctcatgcaatcctcccacctcagcctcctgagtatctggggccacaggagcataccaccatgcctggctaatttatttatttatttattttgtagagaaagcatctcccttatgttgcccaggctggcctcaaacttctgggctcaagtaatcctcctactttggcctcctgaagtgctagggttacaggcatgagccaccatacctggccacaaaaaatatttcaaccacaatcatgtctcttttcatgctgacttacctcgttgaatggccctggagtggtcatggggattttaggactaggctaagggaaagctgacttatggatatatttagtttgatttcagtgaatgtcttaatccatttcagctgctatagcaaaatcccataaactggatggcttataacaacagaaatttatttctcacagttctggaggctgggaagtccaagatcatagcaccagcagatttggtgtctgatgagggcccctttcctggttacaaatggcactttctctcttaatgtcctcatgtggtggaagaggtgaggggtctttctcaggcctcttccatagggcactaatcccactcatgagggccccagcctcatgacctcatcacccccccaaatgcaccaccccttagtagcatcaccttaggggttaggatttcaacctaggaatcttgagggaacccaaacattcaggccatagcaatgggatttacttatgtgctttgcaatcacttccttaagtaggtaagttattcataactatcctggggtgggaggggctttcaaagatagtcctactgaccactgtgcctactcaccaggcttgtgacgtgtgctacgagaagaacactttttgcagagcctaacattggcagtatgtaggtagtagaggaacatttgaaatatatagaaccagcagtctgcaggtatttttccagattttatagctcctatatgaaaaacacttggcagagatttctccaaatttgtcaataattctaacaatttacatgacattatcaatgagttgagaagctgaaataaattattctaaactattaatgttggaaagaactccaaattttagccaaattaaaggaaaaacaacttttattctcactagagaaaataattttaaatctttattttttaggaaaaaagtgttttaaaagagcatgcaactaaaaaagataggaaagggagcactaccgaaatgtcccaggcagttagtaaaaatgttatttcatattttggtgaaaaattttgtttgctgtatttgtcagcgttattaaatttatgctttatgtttttttgttctagatacatatttgtgtttatgattaaatttgcatttgtaagtttgccttctttttcttgtagagagcctccaaaattataaaaacacagagcccctcaaaatctgagtctgacctgaaggagcccagctttcaaatcgatccttgttttcccacaaagttgttatttgagtctgatgctactatttagaattgtaggttctctgtttttccatttcctacagaagaactcagattgagaaaagctatttaccaatcatttccttttaacctaaaaggtttcagtgactctctctagcaagagtttgagggtgcatgctatttacctagtcagagcaaaaccatgattcagagtgtgagaaaatggctctcattttcctaggaagttttcaatataaaaacatgctgtgcttttgaatgaaaagtaaaatttaaagccaatggatggaaatttcttgtaagaagatgtaaaaaacccctagctgtttctattcttgaaaataagagttgttttttcacagggtctaagacttgaatacattttttcgaaatgaatttggcctgttgtattaaggcctgtgataatacgatttcattccttggtgcagctccttaagtaccttccttctgtagccactgtgctttggtgttttaaagttaaaaaactcaggaaaaaatagtcttgggtcataaaattacatttgcatatatggggttttaatttgaagccaggggtttctttgcctttatctctgatcaaagataagcttcacttattttgctgaacttattctgtggtttaaaaaatatttcctgttttaaaatataacagatctgttacagaaagaacataaactaagtatccagcctagaatatttgtcccctttcccctatgctgggatggagaaaaagaaaagagcatgtcttcagaatacagtagccttatgttaaaatgtcagctccatctttcattagctgtgtgaccttgggcaagttacttagtcttctcatctattaaatcatgcgtattaatattcatcttgtgaagttgtgaaaattacatgataaattaaaaacaagaaaacaatcaaaaaaccttttcccatctagttatagtaagtacctggcacaaaaaggaactaagcaaacacttaaaatatgagaaagataaggccttaagcctgctcctgaggagtgtggaatctggaatatggcagaaaagaaggatcaaaggggaagggttaaattatggagcatttgaagttggtgcatttcgaaggaagtggtggaaagaagttgagtgattctagtttggagaaagttttatataaagctgaggagtaagtgataaattacatgtaggggaccactgttatattttcttggttgaattaaagagtagaagttcatttatttctttattcttttattaattcaacaaacatgtagtgaaatgtttaacatgtgccaggaagtttttttagttctggagaatacaaagagaaaggagacccatttctcacccttaaggaagttatagtctactgggaggagagaaacaggaaaaaatggtagatattaaaatgtggggtacaaaagagaaagggagggaggtggggtctgtgagttctttaggtgtcagaggtaattcttgagctgaggtgtctgcatggctgcgaaggtccggtggcagggtgtgtggactgtgtagacattgtaggtagggaactggaatgaacgaagtcccaggtgtacatcagctttgcatgtgtgtgggagctgctccagagtaacagcatgtggggtcagtgatggagggctggcttgcatgcatcagcacaagcccgtgaggggccacgtcagggaataatgacagtggctgtggcagtgactccaagaacaaatagatgtaacctagggcaggggtccctgatgcctgggccacgaaccgggtactgggtactactgctctaggggaaggtctgaaagaccaggtgaaagggtgggatttgaaaattttgggaaacatgatgaaggtggggtttggaatgtgaggcttccaactgtatatactgctcaaattgcatgaggaggtggcgcatgcctgtaatcctagcactttgggcccaggagttcaagaccagcctaggcaacatggcgaaaccctgtctgtataaaaaatacaataaaagtagccgggcctggtagtggactcctgtagtcccagctactcagcaggctgagattggagaattacctgagcccaggaggttgaggctgcagtaggtgccagattgagactgtttaaaaaaaattgcgtggggaagacagctgagacaaggatattaaataagaagacattttataagcctggccatttgaagatataggcttagaccagtagattgtaatttaaattttacttttttattttccaactctttaatctctaggaataactggaaattttaagaagttactatctctgctatggggatggatagtcagacagcaatgttcacaaattactcttgaaacttgatgcaaacaacctgtttaaaaactgatgtaacgagaggaatttcatggatgcaaatgaacacctgtgaaaattcttcggcaagaactgtttcatttagcaacaccaggttagcagtttgagagaggatcttttttgggtctacatgcccaaatttacagactgttttgctacttgaatctgccataatgtttgttgaataaataatctctatctttgagggagctgttgaatttttttacaatcaaaatcctgaaaggaatacatttagattgtatgcatctcaatgtgctccgaggcctgtggatgtttgctgttctttttaaagaatttaggcatcttaactcttggcatataaaattattcttaggaacgatatggatataattcaagtgtaataccacctatacatttgccagaaatcacagatatatatgtgtgtgtgtgtgtgtgtgtgtgtgtgtatatatatatatatatatatatatatatatatactttttctcatttctagtaacaatgaaaatcctgtaactttttgctacagatgaaaataactgggatcatgaatgaaatgaccagatggttgccccatcacctaacagtgaggtgcccccgcttgaaatgttgcccccgcttgaaatgtttctggtttctttttttttttttttttcgagacagagtctcgctttgtcacccaggctagagtgcagtggcgcgatctcggctcactgcaagctccacctcctgggttcacgccattttcctggctcagcctccctagtagctgggactataggcgcccgccaccacgcctggctaatttttttgtatttttagtagagacggggtttcaccgtgttagccaggatagtctcgatctcctgacctcgtgatccacctgccttggcctcccaaagtgctgggattaaaggcgtgagccaccgcgcctggccaacatgtttctggtttcttaagactttagtatattgttcttaacatttatttgggatgtatttgcatttttggaagctgaccagtttctacacatatctaaatgcctccttacatttgacagtacatttaacatgctaaagtacttttcttagatatgatcaattttatccttgaaataagcctattgggagccatggacaccagctcattgtggtgaggacgctgaactcaatggtgcagatacagtggtgaaggagacacacaccctgtggtatggtggagtagactcctaacagaccaaccctgccacaaatatagcaactataaactggacaaactaccaaaagtaactacttaagagacctgggaagtgagcaaatgcaggcagaggggagttgaatcttggaggagagtgtgagtttcctgtttttcagccttgtccaaaagatgggccctggtcacaaagtgtctgggggtggctaaaactcccatagaaagactgccatgtttctggtctagggaaccaggggctggagcctggggcaatcatggccacgagagtgagggagaaatcccagagaggacagagccagagaagggggcacccaaatgctgtatctgaactctgcccaagtctctagctgacccgtgaaccacatgcacacaaaccagattcaaagccacttgcagctaaggtttggagtactgaattgagatttgaatggccactcaccatgagagacatggagtttacagccttcagtgtaaccaagtcaattgcttgttaaaacaaagtatcaacagccttggaatgaatacaacagaatttagagtcttgacttatgaaacatccaccatgtccaaaactactcaaaatatgaaggaccaggaaaatgtgatgtattggcaacaaagaagttaataaaaagaggtcaatttcagatgaccgaaatgttgaaactattagtcaaggaatttaaagcagctattgtgctcaatagagtgaaaaaaatgctcctaataaatgagaagataggaacttttaggaaagaaatggaaaatatataaagaaaatatacaaaaaggggaaattttagaactgacaaatacaatacatgaaaaaaaaattgctggatgggctctaatagcataatggagatagagaggaaagaaccagtgaatttgaagatagagcaatagaaattgtcccatctaaaggaggaggagaggaggaggggggcgggggaagggagtgagaaacatagagagcctcaggaatgtgtggcacaatataaaaaaaactgatattatggatagttaaaatatcaggaagagaggagaaaaagaatgggatggcaaatatttgaaaaaatagtggctgaaaacatcctaaatttaataagatgtttacattttctgattggataagctttgtgaatcccaaatgggataaatacaaagaaaaacaaactagacacatcatagtcaaactactgaaaacaaacaaaaaacaaagaggaatcttaaaagcgtaaataaaaatgacacattttatatataggagaataatgatttcaatggttgtggacttctcagcagaaattatagaagtcagggacagtcgaatgaaattgttgaagtgcttaaagaaaaaactgtcagcttagaaatctctgtctagcaaaaatacccttcaagaatgaaagcaaaatgaagacatcttcagatatcagaaaactaagagaattcatcaccagaagacctgcacttccagaagctaaagaaagttgtacagactgaagggagatgatatgagaaaaggaataaaaagcataaaaaattataaatattggagtaaacatcaaagaccaattttcctcttaatttctttcacatatgcacaactgtataaaggacataatattgacttaaggtttatatcacatgtagatagattttatggcagctatggcataaaagatggtggcagtgttggtggtgtggccggggagggtaaatggaccagtaaaattgccagtagactgagaagttaagggattatattatagtctctagaggagcttctaagaaatcatgcaaaagactaaaagaccaataggtaagttaaaatgaaattataaaaatattcacttaatccaaaagaatataggaaagggagaacaagagggactaacagcagaggagacaaacataaagcaaataataaaataatacagcataaccaattagttttatcccaggaattcaaggtttgtttaacattagaaaatcaatataactcaccatattaacagaataaaggagaaaaaccatctgatcattttcatatgtagataaaaaatatgacaaaatttgatatccatttataagaaaaattctcaccaaactgactatgaaggacttcttcaacttcataaaaagcatctatgaaaaacctacggtgagcattatacttaatggtgaaatattaaatgatattctaccaaactcagaaaaaaggcaaatgtgctcattttttttaccacttctactcaatattgaattggagcttctagccactgcaataaagaatgataaaatgataaagattggaaagaaggaagcaaaatcgtccttatttgcaggcaatacgattgtttacatatgattgttttctacatcctaaggatctaaaaaataattagaagtagtatattattccattctcacactgctataaagaactacctgaaactgggtcatctttgaagaaaagagtcttaattgacccacagttccacaggctgtacaggaggcatggctggggaggcctcaggaaacttacaatcatggcagaaggtgacagggatgccagcacgtcttcacatggtggcaggtgagagacagaacgaaggcggaggtgctacacacttttaaaagaagcaggtctcatgagaattccatcacaagacagcactagaaggatggtgctaaaccactagaaaccacccttatgattcacctttcaccaggccccacctccaacactcagtatcacaattcaacatgagatttgggtaagtacacagaaccaaaccatatcattttgcacctggcctttaccaaatgtcatgtccttttcacgtttcaaaaaacaattatgccttcccaagaatcctccaaattcttaactcgttccagaattaactcaaaagtcccagtccaaagtctcatctgagacaaggcaagtactactcctctgcctatgagcctgtaaaataaagaaacaagttagttagttccaagatacagtgcaggtacaggcatcgagtaaatgctcccattccaaaagggagaaattggccaaaacaaaggggctataggcctcttgcaagcaaaacccaggaaggcagtcatttaatctccaagctccaaaatactctcctttgactccatgtctcacatccaaggcacactgatgcaaggggtgggctcccaaggccttgggcagctctgcctctgtggctttgcagggtacaacccccaaagctactttcatgggctgggattgagtgcctgcagctttttcaggcgaacagtgcatgctgtcagtggatctatcatcctggggtctggaagatggtggctctcttctcacagctccattaggcagtgccccagtgggaacttggtgggagctccaaccccacatttcaccttcacactgcccttgtagaggttcttcatgagggatccagtcctgcagcagacttctgcctggacatccgggtgtttccatacatcctctgaaatctaggcagaggctcccaagtctcaactcttgccctttgcatacccacaggcccaacaccatagggaagccatcaagacttggggcttacaccctctgaagcaatgacctgagctgtactgtggccccttttagccatggctgaaacgggagcagctgggatgcagggcaccatgtcccaaggctgcacagagcagtaaggccctggacctggcccacgaaaccatttctccctcctaggcctctgggcctgtaataggaagggctgctatgaaggtctctgaaatgtcttagagggattttccccattgtcttggctattaatatttggctcctttttacttatgtaaatttctgcagctggcttgaattacttcccagaaaataggtttttcttttctactacatggcaggttgaaaattttccaagcttttatactctgctttccttttaaatataagttccaatatcaaaccacctcttcggaaatgcatatgagcatatgctgttagaagcagccaggtcacttcttgaatgctttgctgctttgaaatttcttccaccagatactctaaataatctctctcaagttcaaagtttcacagatccctagagcaggggcacaatgccaccagtctctttgctgaagcatagcaagaatgacctttactccagttcccaataagttcctcatctccctctaagacctccttggcctggacttcattgtccatatctcactatcagtattttggtcaaagccattcaacaagtctctaggaagttccaaactttcccttatcttcttgtcttcttctgagccttccaaactgttccaacctctgcccatccaaagctgcttccacattttcaggtatcttttgtagcaatgccccacttctctgataccaatttcctatattagtccattctcacactgctataaagaactatctgagactgggtaatctatgaagaaaagaggtttaattgactcacaattctgcaggctgtacaggaggcatggctggggaggcctcagaaaacttacaatcatggcagaaggtgaaggggaagccagcacatcttcatatgatggcaggtaagaaagaatgaaaggggaggtgctacacacttttaaaagaagcagatctcatgagaattccatcatgagatagcagtggagagatggtgctaaaccattagaaaccacccccatgatccaatcacctccctccaggccccacttccaacactcagggtcacaatccaacatgagatttgggtggggacacaagagccaaaccacatcaagtagtaagtaaatacggcaaagtatatgaaattaaaaatacaaaaatcaattctgttttcttttttaaattttacaggcagggtcttgctctgtttacctaggctggagtgcagtggcacaattatagctcactgcagcctcaaattccttggctcaagcaatcctctcacctcagcctcctaagtttctgggactacaggcatgtgccaccatacccggcttattttttatttttgtcaagatggtctcactctgttgaccaggctggtctcgaactcctggcctcaagtgatcctcccgccttggcctcacaaaggatgagatttcagacatgagccactgtgcctggccaattctattcttatattttagcagcaaaccactggaaaatgaattgaaaagcaatttcatttataataggttcaaaaataaaatatttagtagtacatttaagaacagatgtacacaggtgtatatctacatttagatgtacacctgttacacgtaacagatgtacacatcagcatagtgtattattaaacttttagatttttgcttatctcatgggagaaatagtgtcttcgtgtagtttagtttttttaaaaaaatgagtgaacttgtgtatcttttcaaaagttaaagagccatttgcttttttttttttttaaacatattttaaaatagagagtgggtctcactatgttgctcaggctggtctcttagcttctgggctcaagctgtctgcccacctcagccttctaaagtgctgggatgacaggcatgagccaccatgcccagttccatttgcttttctttttctgtgtattggctgttcgtatcccttgcacatttcttattgagttttgttctttcccttatctttttacaggaactttatatgttatagaagttagccccaagaatgaaatcgtgtcctttgccaaaacatggatggagctagaggcctttatcctaagtgagttaacgcaggaacagaaagccaaatagtgcatgttctcactgataagtgggagctaaactatgggttcacaaaggcatgcagagtggtactgtggacattggagactcagaatgggggaggctaggagggaggtaagggatgaaaaagtacctgttgggtacaatgtacactacttgggtgacgatgggtccactaaaatcccagatttaaccactgtacaattcatccatgtaaccaaaacccacctgtaccccaatgctatgaaaataaataaaaccaaattagctctgtttctgttagatgagatgcaaatattttcccaagtttgtcctttgtcttttgactttgtttatggtgtttcactcatgcagatgttttttattttcatgtttttaacttgtcattattttctttcatgtcttctggattttaagtcatgttatcaaggctttcccactctgatattataaatgaatttttcctcatttctcttagaactttgattctttcacttcccacatttaaccttccacgtatccagaatttcccctagcataagttgatacggtcccaatgtttcttttttttttttcccaaatggccactcatttataccaacaccatttattgaatcgtctatagtccccactgatttgaaatgccagctttacataccaaagtcctgtatgcatttgcctctgttctgtttggtaggtctattcaagctccagttcccaaaagtgttgagtgtcgcttaaaatctagaagggctggtttctagttttccataattgctcctcttttctagtgtcctctgtcctattagggcttattgatttttaaatatgatttgtggattcagttttctttagttctagtgagcaacaaaaacaaccaagaaaaaaataaaaaaaaccctccctgttttcctttctttctttctttttttaatcaagatcaccttaagtttaaaaattaacgtaggataacttgacatattttatgatttttatgttactctccaaaaatataataagtggttctatttattcaactctactcctttgtcctgcaggaacattttgtttccttatcaagtctgatattgtcttttggtctgagatagacatatttaaaaaaattgtgttcattgatttctatcttattaaagactggttttgctaactttgttcctatctattttttgtgaacgtacatggggccttttcttttgctatattttctagctattagtatgtacagaggcttttgatttctgtgtatttattttataccttgcttgctcagtgtgttttatttctagtaatttttgttattagttgattctcatgaattttccagatatccaattatataatttgtaaatagtcatagccttacctcctctcctacaatttttgtttctctgatttctttctcttgtctggttgctttagatagtacctccagagtgtgttagataataaagggaaataatgccaatcagacttttttctgacttcaagggagtttctagtgtttccttattaagtctgatattgccttttggtctgaaatagacatatttttttaaaaattgtgttcattcatttctattttattacatatatttttaaaaaacctcaaaaggcctggtgcagtggctcacacctgcaatctcagcactttgggaggctgagatgggaggattgcttgaggcccggagttcaagaccagcctgatcaacatagtgggaccctatctgtattatttttaaaaacataataaataaaaacctcataatggagattaaattttgatagggcttgtcttactatctatggatctaatcatgttactttccctctaacttattaatatgatatatcatattaataattcctacatcaagtcatatttgcattttggaataaatgtcacttggtcatcatatattctattagataatattttataatttttacatcaatatttgtaagactgatctgtaattttcctttttgtgtatgtgaaattgttactgggttttggtagcagttatagttgctttatcaagataatttaaaagttttttttttctttttcatagtctaggtagtttaaatagcactggaatgatctgttttttaaagatttggaagaaatcctgtgaaaccaactggacttagggaattagggagagtggttggctagtttctttgtttcatctatgaaataaatctgcttaagatttttctgttttttgtaatcaggttggtaaattatgtcttcctagaaaaatgataatctcattcatatttcaaatatagttgcatagcgtattcaaatatattaatacaatatataatataatatatattaatataatgtatattatgtattataatatatagtacttcaaatatatttgcatagaatattcaaatatatttgcaaagtagtcttttgattcttctaattttctgtagttattgtcccattagcatttctcatgttgtatgtttttaatttctcccttttccttgcttagattaagcagaagtttgttttatttattttttcagagagccagctttggttgtatttatcagttttattctttttctgttttctaaattattaatttcaactttatttttattatttccttttctagctccataagtggtatgctgaattcattcatttttacttttgtttattaatataatcatatgaggatgtaaattttcatctgaacgccactgtagctatatctcagattcttggtgttaatatatataattagctgttgtcataattatgatttatggtagaaagccactagagagttaagaaaataagtgaatttgcttacttaggatgggcctaaattaagaagggccttgaatgatagatggtaggcagaggactttagactcaataaaaatagtgttaagaagacattgaaaatccttggttaggaaactaacaagatacgtgttgtttggaaagatgaacagcccgtatatcagcagttaccttatctactgctttgtgtttttcaaaacaaattttggataagaaatgcccttttcagcaaagatggaaaaataacatctaactatttacttctcaaagatattgccaaatcctgtaagtgaatatccagctggaaccttccacaattgttttgaatgttgtacttgcacttgtttgaaatctttaagtttcctttaaatgtgaagtatatcctaaagtaatgagaccatgaagcagccattcatttctactatgtattttgtgttattatcactcacttggaacttacctttgctgtcaaaggtgtcttatttctctactagattgtaaattccttatacaaatgcaatatttttatattgtaggaggccaatatttgttactaatttattttgcttaaaactactgttgtataattgtaaaattctcacagtgagcatacaaataattgaaatactcttgagactgttatctaccttatctttttattattcctaatcatatggaacattttcaatggtctcatattaagtagatagtctactttatcctgcctttttaatcattgagcaactaaatttggatttgtttcgttgtacctacgatctcttttatttgacttttgtgtcaaggccttgcagtatccatctcctaatttcttactgattttgctgggagaggcaattggctataaaaactgtattcttaggttcctctgctggtaagagtagccacgtactggccgagtgcggtggctcacgcctgtaatcccagctctttgggaggccgaggcaggcagattgcctgagctcaggagttcgtgaccagcctgggcaacacggtgaaaccccgtctctactaaaatacaaaaaattagctaggtgtggtggcatgcgcctgtacttccaactacttgggaggctgaggcaggagaatggcttgaacccaggaggcagaggttgcagtgagccgagatcgtgccactgcactccagcttgggcaacagagtgagactccgtctcaaaaaaaaaaaaaaaaaaaaaaaaaaaaaagagaagccacgtactaagttctggcctctgggatggaggtagaggttattgagcagaaagttcctgcttgggatctggagggaaaggttgggggaagaggatcatgttcccagaaaggatggtagactagaaagttgaagttgtgcacaagactggctacataatttgcagggcccagtgcaaagtggaaatgcaaggctcctgttctcaattattaatactctaaaaatgccaatagcagagaattaccctagcattgggtccacaggtcatagccccatgcaactggctctgagtatgaaggaacccggggccggaggaggccatgagccttcatcccagccctgggctgccagtctgttcttttcatagagcgcacaaacctccttcttggttaagcgtctgttgtctgggttttctgttacatgcgttccgtaactgatgcaagttatcattaccctcatctgatagatggagaaaccggagctcagacaggtttagtgccctgtgcatgggagcagatttcggggtattcacagactcaggttctgtgaatttgggtcgtatattcattctgtgtcaacacgttgtctttctttttccacggagatgttaacattctgcatttcctatttctggccagattttgcattctgcaagtttgcttgtttcacaatgcccccctctttgtagcctgtagtaggaggaagaacttcatcccatttgtttttcctcatttacatttaatttttactctggagtgaacataatgcagaagttcagtccacatttaaaatattgctaaaaagtgattcacttccaattctagcaaaacgtttatacctctgattcctcagtaattctctttttgcagaggaagagttaagattacataatttaattaaaaaagaaactggaaacatgtaagatcgcatccgatgtgagtttctgtctgacctttcaagagagaagcatgtattggcgatttttccagtgagatcatgatcagaagaatttatctatcaatgtatacttttaatttaggataaacctaaggataaacagtgtttgtagctctttgcacattctatctatggccataggatgtgctatggccattaactgtcatttgttttgttagcgctaaaaaccatagctgcgacttcaacttcctagggaccccagtgtaacacaggtgttgtatttgttgcgttcaagttctggtgcaatcttagttttgctaagctcctgcaaaagcacctaacacaagtcaacatttctgaaacaagttttaatttctttcagtcctcagtagtgctggtgtgtgggttgggggcatggtgcacagtgtgtcagcacagataatccgtgtatcatgggtcatccacctctccccctctttaccggaggagagagcatctcccagggaatcagacctgaatttaagtttgagctcctaattaggcttccaacccggttttactatacactttgcatcaggtacatctgtgattgtcccatttgtcattagtgtgggcccttaggaagtcaatagaggacagaactctggtgttcctggatccttgactaaagcatcattttattgtcatctaaatctcactagaagccctagctctctggttatggtgaaatattcaaattattggcatattcaaggtatcattaagtagtattttgaaaaacttggtgttatgggttgaattgtgtcttgccctatccaaattcatatgttgaagtcctaatccccaacatctcagaatgtgactatatttggagagagggtctttacagaggtaaaatgaggtcattaggttgtgtcctaatccagtataactggtgtccttagaagaaggggaaatttggagacagactcacgtagagggaagataatgtgaagagacacagggaggaggccatctgtgctaaggagagagccctggaacctattctccctcacagccccagaaggaaccaaccctgctgaaaccttgaccttagacctccggatttcagaactgtgaaacatacatttctgtggtctgagccgcctgatctatggtactttttacagcagctctcaaaaactaatatacttgggagccaggttgggaaaacctgtttgaaaggcagatggactccatagataggagtggggctaccacactgtgcaatatttgaaatagtcaactgttgctgtctgcactgttcaaagactaacaatgacatttgcttgggcagggagctcctaaacgttcgtcagcaaaatgtgctattcatttgtgtagaggacttccagtttcattccacttttttaaaataaggaaatttgggtagggttttcgtgacctgagtcgggttttcgtgacctgagtagggtcacacggagatcaggtgaatggtaaagtgggaatacatttgtaacttcctggtttgtagtcttagtggtctattgatgggaatcctctgattctcaataagaagtggctattattagaggcagaggattttttttttcggtactgaaatacttagcacagtgcctggcacgtggtagatgctaaaattgtaactattgctattagtgaccaactctggaaaaggactgcttttcttaagttagcagtcaggtaagctctgccccatgaaatttatatattattggggcttaataaagttttattatttattttatttatttattattttaattttttgagactgagtctcactctgtcaccctggctagagtacagtggcacgatctcagctcactgcaacctctgccttccagattcaagtgattctcctgcctcagcctcccaagtagctgggactacaggcacccatcaccacacctagctatgttttgtatttttagtagagatggggtttcaccatgttggccaggctggtctcagactcccaatctcaaatgatctgcccacctcggcctcccaaagtgctgggattacaggtgtgagccaccacacctggcccatcaataaagtatttttaatattaggtctgagtatgctgccttgagcagtctattttacaacattattaactttgcccattattgataaatcatctccgaaaagactcaacacaaaatatttctataacaaatcagaagcatgcatgatattttattttaaaaagataaaataaggaaaattgaagtccagcatctctaagatactggataaatatcttaataatcgaacagtaaagctctaatacagtacaaacattttaccattatgtttgccaataattaagcaaactgagcatcataagaatgaggtgagatgtaaaattactggaaagtttaattcactagaaatgagaaattttacatttgttatattatcctgtatttgtgtactacatttttctggcagaatgactccttgctgaaaaaaaatggcttaaagtaggtgcttttttaatggttttgcaaattctggagaacagggactgcttcttcctaaacaagatccccggtcttgctattagtctagaatagtgaatatatatttaataaatgcttgttgagtgaaccaatatgtgaatgattttcttagtggatttctattaattgagggaaaggagttaacatgtcaataaaaaaagaacatttttactttcaaataaggaaggcaatttattgtagtgaaattacattgaagttttatatatgacccccaatgcatataaaatcatttacctccacattataggataggatatcatgaactacaaagatactcaaagtgctatagatgagttaatattgatgtaatacattttcattaatctacccacatttaattggatgattgaaaggacacgttgaagtgtttttcatgatttttgctacggccccagcttttactggagtttttaatgcctttgatgactccagacactcaactctgttccttgcagtctgtttctttcttctatggtggtgattagttattgcaagactgcttatatagagtaatatatagtttactctggtatggagtaaacttataccagagatttaaacatttctccctaaatggagtttgtggaagatgtgaaaattggcatgacatttgaggccacattaaaaaagcgaagataatttttaaacactaaccaagagaaaagtgccccaggaagcaaggaacagcagtgtacttcactgcaagttcaaaacgtgtgcagggattattagacatcctttgcacctaacaccttatctataatacatttgatacatttttacatattgcacaaatccaggtacacagagactatctgatgcgccatggccatggtgtagctatcctcactgaggagggctttccacaactttctcaaggagcttattcaagaccttttaaaaacaatctacaggcagttctttacaagtctcatatttacagatagcacaagctatggcatggcgtatggcctccctcctaaatatacgattctttggcatattggaattggtcagcctcaaagaccggctggctacatcgtcgcacgagacagtcccgcttattcctctgcacggactcggagacggtcctcagcgggaggagctcaggtctccctgggccagacacgtgccccagagagtccccagaagcatggacagttctgctctgtttccatcgctcaggcaggggagagagtccgtggccagggagtggctctttgctgcccctgtgtcttgagtcctctacgtggtgagcaggtggaagagggggtaggaggcagtgcgcctccagcatcctcgccctcatgctccccaccgtcatgctccccacggtctggctctcggaggccactagtctggctgccgggccctgcatggcctcttcataagagggtgggcttccaggcctctcccagtcagctccctggaacacatcatccaccgagagggcgtggggtctcaggcagaagccgcgggctgtttggttgtgggtttcacacccattttcctgcacgattcggccggcaagctggctttcctttctgacacccctcgggacgtggtccctggtaaagtcttgcgatttcccagagcccgcgctgaggtttttggtcagcacttttttgtgaggggcaaaggtgaaagacatggagtgctttttaatttctcggctgggcttgcctttctctgtctttgtggtgaaagactgatgtctgctgaagaaatttcttttgggactggaaggagaagccacgggcgagctgtcagaggacgcgtccagcgagctgctggagaaggctttgagaaccagtgcccgcgggagcaccgaacccggggccaagttcttgatcttcaggtccaccggcctcttggttttgccttgcactgcagggaagacctcctctggaaatgggtcttcagcctcctcactttccaaacgagagcctacccggggcacggggaagtccccttcactctttgttagtgtttggtttgtcacccggctctcgaggcactcctgggaggatggcatgctgggctctgagtatctcctatcgggctgtgcgagggagcttttcagcctggccacggtgctcacaatgggctctgggctgacctctcgggcatcctgtgggcccgcgctatccaagccagcagctgtggccatgggcacctggggctgcctgctgggagagctgatgccactgctgctgttggattccacatcagggtcgttgctgtcgtaggctgagtcattctgcagggtcgacacatctgggggaagtcaagcagcagttgaacatttgtttgggtttatttatttatttatttttatttgtattttttattttcattttttgagatggagtctcggtttgttgcccaggctggagtgcagtgatgtgatctcggctcactgcaacctctacctcccgggttcaagtgattctccttcctcagcctcagtagctgggattacaggtgcccgccaccatgcctggctattttttctatttttagtagagacggggtttcaccatgttggctaggctgtttttgaactcctgatctcaggtaatctgcctgccttggcctcccaaagtgctgggattataggcgtgagccaccacacacggccatttaggttcttttagaaatgaactttgctacagttcgccctgctcataccaatcagggcactaggtgatttattagcagaactacttaggggcttgatatgacaagaaatgtaccacatgaaaagtttatttctttctgaatttattttgagatcagaagaaaaatagggaaaggaaatgagtaaaggagggaggaaggagagaaagagaggagagaataagaaaagagagaacagcatttcactgaaaatgtattgaccttaatttttaaaactgctccttttactggacccattttcattgtgatggagtcatatcccatgaagtggaaacaaaagtttctcactccaactccagagctaaaggtagcttagtgaaatcagcagtgatttgcgatgtacactgggaagggggaaagactatctgtggtctgaggaggcgctgcaggaaaagcccggagcagggttttcatgtttaatgacttcctaatggactggagtctagtctgactcggtgatttgtgaaggtaacttctgcctcaaatatcagagatgctttacatgactggcagactggcatgaacttttccctacaatcgtaatcaaatgatagcacattccatacctgaactgtcagtgtgctccagggagtcatcagaagtgatactggaatgcactggaatgttctccccaaatatttcaaagcagttatcaatgaggaattccaccagtgtcttcacctgtgaggaaaagtaagcaatttgtcagcttgaagactttttttttttttttttttttttggaggtgaggaagaatggggacactggagtcaggtgccaaaatgagaatctgagatctttatgtgtctgaaaagagcatacagaaatttggtaacaatcagatacttttttttttttttgagacaggctttcactctgtcaccaggctggagtgcagtagcctgatctcagctcactgcaacctctgcctcccgggctcaagcgattctcccgcctcagccttccgagcagctgggactacgggcgcccgccaccacgcctggctaattttttctatttttagtggagacggggttttgtcatgttgcccaggctggtctcaaactcctgagctcaggcaattcgcctgcctcggcctcccaaagtgctgagatttcagacgtgagccaccatgccaacaatcacatacattaaagttagatactccttggtgttttgagacatgcattttaaatttaagaacttaaaaaaatttaaagtattaataaaattttcatttaagtaagtagtgtcccagattgatagactgatagactgtggtgtacaaaacacaaaaacaaaagggcttttttatatcgggagagagtgatgtaaatactcgcagcactcatctgtctcacagatgacagaagacacggatttattcagtttcattagatacatgtatctgagagagtggaactatgacaaaagcattttgcattttatattttcactgtgattctgagtcagttggagacattctgaagcattttattgcctggacttggcaaacagatggtgagatcataagttggggatttctcatcagtaagcagaacaaaccttgttgttcaggtccttctgggcttcaaatgacaggctctggtcattctccagggtgagcatgttgggtccaatgcagatggccagattgctggagtccatcctgttcacctcagagttcttgctgatgaggtgcagcacatagaccaagtgcttgagtagcaggaggttgggccgggggagcttatctgcaaccctggaataaagtgaagggatgttagttttcaaaaaggctaatggtcttcagtgtagcaagctgagagtttctgccgaaaccagacttcctttaaaatgaggaaggtgcattttcacaagtaatattgtgaaatgctcattcagacacttccagtggcaactgacacagagtgagactggttaaccacaaggtcttgaggagctaagaaactggcctttgtaattgggacaccaataacacagccctttattatttatacagagcttaaattatgaagccaatctgcattaaacaccatagtttgcctttatgtttagaaaatagttttgttgagtaatcatttagtcatgtagaatttctttctgtttctaacacgactagactggttttcttgccttaaaacaaagacggaaacaaaactataattaccaaacgaagatgacacatttttacaacattctgagaaagctttatgaagactaaatcagtttctaagggcatgttcatataaggcggcacttaaatcgcaacattgtttctaatgataagaaattagacttcttaaagtctcactttttcaaaaacgaaatggtgattattttcatttctcagaagaaggaattgttataaaaatgccttatgtctaggtagaaactcattgtgataatcttagaattttcattttgggacagacattttaatgtcttcaattctatacatatgtcattgaaagtatttagccatgtgggacaattataacatttagataaactttcataggatgtgacaaccatgctgacatttcaaagcttgggttttagaattctctagtcactaacagatcacactttccattgcatatgttattatttttactctcactggaatgtgttattatatagttttcatttgggttaattataagaagatgaaatatgctgtgaagttttatgaacaaaacaactgccccccaccacactgtctggctgcatcctgagggatgttttatgggagaactgttgccttgcatgacaccagtcagtgtagcttaaagataatcccgaatttctacactttgctggtgagcctgtgttaaagttctcaggtctgattttatctcatacctttttgaacatcttacattttcagacttccctacctcttgggatttgtgaggattgaagttcgctttctactttttgaagaaatatttcatttggctaaaattaaaattcaaaagtccagggcaccctctggtttttgttctgggagtggacgagcaattccactcggattccctaaacatcacaattctcatggaacagggatcatgaagcatttagaaagctgtgtaaagaatcaaaagacggaggtgatgtggcctggcaatgaccgatgactttgatgacttactgtttcagggcctcgattctgtcctcctcgtcctgcatctccagagcacccatccactcctcaaagaggtcgcttgaaagtagcttccgggggatacttctgaggaagtcctgggggatgagagtgggctgttggcctattggtactgtatgatgtcccatgtccttgttttcacccggttttcgttccatcgcagggtgctctatgcttagcccatcatagattgtggcccttcattcctgcatttgatgaatccagggaaccctctctccaacacccttggcctctctgcaactttctaacatcaggcagagtcagaggcaccatccccaggtgggtgtgttctgaggggccactggattttgacgtatggattctgccacggaacaatcaaattgcccgtacttggcaaagttttgggagagcagaatgcatcactttctgttggaatctgaggtcacagaaacagaggtgcttactaaataaataaataaagggcttaatgaaaaaaattaaactccaagatcagtgtaccttgctgtgtggggagaagagcctatttcttgcatcctgagaatgagtgtgtcagggccccttggcaggttatttggcgcaagtgtgttgaactcaccttaaagaccacagcgaggaggtgcacggggagcctctccagatccaccgcatccccagagttgagctcctccttcagctccttacgggctttctcgttggctgctctcctgaatatcccttccgttgaagggcctttaaggcatagaatagtgagaatgtcctaaaggaaacagcaataggaacaggaaagggttacccttcttctttagtatactgagatagtcttaacaggaatattgatgtcagattttgctttcagtccagttgctgtcaatggccttcctcaaccctgctatttttctaagaggaggcaaattgtgaaagctctaattttgcactttctaaaatcactttggagctctctcctttcaaatacttccatatgaacattggatttcagatcacaaagtctatattctgtttcccccttttgacttttcagaagctacaaatcttcagcattctccactctgtgaagtcagaggaatggcgggaccatagctctgagctcattggcaaatacaactaatttcaatttctggaatggaagcagtcagatattcttctgactgcacgcgtatgtgggagtgccatgttgaagagtggaaaatatggaagatcagtccctacaaacttaataggagaatgacattcagatttcccgagtattttgcatgtccaactgaaaactgaagtaggtttatgagagaatgcacgcctacctggatgggtctggggagtgtgtcactgtcaccgcagataattgacaagggctgatcaaatagcgatgctttcaagtctgtctccaaagccccagaaaaatctgatgcaggggagagccttctcatgagaaagggccaggacagcaccttctttctcttcttaacttctacagccaagaaaacaaggcaacgagaaaaattagactacagtgttaagaagcaaagatccaggtaagaaaatgggtatcgttggccgcataatgtggtcaatagtatgcgatgtgagaaaaataattttgaaaacttgagaaagcaaagggcgtgaatcttaatctagaaaaaccaaccgataaacaaccacactgttaccagggcaaccagttccctaaacagcaacaccagagttcctcaaggcctccacctttcctgttttcactctttccagctgtttgctacagaaaattagcaaaacctaactgtgctgatcataaacaaccatcttaacctactggcctgaataactatagaggaaatttctgatatgaaatagattattttgatttcctcctttaactggcgaagaaaacgaaacttaaaaggtgaggaagtgacttgctgaatatcttttcgaaggcacatagcagggctggctccaaccctttgcagccacgcaggcactaaacagccactagagggagctaacaccatttttccttccaggtgactggtcaccttgggttttccaggttgctgctttaggacagaggcaaatacgaatcgctgcgggaagccttgaacctagatctggcaactgggaattatcagcaaaacgttatcaagatattctgtccttctgaaatccacaagatgtgtgtgcaatggatattgcaatctcaaacatttccttctttcttttcttttccttccttccttccttctcctttcttactaattataaaggctatattttctaaatgcattggcatctgtttctatacatttcagattggcaagtggaagcatgatgagaaagaagtggcctgtctttatggttcaggagaactgggtcagggttacgctataatgaaatgcattatgaaaaaagttgagagtgaatggtgggtcctttgggatttgagatcagcaacagttgcttcataggctcttggatgcattctccataagagaaggaagaaaatggaaaagacactgtgtgtttttcaaatgtgtgcatgctaattgtcgaaacatacatggccaggagattgaaccgcattaaaaacgcttggcagaactggggattctctatggagaggctctttcctttcccagcactccctgctctagtgagttggagcatacctgccatttaagggttaatgttctgcggtctttaacagaacaacttatacaaaaaaattcctagtagagtaaaagcgctgtggttttgcaaaccaagagcactggttgttagcacttacataaaagatcggtatgtttttaaaactcaccaatgagctggcaaatactgtcttcactctcacatgatgccaacaggggatgttccttgatatcaccctaaaaacatttttatttcagttaaatatagtgactgaagaaacctatcgagtctttccccacaaaacacacatacagcattttattcatattaaaaatgaagtcagtagagtgcattgatgttttttctagcttctagaagcaatattaaggtcttgattgtcatcatataagatcctaattaatgtgcttaatttactacatgtgtgatgttagtttactactcttataattactattcaacccaaataatattcaattaaaacaaagttttccaccttctcacagtacagataaaaagtcttaaaaattgctttcttacctctgattgacattcgattagtgtctccatattattggcgtttagtgtttttgactaaaagagaaaaaataaaattaggtaaatatcttttggcccttgcctgtaggaaacgtgaatgaatgaatgtgagaggggcactcacagcattgtggctgcttctcagcttcatcagtattgcggctgactgtccaggggtggatttcactcccgtgtggctgtgcctctgtctacaacgaatcacatggaaaggagttaggagggactcacacagtaggccactttcagcgccactttgccaaagcacagagtttgaaactatttatttatttttctcttttgctattttttcacttgcctttactttggaaaaaactattacatagacaagttttcatttaaaatcagttctgttaccagatgttgtatgttgttaagagcagcatctgaacacaattatttctaaattatttaagtcaactatctttaccactctaaacgttgttaccaatttattccgttccatcaagagataatctggatatcaattacgttaacattttaaattaacatgaacattaacttttttggtggagtgctgactatatgccagctgtcgtagtaggtgctttgcatggattttctcatctaatccaaaaaggaaaaaaaaaaaaacatatccctaggatgctaaaatagtaaacatgaaacaaagataacatttacagaactcctacaccaaaaaggtgcagccttcacgttgaagcaaagctttgtcctgagactttataaagtgagagcatattccacgggatagctgttttctgttgcctgtgatctgagtgacctgtgacttgcgaggcagcttgtaatttctaggcatgttaatatatagtgtacttacccttggagggtctctagccagagttcttttacatccggtgagctgtaaagaatgggagaaacagcataactctctgctccttctagtccactgggagagagagagaccgagccggtctcccttcacatgctctgcattataagcgaaggggcgggcaggtggaaattcagaatattacagagaccggaaagaacatcatgggctgtcacacggacggagccagccagacactggagagctctcgcttcctcattccttttagggcagctatgtctttttttttttttttttttttttttttttttgtgtcttccacttcaaagtaaaaaatctgtaaactactaggagtggaaaacatgacattcagcccataggtgaaggctctgattaatgtcataggtgggatgtgtgaacaagaaattgtgttattctgtgcataaacatcactttattttctaaagtggtaatttcaagtgcctctttttgcatcctgtttgggtgctctttcccctcccacgtgccatctgctctgtccaccagcaccacacgttgattagcacccctggatgtgggacactgttacagaaccagaaagaaacccaagacagtcccttccttgaggaacaatcaccgtccaaagccaggttagtttcctttggaagtagaaagaaaactccctcgagtcagttgtcaatatagtaaccccctcctcctttctgtaactcctggtcaaaagtattgatacttaatttacagtcagagcagctgtcgttctgacacggaaggaaaacaaacaaaaaaattcctttgatcagaccaacttaaagtaggaaagagatggtgaatttcatttgtggatcactcttctgcataagagaatttctgatcttttctgtagatcaagggctatatatgaaaccactcaaatgcctcgacacgagaatggatgcataaattgtgatccattcacatagggaatgaatgttgtatagcactgataatgaacagcctatgactatagccaacaatatggttggatctcataatatgacgctgagcaaaagaagccagacgtgaaagtgtatatcctgccggctcccattaatgcaaagcacaaaattagcaaaagtcgtctgtgctgttggaagcaagagtagcagtttcccagaggggatggtaatgacttccaggggccagcggggggcttggtgatggtccattcttgatctgggtggtgctaggcttatgtgcacacttccctatttatgtaatttttcaataaaaagttttaaaataacttggcttcatttatcatcagcatctttaattttaagacttttccgcattgtcagttcttttgtcattttactgaaaggaggtgattatggggcagactttgggaaaccgaagcacagagaggtcgaaatttgctctgtaacttagcggctcggtggggacctagggacagatcctggttttcaggcttccagctgggggctccctctctgaaagccaccacagtgccagagttcacccagtgttcccagggcagctgtagaggccaccactctttcagcatccctctcctgcctttataaacctccaaagtgaactcactgatttttttaattgaaaaagggcatttacgctgtgcccagcctagtgctaggcatatagtaggtactaaataactaatttctgaatatatacatttccttataaaatagccaaaatagaatattactataatgttctatatatcatagaatatatatgtgatgtatattcattgctagtatgtattttctaaacttttttttttcccgacaaacggacttttcaaatttttgtaagaaacttaatgtacttactgttctttctttttttttttttttgagatggagtttcgctcttgtcacccaggctggagtgcaatggcgtgatctcggctcactgcaacctctgcctcctgggttcaagtgattctcctgtctcaacctcctgagtagttggaattacaggcacgcgccaccatacctggctaatttttgtatttttagtagagatggggtttcgccatgttggccaggctggtctggaaatcctgacctcaggtgatccacccatcttggcctcccaaagtgctgggattacagatgtgagccactgtgcccagcctcagcatcttttaaaaatacataacatgaatggtttgatgacctgcagaaatggttacatcgacggacttttctttttcttctgggacctaccatgcctagttaagcacccagggaactatctaggatgaaaagttagtagcaaatacggcaacagaattagggcccctccattttttgaaacagaaatatgttttggctcttcttattgacacaactgatggtgggaaagcccagagggaggtgccatcctttggggtccctgggagattttgacagtcaacatctaatgaataggtacattttgtgactgaaggaaagccaccattgttggctggtgctgctgggggactgaggagacgttctcctttatgactgtggccccgcctgcatatggcgcctactgtggaaagagaaagagttgtgaagggcaggtgctgcaccctcaactctgaaaatctcacagtaattttgatcgcagttttccgagcactaggagaaacatttataaataaagtgtaaaatttggaagcagtcatgccaaaagttagaaaaaaagatggaaatgtcagattcactttttccatattcttgtctcccacacatctctttgaaaagcaagctctcatcgtcctgcatagtaagagtcttcagaacgtggaaaggaacttcagtggcttttgctgggttgggctgaaggaaaccccggtgaaacccacacctgtaaagatgcttctcacagtgggacttttatcgcttgggtcctggtcacaatcaatttttctgcaaataattggctttgcttttcttgtggtgagtctctaaggacagtgagttccgttctggggactgtgagttctatgctgtgtacatgtgtgctttggagggtgactggaagcaccatcgttccttcccatactttcaggctcagttaccgcttcagtctggactgttgtgaacgagaatatggaagtcattttccccacattgtttacccagcttgcctgggaaacaccaactggaggattagagtccggctcttcagtttgaactcactttccctttctcttcctgggaccacccagtgattcagagccctgcattctgtaatgagattaatgtcaacagtttcctgcattgaagattattttcccaaagagttcacgatttccttcaggacttctccatcaccccagtgtctggctacctaatgactgattaacaggttgattttctagaaaactcaaattacaatttcttttttttaaaaaagggcaatccagccttttctctgattatccgtcctccccatctcccacttgtcctatgttttagccacacaggctgttgtcatcccctaaaagtgtgcttctgagtctccaggcctttgataaattgttccctcctcctgaaatgccattcacgccatctgccttttggaattctgcccttccctcggaatctagcccaagtcctatctcctctaagaagggacttttctagattgaattaaatttccttccctggccctgcatagtggccgcacccagtagactgtgagtctacttttttcatcttttattcttacaagtgcctggcctcatattttgcacacagtaggcatttgctatactttaattactagtaaaattgagtgataaaataaaacatttaaatctcaccatacgtttgctggtattgcaatttgttactcagactttttgtcacttagcctttgactgtttcgtttcatggagaaagactacctctttgtcacgctgtaacagagaccatcgttgcagaatttgattgagctggagacagcctctccttgcacacaccgcgggcttatgtcgataccaatgttgtgggattagacacatggactctctagctctgtggtgaggaaggaggcctcgccttaggtggacttgagtgtcagcttctgtcagtgaatctgtcaggagggcgtgaccacacctgtccagcctctcacctcccaccctccaaggaccaaagccttaccagtgttctcaccttagactccctagttctgtgtgctctgggaggtgtggacgtccccagagccatgctcctcactgtctggtggcagaggaggacttagcataaaggactccgggggctgggaagttggtgctcactttgaatgacggtcttggattcactaatctgcaaagtacccaacctgcagaatcttttatgcggtgactttggttatagcgaattagcaataaaactccttgcctgcctctcctctaagaaacttctaggaaagtctgtgggtggggaagatatgcctggaagagacgttctcacctctctgcaggccccgggctcacagatacaggcaaggactcagtctcggctacggtaaatacagttcagtcctttaaggtcattttttaatttttgttttttttcctggcaggagaagggctgccttccagggaacttctcagaggtttgctgggaccctggcatccctgaaataatgtcaagcatcatttcatcttgcaaaataatttgctgtctccacaaatggctgcatttctgcagtagtggaagcagacatttcaaatttgccccctcagatatttgcaattatgaatttatctttgtgttggaatacaaaataggctcagcataaaataatatttgaagaacgctgtgttttcaaaagctggcttgaaaactaagaaaggctcaaacaaaatgttctttttaaactggcttctccacttattgtgatcaagatgaagaattaaaaataagacatcctgagattaggtgattagaagctgtatggctgatgacacaaactgctatgggacccaggcagggcctcagcttagccgcgcttatcactgctatgggacccaggcagggcctcaccttagctgcgttatcactgctatgggacccaggcagggcttcatcttagctacattatcagtgctgtaggacccaggtagggcttcagcttagctgtgtttatcactttaagaactaaagaatgtggctgggcgcggtggctcacgcctgtaatcccagcactttgggaggccgaggtgggcagatcacgaggtctggagttcaagaccattctggccaacatggtgaaacactgtccctactaaaaatacaaaaaatgatctgggcatggtggcacacgcctgtagtcccagctactcaggaggctgaggcaggtgaatcacttgaacccgggaggcggaggttgcagtgagcccagatctcaccactgcactccagcctggcaacagagcgagactccgtttccaaaaaaaaataaaaaataaaaacaaaaaaactaaagaatcttttctttctgttgatattttggcctgaaaaattgcacaaggcaaacatgatgtcaaaaaaggcatgtcagcagccctgaacatcagttaactacaatatgatttggtaggttatttttttgaagaaacaaagagaaaactatgaaagctgaggttctttgttagcagtctacaaaattcatgtgcagcatttgtaaaaatctgaaccaaaaaagtagaaatggtggaaaaatgtttagtttgccccatgcttttaaaatgccttttaaagatatatttactgtagttgactttggtttttttactgagcactttttttcatttgtcatatgaaaaaaattatccagggcttttacctccctgtgtaaattttaaaaaagaaaagtatttgttattttgaatgtgtgtggtccccttctcaaatatgtgccttatttggtgtctcctaagaaaatctttcagtgatgccctcccaagcggcccctgctcctcggggttggggagcgtggccactaggcacgcagctcctgccaggggaagcagtaagggggtctccaacctgaagacaaactctcacctggccggagcgggcttgccagtgctcagggcactgtgctcattggtggcttcacatctgattttcaccttttcacccaggttcagctagcaaccatttagcaagtcctaaccctttgtggctgggtctgtggagtgctttcttttcctggcaattgtagccttcctgatggactagtccagactggttctgatttagactctaggaccagtccgggggaagggtttaaagctagtgtcatcttctgtgtgaaaagactttgggcagaggggcaagggaaagccacgtaatttttgcaaacctgatgctgcctcctgggcttttcttacagaaaaaagaatcataagatttctccttctgtttttgggtcataaaacattatgtaacacactagaaagcattatatatatatatatatatatatatatatatatatatatatatatatatatatttttttttttgagatggagtctcactttgttgcccatgctggagtgcagtggtgtgatcttggctcactgcaacctctgcctcctggttcaagcaattctctgccttagcctcccgagtagctgggattacaggcacccgccaccacacccagctaatttttgtatttttagtagagacgaggtttcaccatcttggccaggctagtcttgaactcctgacctcgtgatccacctgcttcggcctcccaaagtgctgagattatgggcgtgagccaccgcgcccagccatgatacatatttaaaaaaatttccatatctttcctaagtttgcatatgttaactggaaaactgagcccagaagccctttctctgagttgtagcctttgtgagatcttccataaatctcaaacagcaaccatttctcaaatgtgcagtgcagtgctgctccaagttgatcgcgtatcagaatcacctggaggttcattcaaacctagactgtggcctccaccttggagcgtctgattcggcaggtctggggagaggcctgaaaatgtgcatttgtaatgagtacccagtgacgctgatgcagctggtctgagggccacactctgaaggatggctgtggaagcacagtaagacctcatttaatgtcatccatagattcttggaaactgtgactctaagcaaatcaacgtataatgaaaacaattttcccataggctaactgatgatgtaaacaagagtcaagttcctgtggcatatttctggtcacaaaaggatcactgaacttttcagtaaagacccataacacttcaaatattaaacattgaaataagtgtgagctatacgtacatttaggaaagatgaataaaaacaaagaggttcattatttacctgctcattccagttcagggtctggggtgacaagagaccatcctggcggctcagctgccaccccatcgcagggcacactcacacacacacctaagctcactcaacctgggaccacatagacacgccagttcaccgaatggcacagctttgggatgtgggaggaaaccagaggacccagaggagacccatgtggatgttgggagagcatggaaattccacactgagagtggccgtagccgggaagaaattgtttttcttcatccacgtgataatgaaatgacattgaacaaaatgatgttatttgagggcctgctgtatcatgaaaaagtaaaaagtaaaatgtatttaatatattcctgcttcctggctttggagtagtttatttaacggcatttttataatcactaggttattccatgattccttgctagctttcacgttctatcttgccccttgaaattagagtgcaggtccttaaattgaagcaattcattcttacaccccaagacaagcctggggtgcacagtatgaagtacacaaatatccatttttaagaatgagtaaaacaggtgcccagcctgaagctgtacttctgcttttttggatatttggacacatttcttcttctgattgctatgctcaaccatgttttcccagacaaaagctgagggctactccaaaggaatcgtttacacttttatgttgagactaagccctagacctttcaccaggtggctaaacagaagagagaaggcatctactgcttggctcacttagagccccgagatctaactcaacagaggctttgctaattttacttaattttttcaaataaatgtggtatttccctattggcgactcactttcaatggcctgggttaaggaagccaaatagaccaccaggtgcacaaacttgtcttgaacctaagagccagctgtatgtccacggggcgtctgttttttgtgagagagctcagctctccacaaatgccccttggaagatccctaaacacttgaaggtgagcttccttgaccaccacctgcaagaacactcggggtgtgtgtgtgtgtgtgtgtgtgtgtgtgtgtaacattatcctttcatgatgcatgtttaccatgtacaaatgaccaggtcgacagagtaaataaggcgttagttgaatctctctgacaattgagaaaaggcagtttaaagtttaaatatcagtccttctcaaacttggctgcacgtgagaatcccctgggaagctttttaagaataatcaatgcccacacctaatctttgaccaataaaatggaaatttctgaagacgggatttcaggattaaaaaaaattctccagagaattccaacatgcagcttaaccagtgatctcagccacagtttttggggtcaactgatctgtcagttttataatgggatccttttccactgtaaccacaggcaccaggcaatcttagaagcagcaggtaccttgtccgcctgggtgggaagctgagcctcagcgtccctccattgagcagcgtcgtctcaggagcactatttccctaacttaccccttctcacccacaaagtgagagagctgaggtgacttagaatctgctgcagtcttgtggttaatgaaatgtggccataattctttgaggcggcttctatcaagacacggagtctacttccccactttatatgaggctgccctcatgacttgtagaatgcagaaaaaaggatactgtgctccaatggcctcaaagtttccacctttgccctcttgaatgcagccctgagatagccatgtgaggaagccatacaagcttcctggaggatgagagaccacgtggaggagagacaaggtgcccagcccacagccaacaccaactctcagacgtgtgtgtaaggccgtcttgggcgatcctgaatgtcatctaagtgagaccgtgtgaaaccaacagtagaactgcccagccaacccgtagaatcctgctaaatcagaaattgatgctgttttaggagactgagtttttggtggttattattcagcaataggtgcctgaaacaaatagtgactccataaattgttaccatgacttttgcacatgcacccccagggtaacattgcaatgcattgcaaatgcaactttaaaaagcactgatttagcctcgttctcggtggaagcaatccagctttattttaaagcatcttagtgagctactgatacagtatttctcacagtgagcccatgatgcattttttagtgtgtttaagataataaagtttaaatagaccagagagatgtaaaataaaaatcaatcagtggtggatgttaaaaaaatctgtgcttatggatacaaatgacatacaagggaattttcaggatgcaaaactaaagggtggagtatccagaactttgggtagaactttcagaaattccaaagaaagactgacattctttgggtactcgaaaagttgaactgagatgcttctggaaacttaatttcattattatttgtactcagtcaataaatactttttgagtccccacaaggtgcatggagctttactgggtattgagttggaaaatggacatggctcccaaactcaaggtgtgtttcacgttcctatctcatcctttcagttttccaagttattagctgctgtcaacaggcatttctcaatcctaacagttgggattcacatttagttcttctggaaatgatcgtggttcttcagtgcaaagagggagccaaggttcccaggaggatgctgtggagcgtgtgttgggctgtgaccaggaagggccctgtcacaccgttcagaacggagtcaggaggggtggcgcgtttcatttgacagtgtagacaaggggcttctactgggcaacagccatgtgattcagcgatctagaattaattcagggaggaggctttgccttgtgactagccactccaacttttatcagttcctcatattatacacacacacacacacacacacacacacacacacgcacacacacgtctgctggggctgccacaacaaaataccacagactggatggcttaaacaataggaatgtgttccttccagtcctggggtctaggagtgaccaaggtgtgggcagggttgctttctccgaggcctctctcctcggcttgcagatggccatcctcactgcaccccgccttagtcttccctccgtgtgcacattcctggggtctctcgtgaccacattccctcttataggggcgccagtcggactggagtaggacacactctaactgcctcaccttaacttcaccacctctttaagagcctccctccaaacacagtcacatttggaggtgctgagggctagggcttccacacaggaattttggggagacacaattcagcttataaatatacatatgtatatatgaatacacatataggtgtacatatatatacttttaagttgaccagaaatatgcctgcctttgtttctctgtcagggggttggtatcagttctctgccttgtggaccaccctacgatgtgacagatacagacaaagggaaggggcaggagggtggtttgaaagcaatagacactcaagtcagactcaagtcagaatcgctgaaggcagagaccaggaaagctccaggaagtctggagctggcagtagtgacagaaactcaaatctttgcttccagggaccacacaaagctgtgggccagccccacagcatcaggagggcatcagtttgcacacttctgagcaacttaagtaggacaaaaacctcaccttctcgagtgtgattgctcaagttcctattcagaaataattgtcaaagaggaaattacattttttttggcggctcttttccttcttctcatttttaaactctctagactgtgataggcagataggagttttgcttccttaaataaaagccacttagttcctgttttctgtcattggaggcatttcaaataaaaagccaggttatcagatagacatgaaaaacctacttcctaactgaaggggaattctgcagataactacggcatctgagaatagggattgaggatgtctgcatgaagtccaaaaacatgtattcatttacaaactcaacagattgttttctaggatttactcactactcatgtccgaggagcctttttccaaataagtctgacaaagacctttgctcagcttttatgggagaagcttttgaagccagccagaggggagacttcccacagccttccccaggaagggctggagccatcacagcaggaggtgaagtgctcctgatggccatggatgagagaagacagggttttaaaaaggaaatatgaaaagcctaacccaggaacaaacagggagacaatgttaacatcgaagtcctgaaagtggaattgtcagcaaaaatggccagatgaaaacatcagatcctgaagactctgcatcccatgggcagaagtcaacatgaggagactgggggatgctgcctaggttcccagagagtcctgagtgggacagcttcctgcaggttttcagccctatagttagtctgcctttctgcacacttttgtttgtttgttgtgttttgatcatgatgggattgaaagctttaaagaaggcagattccaagagcttgcgcgaatttctgcaatggtccctggatgccaagatttatacattttactcagagctcattaaattagtaaaatatgtaaacatttcctgtactgctttttctcaacagggaaaccactttttcccctgaaagagagccgtgtctgagacacacaatcacacaggagcctgagtttcttctgtggtgatgaagggacctgcttggcgtgagtgtgactgtctaagagcagagggtcctcagatgtctttctgggagccctgcctggtgtccctcagctggtctgcagtgttctgcggcgaaacacaagcatggcagtctcttcccaatccacagaccaatttaacttggtagagaaaacttgcttagttttacattttctccccatatttacaacaaatttgcaactcacatttgtctatgttggaatctactccatggtactatttgctctggcataaagttgccaagttattttacagcgaacgtgttaaactttcatagtgatcaaaaaaactttcctgtgactttcagacactctggtccttgaacaagggtgtcccctgcagtggtctgcttgactgtccttccatgagggcaggggctgtgtcctgttaatgttgacatcttctccgtaggactcgcatatagttggcattcagtaaaggctcatggactagatgaattctggtagggtccatctttgagcatgaagcatgtgtggctctggctctgcagctggcggtgacgaaatgtcattaaagggcaggggatccatgagccccaagagtcagaagggaggaggaggcagagttaccttctggtttctgggactttatgtaccaggctctacccagatgcggagggaggacgtatttcctctgtggtagtgagtatggttttgcctgtggtccattttggaagtcatacttccattttggaactctatcctagctgcccttggtagaggaatttcttaaaaacttttacaaaagcccaggaaaagaccccgaatgatgggaaaaggtggccacagaaccaggacaatggctggttccccagagtttctctctttttctttgatggccacaagaatacagagaaaccctttgtccaaagccaggaaggaggttcctcactctgagtggtggtgaaaagtgaatctctccttaaggaacagaaagtgatggacctggtgatagttgactagttggatgcgggttatataaagacttatgagtcaaatttttttcgtatcttcctcagagctgtatatttcacatagtaaaaagtataactatgtttttctttcttttttttttttgacagagtctcgctctgtcgccaggctggagtgcagtggcacaatcttggctcactacaacctctgcctcccgggttcaagtgattctccttcctcagcctcctatagctgggactacaggcacgcaccaccacgcctggctaattttttgtatgtttagtagagatggcgtttcaccaggttgaccaggatggtctcgatctcttgacctcgtgatctgcctgcctcggcctcccaaagtgctgggattaccggcgtaagccaccatgcctggccaactatttttctcttaatggaaagaaaattattcccagtaagaattgattttcctttctgcaccctcgaagacctctgcatcctttttagagcttggatattggggtggttgtgtccaaggatactactcagtgaatctggaacatgagaatcacctgggggagctcccagtgatcctaaggcctgtgttggaccccgtccaattgcttcagaatctttgattcaggcatcagtattttaaaagtttgtcaaagggttccaaagtgaagacaatactgggaaccactgcctggagtccactatagtcctcaaatgcaaaggtttcgatttttaaaaaatgttcaaaggtttcttttacttggaaaaagtgtactttaaaaaataatctcataactcaaaagttaccaaagggatttttccccttaaactttccattaataaaaaacaaagcaaacttatactgaaaacaattatgagaaaattcagcccaaagtagaaatttccagaaagttatgggcaagtgaaaaaaaaaggcaaaaactatcactgaaagaaaaaatgctttttacaggaatttcattttaaattcatttgcaatgaatgtctaatttcaaaggtggataaacagcatttgccaaaagtcccacctctggtggtgctaagaagctctgtgtcgagtgatggaaatgcccacaacagagttaactcagtctgactcaatgtgggttttaaaaaaagaaattaacaaattttaacagtaagagcacaagtgggcgacaaaatgactagcaacaaaatgactggttgaaaaggattatcttgccagccaggatggatggttcattttgcaaacacaacttttctaaataccatgtcagccttatcttttggtggcaaaagaaatgcgtgtttccaattagttagataataatactacactctgcaaggctctagactactctgcaaagagcagaaaaagtggatgtaatacatcagttattgacatggcacaactgcaccaagtaattgttaactctttgcattgtattaatctggcacaagacattgagttcactgatttttgtgacatcagcttcccattagctgcaggacaagtagaaattcctcgggctgatgtttaagcccttccatgatgaggtcacactgtgcttttccatccctgtacccctctggtgcctttttttgggccagtcttcctaaaatttttctagtgaagagacacaatgacaaatgagagtctaagagagtctcccaagccctctgttttcccctctctaccattattggggtcttcccctaggtcagactctctgttacacattttacaaattgatcttctttgtgcctaaccgtaaacctgagaagtgggaattattattctctttttacttacgatcccgtgtcactgctgaagtctccttcttactataccagggtttgtcttcataataaagagagtactttttcactctcaaatcaccaaagttgaggtgcagggagatgcttagtcctgggtcatgctaatctcttggatgcttttgactgagcacacatgtttgcaagtgaactggagtgaaataactcaggagtaggccaagctggaattgctctgcaggaatggagaggttgggcattccttgttcaacttttctgttgcgttgcttaactcagtgtcggtcatggccatgacagtggggatgatgggagtagcttatggagcagaaaggaagggacgggcagataccaaatcccgttcagccctcctctgctatgcctgctgccttctgtgggtgaagggtgctttgcatctctgggccttcatcccttttgtccctctactgaaatgtcctttccactcttctccaaaggcccaatcctgcctctccccacaaagcccagctcagaatgccccctgcccctcactcccaaatcctcccgtttctctcaatgaggttaattgtctacagtggctgtccctcagaaagatatgtctaagtcctaacctacactacctgtgcaggtgatctcatctggaaatagaatctttgctgacataattaaggttagaattttgagatgagatcatcctggatcagggtgggccccgaatccaatgatgggtgtctttaaaataaaaaaaggagaagattcacagaggagaagccgtgtgaggacagaggtagagactgaaatgatatgtctacaagccaaggagcacaggggatgccaggaccactggaagccaggagaaggcccggacacgttctcccttagagccttccaggggcacccacccagcggaaccattgactttggacttctagcctcagagctgtttgtggtaatatgttacagcgcccctggaaatgaatacactgccttttcctgaaccctcctattattctatcttattttctcttgagacccatcagttctgacactatgttttattttttcacacacacgtttgccttctaccagatcacaacccccagagggcaggatccagcttgactgccctcatgccacctctctcgaggattcctgaagggttggtactctggtaatgtctgcatggtactgcacgaggaagctggagcaccaatgagttaatgcccctgaagggacttgaccgactcagagggagctggagcacttccttggcctccatggcagcccctcccctccatggctgggtcagcctgattctggctcagccctgagacttctttgttgcttcaagtcttaggacgtcctcacccaacctccctggtagacttcagacagcactgggtgaggggcttatcctctttgcacccccgttgtcctcatcagcacttagagcccttgaggacttggtctccagccagatttcaggctcagtttgtcttatctatctgcttggccggtcccctagccccctgtccctacggcgaactctctgactgcagtgcagtgataccagccccttggcagtgggttgatttgcgtgcccacctgcccccaaccttatttatgtgttggagtccccagtacctcagattgtggccttacttggagataggatcgctacagaaggaatttggttaaagtgaggtctttagggtgggcaatccaggatgactgatatactcacaaaaactagaaatttgagcacaaatatgtatagagggaagaggatgtgaagacgcagggagaaatcagccatctaccagctgaggagagagtcctggaacaaactcttctctcacagcctcagaaggaaccaaccctgctgacaccttgatcttggacttccagcctccagaaccaggagatgtacatttctgccatttaacccacccagtctgtggtcccttgtaatggcagccctcgcaggcgaccactctagtagttctcaaaccatccaaacccttccctgggggcaggcgccatgctcagaggtttacctgaattatctcatttaattctcttaaaaacacagtatctgaagttcctttttatgaaaagaagcgttgtctatgctggttggcctgtgctgacattgtaaacgaacccatctgaatgaatcaaaaacagcagtcacaggattgcatgatatcccagagactacaacgggagggacagttcaaagggcatagccatgctcaggccagcgtgagtggagatgccagggcttcttgtggtcatctgatattagagggggtggaacttcccacattagtaagagaaagaattttttctaacttggaggaagccattctgcaaggagaaaatccatttgtgacgcccagtttgaaagactcttacctcacatgtgactaggacatctgtgtcagaaaggaagtgggtgacttattgtatatcaagtgctcagaagagtgacaggcgcatagcgagttctgggtaactgtggaccattattattattagtattctaaagtttctctgtcaagaaagagtgtcacaaacattaatgatggttcctaccttgtacactatgagctgatcctatgaagtttataggaccacagttatctactgcaaggataaaacagaagccatttttctagaatatttcagaaagtaaaagaagatgacacaaccccaaccatttcctgccaaagccctacatctgtggctacgaactttgcggagctggttttttattgtgatgctcagtgaacctctcagttcttacgtgtggctgcaagcttctctgctatcatttgggcctctgtaaggctgcagagtgagccttcttcatggcccctccttttgcaggtgtttatatctgctctccagtagaaagcccttctccacactttgccattaagcagtttgccagaacaatttgaagcaaatagggaggttgtgggagagttcccaagtcacccctcagagatggactgagatcagaaacttagtaattctaaccttatcaatcatcttggctgtgaagaccatcttcactggcctggatcttccttcccccaaccaaaacaaaaaaccagttagcagccagcacttgcatcacacacctgctaagtgcgagaaattctgtgttagttatttctatttaagctacctcattcttagttctctaaactatgtgtgacagcagctcatttattcttcctcaaaattctgtagtgcagataaagctacttccttaatggatgaggatactgaatgaaatttgcctgggtaaaatactcaggaaaagacagatttaggattccaatgttggtcttcttggcttcgggttctaggctatttccaaatcccctgaagcttctcagtttgggaatgcctgagtcagggagaccatttaggctggaaaggacacggttgatgaaatacactgagaaggttccacatatgaggtctctccagagatgtctggaattcctcagtcagaatctctgttttcggctaaggtgcatttacaaaggggcagcagaggctctcagtactgacctggggggcacacagccccctgttccagtgggtctctagatcagatggcaccaccagccaacggagggcacaggtgagtatggatgtcaggagaggatgaagaggcttcaagaagaggccggaagagctggaagagtcaatgcaacaggtattgtgggtgttattgggagccaggctctgggctgattgcaggctgtgggctggagggacgtggtctatgagggaggaaggtggagcacgtctacagcagtgtgtgggtcacgagtgtcaatgggaaagaacatagaaggcaaattcaagctatgtttctatgaccttcgtgtcccatattgaaggaacacatgctgaacttttggaagttttgttcctttgaagcaggtgacccaggcaacccttcccaaagcaaagaagaggtcattctcataatgctgtgtacatctcatcatcccggcatccctttgcccacagaagaaccctacgaactgtgaaggggaagcagggtgtgtaatagagaaataacaccccatttcaattctgttcttggtggaagcctagagttgctctgaaccttctcatgaaagatggagacagagcagctgtctttcgtgtgtccaatttcctacatgataaactgacttattgggttatgtggtcacaaatgtgctataaggaaaagaaatgccattgtttgtgtaatacaatctttagagggaaacaaaactaacagttagcttgagtccgggaattggtagtgaattactaaaattcaactgtttctcttcccttcatatctctgcacacaacacaattctttctttaaaaactaatctgtatgaaatacgagaaaaagcaaaaataggctatgaggccgtctggtaacaataatggaagtaaatggagatctaaatccttcctgcaaaacttctttttgtgagagctggaatctgtcaaggacccagactttgctaggatgactgtcttcagagccttctccctggcacattcctattttcaagggtgccgtgctttggcataatgtattcattgcaagtgacacgtcttggtcgagtgtctagaagacactgtcacgtgctctttgttgtaacagtcatgagttagtgaaaggaccggaggcttcctgaagatcttagctttgtaaacctgtaattgaaactgctggcactcacggaaactcggcgacacaagggtcagaagccagcatgaagaccagagaatttcctaaactgatagtgagatcctggtctttgtccccatcctgcctttcctctctgtcacaggtgacagcctgcacgccagatagatgcagcttctgttcgactctgtagctcttggaagacctggaaaaaagaaaatgagaatttcgctgattcttggattgactgtgaactgcaatggaaatgctccaagggaagccaggcaccagtgagacctgggcaacccccaattagacgcttggtccgtgtgtgtccctttctatccagatcggtccttgattagccttctcttcactttccagacagcatctgcaaaggaagacacaccacaaacatacctggatctgaaagtgtgaggcgcttgtgaaggaaccattaggtggccttggtgtgacaaagcgttccctggcacacatgacctgagctttctaccaggtcctgtctccaaggggagaaggaacctgtgttgagatatgggccagctaggtgacacggcttccttcacagagctgatgtctcagcatggctcccactcagcccctgtcaccggcaagagccaagtcgtggccaagtgttttgataataaaacagtaacaataaatgatagccactattttctccatgactttgttttgaaagcatcaaaagccagcaaaaagacattcccgctccccccaccttctcagctttgttgtaggtataaataaaaagtgtaatttaacagatcaaaagaaaagcagaaggccaggcagatcataggcacttaataatgaaaagaaaaatttacaaaaagctcagaatgtatcaggagtttgaaggttgaataaaaactcatgggtatgcaggggggttgagactttcctttttaacaaggacaaacttgtaagtttcccttccagtctcagcagccacgacaaggtaccataacaaaattattttaagtcagggaaagacaaattctgaacatgcaggaagaagagaagccctagaaagagtatatttcttgacttctggactctcctccagctctttttcctaggaaactcctagcttcaattcaacatgagaattgtggacagaaaacaactgtggctttggcagggattaagaagttgagtgggggtggccctcactgtcccttgatttaggaggggaaggcagctttattttcaagagcagatctgagctgaataagagaaatggaacaaacagagagggcaaaacaagagacgcataaatatcatttagcctcagcatgttttcaaaacatctcaaccctcccagaagcacatggtgatcctaacacatgacagtgaacttggacaataccagggcctcaagaggccttctggtggttggtggtgggggtgggggatgcaggaggagctgtggagggcggaggaagggttgaggtagggcatcgtagcagttctctccttctccaaagaccagcagaagggattctgttggctgtcttgaaaaagcccagttactctgtggggtaggctgaactgtcagtcctaaatatatatgtttctaacaacaattttctgcttgaaataataaataagaaatgaggttgcattttgttttcctctctcttatcacctccagggcacttcagattctttagactgccaagattaagggcaaatggccagtggtgacccctacttaggcgccaatgaagatgacacgcatttttctaatggatcatactactgtgtaacttcattctctttaaacatgtcacccacactgtgcaatcacagactgttctttggaagcaaacagaaatctaaatccttcctgcaaaacttctttttgtgagagctggaatccatcaaggacccagactttgctaggatgactgtcttcagagccttctccttggcacatttctgtttcccacggtgctgtgttttggcacaatgtacattttgcaagtgacacacctctccctcactgccaaaaagcagtaagtgaggccaggtgttctttaactcacactccagagatggccccatccttctaaattttgaaaattaaaaaaaatgttccctgatgctcaatacttgttctctcttcacccttctcctgcccttctctctctctccccccaaacctcccctctgtgttttctgatcttcgtgaaggatttttattttctcgagggatgcaacagcctgggttgttgcatgctcattcgtgttattcttctttttttactgtcaactaagtagattgtgtcatttattttgggtggctgtatagactataagccaaacacagaatttttgctttttctacgaacccagtagacagcaggacaaaaggacacttcaacccagtaagatgccatttttttttgtccttgtgaaggaaaatgaaaaggaataaattgttaatgtcttctcttttaggagataggatggagtgtcaccaagatagaagacaaaaacataagctgtgaaatgtgattataaagtagtgacatgagtgccagaaaccacggaggaaacgtctccttgttctggatccacacttcatacgtggtcattgaaacgtggcatcaaacgggaggaatgtgatgggccaggttaggggaagagcaccaagcagggcctttccctgggagatggcaccacgtgacatgcttcatacggaagcacatgggccctcagcgctggtatcttgcttcacctggggatggtgatgaaatgatgcagagctgactcaatacgatacagagctgactcaatacgatgtgtgggatcttccatcgtgaagcagctgggagcaccaggaggcaggttttcccgtgcttatggaaagcaccacattgttctgctggggacatgttcttttactccaaggagtagtggatgtgcaatgggctgtcctgcccgtagagatgtgtggggctggctgctgagaacagatggcaactggctggctctgatgcctcagaagaggtgaatgcattcggagaggccacagctgagagtccctcaaactggggagttattattctaaaagttggatttttagcaagattttaccaggtgaggctgattaaatgatggtggcaggggcggggagaaaaacaaataaaagtgagttgaagtcaacctctccagttaatggatgtgcgtctcctttacccagtgttcatgggtcagaaatctcactattccacttagtaacacacttctagaatttttggcttctgttttcctgaatttgagctcttctaggacattttgttttgcagtggaggaatacttccagcagggcaccaacggtggctccactgattgccgatcgagacttctatctgaccattcgggtctcctcacaccactgaaccgcacagaaaagaagggcaccactggctggggtggacatgcaaccaccaagaggaaatgtggttgttgccatacagtggggcaagggaggattctctggagcacaggggactctctgggctgtcccttagctcttccatgtctaataataaatgttaagggaaaactatagtaacaacgaaaatgcagggtcactgaccccttaggaatgaaggttccagtcactgtgtagagaaccctcacaagctgaagccatggccgaggacaaaggaaagagaatggccagtgcagaaagaagctgtacacatcaacgacagcctcatgatcagtcagagaaagggggaccaaagctactccgtgtactctcacattcgtcataagtgtgtgcatgagtgtgcttacatatgaacatattttgtcttctaccttctccctctctttacttctttgagcaactattgttggagattaatttacaattttgtctttaggtaacacgttatttgaattggctgtgactgaatttgaggaacaacgcgcccaccccagagatggacagtggcctgttttcaggagatggcagcattgatgactgggacattgtatctcctcattcaagggagagaatgggaatgcctccatttcttatgaaagaggccccacaacttgttaagttgaaacatggatgtcttgggagttccaaagctcacagaggggagtgtgtggaagcaaagcccagggcaggctgtgccgagtatggagctttggtttctcagtcccaaacctgccatcctccaccccgagatgctgggctgggacgttgcaaatcaatgcctgccttgctgcctggctccctgtgaggtcctgctgattgggccgctgcaggctggaggagggggaagggacttgctccttcctggtttgtcctagttctgctttctttcattcggttcccgtcagacacctgtccgtgtcttcaggttggcagtggcagtcccatccagtagcaggaattgagatcagttttcagttttttccaagattctcagaactggcctcatcacactctcttagggccgtgagtgcctgttgcccagcgtccctcccctcttcagaggtcagggactcagcctcacagggaccccgctctgatctctgggatcccaaccgggctgagcatcacttgattctcacgggttttgctctgcaaggctttcccccaaactgttaggaattccaacttcttccctttgttctcctagccgaggtgcgacggctgcttcccgcctttgctacatccacgatccctcactgtttccattttgccttttcatttctccaggtagttagcaattctatgcattacattctctctgtcagagtaaccagtttggtttctgcctcttgtctgcatttttaaactttgcttctttttttatctctcttcctcactcgtggaattggtcaaattttcttttacctgctttcagaattttcttttgcctccttttagaaggtaataacatacattctacttttactattttagaaatcatccactaattcttgattcttaatgcttactcgaccttatttttttttctaacaaaatctagagatggttaatatttctactctcttcttgaacaagtcaagaatggtttactttcttctgaagtcttctcttccatcttttatgacattgtcttttatatcagttctactatcttgattttttttttttttgagacaggtctcattctgtcacccaggctggagtgcagtggcacaatcaccacttgctgctaccttgacctcctgggcttgagtgattctcccacctcagcttcttgagtagctgggactacaggtgtgtgctgccatgcctggccaatttttatatttttttgtagagactgggtttcgccatgttgccaaggctgatcttgagctcctggccccaagcaatccacccgcctcagtctcccaaaatcctggcattacagatgtgagccactgtatctggcctccatcctgatttttaagcaatctctaactagctgtaattatgatctgtaccagtcaactatgtagactgatcagtgcatttgatttatttctttggttaccattgtctttttggatcctcatttttccctttggattcaacttccttcttgccagggtataaaataataattttttttcaccaagagtctgcgggcattcaactctcagttttcgttgtcagaaattgtctttatttagcttttaacttagaataataatttagctggaatttagatttctttgatgaaaactgtttttccctgagtatttaaaagatattattcatggctcctgctatctgttattgcttcttggaaatctactgtcaggttacttattattcattttagctctctgctttgttttcttattagataacatccaggttttttctctttacttttgatattctgcaggtttattaccatgtgccttggagcttttatttatactgttctggtttcagtctacttatacaatttgaaaagtgatgtttttcctctcttctggaaaagttttcagatattatcacttgaatattgcctctctaactttctattttatgcacttattctagaactctaattagacacatgttgacttttctcactgtacccttgtaacttttttttttttttctgtatttttggtacagatggactttcaccatattggccaggcttgtctctaactcctgacctggtgatctggcctccctcggccttccaaagtgctgggattacaggtgtgagtcaccacgcctggccacccttgtaactttcatatgttacattttatctttctgaactatattctagatgatttttcctagttctttatgctaattcactattctcttcaactattaaacccacctattgaggctttttgtataatttgttttttttttttggaggttaatctctccttttctctcccatgctcttcctttatgctatgtacatctttacattacatattttagatatatttaggatcttttcagattgttttatttttcttattttattttttgagacagagtctgctctggtttttgggctggagtgcagtggcaaaatcatggcttactgcagccttcacctcttgggctcaagggatcctcctgcctcagcctcctgaagttctgggattacagctgtgagccaccatgcctggctagattattttatttttagttcttgaaatgcaaatattcccatttattgtgtttgctatttgcccctgttggtagtccatttcctaatgtgatttagagtctgaattcatttttttaaaagggctattttctacaggagtctcccatactgctgttttatggaactattcctacagagctgtttctatttcccagaagcctccaggaaacctttcctggcacctcattggccagagtggagtcacatgtttttctcaggccagttgattgtaagggggagggaattacccttagatcaatcaagtccaccctaatcaagctgagggtgtttcaatcttcccctcagaaacaggctgagagggagggtggacacctgaaccaaatcagggttctgtgagggagaaatgtacatttgaaacttcagcactcctagagatgttccaatttgcaaagaatcactagttaactatccagtagacaaaatctccaagggatatggaaggggaagggagagacagagagtaaaaatggaaacaaatacagtaagggcaattttttgatgagacatattctggtggagtagcatttatatgttctctagaagtgactcacgtttttctgaaaggcgactttggcttttgttgttggatgtggagtagcactgtacataccactctgtttttcttttgtctttttttcccttctatttacaggaaaataaaaacaaaagcaatccaatgaagaaaatgtaaacaaaatgatctctaaatttcggatatggcaagacaaaaatttagtataagaacagtttgaattaatctgtgagtacactgtgatcctttgatgagttcaaagtaatttgtagaaagttagttatattttcagtattgacgcagagctatgctttactctgcttacacaacatagtagttaagtaacatgatagggaacacagtgtctgactgtgggtctatctgggtctaacactatcaccagccacacaattttggcaacatctcttctgtgatttgacaagctaagttcctatagcagcaacaaaagcctcaggggtgctgccaatgctctatgaagttttgctaagattagtccacttccttttgtcgtgtcaatatttgatgagcatccactatgtgtcaggcactgtgctgtgtcaaagacgtgacagggaatcaacaaagtcgctgccttcattggagcttattgaggaccaaatctctgaggagatgagaatattgtaacagactttatacatatttaaatctatggacatttcaattcttcattatttatgggcatacttgccaccttgttgaaaagtaaaggtattattgatcctagtaataggtgctaaaatacccaacatttagcattctagatatatctagcctctccatttgtttgtgtgactttgtccagccattcactccttcattttctcaagagacgttagatcttagatggcagaaagacttctcggcaaaggtgacaattaggctgaaacctgacgatgcgggggaggaatggtggtattggtggaagtgagggtagaggttggctgaggcaagaagaatgtttccagagaaaggaaaagagcagcacatgtaaagaacctcagctgggaaagagcttatgaggataaggaacgactatttccttctcgcattaaagccatcagctaccccaaaccgtatgtcccttgctccctctggcattcccatcttagacccgggaacagtggttttctccttcctatctcctttgctttttccccttgcatcctttcgtgtgtcatcctcacctcaccccttttctatgttcttatcatttcatccttgaactttaagtctgcttgacgttttgttgttttctggtcataatgttattgtgtaacctttgaaatcttttgagtctatgaacatgctttgaatcctgctggcttttctgtaatgcaactttcaaacgccataatgtaaacttggaacaatttcatatataagccctgtgaaagaatccccatttgtccatcatgtttgcaaggggggttttacacatgtctctttgaattccagccccaatctgtcaaggaggtgttctcatgaggaaaccaaggctccaagaaggactttgttaaaatctaaaaactaataaacaatggaggtcagccagacccaggtcttcggactccaaatctagtgttcttcccaaatcacttctttgcctttttcacaaatgatatcattgccctaaatacagactgcagatttaacttaaataattacaggatctcttacacacagcttatgttgagtaggattcagaggctcaattgatttttggagattggagctgtatttagatcaattatccttttagatggcatggacagaacagattatgcaactcagttttatctcccacccctagtccacccagtagaactaggattacttgtatttgctcagacaacttttcgtttagttgattctctatatttgctagatcaggagttgacaaactttttctgtaaaggactacatagtaaatattttgggcttgcacaacctctcgactcttccactctagcacaaaagtggacatagacaatgtgtaaacaaacttacaaaaaacacatggctggtgggatttgtcctctgggctgtagtttgctgaactttgtttaagataaatgatccagataagtgataaagattgtcttatctttattcctcatatcagttaggatttgtttcaactctgaataacagatcctccagataatagtggcctaaacaagatagatgtttatttctgtctcataaaatgcccagagatgagcagtctcaggctagtatggcatctctgttctgggaagtcctcatagtccgtccaactcaccactctcccatccagagtgtggcctcatccttagatctgagatggcagtatccagcttcaggcagcaggatggaagaaaagccaatgaagcttttcttccatcgaaagaagtgacccttcgggaaaatcccagaacctgtcacatgatacttcctctttcatcctgttggtcaggctcagtcacatggctactggcctaactgcaagagactctgggaaatgtggttcttactctggatggtcatttgcctggctcagaattgttactgtgaaagaaagggaaaatggatattgggaggttcctgacacacatgcttcttaattctttcattaactgaatttcagtagaaaattcagtaactaaattttatttttgttattgctaatatgatattaactaatgagcactcttttcttgtttaataggaatgatgctaatgtttcacttttaagtatgaaatatttaaacagattatgcatattatctactatattaagtatagtagatttctgtcagagatcctttgtcaatttaaggaagttttcttctaattttagcttgttaactactttttaatcagaagagaataagccataaaatcttctgataaggcaggcctggctatcccaccctctttatagttcacaagaataaccttaacaccatctgaatggaaacacataggattcccgtggaggtgagccaggtctcctcgattctccagggccatctggtcatgctgtcagtgaattagtctcagggatgctgatatccagcctggggaaagacaaagctgcctttatatagaatcacttctttggctctctgcaaacagagaccctgctctgtcagacttaattggggttggtgtatcatgatgatttcctatcttcctttgtgataaatatgtaaactataaaatgtccccctggggtgcagagctgtcacagactctcggtttatatggtctgtctcagaagatgggagagtttattgcttgctatgggcataaaagcacaccccatactccttgttgaaattggagtcttccagcccctgcagacacacacccaaatgttcttacctgccatgcctaaggactccctaaacccaggcagagaaccttttggaaaccctctatgaaacagtagcttcctcgctgacttagtcaactttctatgcctctggattcgaactggatccatttcacctgccttctccagtctactttgaaggggtgtagattttctttttgtttagtttagtttagttttgttttgtttctgacccacagcgcctacttgccacttcctaaaggaactgctgttctgggtctgggcttgttgccaggcccttcctgggtgatgggagtcctgctctgtcaccccagctctgtcctgtggggctgcttgcatccaagtgcaatactctctctgctctgtttgtgcctagcataaggcacatatcgcctgcaattcaagctttaagagcccgggaatgttttactacgtctcttctctcttcaacagagcctgttccatcagccggggtcctgggatgaaggtaacgtggagcagagttgcagctgatccacgatgtgttagcgcaagcaagaaataaacttttgtgatcctaagccacgggggtttttaagttgtttgttagagcatgacctatcctatcctgactgctgtacaaaattaagcaatttctgtttggcaggatttcccagaccctccggaaggctgctgtgctgtgtcaatctttaaaatgggaatgaggtatatcatttttcccagtcttaatgcccaagactttcttaatgaaatcatctactgggacttgaactgctgttccaaagaagttaatgggataaatggctacgtgtgttctgtgcatgagtcatcttcttccaatgagattgaaagcccctcagtggagtagcatagcatccaacacagagttcaattcaacaaacttgttgataaaaaaatctcatcctttcctgccacctccatgccccaccccatgctgaaagatttatttgtaatacctgtttcttgcttcgtgaaccaagttaagcagtcagtgcatcctgctcatgtcatatgaggccctgtctcgcccatggaactaccactgacttctttttatttacttatttttgagacagagtcttgctctgtcacccaggctggaggacagtggtgtgatcttggctcactgcaacctccacctcctgcgttcaagtgatctttccacctcagcctcccgagtaactgggactacaggtgtgcaccaccacacctggctaatttttttgtatttttagtagagagatggtttcaccatgttggctagctggtctcgaattcccgacctcaagtgatctgcctacctcggcctcccaaagtgttgggattacaggcgtgagtcaccatgtctggccactactactgacttctacaagtgctcccttctggggcagcgcctgggaggcaaagagctgtgtgagaagcttatttccagaagaggtgatgaaggtaaatcaataagattccgatgctgtaaactggtcaagtgtcactctgcagcagacatgcagtattaaaggctttgctaaaaagaaacctttgccacgtctgcagctattagaaaactttttgaatgtcttcaaagtaggatcgcgacaatagtttcttaaaaggtgtggttgttggggagaaaagagaggctgccatgaagtccttttcttctcaaaagcaattgcaggagagatccctgtgttcagaagagaagggaaggtgtggatgggaaacgctttggtctgcagttgatgttaatcgaggctcttctggaaccagtcagaagctgccagtgcctgtgatttccccagccctcagtgctgcgagcgaggcggcccgtgagtaatagcagcgcagcccactctgcagtatgtgggaggacaataaaggtcaaaccacagagtgggcttccagctgccagcacggtggcctctgtcctttcactgcgagggggcttgggaggctcggggaggaaagggaaggctgggtgttaacgtgaggtcctgtcatggtttccgtggtaaaccatgggttttccaggtcttcagattccaggcccaccgccctgtggttgccatctgccagcccctctggaccagatcaagtgaagtctctctcccagtacccttctagtgaggaagcagacatctggctccttatcattgaagagagaaagcacttatgaaattggattttgatttgtgagagattcaggaacaacagaataataaaactagagatcagtggatccaggcgctttttaaaaaagtcggcattctggggcactttcattgtgcctggtactgtgataaagatttttcaataactattttgttttgttttgttttttgagacgagttctcactctgtctcccaggctggagtgcagtagtgcaatcatggctcactgcagcatcgaactcctgggctcaagcaatcctcctgcctcagcctcctgagtagctgggactagaggactgagctaccaggcctcgctatttttttttcttttgtagatacagggttttgctgtgttgaccaggctggttttaaactcctgggctcaagcaatcctcctgccttgacctcccaaagtgctgggattacaggtgtgaaccaccacactcagcctaataactgtcttttctaatctccctgtcaccactatgctgtggtactattactatccacattttacagaggacgaaactggcatctagaagcttaagacccccatagacagctgggaccaaattcaagttcagctaaatcaccagcctgctctctatcatgctgctgccctgtatggccattttggaaatttctggctaaaatagctactggatagaaatgaactactactattggttcagcatttcttcatttatccagcgaacttctgttgagaccctgctggtgagggcccaaggtggataaggtttgccccatctggaagtcacctgggctggctcaattagagggaggcaatgccaaaggcagtgggaaccttgaggaaggaacaactcactctacctgcggcagctggagtggacttccatgacatggtgacattgacgctgaagtgggctatcccaaagaggagaaaaaggggcaagagacttggagaagactcagcaaggtgacccaggaatgggaggcgtggggagtttgggaaactccaagtatttccctgcacaatgggaggagagggaggaagtaggagagagtaaaccttcttagtgccacactagctggaggggcttcataagaaggcaggtgatgttactgatgttttattgagatgatgtttgccattgaggattggaagagatgggagtgaggtgaggcgggtgctagatgagatcagtcttgaagccactactcctctgtggtggcatgaaggatgaaatgggctgagcaggtaaggagacaggtgcaatagtcagatgcgagatgatgagggcctgggatgaggcagaggggatgggttagaatgacatggtcttggtcattgaatggatttgggcaaaggaagaaaaggagaacattttggcttctgcctcgccccattgtctcaatctcatgctaaaggggactctctgtcttgacttagtgggtgcatacttgaaaatggagtttcaggctgggcgtggtggctcatgcctgtaattccagcactttgggaggccaaggcagatggcttacttgaggtaaggagtttgagaccagcctggccaacatggtgaaaacctgtctctactaaaaatacaaaaattagctgggtgtggtggtgggtgcctgtgctctcagctactcaggagactgaggcaggagaatcgcttgaacctgggaggcagaggttgtggtgagccaaggttgcgccactgcactttagcaaaaaaaaaaaaaaaaaaggatttcagggtggctattacctaagtaaaggtggatgggtttttaagttcctctgtttcatttgttcacttctattattcatgtctctagcatgaatctgcaagcagaaccagtcccagtggaaactgtggtggaggaggttcgaaatgacagggggtacattatgtaaagctgctgtcctttttttgtctcccggccgctcccagccttgcactgggtctctccctggttacagagtacagcattccagagaagaacagtttggcagaaaataaaaacatttggcatatagtaaaaataaacagagatctgcaatgaggaaatcttaaccctgaacaattcatggagaaaatatcttctgggatatttgaaccatcaagagttgggataatttaacatatgggctataaaatgaggaagaaggagacaaatttaaatgcttcctttaattagaatatcttggtgaaattgggttatagcctcctgggaccaattgttttattttataacttttccttaaattttgttttgcattttttttcactatatcaagaaagcctagaccaaataaactactgaaacatctgggctcagaactatgaggcccccacatagctgtctaaagcacaagaaaatccaggttcaaatcccaacttcactgcatactcatgctgtgacttgaggcaaggggataacccacgcatcagcgtttcgatcctcaagctaagaataaaaacaccaaggataggttggtctgaggaccaaattatagaaataatatgaaaatgttagtctactacctggtccacaggcaacacagaataaaatgttagctctttattatatcatttaattcaaagagaccaaagtcacgtgtagtggcatttgggcatagcagcaggcacacaggaagtctcatggcccagcagaattgccttacttagcttctctctagagacagaggtgtggggcagccttcattgtgattaatgaaacagaggttggccaaggtctatgacagcacaggtcttccagtcagaagtgaactccaggcaggggtccattctagctcttgtgttgacagcacaatgtaagagacacttagtctgtaagaaacttgaaatagcccataaccttcctcacatcctccacctcctaccaagctctggggctgtcccactttgtgcacagactggaagttgtgctttgttgacactggggtaacgtaactgtgcacatctgctaatgggcaaggtggcctggcagaggaacggtctcaggggcttccccttctgcagaaaggactgtggagctcacaccctgagtttagagaaatgaccagtccctttctttctttctgtctgtgctctatgggttaatctaacaatacccatcaaaaggaaggaagagccacgagggtctttttgttttatttttagcagagccctccttcctgtctggtcttccccagtccctcacttaggtcccacactctgtggtgaggcagtcatgctaatctgccttacaaccaactttccatcatccttacaattaggagttactgtaaaaaatagatctggaacaagggaatatacatccttaaaaaaaaaaaacaaaaaaaaaaaaacaaaaaaaacaaaaaaaaaaacaaaccaaaaaacaaggccaggcatggtggctcacgcctgtaatcccagcactttgggaggccaaggcgggtgcgggtggatcacgaggttaggagattgagaccatcctggctaacatggtgaaacccctctctactaaaaatacaaaaaatgtagccgggcttggtggcaggcgcctgtagtcccagctgctggggtggctgaggcaggtgaatggcatgaacccggtaggtggaacttgcagtgagctgagattgcgccactgcactccagcctgggtgacacagcgagagtccattaaaaaaaaaaaaaaaaaaaaacacaaaaaaaacccagaaaaagaacttataggaatttagaagtaattacaagtaattacatcctcacactatcctgaaaattcagtccatttcagtttttaaatcaacatttaaggaaaataactaatatttgttgagcatcaaggacttgacccattaacatcaaatctttagtaatgctctataagtgagctctattttccgtatttcataggtgaggaaatgcgtggccaagcttaacagagctccaaaataaaaagacaggcatttgaaaccatctgtgtccaaagctcacactcattcccaaactctgcctggctcatcactaaacctaacagcctcagctaagtgagataatccagtaccccttggtcagaagtttcatctcccaagaaaaagcagataaagcaaattgctttttaaaaaaatttccatatgtatttggggaacaggaggtgttgggttacaagaataagttctttagcagtgatttgtgagattttggtgcacccatcaccagagcagtatacactgtacccaatttgtactcttttatccctcatcccccatccccctccacactttcccccaagtccccaaagtccattgtatcatcttatgcctttgcatcctcatagcttagctcccacttatgagtgagagcataaaatgtttggttttccattcctgagttacttcacttagaataatggtctccaattccctccaggttgaatggaaacaatgataaataggtgagacttaattaaactaaaaagtttctgcagagcaaaagaaacaattagcagagtaaacagacaaccggcagagtgggagaaaactcttcacagtctatacatcagacaaaggactaatatccagaatctacaaggaactcaaacaaattagccagaaaaaaacccaaacaatcccatcaaaaaatgggctaaggacacgaatagacaattccaaaataagatatgcaaatggccaacaaacacatgacaaaatgttcaacatcactaatgatcagggaaatgcaaatcaaaaccacaatgctataccaccttactcctgcaagaatggccataatcaaaaaatcagaaaataattgatattggtggggatgcggtgaaaagggaacacttttacactgctggttggaatataaacgagtacaaccactatagaaaacagtgcagagattccttaaagaactaaaagtagaactaccatttggtccagcaatctcactactggatatctatccagaggaaaagaagtcattatgcaaattacttttaataatgagctcgtctctcagagcagggctggaaatacatggcctttctgcaggtgttgacataccacagaatcacagtggaaaatgatagaaaacaaaacatcttacttctacttaactagtcatatgctttattaaaaaaaggatttttgagattataacgaatattaaacaataaacttgggccaggcgcagtggctcatgcctgtaatcccagcactttgggaggctgaggcgggtggatcacctgaggtcaggagtttgagatcagccagaccgacatgataaaaccccatctctactaaatacaaagaattagctgggcgtggtggtgcatacctgtaatcccagctacttgggaggctgaggcaggagaattgcttgaacctgggaggtggagattgcagtgagctgagaatgcgccattgcactccagcctgggcaacaagagcaaaatttcatctcaaaagagtaaaataaaataaataaaatggaaaaaaataggatttttagtaaaggaaatttcgtttagatttattacaactaacatgaatataacattttatttctctgaaaataataaaattggaatctgctgatagactgatagaaaatgtatgcatgtacatacatttctatatctgaaaatataatccgtgatgatgcaaaacattgctaggtaacttagtgactagatagaggactacatattcagcttgctgaaccatataatgtgggctagttgttagctctgtcttcatgctgattttcctaaatggtatttaaagaacacttgagatttttaaaattccttctccttgctcttgctgtagctaggtacatatttgttttatatgttttctttttaggaggaggctaatttttaaaaatacagaaaacaatacaaataacaaaaaagcaataattcataaagccactacccactggtatctgttttaatgtctatggctttatattttattttggtaaatgatagcatctgtcttctttctttgttgatcttcacacagttgccttggctttttggcacatttaagaatttaataatcaattatgttttaaaaaaatcccttgatgattttgattgatatagcagttatacagtaatttgagaagaaattgagtcttgccatccatgaatgtggtatagctcttcactattcaagtcatctctcatttcatatttaattaaaactttctctataaaggtcttgaagatttttcttagatttattcctattttgaattttttgcaattgcaaactagatcttatttttacattttaaaacttttgttatttccaatttttaaattaaaaaagtttctacttgtttggatatattttaattctgcttttctctattttttttttttttgagacggagtcttgctctgtcacccaggctgcagtgcaatggtgcaatcttggctcactgcaagctccacctccggggttcatgccattctcctgcctcagcctcccaagtagctgggactacagactcccaccaccacgcccggcttatttatttatttatttatttatttatttatttatttagtagagacagggtttcgccgtgctagccaggatggtctcgatctcctgacctcgtgatccactcccctcagcctcccaaaatgctgagattacaggtgtgagccaccgtgcccagcctgcttttctctatttttaaatttagtgattgatttatgtattaatctctcttgttttgtaataattgcatataaagtgtataatattttataacctgggctagttttgaagttttatatttaatagcaaaacaagagattccattttaaatagtaaatttactttaataacatgattaaaagttttgccataattgtatttaaaggttttgaaaaccaagataaagtttgtgcatgcaagtatctgtagctgaaaaaaaattaaggtagtggttttacaaaccagggtggtatgtatcacttgtgcaatgacatcagtacatgagaatcttttttgtttctatgaaagtactgatgttgcatcatctacttattaagtaattgttctttttttttaaaatctatttttgggttaaaacaagattgccatctttccttggatggtttttcacattgaattactgtttcatcatccgttagcctattgtggatttgatttggaataagcaactgatcaatagaagaagacaaatgcttatatttcactgcaattttaagaaatattgcccacgttgttatcattttgctataatagaacattaaaatgttaaaaattttaaatgtaaaaaactcttctcatcaatcttaattgtacttatttttgttataaatggttacttaatgaatagatactaaaaattttaagtcaatttaaattgattttattactttttcatccactgcatacaaaatttgttacaatactttgaaaacagtttttgaagtaattgaaatttattcctgtcttacacatgtcaatggagtagatttttaggttcaaataaaaattctgaagacttagactcaatatttgtagagggaagaatctttggaattccatgaatttaaaaaatcttcaaaatatatttaaacatattcaatatataacagaaaaattccatgaacaaaatctcaaaccattttttatttataaaagttatacttttgttcaatgtagacaatttgaaaacacaaaaaaagaaaaaaagcaaacttttgggtaattaatgagaattttgaaaagattttgagaataacttctctgtttgtgggtataaactttaaaatttatgattccacccttggcctagagtgtgaggtccagcatgggccagattcctcttaggctgatcctagcatgctccttcctctggtcttttttccatccatgtttgaccctaatgtgcctttcctggccttcatgagttttcgcctggtccctgtcgagctgtcctgcataagagcttgcattctggggccggtctacttggggttaagtgtcagtttctccacttaaccttagtgggacattgggcaagtcttctaacctctgctggtaccctcatctgtaagatgattgtaagaatagcagtgtgtatttaactgctatttaactaaataatggctgtatttaactcgccatttgacaagtctgggcgatacgatgtttgtgcacacgaggcaagcaaagacctgacacatccttgtgaggctaggtttgccctcttgcatttcagttgtcattagaaacacatgccctgagtatccatcctgctggtcctagaagaataacagacactagagaatgcctgaacttaacctgtgttgggcacccaagcccaccgggtccagcggaatgctagacaacctggagatgcctgaataagatgcaaatgcttgttttcatgagctactgtgttttgagatggtttattctgtgtcatttttgtgacactagccaattaaaacagtacctgctgcatagaggtattataaaggtaattaggcactgtgtctaaagtacttcagagcttatcacaaagtcacagcttagtgagtgttgggtttttgagctcagtttccaaaccgctgtgtcatgtcctgcctccctaactgtttcctcccagtgggctgatttttccaccttgggactcttttgtgaaaggcacacaacgcagctatggtggcaatgcacctggcctgattcctgggaccagcctctcctcacatgcagccccagagtcagagggcagatgcctgtggatgagattctttatggatacaatcatttcatagtttcagatagttaaagtgagaacactactcatatcagaaacacttagaaagattctagaaataattttctttctaccatttttttcccttgccagtattcacctgagcagtgaagataatctctggttctagagaacccagaaataaagccacatgtttacaactaagttatcttcaacaaaactgacaagaactttcattggggaaaggacacccttttcaataaatggtgctgggagaattggatatccacatgccgaagaatgaaactggacctgtatctctcaccatataaaaaaaatcaactcaaaatggattaaaaccaaccgaagaccccaaactgtaaaaatactagaagaaaacttagggaaaactctcctggagattggtctaggagaataatttatgactaagacctcaaaagcacaggcaacaaaaacaaaaatagacaaatgggacttaactaaactaaaaagcttctacacagcaaaagaaataatcaacagagtaaagagacaatcagttgaatgagaaaaaaatatttgcaaactattcttctgacaggggactaatatccagaatatacaaggaattcaaacaactcgacaggaagaatcaaataatcccattaaaaagggggcaaaggacatgtatagatatttctcacaagaaggtatacaaatggccaaagatatatgaaaaaaatgctcaacattgctaatcatcagagaaatgcaaatcaaaacaatgagatatcattttaccccagttagaatggctgttattaaaaagaaaaaataagagatgttggcaaggatgtgaagaaaaggaaactcttatacactgttggtgggaatgtaaactagtacagccattatggaaaacagtatggacatctctcaaaaaactgaaaatagaattactattctatccagcaattccacaactgggtttttagccaaaggaaaagaaatcaatatataaagggatccttgcactcctatgtctattacagcactatttacaagacaatgatatggaatcaactaagtgcccatcaacagaagaatggataaagaaaatgtggtatatatacacagtggaaccctattcagccagaaagaagaatgaaatcaagtcatttgcagcaatgtacctggaactggaggtcattattgtaagtgaaataagccaagcataaaaagacaaatatctcatgttctcccacttagatgtgagagctgaaatatctgatcacatggtggtagaaagtggaaagagagaacagagatgggaagggtgattggggtaaaggggtgaggatgaagagaactgggttaaagaacacacatacaattagatagaaataaattcaatttgtaaaaaataatttaaaaaattagagatgggatctcgctgagttgtctaggctggccttaaactcctgggcacaagcaatcctcccaccctggcctcccaaagtgttgggattataggcttgagccaccgtactgggcctaaattcattgtttggtagcagagcaggatgagtatggttaaacaaaaatgtattgtacgtgggtgatggatatcctaaataccctgacttgatcagtatacattatatacatgtaacaaaatttcacatgtaccccatacatttgtacaaataagaaaaaaatattttaaatgtaatctactgttcctgtggatggaggtgactttttccatgaagccaacaatctcaagaaaaaaattgttaaataatatgtaaaatgaaagttaacatcagctttctacttccttaagatgtcaaaaataagccagaat

SEQ ID NO: 360 - DNA, 335218 bp, Homo sapiens
cattcagaataacttttttctttgtcaccacgttggcttaattagacaggaattggtcctactttgattttgtaaatgaggaatttaagaagcagcagtaataataattactgcaatattttcagcctttctaggttgtaaattctcagcactgtcgttatttgcattcagccctcacctaaggttttctcagatgcctgtggtttagatacccccacagtagggataccttccattaaacttaactcacatgtaaagcctttccaactttagatgagtagtgaaaagctgcctttagcctgtcattgaagtaccttctactaccagggcaagcttttaagtgagggtcttgataagagcattcctctgagatgatcactctaagacttggagtaggaaaggaaatgaaatcccaagttgccttatccacctcctacccctcctcttggttcatcatagtagacttctatctcccccaatttttttacacacatgaacagggtctgtaaacataagttgtcgcctcctacattcctttgacaatcaccatttcctctaggaaaaactcttcctgctccacccaggtagggttaggtgagcctcctctataccctaacagcagcctgcatgtatttctattatgtcatttgttaaactaccatgagtttgttttttataaattataagaagcttttcattaatatcgataaatgtgcatatattatgggctttatacctttgatgataccatgttcttctattatgtggtggtttagagattcataaaattcattcttacctatttaaatttgtcaagaaatgtgcccttggttgacggtaggtaaagaggttgcaaacttggtatcagtaaggcataaaatctggtttgttctgaccgctgtattatatttctgctgttgaataacaaattatgcaaacaaggcaaacttgaaacgatagccacttattattgcacacaattccaggtaagcttagctaattcttcactcagagtctcacactcaagatatcagccagctgccattcccatctgagtcttggggacttcttccaagctcattggttgttggcagaattcattttcttcttaccctttccatgtgggttctccatcttcaagccagcaatggtagtttgaattattcttatgcttcaaatctctctgactccctcgtctgctgccagccagagaaaaatctctgcttttaaaagcatgattagttttgcctacctggacaatttccctttcaccctaatatgggcataatatcaagttcaggggccttggaagtcatcttaaaattacgccttttacaaccatgactctggcacttttgatcaaatatttctgcattcttcatctttttgtctataacaaggatatgattttctaccagggatgtttagaattgagaaatgcaagctgaagtggtcctgaagtagtcagagaatcactgaaccaaatggaatcaatcccacagtcttgacttcagaggaaagtgtatgctgaccaaatgagcaaaccagtcatctctactgggaaagtaataatagaggtggccctgatttcagaagcagagtgagatgccaatgactccactaaaatatttcattgtcccaataaagtaaggttgtgaccaccatctgagtcgctgctgtcaaagcacaacttcagttatactgtgcagactagaatttctgagcccaatattattaagctgattttctgattataatggagtccaatttcagctatttctctgtgcacttcctatttttataaaattatatcaatcataatcactgtgataatattgtcagtgctgtctaacttacatatttagcttataagttaacaaaatctttaacaaaccagccacaaaagttagctttatgaaccagacttatagagaatataaagggacatgaaacccataggaaaaggaaattcatctcctaaatagtcacgattatttaggcaagatttattccttttcagtaaaccccttgaaagaggagactatctgtgtcttaccattttgcccccaacaaactgcctaatttcatatctagaacatagtaggtgctcaagaaatacttgctgaataatgaatgaacatttgttaggaaactttagtaggaaggattttaatagtaaaaccgtgaaactaatctaagtgtctaaaactagagaacgatttaataatgttttaacagcctccaaaattatgttgaggaagaataagatatatcataacataaaaattgtgatacagattatagatgaaaaatttaggttactaacaagaatgtataaaatattccattaattatatatacatatatacacatattttactattttatatattaaaagatatacagcattatactatgttggttatctctggggatcagattacaggttgtttttacttgcttccttgagatttttttctgtaatatctgaattttattcctttctttccaaatttggggaaaaaaataaggtttctgaaaattaaaaaaaatagataatatatcaagtttggactgcaaaccagagctttcagcagaacatagttgagtctttgccatagacaccaactcatttccttcctttctgtggcattcattccactatcatgcattttttcccaaatgagatgacaaaatggaaagaccatttctacaccaagcattgagccataggaaagcggaatgtcagtcagggcatctgcagatcaggaaatcatgtcacagaaaacaggacctgtataagatctaagtttatgccatttgctgatcagttaccatatttcaaaaattatacacactgtaatcccctctctctgttctgcgggccctttgaagaagaaggcatttttagcaaatgtcctttaaatggagaaaagaggcagatcaatttactccaaactacttcagattagatcttagtcagaatgcctccccagagtggaagctcttctccagaagtacctttcctgttggattcaggttcagggttggaacccacagacccagaatgataggctatcagcaaagaaaagcatgtcattagcatccagcagccctcagtttgtccttgtctccttcatcttccttcaaacttctatttttctcttagatttccctgaaactcttttaaaaattccttttgaaacaagtgggtgcctgactcattgcctatttcctctgttttccacccaagtggtaaacaatgggctctattcaaatatggaccgtctgtgagctgggaacctgcgtgcagacaaagctccttgtcccagggcagactgccagacccatgctctcctccactcacctcctaggctgtttaataagggccacttggcaaaaggcaacatattgtcatggtcctgtgaccttgtagttctctgtctcttttcccttcagcccgaaagaatatttctctaaattctcaagtcaacgcatttgagaacagcctttcaaaagatacttgtaggaataacagaaggtagttcaggacccagtcaaaaggactatctggctttatttacaataattttaatgcctctgtcctaactcctccaaagttattaatattttgtctgtagatggtggttgccaggaaagagaatcttgcaaagtcaagggcatgacaaagctgagaaatagagaaggctagcctaagactttgggaagagaaaggtgaaggaaaaaaatagtaggaatcagactatggaacaagaagaacgggacaaagtttcaagtccaaagtgagcaggtaagacaaaaataactgaacttaaatgacagagtagtcttcagggaaaaaaagagagagagagaagagactagagaacacatttgcttcaagtgcttgaggaaagcacacctccagtgtgtagaggaatcacaggaggagattttgcatatggtgtccaaactcccttcccaagaatttatgtttcctgaagaacactgccaacttcccccctccatcttaaaatggtaagaaagagagttaaagagaaggtaagggaaacaaataaataattacgataatccagttatattagatatgtgtgcattttaaaataacttcaacaaccatatgaaattgtggctcttgttcctgttttttttacagatgagaaaattgtagcttatggagtttaaataatttgctcacagtcacagaattagcgctagaatttaaaatcaagtggtatgactaaaaaaccatgagaaaattcattccttcttttacaaaacaagtcactctctactgacaatcaaacccaagtcctctagattctccataatattatttacatctatcctcttctatccagccctactgtccctccctcatagcttactaagttttccccaaaagcctcctgacctcccttctctgtgtccccccattcttttcctttcttctttccttttccttcctctctcaacatgtatctcatcaattccaacctgcttaaaacccttcagtgacttcccactgacctaagattaagtcattgctctcaaatatggcactgcttacccattgttctgcatattatattctctctccatcactttctatgttccaaccacattggacttctttaatatcctcaaaactacaagtcgtataccagggaagggcttttacacaggctgtttattcactgtggaacactccctcctcctcttctcttagctcagccattcgcaaacttttggggctcggcccctttgtgctctcaaatcttctgaagaaccccaaagaccttttcattttaaaaaaggtagattatatcattatatcatgttgcaaattagaaccaattcttttttaaatatttaattcattttaaaacaacatagtaaactgattataccttaacataaataacattttatgaaaacatagccacgttttccaaaaccaaaaatacatgagtgagactagtagtgctgttatgcattttttgcaaatcttaccaatatctggcttactaaaggataaatggattctcatgtctgcttctgcattcaatctgttgtgaaatctatgttatgcagcttctgtaaaactccattgtacacttgtaatgcaataagaatgaaaaggcaaatgacttcttagtattataggaaaacagtcttaactcctccctaaaagtgtcttaggcagagacatccaggaaacccaaggtatacattaggaactcttaattatccttaatatcttgtcttaaagttaaaatttgcaaagatgtctttcctgacctcaaagaataggtctgagtcctcttgttatatgtttctataacattcttacctctctgtcaaaacactcaccgtacctataatttattcaataatttgcataaggacagggaccataccaactttgttcatagtgagtctccagtgctcagcacacagcaaggactcagaaaatctttgtgggaggaagcaggaaatagaagggggagagcaaggaagtaaggcctcagactcaatgacacagctccctgacaatcgctccattccttcagcaggatgtacacagagatataactttctacagcatccactgcagctctgggctccatttccctttgaaatgggatgggagaaaggggcaggtaacagactggagtgaggagactgaggagaaactgtagagaataatacttaggagtacacgtgctggattctctcattaaggtaatcattcaatatttactaagcagctacaatttgccaggcattcttctgggcacttgggacacatcagtgaacaaaatagagaaaagtttctggcctcaagcgatttacaggcagacctgaactcaaccacacatccctccacttgagttggcctggattgtttgtttaatcttcttgtgccttatttctctcatcagtaaaatgtgaacaagccttgagagtttccaggtgagaactaaatgaaagaatatctttaatgtacccaatagaatcaggcacctggtaggtgcctaataaatggaaatctttctgctggcaactcttattccaaaattgatttttttttcatgtacagaaactattcgatagattagaatccagtcactcacaggatatcacttgggtagttgtcggggagggggagtggtgtatttagggtcttctcaggattcggggggctggctgcagtgtcattttcctatagagaagcatcacctctggcttcctctcttcttcacaagccacctggatatgtttacattgaactatgcaaggtactattgtagtcttaagctatgcagtatttcaaaacagactttcctgaggactcttacaaaaataattatgccacgagtgtcagactatttgaaagaagatattcatagccaactgtttgtaagggaccacctccttacatgggtttattgtgtatcatagggttgctggggttttccaacttcaccctctgagtgtgggttggcctttctgagaaagctacactgcctttgaagtaggactaccaggagagaggggggaaaaaaaagtgtagggctctttgacttttcatttccctttctatctacttactctttgtgccttctccagttagtaccacactagagaagtgttaggtagaggaagaggaagaaagaaaaaaggacaatcttatcagttgattttgctatgtgttaccagtctggtaaaaacatttgaagttagaaagtattcaaacatgaataaagtttgggaattacttgtatggatttaatttcctcagaataccctcattgttccttcgcaggaaatattcatgagtcaactatccagaatcatagttattattcaagcggtgtgggtttaaaaggagatttgatgccatggcaaacctcactgacttagactgttcttcaagttaaagagcaggatgatgtctgaagtggctgaaacacatatggcttcagtgtgtcaagaagacctgaaagatcccacatggaagtgaaattcattactggcaagcacggtggcaggagaccccagagggctgagccgcaaagaatttgcagagccttatggctaactccatggcctagtttgatcttgaagttactgtcttggataatcctctcaaatctgttcctgcacttaagagccactcatcacatgacggagctccctctcaggttcctttacatcgccctgtcagaaatgactttcagggaacagacatcacatcaaatcatccaacagatgtccctttcaaataagttggagcagaaccaactatatggagaagtcataaacaaagaaacagacaacccagtgatttccagcggattgacattactctttgcacagaaacctcagtctcctgggtggaagaacatgagttcaacaaagcgtgtgtgcactatattggctgactcttgccgtgctcaggctcatgctgctgacaggggagagaggggacattttggagtccaaatcttgcatcatttcattgaagtgttcaatgtcatggctgtaagaagtaacccattttaataactggcatcaaaggatttaggagagagaaacccagtatccagacccatttccgtcagtgacactctcctcgtattgggaggattggccagaatcgtctgattcctgtttctgatttccttcctcactggcatcagagtatttcactataggaaaactaatatctaactgagctccaagtgctaaataacagcatctcatgttcattccgggtcaccaagaggttcagggtgaccaagtcacaaactataaatttgaacatttgatgatttttgcaggagactgggtgaacaaaggaaaacccgagagatacataaaggtggaaactaggatttctcatttgaattatttaacatgcctcactctaatggttataaatgtaaaggaaatgcaggttcttcaagaaggtgaaacgaagttactgaatttaagtttttttttttttaaacctactttagaataggaaacatgcttactaatatttacaaggcactacaaggcaccagccaaaaagcctgatttattggcaggatattcttgttgttgttgtttctattgtccatataggcaggcaattaatactttttagaaaattaagttgccaactcaacactgcctacttttgaatttttattctagcaacagccgataatttattggaaattccttatgtgctgggcactacgctagacattgggagtacgaaaattaatatggtaaagatcctggctttaaagagtctttaacattatttcagcagttttattacaggtgtatatgttggaattgacagaacacttagctcaaagcaagggttcaagcatgactttgcagagtagatttcagctgagcttaaaggatgtgagaataagtatacacattttttaaattacccagaatgtagtgcctacagaagtgcttgagcctcagttgcttctaagagtccaacttcagaacttgtatcttctagattgagctcattgcttaatttctagccaacatagcccatctctctcagctgaatactaagctcatcaacttctcctttgatctaggtcttgattagaatgttgaacatgacaaggctgaaggcagaaaccatagaaacttctatccagagttacactcgtctcttaatagctgcctactgttgcaatcagaataaactcacttcttgcccaattatgacagttcattcaccttctactcaagggagactttaagaattgttgaagttgaacttctcaggttcttatacttagtgacactgttcatgcaatggctcagtatttcttgatttctcagaaccagcaaaagtcacaaactgaatcctcaaattggaattcgtaagtgactaacttgtagcataactttattatactaggaaagatggggcaagggacagaaaaaatatctgtaacatcttatatgttcaaatataagcgctttatgtatatttagtcattcaaactccaaatacacattaagaagtagtcatcaatattccactctctaattctacaatttctacctttttagattccacatataagtgagatcatatggtatttgtcgctctgtgcctgacttatcttacttaacataatgtccttaggttcatccctgtttgaaaatggcagaattgcctgtttttttttttaaggctaaatagtatcctattttgtatattcagcacattttaaaaaatctgttcatcagctgacggacacttaggttgattccttatcttggctcttgtgaataatgctgcaatgaacacaggagctcaaacatccctttgaaatactgatttaaatatctttgggtataaacccggaattggctgtggggagttagacagggaaaatgtccacattgctctacggatacaaagtttcagttaggaggaataattctggtgttctattgcacagcacagtgtctatagttaatagtaatgtattatatatttcaaaatagctaaacaaagagaattttaatgttcttaccgcaacgaaataattgtttcagaaaataaatatgctaattagcctgatttgctcattccacagtgtatatacatgtatcaaaaagtcacattgtaccccataaatatacaaaattatttgtcaattacaataaaacttttttttaaaaagtaattatcaaggtctccatttgactgataaaacttagattaaatctgagctagaactcagcgaatattgcaccaaatgttcttcccattatgctcctccctcttcctcgctaagattgcgccccttctcctccctaactcgccacaagttcccatcacccttcactagttttcaaaccaaggaaaacatcattcaatgaatgataatacttgaccaagaacttttaaagagttttgagttaaagaaaatgtgacttgggttaaagtcacattttaaacttgtgatttgtgttaaagaaaatgaaacccctaaatgacttttcttaaataggcattcaaaaaaaattgaccttttaatcacttaatcctcacatatctatatgctatggactgaattgtgctccccaaaattcatatttgaagccctaaccacttccccacaatgtaactgtatttggagatagggcttttatttagagatggaacattgaacctaattaaggttaaatgaggtcattgtcattagggtgagaccctaatccaataggactcgtgggtttattaaaagaagggactgattctctctctctctctgcctctctctgtcaggtaaggacacagtaaaaggaagtaatctgggagccagtaagagggccctccctagaatctgatcatgctggaatcctgatgttggacttccagcctccagaacaatgagaaatagatttatgtcatttaagctactcagtattttgttaaggcaacttcagcagactaatacactatataatctatggaccccctccaggaatgccatttggaccattttacaagaagagtatgtgagattcaaaggggtcattaggacatacgatgaggaaagttggttattccagggttttacttactaaattccagtacataattcgaaccactgtggtacacagtacattttcccacaggaatgccatagcctgctattccaacaggatcagggaatcaaaagtgagcaaattcaggcggtgcaactgtactatattggacagatggacagatgggcatgactctgcggttagcgggaggagcaccatctgttgcggacacacaagtgcttcttgctctccttgggaaaactcacagatgtttccataacaggtgtgtttgcttcccccatgtagctttcccagacacgtcacacacagcactttcactgagttaccctttctactcaggcaaaggaagtagagaaatgagacctctgccttgataatttagagagaaaaaagatgcgacttggttgcttctgaggtgcctgaatgtacttttggcagagagtggggaaatagaaaaaataccaaatactgaagaaagcatatttcttaaaccgtgaataattgttgaattctttatttttataagttccaagggacatgtgcaggatgtgcaagtttgttacacgggtaaacgtgtgccacggtgcttcgcatctatcaacctctcacctaggtatcaagccctgcatgcattagctatttatcccaatgctgtccctctttccctcctctgtgtgtggttcttgagtaatagaatcaggacaggataatgtgcattatgcttcctgaacaatcgattagtaggctgaggcttgaaaggtaaggcaatatgatgccaatgagcttattattatattcaataagttgagttattgagcatttaattattaaaaatgaattattaaacacacaatgaactcaaatgtaactactaaattcacaatcttagattgtctttaacctattgtccccacgcattctaccaaaaatttttagtatctaactttttcatgaatccagtgaaaaatactgacaaaattgaactttaaggcataccatttttttctggtatataactgatctgtggttaatgagaaaatttggagatgtctgtctttcaatcgtcgtgtataagaatataatcttccacaaaccctgaatttaaaatactctgcgtgtccagaactcttttctagagagtagcatagaatggtggaaagtcatacgtaaccctaaaaggaaaacctccatgtaattacctctaagtataaaattgcataaaaagagaaccagtctaccaagtgtaattaaaagcagttcaaattttaattatttttcacaagtaatgacaaacacagagatatatacccttactgcaaaaaaaaaaaaggtgccttgaggttatatttccaattattgcactggtattccacctatgaatttatctattactctatcatgtgaccccaaaatctcaccttccacagatgtagcaatttttcatttttaaaataatttataataatgttctaagatgaggattatctgtgtaattgtgtaatcatctatctagctgcccagagaattttctgttcaagaacatgcacctcctttcctaaataaataaaacttattcgaagatcctgataccgaagcctagcagagacacaaccaaaaaagagaattttagaccagtatccttgatgaacattgatgcaaaaatcctcaataaaatactggcaaacccaatccagcagcacatcaaaaagcttatccatcatgatcaagtgggcttcatccctgggatgcaaggctgcttcaatatatgcaaatcaataaatgtaatccagcatataaacagaaccaaagacaaaaaccacatgattatctcaatagatgcagaaaaggcctttgacaaaattcaacaacgcttcatgctaaaaactctcgataaattaggtattgatgggacgtatctcaaaataataagagctatctatgacaaacccacagccaatatcatactgaatgggcaaaaactggaagcattccctttgaaaactggcacacgacagggatgccctctctcaccactcctattcagcatagtgttggaagttctggcccgggcaatcaggcaggagaaggaaataaagggtattcaattaggaaaagaggaagtcaaattgtccctatttgcagatgacatgattgtatatctagaaaaccccattgtctcagcccaaaatctccttaagctgataagcaacttcagcaaagtctcaggatacaaaataaatgtacaacaatcacaagcattcttatacaccaataacagacaaacacagagcaaaatcatgagtgaactcccattcacaattgcttcaaagagaataaaatacctaggaatccaacttacaagggacgtaaaggacctcttcaaggagaactacaaaccactgctcaaggaaataaaagaggatacaaacaaatggaagaacattccatgctcatgggtaggaagaatcaatatcgtgaaaatggccatactgcccaacgtaatttatagattcaatgccatccccatcaagctaccaatgactttcttcacagaattggaaaaatctactttaaagttcttatggaaccaaaaaagagcctgcatcgccaagtcaatcctaagccaaaagaacaaagctggaggcatcacgctacctgacttcaaactatactacaaggctacagtaaccaaaacagcctggtactggtaccaaaacagatatatagatcaatggaacagaacagagccctcagaaataacgccgcatatctacaaatatctgatctttgataaacctgagaaaaacaagcaatggggaaaggattccctatttaaataaatggtgctgggaaaactggctagccatatgtagaaagctgaaactggatcccttccttacactttatacaaaaattaattcaagatggattaaagacttaaatgttagacctcaaaccataaaaaccctagaagaaaacctaggcattaccattcaggacataggcatgggcaaggacttcatgtctaaaacactaaaagcaatggcaaacaaaagccaaaattgacaaatgggatctaattaaactaaagagcttctgcacagcaaaagaaactaccatcacagtgaataggcaacctacaaaatgggagaaaattttcgcaacctactcatctgacaaagggctaatatccagaatcgacaatgaactcaaacaaatttacaagaaaaaaacaaacaaccccatcaaaaagtgtgtgaaggacatgaacagacacttctcaaaagaagacatttattcacccaaaaaacacatgaaaaaatgctcatcatcactggccatcagagaaatgcaaatcaaaaccacaatgagataccatctcacaccagttagaatggcgatcattaaaaagtcaggaaacaacaggtgttggagaggatgtggagaaataggaacacttttacactgttggtgggactgtaaactagttcaaccattgtggaagtcagtgtggcgattcctcagggatctagaactagaaataccatttgacccagccatcccattaccgggtgtatacccaaaggattataaatcatgctgctataaagacacatgcacatgtatgtttattgcggcactattcacaatagcaaagatttggaaccaaccgaaatgtccaacaatgataaactggattaagaaaatgtggcacatatacaccatggaatactatgcagccataaaaaatgatgagttcatgtcctttgtagagacatggatgaaattggaaatcatcattctcagtaaactatcacaagaacaaaacaccaaacactgcatattctcactcacaggtgggaattgaacaatgagaacacatggacacaggaaggggaacatcacactctggggactgttgtggggtggtgggaggggggagggatagcattgggagatatacctaatgctagatgacgagttggtgggtgcagcgcaccagtatggcacatgtatacatatgtaactaacctgcacattgtgcacatgtaccctaaaacttaaagtataataaaataaaataaaataaaataaaataaaataaaataaaataaaataaaacaaaataaaaaaagatctctcctctacatagaatgagttgacatttcctctttacaaacttgctaaaagtagcaccccaggcacttgtcacttaaatgagataggtatttaaccaagacgataaaatattaaaactgaaaaattgtatgtgtcagccacatataagatcctgggggcaactcacagactattgggtcccctcaggatctatggctcctaacctggtgggccctactagtttctggaaggtggaggagagctgtccttagaattctggagaacttatcactatctacacctaccttgtttatctgtttgttcatatgtatattgcctgcctcatccaccactagattgtaaacttgaaagtagggacatgttgtcttttcagccttgtagttatagctcccagaacagtgattggaaaagagtagatattataaaagtgttctgaataattaaatgaatgaataaatgaatccatgctgcttaaaatatacccttcccctttgttccaccttcctgtgtggacaggtgcagggatccctccaatgacaaacaactgagcaaagagttatggaatcagacatcaaaaacaaacataaaagaatgacatatcttccaaggaacaggattcttgagaaacatgtctctcctatccaaagggtgcaattaggaaatttccatgattatgaaaagaaatttactggccattctttaaactcaaaatggctaatgcctggtgtgtgcatgtgtgcgtgcctgtgtgtgtgtgtgtgtttatgggaagcagttggggaaaagcatttaaattggctcttagagatgctttttgtgacaagaatgtaagataattataaaccaaatttttccccataataaatgagttatagtcaatagtagacaagcaaatacctattgactaggaattatatgctgaataatgtattcagctgctaaggctattgttataaaatatcacacactgggtagcttaaacaacttaaatttattttttcacagttctggatgctagaagtccaagatcaaggtactggaaaatttggtgtctatattgaggctgacagacacctgcctcctctctgtgtcctcacatgaacttttctctttgtatgcagagacagagagagagagagagagagagagaaggagaggagagaagaagggggaggggagagagagagagacagtttactggtgccccttcctcttcttataaagacatcattcctatcatattaagccctactcttataacctcatttaaccttaatcaccttcttaaagctgctgtctgtatatacagtcacaatgggggttagggtcccaaatatgaatgggagagggcacaatccagttcacaatagatgataaaggagagaatataaatgagacactgattttctcaaaaatgtttcaatctagaggtgggttggggagtggaaaccaatgctgcccttgcagaactttaacacctgacctgataggagttccaagagagatgtgaaaaacaattgccctgagactgccaaaggaaaactaatgaatttgatttaaaattattgagaaaggctatgtaaaggaaatattagaaaatcccacaaatatgagactccataatagctttcttctgaggcagatttcaaaaatagcaatctggaagaatttaacaataggggaatggaatgaaacctctgaaagaaaacaagataagatctatgaaaaacaaagctttaaaatactagaaaaaaatccctctttgagagaactcaataattggatatatgtgaaggtagctgctttctgatttattataaatgtctggttcacagaccgcagcagcaaggtcttatccacaaagaaataagtctaaacaaaaattgacagtatgtatctcaaaataataagagctatttacgacaaacccacagcgaatatcacactgaatgggcaaaaactggaagcattcccatggaaaaccagcacaagacaaggataccctctctcaccactcctattcaacagagtgttggaagttctggccaggataatcaggcaagagaaagaaataaagggtattcagttaggaaaagaggaagtcaaattgtgcctgtttgcaaatgacatgattatacatttggaaaaccccatcgtctcagtccaaaatctccttaagctgataagcaacttcagcaaagtctcaggatacaaaatcaatgtgcaaaaatcacaagcattcttatacaccaataacagacagagagccaaatcatgagtgaactcccactcacaactgctacaaagagaataaaatacctaggaatccaagttacaagggatgtgaaggacatcttcaaggagaactacaaaccactgctcaacgaaataaaagaggacacaaacaaatggaagaacattccatgctcttggatagaaagaatcaatgttgtgaaaatggccatactgcccaaggtaattcatagattcagtgccatccccatcaagctagcaatgactttcttcacagaattagaagaaactactttaaagttcatatggaaccaataaacagcctgcattgccaagacaatcctaagcaaaaataacaaagctggaggcttcatgttacctgacttcaaactatactacaaggatacagtaaccaaaacaaacagcatggtactggtaccaaaacagatatatagaccaatggaacagaacagaggcctcagaaataacaccacacaactacaaccatgtgatctttgacaaacctcccaaaaacaagcaatagggaaaggattccctatttaataaatgatgctgggaaaactggctagccatatgtagaaagctgaaactgcatcccttccttataccttatacaaaaattaattcaagatggattaaagacttaaatgttagacctaaaaccataaaaaccttagaagacaacctaggcaataccattcaggacataggcatgggcaaggacttcatgtctaaaacaccaaaagcaatgcaacaaaagccaaaattgacaaatgggatctaattaaactaaagaccttctgcacggcaaaagaaactatcatcagaatgaacaggcaacctacagaatgggagaacatttttgcaaactacccatctgacaaagggctaatatccagaatctacaaagaacttaaacagatttacaaccccatcaaaaagtgggcaaaggatatgacagacatttctcaaaagaagacatttatgcagccaacagacacatgaaaaaatgctcatcatcactgtcatcagagaaatgcaaatcaaaaccacaatgagataccatctcgtgccagttagaatggcgatcattagtcaggaaaccacagatgctggagaggatgtggagaaataggaacgcttttacactgttggtgggagtgtaaatcagttcaaccattgtggaagacagtgtggtgatttctcaaggatccagaactagaaataccatttgacccagccatcccattactgggtatatacctaaaggattttaaatcatgctgctataaagacacatgcacacgtatgtttactgcagcagtattcacaatagcaaagaaatggaaccaacccaaatacccatcaatgacagaatggattaagaaaatgtggcacatatacaccatggaatactatgcagccataaaaaaggatgagttggtgtcctttgcagggacatagatgaagctggaaaccatcattcttggcaaactatcacaaggacagaaaaccacacacctcatgttctcactcattggtgggaatttaaaaaatgagaacacttggacacagggcggggaacatcacacactgggacctgtcgggagttgggggacttggggagggatagcatcaggacaaatacctaatgtaaatgacaagttgatgggtgcagcaaaccaacatggcacatgtatacctatgtaacaaacctgaacgttgtgcacatgtaccctagaatttaagtatatatatatatgtatatatacatatatacatatatacacacacacacatacacacacatgtgtgtgtatatatatacatatgtgtgtgtgtatatatacatatatgtatgtgtatatatatacatatataattgacaaaatatctacatatctatgtctatactcacatatttaccaacgtgcaagcattttagaagtcccttgattctaatttattaatctgaacaagtggacattttttaataggtgaataacttctactgataaaaccacattcatctatgattaaagaacaaaaagccccttttcctagtttatgttttcttatgtggagggatataaactcctgttaataatgtgctgctacagagagccttctttctaggatatctaagacctgggatttctctaatcatgggtgttcctacctaggcttgacctgcatttagggaaacaaactggcagttttatgttaacaaatataatgtcaatctgtctgtcttcaaatatatttttagctaatcagcaggacttccgcaggacatatcactttcaaaagaatggcctgcatctgattccaatttgaaatcttgtattttcctgtgaaatcactccagcagtatccttcaaagcccatttcctaccatgttgccattccctgtttgcctgtgacccctctactagactgcaacctcttcgatgacagcccttgccttgtccactgccatatccctggcacctcgcataggcagtctccccttgaaggttttcagcctaggtcatgagtgttcctaacagccattttccaaagttattcatgcttttgtctggaaaactttccagtctagcacctggactggaaaccttcacataaaaagtatgttcttatgcaaaaaaaaagcaagttgattataatattttaaattgaatgcatctgttaactaaatggtaacaatagacaaatagacaactgaatgcatctcttataatttggtatggcttagcaactaaagcttctgccaatgaaacgtacgcataacagtgaatgcaacttccaagaagttccttaaaaagaggagttgctttaccaacccacctgcctccttccagctagctggaatgtggatctgatggctggagttcctgtagccattttggatgatgaagttctttgagtaagaaagccatgtccagtgaaacaacaagacagaagaaccctggatccctgatgcaaagaatcactgactacctttcccacctccaattcagactcctttcatgtgagaaaagaactgctctcttgtgtaaatggcattattttgctttattttgacaatcatggccaaatctaatccgtaatcttagcgtctgagagagcagtttatcagtccagcatctctcaggagatattagataatttataatggtttcataagggcctttggggaggaatttattttagtgctatgcaaaatgtcattcatggaccagtgacaatccacaagctatttgttgtgggtctgtgacaagataattatgaaatttgacagtaagcgtttagatgcttttatagcaatttcacacttatcgctgaaacagcgtgagttgtcaccctttcctagtgagtcacatgtaatgcaagctgcctactagtcatgtacaataggattgcatgaagtgtgacttttaaggatacttttgtcagctgttacccaaaagtgtttaaaaatcagaaaaagtataaatgtatatgagatatgtaactttttgcttacactaattttaattttaatcaagtctgtctgaaatctacttttattgtcattagctatattagagaactgaaattcatattattaatggtaatcccaacttacagatagaaaacaagcttcactaaactattttgttaagaaaagaccggcctatactgattgttcttgttaattaaacgataacaatagacaagattctaaaaaaatggaaactatgaagctgtactagttttacttaggtactaaaagccccacaaagaactcactctaggctgaatcccttcaagctataagggtgtccagtcaatcccagcatagcgtagcaatgttatcattatctagtggtgcttccatttaaagaaatgtttcattcactggagggatggggaggtctggggtggtgggtgggggtatgatttgcattcattgtggggctcttagtacctaagaagtatgatctttcatgcactgaatgcagttttgtagccatatttggtacttacgtgctaaaataacagtgtgttatttgaagagatgcatttactaatgaatcaatgaaaacattaaaacctaaggcatgttgacctccaaattataaaagtaattcaaaaccaaaagaatcatttagaaaataaagagtattgcattaaaacgccaccagaaacaaatgtgcttagtgggcttcctacaaaagaacactttgaattgctaaatctaaagacccacatacatttgttgaaatattaataaaggactgaatcaaagatgctggattggaaacactaaaagaatctcacgaggcaaggtagcacaactgccattttccagtgacaccatagcacaatgttatgcaggccaataataacaagcaaatagtttttaaaaatacagctaacaatgtaattttcatggcaactagacaggtgcataagtattgctaaaatgtcaatccctttaacatatgtgcaaactgaacatgacagtaacataaagaatttgttttctaagtttcatttccaacaacacaaccaggtctaaattacatagaaccatgatggaataatcaacgaatgtgacctagagtttaaattttgggattatgttcagatggcatagctacaatagcagaaaagcattctggaattgctacaccacaatataaatcaatgaattgcttccttatcaagaaagtcttgttacaaaacaaaaatgttagcaggactaaaaggtgtatttagtgcaattgtaaattacctacaagctaatgcactaaatttgatattactctttttatttgtaatgatatggaagctgcttatacacaactactgggatatgagttatcaaggagaaaggttttatcagtaatatatgaactattcaacaaccctattgtgttccagacaagataagaaacaagccccaacattccaaagatatgaattagacagtctgtcatgcttatttctttggtaacgttgatcttttttaaagatcttaatacttccatgcaaataaagaatgtgacatgttttcaatggcagataagattaaagtgcaaaaagctagaagcctggacaaacagagtttctaaagagtgctgaaagtcccgtaagttaataataaataataatgaagtaggtgatgatcttgaaattatatacctgccaggatatttccctataccttagaaattttgtaaacagttttaaatttaactttccattataagaatattttacatctgccaggatattgccctatatcttagaaattctgtagaaagttttaaatgcaactttccatcataagaatattttacatctgccaggatattgccctataccttagaaattttgtagaaagttttaaatttaacttttcatcataagaatattttacaaataggaaattcataaatccaaaatccctttctttcattaaaagtaaagttaattttaactttaaaggataaattgttcaaatatgctactggtgaaggatcaaaggtgagttttgcaaatactgaatcacttgcttcatttctacaaaaagttaaaaatgaatatcctgagtttactgaagttactttggtatttattctctttcatatcaaggtaactctgtgagactgtactcaagctactctaaatgttactgaacgaaacagaaacaggaaatgagtggtgtcattgccactccagctatgctacaacaaccgacaagcgagaagcatgcttatacattgcattggttcaaccattgtggtagacagtgtggcgattcctcgaagatctagaactagaaataccatttgacccaaccatcccattactgggtatatacccaaaggattataaatcatactgctataaagacacatgcacacgtatgtttattgcgccactattcacaatagcaaagacttggaaccaacccaaatgtccatcagtgatagactggattaagaaaatgtggcacatatacaccatggaatactatgcagtcataaaaaatgatgagttcacgtgctttgtagggacatggatgaagctggaaaccatcattctcagcaaactatcgcaaggacaaaaaaccaaacgccgcatgttctcactcataggtgggaaatgaacaacgagaacacctggacacaggaaggggaacatgacacaccggggcctgtcactgggtgaggggaagggggagggatagcattaggagatatacctaatgccaatgacgagttaatgggtacagcacaccaacatggcacatgtatacataggtaacaaacctgcacattgtgcacatgtaccctagaacttaaagtataattttaaaaaaagaaccttaaatattgatatacattgtgttcattaaaagtatgtctatgggtatttaacatgatatattcctattttactcatagtttccttagtttataattgcagagagaaaaagggctattagtacgaaagtgatcctctatagttacattatatttgtatacatcaaatgcaccatgtttttaaatattttctttttcctatgcttattctgatcatgtttgttaaaatgaattttgtgtctataaaatctaataataaaatctgccttctatgtcatatgtcttctatcccttttttgtaggaattagtgcatattgcattttacaaaagcacagatctgggatggattggaaagcaactaacaaactgctccttctccacagatgatctgagaagcacatacattatttatctgcctttagatcatttctaagctatcctaaaatcaggattctacttttcccaaattacccctgccccaccctaccttgactccttgcctacctgaggaacatcatccatcaaatcaagatgaagtaaatgcaggctgttcttgtgactcttcaaggtcaaagagccaaatgctcacagaggctgggctgggagagcacatgggtgcaggaacaagcagcgtgcaggggtacctctgtttcagatcaactggcccaagcaggagcatggcctgggttgccagatccctcacagtttttcaagagaaaccagaaacccagatttttacagggaactacagtcatttaaaaatgtgaagaagtaattcagatttttacaagccacaaggccagctaaagaaaatgcctgtgtgggctaaaattggcccaggaatcccacctggggactgctggggctccacatgctactgatagaaaaagtgagatcagcaaatgcaaaggatttctttcaagcacagcctgcaggtggattttggcagtttcctatcagcgtttttccatctatggaaaacagctgctggtgtgagccaatgcttcaggagcactcctcctgcctctgtctagcctgaggcaaccccacaatcagtctcagataccaacatgagcatgaaacatactccacaaaggagctgttcaacaaggggtcccatgatttcagggccactagtccagaaaaggatattcagtcacggtgcaaaagaagagggtatatgaggacctctttgaagggagctgagagtgagtatcctgatcccaccagcaggaaggaggtgaggtgccaccctttccttcaatcctagttgggagagggatttcccatgggaaacattagaaaatttcatatatgtttcttccgctgggggctgtggaggactggtgcttggttcacacatgagacagctgagctgcctgatagatttggccatgctgagattagcctgtactcccagttgggcagggcaagggatgcaccagtgtttcctgctagtgtgcccatcatcattctcagaaacaggaggagaccaatgtacattcattgtccaggaggagcatgtgactttgccgcctgatgtttacgaaagagtttacagtgctgtataagtgctgaatggcattgttcttccacagggctttcatggacaaaatgaaagataagaattccctctctgccttcgagggcccttcccagccccttcttcttttgtctgtctcatccacaaactaaaaagtatctgccctgagatcctgagatggcctttccctttaagcctcattattattcaccttctatggaaagaactcactttaggctgaatcccctacaagctatgagagtgtccagtcaaacccagcacagtgtagcattgatatcattatctagtggtggtttcatttaaagaaatgtttcattcactggagagatggggaggtctggggtggtgggtgggggtatgatttgcattcactgtggggctcttagtacctaaaacaagtggcttgtgtttctgtgctggactctgctttttctccccaccccacccagtagctcccaattctctatccacaagatctttaaaacccaatgcaagtcaaacaatagaaccctcaatttagaaactgtaactctggattcagggagctaagccaacattcaaaccctccctgacttttcacagcacttactgcttctgtcatgggtttggcacttgattatattcaatttagcacataattatatccctactctctcatgtttttctttcattgcttgtaagtgttcagtttatttgtcccaatcatacagtaagcccctggacagcagagaccacttttcacccttcaccagagatccatatacttagcagtgttgggcccagagcagataggcaataaacaccagctgagctgaacagagtggaacaagccaccagctccaccttccaacttgccattgatggggagaaaaggcaaaaccacctgagcattcagcttgccgctgcctttccctgctggaaagtcataagcttcttccccgggcttcttatgggaaaggcatgatcttcttgagacttcagcgtaggcacatcctcggggagcactttctaatgggaagtgtgagtctgggtggatagtgcccatgactcattgtaaagtctatgtgggagcctgggcggctatagtctcatatgaaaagtatttctgctctatcctgctccttcccacgctcaaccttcctgagccaccctgttgccataagcatctgtacagtgccgcaagcctcactactaagtgtcatccttggaccatcagcatcaccagagggcctattagaaaggcaggatgttgggtgacatctcagtcctaatgagttaagacctttttaacaagacctccaggtgtgtcctatgcatggtaaaatttgagaagcccttccctgaagaggaccttgtcaggcattctccctgaggagacaggttttttgagctgtctccagaataatctggagagctgtcctggatataaatgatgctttcttcctcggggggaggagaagctccacaaaggagcaacaacacaaattgtctccaacccacagataggcacagagctcaaaagaaattaagtcaagccaaatggcaagcaagatgctgttagtatgagtggtaatagatagctccctatgtcctgttctgtcattctgtctgttgctgtacatgctccaggacatcctgcccttagcaaaacatgctggaatgggtttacagtgggtccgaggacatattctagtgaaagaccaaagccttgccagtcctctaggcacagtcgttatctccctggacaaatgtgtacaagtcactatagtgggtccactttcccagcatgagctctgaacctcaggtttggtccaagctattgcagtctactactatgcagttagttcttcccgtccctccacccaggcacagtctgttcaggtttcaaggcccaattcaaatcctgcttcctccacagcatcttcctggtcattccaaatacactggggacatcctccaagacactggtgtttaataatttcatggaaattttttcagcaggctataaattcccagaatggggagacttatgtctgacattatgttctataccttgtccactcccctgattatagagacataatattcagtatatgagtacaagtccttaaacactcagtttgaactgtcatgaggatctagcaaatctgttttcagaaaggacctggggaagcccctcagcctggtgatctttctcctgcttcctgaaaacccagcactcttcatacctatcctatcctggcttggctgtagactgagtggacggtctttcctccagaggaacttctatgagagtccaacagacaaccagattccagaatcatatggagaaaccaggtgactgggctaagaggggaccctcagtgtgacaatggcaagagatgtttatccagaggaccaggccaaacaattccatctagttatctagttttctgtgactcttgggtagtagtgagctattatatcatgatgggaatgacaggaagaacagggagaaaaataatattaattatagcaggctgagattattctacatagcaaaccacagttctgtcctctactggaaaattagctgtacttcatggttgccccagctgaggtgctgtggctaaaagaagactgtctgagaaaatgatgaaaggcacagtctgacctttgctccttggaatgttattattgtccaaataaacgatgcatatgttatcagagcatcttttctaccaggtcagtagatgttcttcctatgcctatgctattacccctaaagtggactaaggtagcaatgcatggaccagatctgagaatacaattactgaatacccttaaacactagtcaaccgaatattgtaagcagaggtggaaatgacaactgtgattcttcactgtcattactggcatgaagaaggtccagtctccttctcaggaccactgaagttcacaggtctagggaatactgcttgtactgcagtctcaggaattctaccccatggcatttccagtgtgcagcctgcctgtcatttgcagctgccccaatccttctatttccaactgtcatttattctttccaatgaatatagaaacatgcctgacaaacttacgcactatgagaaaacttagagcagggactgagtcttggaaaaaagttaaatgtttttcttttaaatagatctgaatataatatcttccaggatcacacatcctaaaataactgtgattcttttctttaaaaagcaaacaaacaatatgcccctccaattaaaagaaaattctaaaatggaattgccaaaattctggatgagacattcttcccttttacctctctcatgccgggaaattctttctgcttgctaacccccgaataccatccgcgattagaaatagaggagaactccatcgagcactgtgtttcaggttctcaacaaatatctggggctctcagactgcctgccaggcaccttgctaggcaccagatccataaaactggttctcacttctctacccatttctccttaaaaagaaaaaaactcaaaagttggtttgtggaggtttggggtccaacaactatttatgcaaaatatttgccgattttcaccagctttctatccatggcctaaaggaagctgaaacagcttagaggctgaagaaatgaaccacagagcttgaaacagaggcaatcaagtcatctcaaacagcgggactaggaaatctaagtcaagtctgaagagaaaggtagtgaaagacttaccatttttctttttctttttcaaaagaagtcaatggccattcagtgtttaaatgagaacaaagactacaggggggaaaaattaaggtaaatatttgtaataatgtgtcattgcattttacataatgggccagcagtctttgaaatgtgacgacatccatatctacagttttatttgttttttcttatttgctctcctgaggcaagtctcttttaggctgtcagccaccaaagcagctagcaaatacaaggacactgaaaggcattctgccaacacgacctcagaagtatttacagactgcaatggagaccatgatataattcagtttctgcatggctatactctttgccaattaatattctaatgtatcctttgaggatgtggtaaatgttggtttaagataaaacagcaaagacaaatattagtgtgccacataaaggtattacttgccatgagagcactgtttcttagtacagactacctggattgcacaaccagagattctggtctcactggaccagagtgtacagcctgggtaccaggattttcaaatagcctcgtccacctagtgattctaataagcagctatgattgagaaacactgtactcgtcaattaccagaatgttttgtattctatttggaacacaactaaaatttgacctgatgaactcgtgcaaaatattaaaagctgaacctgcagaggccagatgcagtggctcatgcctgtaatcttaccacgttgggaggctgagtcaggcagatcgcttgaacccaggggttcaagaccagcctaggctacatggtgaaacttcatctctattaaaaatacaaaaattagccaggcatggtgatatgcacctgtagtcccagctactcaggaggctaaggtgggagaatggcttgaacctccagaggcaaaggttgcagtgagctatgatcgtgccactgtactccagtttgggtgacagaatgagaccctgtctcaaaaacaaacaacaaacaaaaaaggctgaaactgcagagaaatagggagaggactatggaaatattatagaaagataaatagctgaagaagtaatgtcaccgccacacaccctaacctgatatttgaggaaaagagacgaaacacacaagtaacaaaaacaaaaggtgaagcttggttagtccaatccttgatgcccagaaaaaaatcttacaggagaccagaagataagggccaacaaaagctgaacagaagttcagtgaaaatcagtaaggtctttaggatagtctagttctgcctcattttcctgaggcagcagtgggaagcagctggccctcctgcccctctccccagcccctccaggcctgcatgctatccttggggaccctaggcctctgctgggatttccctctgctgtggggatttccatgctggcctagaggcccgcggcaagtagcccagttgctagagcctggaggcaggtgagcagggtggtagaaggtgagggagtgatgtcagagaagcctctcaacagacagcatcagcttcctgacgcttagaagaccccttgtttcttccatctcttcagagccagggccatcaggtggcccataaactcctttttcacatgcaagctgagaaggctgtgagccagccacatggcagggggttgagaggccatcaccctgcgtgttcaccgcctctcctcgctgctgctggaaggaaagggctttgcctccagttaagggaacatgaggtcctcataaaggtttcagagagttggagcagagatggaggggctgataacttgtctctgtccctaatatctgacagaaacaaagagcaaggaatacaacacttactatttaacatttaatttaggatggcaccaatttccattaagtgaagcatcaaggaaaaatgctgatattgatagtcttctaggatccttaatcattctcataattttaaaaaaatctaaagattttctgagctagatatggtagtaattataatttttgtagtatatatcatgtgtattacaaaaagatacatataaatatgtataaaatatgatatattttctgtaaattctttatcctagtatttaattcccatgacacaataattatgcatattattaaacctgtttcatcgtcgagtcatttggttaaaataactgtattcggggatgtttaatccttacagctccttgaaccaaaagcctggaggtttagttacaggtttacaaatcacagggaaaactgttcctagtagctttctcatgctatcatagcctttgtctttttctgcctctcctttgtcaaaatatatctgtcagagaaagatttctcaccatgataatcagtaaatctccccaagaaatgactgtaaaattggataacattgtcaaaaataacaattttaggcctttgaaaactaagcaaagacaagaaaataagcaaacaaaccaactgagaaggatttacccattaaataaaagacagatagactttgggcctccatggtattcttgcctggggctgctcccatcatctctccagctcaagggtcttggtagttctaccagggcagggctggtcatgaaaaccagcagcttcactcctagcagggctcactcgtgtctagtgggactgtcagtaaaataataaggctagtaacacacatgcctcatagtctgaggttgctctcacagatcgggggcatttcaggctggcagactagccagacatttagcaaagagatcctagaaatgagagcactgcagaaagcctagataagaccccaggcagacggggatgggatgctacacacatgctcatgggacacccagaagggcccagttgaaagtaaaacccagggaagacttgaaaactgtctgaacttggaacatgctcctgttaccacatcagcagaaggtggaagctctgctggcttgaggtgtttgagcacaacatctgaccagtctttgggtgaccactaaactacaagatgcaggggaatcccgtgggaacccaggctagtaaaatgaaaataagaattaaaaaaaaaaaagaaaaaaatagctgcctgacatcagtggggaaacaagttctgcagaataagtctaggcaacttactaaaacagcaagagcagcagcaacaacaaaatgacaacaacctttggggggaaagtaagaatccagaattttgacatcatctatttgctaaaatgactggttttcaacaaaatatcatgagataggcaaagaaataagatggtatgacctatattcaggaaaaatatcagtcaacagaaactgtcttggagcaggccctaatgttgaatttagcacaggaagaaacaatccaaaatgaagcaaaaaaaaaaatgactgaagaaaatactgagcagagcactagaggcctatgagaaaacagcaagctgtcattggactctgtactcggtctcagaagaaagtgataggaaaaaaaaatcaaaagtctgtgggaataacggccacacattgtaagcacataacaacacattctgaaaagaaagaatatcctaaaaacagacaaataaacaatatgtagaagtacaataataaaaaaaaatggctgattttcaggaaaacagtgcagcctcatttcaaaacacacacacacaaggtctgtcaacctagagttctctatatccagaaaaagaacatatatctagtaataatatccttcaaagcaaagatgaaatgaagacatattcatatcaactaaagctgagaagaatcctttgccagtagacctacgttgtgagaaatgctaaaaaaaaaaaaaaaaaaacaggttttcatgctgaaatcatactagtctgaaacttgataacttagttctacaggaaagcttaaaaagtacctgaaatggtaaagaagtagataaatacgtaatactattttttcctaatatctttgaaaaaacagatttaaagttaaaataaaagccttgtaattaggggtttgtaatctatatagcagcaaattatacgacagtaatagcaaaaaagactgggaaggcaaatggtattatactgttgtaagcctcttacattacacataaagttcaagacatactatactaagagatatatagacagtgatatagtttggatctgtgtccctacccaattctcatgttgaattgtaatccccaatgttggaggtagggcctggtgggagatgattggatcatggaggcagtttctcatgaatagtttaacaccataccccttggcaatgttcttatgatagtgagttctcgtgagatctggttgtttacaagtgtgtggcaccccccaccttggtccttctcctgccatgtaatacacctgctcctgctttgccttctgccatgagtcaaagctccctgaagcctccccagaagcagacactgccttgcttcctatacaccctgcagaactgggggccaattaaacctctttataaattacccaggctcaggtatttctttatagcagtgtgagaacaaattaatacagataaatagtgtattagtctgttttcacactgctataaagaaatatcctgagactgggtaatatacgaaggaaagaggtttgattaactcatagttgcacatggctggagagacctcaggaaacttacgatcatgtgagaaggcaaagcagaagcaaggaccttcttcacagggcggcaggagagagaatagtgatgagcgaagaaggaagagccctttataaaaccatcagatctcgtgagaactcattcactatcatgagaacagcatggggaaactacccccatgatccaatcaacccccaccagatctctccctagacacatagggattatggggattacaattcaagatgacatttcggtaaggacacagccaaaccatatcagatggatggatggatggatggatagatacatagatagatagatagatagatagatagatagatagatagatagatggatccctaggatcaactactgaagaataaagcaaagggtaaaaataaaaagtcaaggaacgatataaaatagaatactaggccgaggcgcgaggatcacgaggtcaggagatccggaccatcctggctaacacggtgaaaccccgtctctactaaaaatacaaaaaaaaaaaaagtagccgggcgtgatggcaggcgcctatagtcccagctactcaggaggctgaggcaggagaatggcatgaacccgggaggcggagcttgcagtgagccaagatcgcaccactgcactccagcctgggcaacagagcaagactccgtctcaaaaaaaaaaaatagaacactaaaaatacatatgtttcacaaacgatatgtatttgggcaatataaagaattcttgcaattaagtagtttttaaacaaaacaaataacccaataaaaatgggcaaaagatttggacagacatttcacaaaagaagatataagaatgctcaacatgtgagtaatcaggaaaataaaagttaaagctacaatgagataccactatacacccactagaatggttaaaattaaaaagcctaaaaatgccaaatgttacttacgatcttgcaattcctctccttggtgttcacccaaaagaaatgaaaacatatgtccaccaagtaacttgtacaagattgttctttgcagctttattcacaatagccaaaaactaaaagcaacatgatgtccattaaaaggaaaatggataaacaaattgtggtatatttatacaatgcaaaatgagtcaaccaaagcagaaaaaatgaattaactaccgatacatgtgataacttggatgaatctcaaagataatacgttgagggcagaggtgcaatggggaagccagacacaagagtccatttatgtcaatttcaagaacaggcaaagactgtatcaaaacatctcatgcccctcataaatacatactatgtacccacaaaaattttagaaattaaaaagttaacaatatgtaaataaaaagaataggcaaacaggcaaagctaatttgtcaggatatcgaaacagagattaacttttttgggagggagtggggaactgactgggaaaaagcgcgagggaattttctagggtgatgtaaagttctgtgtaaatgttctgtgtaactgggatcatcaaaatttgagaaatgtgcattttactataattacatttaggtaatgtaatttaataaacttcaataaaaatacgcctcaaaccccacattcttcctttttttttcttcatttcattgactgtgacttcccttcaaagctactgaagaaagggaggcatagattcgttaccacaagttcagctcagctcccaactctgaacattcttttcagttcttgactatggtcatcccccaactcctgaagtaggaggattttccaagcataaaagaatgaccaggtttagatttagaccagattttctagaacctaagaaaataagcatatgtactttgctaaactacctgcctatctgataacctgattttagtatctgatgtagaacttggaagccataaatttgaaaatcccaaattgcaaattaacaaattgagcatttatttgaggaacaagtatcatgtttatgagcagcacccacagagtttggaagagaaggtttacccactaatagccatcctaacttacgtttaaaaaagttcataaacctctagtcagctatagaacatgggatcatgggggctgcacagtgactaaaagggattttaaaactgtaaatatgcccaggcacagtggctcacgcctgtaatcccaacactttgggagggtgaggcgggtggatcacctgaggtcaggagttcgagaccagcctcaccaacatggtaaaacccgtctctactaaagatacaaaaattagccaggtgtggtggcgtgtgcctgtaatctcagctacttggaaggttgaggcacaagagtcacttgaacccaggaggcagaggttgcagtgagctgagatcgtgccatcgcaactgcagcccgggtgacagaacgagactctgtttaaaaaaaaaaaaaaaaaaaaaaaaaaactatatccgaattattaaaaatttaaccaattagtcaaaataaactttgtgaaagaattgagccaatcattgttgccaatgtgctaaggactcagggatcaggacagatggaacaaaaatgtgaacacatttgtagtcatatttagataagaaaatcattcttaatccatatgataaaagtatccttttatcttttctaattatcattctatagatattaatgtgagaatactctccaactcctttaaaaaacctgttgctcaaaatgttcttcatttaaaggaactggtaatgataagtgggaaatgacacatactactggtgtagctggtggagccattgacatctcacctctgtgggttgtttagagataaaattcgtttctttcatagcaaggagcattctaaggattcttggtgaggtggttttgttttattccctggaatatggagaatagctgtggcagatatccaggggttgttttctccagcatgttctaacatactttaacttttttttttttaattatactttaagttctagggtacatgtgcacaacgtgcaggtttgttacatatgtatacatgtgccatgttggtgtgctgcacccattaactcgtcatttacattaggtatatttcctaatgctatccctcccagcccccctcaccccacaacaggccccggtatgtgatgttccacttcctgcgtccaagtgttctcattgttcaattcccacctatgcgtgagaacatgcagtgtttgtttttttgtccttgcaatagtttgctgagaatgatggtttccagcttcatccatgtccctacaagggacatgaactcatcattttttatggctccatagtattccatggtgtatatgtgccacgttttcttaatccagtctattattgttggacatttgggttggttccaagtctttgctattgtgaatagtgctgcaataaacatacgtgtgcatgtgtctttatagtactatgatttacaatcctttgggtatatacccagtaatgggatggctgggtcaaatggtatttctagttctagatctctgaggaatccccacactgtcctccacaatggttgaactagtttacagtcccaccaacagtgcaaaagtgttcctatttctccacatcttctccagaacctgttgtttcctgactttttaacgatcaccattctaactggtgtgagatggtatcatgctacctgacttcaaactatactacaaggctacagtaaccaaaacagcatggtacaggtaccaaaacagagattcagaccaatggaacagaacagagccttcagaaataataccacacatctacaactatctgatctctgacaaacctgacaaaaacaagaaatggggaaaggattccctatttaacaaatgggggtgggaaaactggctagccatatgtagaaagctgaaactggatcccttccttacaccttatacaaaaattaattcaagatggattaaggacttaaatgttagacctaaaaccacaaaaaccctagaagaaaacctacgcaataccattcaggacataggcatgggcaaggacttcatgtctaaaacaccaaaagcaatggcaacagaagccaaaattgacaaatgggatctaattaaactaaagagcttctgcacggcaaaataaattaccatcagagtgagcaggcaacctacagaatgggagaaaaattttgcaatctactcatctgacaaagggctaatatccagaatctaaaaagaactcaaacaaatttacaagaaaaaaacaaacaaccccatcaatgagtgggtgcagaatatgaacagacactttaactgttttgaaagaatatgtggtaaatcaggatccccaggggacagactctgaggctctgagattgcatgtaaaagctttatgaagaactgcttttaggattgggccaagagaggttggactatgatgcatgcacagcaggggccccagccatcctacaggaagccctggggctgtggtggcccccagagttgtgctgccttgatgcacgcaagacagccatttcgtgtgggaagaccttggggatgggacatgaccttgggcaaggcagcaccgatggccgaggccagttcttggaggagaatcaactgggagccatccactgccacactcccacagatgtaggaatgagtacctccttcttgacatgggacttgagtggatcaccaccacttccatgccacagtttcagagattctgaacctctccttgagactggccaatgactacatagccacagcagctgatgtacattaataccaaagttaacctaaactatcatttgtttctgttcttgctactattttcagcttgcctgtgactctctggaagatttgaatttctactccctaaattatgtctatcatgtctatctttttacatggatcattggtgctgtttagaatggatctgaagggcaatcccatatctgtgggagaatatatttccatatccagagagaatccccacccaccttgctccttctagcctgatattgctcggtttaggagaagacttcctaaagttgagaaactgtgatctcagagtttggattttaaattaaagctctgtttgttgatacagctgagagtgattttgtgtgtgtggtggtagagggttagatttactgccattatgggcaaaatatactggtttctgcttctgcactgaaatttaacaactacatctttccatattactgaagccatggactgatgtgtggcctgtggaatgaagcctgtgaaggtggttaactggattcttaggcaaagggagatcagaacagcctgtctatctctggtatgcaagggtggtgcccaaacagaaaggcagaggatcattttgtcccagaaaacagctgctatggcatttctgtggttagatatttgggggagagttgataaagtggggaagatataaaggataatgtaaataaccaaagaaagaagattctttgagagagagagagaaagaatacaagaggtatatttttcttcttctttaccaataataactagataaatttaactcaaatgaagaagaaaggaggtggcatggaatgattactccctcatcatcacaacctctgccccatgtgtaagctaagcttgatgatgagatatgatgatgccatgatgataacctcttaaaatttgcaaatctctgctgaaaacttgaagttaaagcatcaggtttagcagaaaaagtatggtacctacagtgagagtaactgtttcaagtcacatcacggccatttaatagctgcttagttttggctccatcattaatctcctcaagacttatatatatatgaaatgcagcacagacagttgatatacaaaatcataaacatgaatgacagcattttgtactctataaggggatgcacaaatttaatgccagattttgtcaaagccaatgcatttttgtggttagttctctgaatcaagatgtaaacaacccaaatcttcccttctttttatttagctttgttgcacaccaattgaagagacattttaaatattttcacccctgagttggtgagataatacgtcttcttccctaagacactaagcagtgatggactggtaaaatttaaattttataaaaagcaggcatttaccaaattcaagttgttctgacattttatggcaataaaactaaacctcctttgcataaaaatttgcattcatttttaaaaactgtcttaatattcctaatgatgactccatggcaatacaaaatatcatccaactaaattgcttttgaatcaccaaataaagataaaagaggaacaacttttgttattgtgacaaatgtacttggtgtattcaactctttcagaactagtcattacttgatatgggaacttagttaacccaaagatcccttactgcatgagaaccctaggatttcgttggagccactcatctctagtgaagaaaggaatccaaacaggtagatagataggcatttttactggcttttcagctggactttttcctccactgactatcacctgtggcaggtagtcacttctttgcattcacaagtgtgtgggcacacattttccatgtgccattttgcttctttgcttacgctttcagtatttctccctgatccagaatgtagtattcaagtgttgatatagctgagtggttaacccagaaaacttttctaatcctcctcctcttcccttgattcttgtgttatttttggaaaacctttaaggagactgtgcctctacaaagataacagccagatgatgaatatacacacacacaaaacagagggaaacaaaaatcttgctcacatacttcacgtaaaataagaatgacatctggataccataaggcggatatctcattttctggtaaaaactgtctcctggtttttctgttatggaagcataaagcaagagatgcttttaaaaagccatctatactccagagcaactctgtcctctctaggtctctgcctagcctgctttaactgaaatgttaacaagtactgaaagtttagtatacccactgttgaaaattcagagtagtagtcaataatcactaatcaggatcactaataatcacaaaaggatgcttctttccatacggaataggttctaagaaacgttttcaagctctacaaatgatactcagaataaaaaaaaaaagtaactccaagattctaagtaatctgaaaaatctatctatataataggacaaaatctgacagaagccttttctccctcccagggctctgttcatttttggtcactgcatatgtcttgtgatgtctgaggactttgaggtgtcatcctgagacagcaatctgcatctgattttgcacagaggaaactgacttgatgcagatcacatattttgctgttaggtcaggtctgagaaagaaactctggacttattccacttgtatttaatgcctctgggaagtgaatattctcagcaataaggtctttcatgcttttgggcttaagcattgcctccatttgaaatacttcccctcctcaaattctcaacctgttgaaatattttgaatcttactgaaataccacctcctctctagagtgcttccttactccctacaattagaatgaatggatcctgcttctgcatgttctgtaacatttttttgtctattttgcacatatctatcctttttaccattgttaatttcatatctatgatttcttttctccagcagaaattcataaagtttctgaatgctccacatacacaggacagatggaagtaggactgggcttgaaccatattattttgcctctgatatctaagttatgttttgttcaagaagatttaaaaactcctgatctaggacttctcatttcatatccagaatttcccagagaaacacattttccatgtctcctgaccttttcttttttcatgctgtaatgaggacattgcagagaccaaaaatataaatccctgtttttgagagctggtcatagctcagaaaatcaaacaatgattcttctatacacctcaaaaaggcaaagataagacactagcccagaaggacagtgagctaaaagtgttcattcgattctggttccctggctatgatggagaaaagtgtcctccaccctgcatctcctccagtgaacttatcctacaaatgttgagcagactcttaccccacaatcagctcttcacaaaagcagactccaatccaactagcagaaacactgtgcagaggataaacacacaaaaaacatttaagtgatttatcatatcatgaacttcaaaaagtatagtctatgccaaacagagtagaaaaaggagcagagaccaatctgtcaccacatccttctcccctcatgtccccatgattctcgtttttctcagaacttttctcaaacaactaattggtttgtatttctagaagcaaagaatgtaaacaaacactttaatggaattgattcatgagactggttattcttatctgtgtggttgctggccttgaaatcatcttcttaagggcaaggaatgactctagaatacagtatcagagcagaaaatcaaatctgagatgctcaaattcacgtgggctcccctaaagataaaatacatgatttttctcataatcactgtagcactatggaaaaaataccagcaacttttatacagttttagctcaactcttcaccttcagtgatcctgtcctctagataaaagtgaccgggtggctaatttgataacagtaagacagttttaggactatttctaggcagaaaacaaggactgtattttccaaatcttcccatccatcccaattttccagaataactgagaaaggcaggcaataagtcaatttttgagaccattcaggaaaagtcctgatatcgtgcactgttcaaaattactcaaataccagtaacaggtagccctgggcaaggacccatggaaaaggccaagagacataggttcttttgttagccgcccgcacaggctgtcttccgaacaggacaaggcatatagccaggtaatgctggctctactgtgcccaggtgcaacatgccctagaaaaagggttctaaaaatatccaagagtcatatcactactaaaggtgattagtgtgcaaagtatccgaactatatttatttaggattctatggagggctcacaattggagtggcatgactcactatacttcctgtggcttctctgccatttccaccctccttcacaggcttaaacatctgtcgggacactgctagagagacatgaaaatgcagtactacttttaacagattcttgttcagggagaaatctgttaccctctaaactttgttaatgttatatttttctgaaatcctagagaatacatgaaaagcaagtttcactttgttacctgtttattttgttagaagtatttgcaattattgaaaggataaaggtcccttcccctttaagaagccaggtggtaacataacagttgcacctttcatccaagcaaatcattcaggagagaatgacttatggacagtacagggcacacaacattatgttctgaatatccctttagagggcaattcagtgccaggaaagaagaaaacaaggggctacagaaatgtgaggtttcagatggcaaagggatggattaaagggagaaatcttgtatttataatttccaccaagtaacaggagaaattaatacctattttctaaacagtagtttaccacaagataaaaattattgtggcagaaattaatttagaaaatactcatagtatattatgtataaatccatgtatataatagccatagtaaaactaaagtgaagatcaacatagatcagtgaagccacagattacttcttttattaatgctttatgcaacccccactcccaagcaccctttaaacatttatcttactggatgatgagtccatgattaattggcagtaagagcaacaaatatatttactatagtaaaaaagtcattgataaatatagaacattttacatcttcaccctgtggagaattagttgcacatgcatgtttatagcagcacaattcgcaaatgcaaaaaatgtggaaccaacccaaatgcccatcaatcaatgagtggataaagaaactgtgatatacatatgtgtatacacgtatacagatatacacatatatatacatctatatacacatatatacatatatatacacatatatatataaatacacacacacacacacacacacacacaagggaatactactcagccataaagaggaacgaattaatggcattcacagcaacctggatggaattggagagcatctaagcgaagtaattcaggaatggaaaaccaaacaccgtatcttcttactcataagtgggagctaagctatgaggatgcaaaggcataagaatgaaacaatggctttagggactcgagggaaagggtgggaagagggtgaggtataaaagactacaatttgggtgcagtgtatactgctcaggtgatatgcaccgaaatctcacagatcaccactaaggaacttactcatgtaaccaaacactacctgttccccaataacctatggaaataaaaaaatttaataaaaaagacataacgattataacctcagaaaatgtctgcagagaataaagctacttcacaagtaaaaagtacatctgaataagaagactaaatactgaaaagaactcagattacccaagattcatgtaatatattaaatgcagttataatataccaatgagatattttttcaaaaatgtttaacaaaatattctgaaattttcctgcgagaatgaactataaaagtatccaagaaaaaagttttaaataataagagtgataaaagtaataacaagcagagggaattcattaaagtcattaagccatattataaaacaacaacaattgaaatactgtagtagaagtctaagaataaacagatcaatagaacaaaatataaagttctaaactaatgcaagtgcatgtaaaatatggtttgtgataggtttatgtaaaatcatttgaagactagtatattatttaggtgataggctaaatacaagggagaatgttaacttcctccctcataatgtacaccaaatcaaattccagacatactcaagaactaaatataacaatagcacattttttaaaactggtagaaaatattatgaacacttttatgatcttggaggaaggatattctgagtaagcaaccatttaaagacaaaattaacttataaaaattattaaatctgactacctaaaaagcataacttctgaaagttagaagtgccatcaataaaatttaaaacaattttcacatgcattcacaaaatttcacatgcattcacaaaaagaataatgaaaaagaaactaatgatggaaagagagttaagttctttaattatacagctcttagaagtcagcaacagacacgacaaaaataaagacaaaaaatatgctcagtataataaacagacaactcatgaagaaatgactgaataacaaatgaattattatccttcctaataatagataaatttaaataatgaaataccatgtttggcttaccaaattagcaatgactgaaacaagaagttctgatcgggatgcaaggaaatggggctttaatttgctatgggtaaaaagtgaaaatggttcctaccttctaggaggggagaatatggatctaaagcctttaaaatgtactttaatcagaagctcctccaagaaaattaatcagatacattttcttttatatctatatatgtagatattaatagcatgttgtttatatttcaaaaaaatgtaaaaccatttataaattgagtaaatttatgaaaccacttaaaataatgccatagaataacagtgatgtaggaaaaatcaaaatatatggctcatagttcataatatatggctgagtgaaaacaggcatttttaaaaatagtatggtcttgatttcacaaactcacacacatacacacacacacacacacacacattcacttactaataactagatggatataccagagaattctaccagtagttacccttgaatggtggaattacaagtaactttcattctctttcttaggcttttatgtgttataaaagccagatcattttgtgtaggtctaaaataactccattttttattgaataaaatgttattaaaataataaaaagtaaggtaattaaaagcaataaagtatttcatctatgtctctaaagaggcattcctctactaggataacaaatattcttacagttcttcagccacatcctcgctaaactcaagcaccaagacacagttggttggaaatagtttctggcaatcttcaattttaatttagttcctggaaatctgcaccttaacagctgggaaaatggacaactgtatattagtggattcactttgtcttatgaacctatgcctaaattgctcatatttagctattggaaagttgctggtatgagcagagggaggtttagaatttaacaatgtcgacagtatttttttcaaaaaatttctagtttatcctccccaaggagatgaggaataaaaactaacccttggcggctccagggcattttctgtaactagacacatataactgtcctggaatgaaatggatatttaatccattttccttccctgtgcttttagtctaccagtgcatgcaacccttaaagcatttctgcagctagtggtcaggaatggcaccagtcttagattagcttcacatggccaagggggtgaagcagaggctctcagctcccaactactcatctacttagggaagtattaggaaatatccccagagatcggagttctttgaaagccatatgatctggggcaggtacttaacctccccacacctcaatttctcatctgaaaaatagaaatagtaatgccaaacttacggagttataaagaggaatacactttacagaaaaggatatgaaatggctctggagtgggaaaattatccaaatgtcctaccatttcaataatgccacccttaaaatgtcactggttttagcagaatgaaatttcacagtttttactcagacaaaatatcagcttcctccaagggttagttactggtggcttttctgcctgatgtttcaagccactggatggtgttgacaaaaagcacaaggcaagaatgcttcttaccaaaaccaaatctaatgtaaattgaggaggatgatccatgcctctgttctaagtcctttcaggaatggttcttttttttattttaggctcagcggtacatgggcaggttttttacttaggtaaacgtgtgtcatggatgtgttttacagattatttcatcacccagatgttaagcctagcacccgtaagttacttttcctgatcctctctccctcctcctactggtaggccccagtgtctgttgttcccctctttgtgtccatgtgtctcatcatctagctcccacttacatgtaagaacatgaagtatttggtcttctgtttctgcattagtttgctaaggataatggcctccaactccatccatgtccctggaaagaacatgatctcattcttttttatgactgcataatattccatatgtttatgtaccacatttctttatccaatctgtcattgatgagcatttaggttgatgctatatatgtgctagtgtaaatagggctgcacttaacataagcatgcaagtgtctttatggtagaatgatttatattcctttgagaatatacccagtaatgggattactgagtcaaatgatagttctgtttttagctctttgagaaatcaccacactgctttccacagtggttgaactaatttaccttcccagaaacaatgtgtaaatgctccctttcctccacaacctcaccagcatctcgtattttttgactttttagtaatagccattctgcctggtgtgaggtagtattgtggtttcgatttacatttctctaatgaccagtgacattgagctttttttcatatatttgttggctgcaaaagaacttgttgttctttcaaaaaatgtctgttcatgtactttgcccattttttaatttggttgtttttttcttgtaaatttaagttctttacagatgctagataatagatcttcgccagatggatagtttgcaaaaatgttctcccattctgtaggttttctgtttactctgttgatagtctcttttgctgtgcagaagttcttaagtttaattagagccaatttgtcaatttttgctttagttgcaattgcttttggtatctttgtcataagatctttgcccattcctatatccagaatggtattgcctatgttgtcttccagggtttttatagttttgggttttacactgaaatctttaatccatcttaagttgatttttgtatatggtgtagggaaggggtccagtctcaagtcttctgcatatagctagccagttaccccagcaccatttattgtagggagtcctttctccattgcttgtttttgtcagcttagtaaaagatcagatagttgtcagtgtgcagcctaatttctgagctctctattctgtttcattggtctatgtgtctgtctttgtaccattatcatgctgttttggttactgtagccctgtagtatagtttgaagttgggtatgattcaacactgaagttgatacttccagtttgttcttttttattaagattgccttggttatttgggctcttttttggttccatgtgaattttaaaatagtttttttctagttttgtgaagaatgtcattggtagattgataggaattgcattaaatctataaattactttgggcagaatggcccttttaatgatatcaattcttcctatccatgagcatggaatgtttctccacttgtttgtgttatctctggtttctttaaatagtgttttgtaattattttttttcttttgagacagagtcgcactctgtcacccaggctggagagcagtggtataatctcggctcaccgcaacctcctcctcctgggttcaagcgattctcctgcctcagtctcccaagtagctgggattatgggcacccaccaccatgcccaactaattttttcatttttagtagaaactgggtttcaccatgttggccaggctggtctcgaactcctgaactcaagtgatccacctgcctcagcattcctttttattgtagagctctttcacctctctggttagctgtagccctagatattttttttcctttttgaagcaattgtgaatgggatagcatccctgatttggctctcagcttggctgtttttggtatataggaatgctagtgatttttgtacattgattttgtatactgaaactttgctgaagttggtgttgggccaagactatggagttttctagatatagaatcatgttgcctgcaaacatggatactttgactttctgtcttcctatttggttgtgatttctttctttctcttgcctgattgttctggtcaggacttccaatactacattgaataggagtggtgagagaggtcatcctggtatagtgccagttttcaagggaatgcttccagctttcgcccattcagtatgatggtagctatgggtttctcacagatggctcattattttgaggtattttccttcgataccaagtttattgagaggttttaacatgaagggatgttgaattttattgaaagccttttctgcatctattaaaataatcatgaggtttttgtctttagttctgtttatgtgacaatcacatttattgatttgcatatgttgaaccaaacttgcatcttggggataaagcctacttgatcatggtggattagcttttgatgtgctgctggattcagtttgccagtattcattgaggatttttacatcaatgttcatcaatgatattggtctgaagttttcttttttcgctgcgtctctgccaggtttggtatcaggatgatgctggccttatagaattagttagggaggagtccctcctcctcaatttgttttttgaatagttttggtagggatggtaccaactcttctttgtacatccaggggaatttagctgtgaatttgtcaggactggttctcttaagagaaaataagaactaccttttaaaaaatctactttttttagagtaatcattgattacagaaaagtgccaagtattttagttatacatgtaccacaagaagaatgttatatttctcttttagtgattttctgggcaatgatttctcctctcacacttgtcttccagttgtgggaaatatctaagattccttcctctgtcctcgctctccacattcacttcaacattaacttactccacccctttgtatttctgcagactaaactgtaggcccagttaaaatgaggggcttctaaactaagataatcatctccaccaaaaaaaaaaaaaaaaagtaataataagctctctgtgggagggatgctcctagagagatattttggggagcttcctgggtagagactgcaccaatggactaactggggctagtaggcttcaggatggccttatcattttaggaggtttttagcaaacacctgatcaatgaacctaaaatactaaatattggggattataattgtctgctacatatgtgaactaaggggtaattttctgggagcatgcccgtagttgttccaaatggctatcaccaaaaaatacagctattcttactttacatgcattcttgcactaacatttttccaaagaaatgagaagaatcaaaatttattcatctgtattctttcaaaaaacttaaatccagcactaggctgggtgtagtggctcacgcctgtaatcccagcactttgggaggtcaaggcgggtggaccacctgaggtcaggagttcgagaccagcctggccaacatggagaaaccctgtctctactaaaaatacaaaaaattatccaggcaaggtggcatgtgcctgtaatcccagctacccaaaaggctgaagcaggagaatcccttgaacatgggaggcggaggttgcagtgagctgagatcacgccactgcactcaagcctgggcaacaagagcgagactccgtctcaaaaaaaaaaaaaaaaaaaattccagcactatttattaaatattataaacataacatcagcctaatcaatactgacagcatataaagactagagttgaaaacataggcagtggggccatgtttccaataatggagtgtacattccatcacttcctagctatactggttttctacagctattggaccaaattattacaaactaagtggcttaaaaacaataagttaactttctcacagttttggaggccagaagtctgaaatcaaggtgttagaagggctggttgcttctgaagcctctgagggataatttgttcaatgcctgtctcccagtttggggtggtagtcagcaatttttggcattccttctctggtagatgcatcgttctaatctgtcttcatcttcacatggtgttcttctctgcatgtgtctcaaatctcccttcttttctttcaaaaggagaccaatcatcggatttagggcccaccctaaatccaagataatctcatctcaagattcttaattatatcaacaacgaccctatttccaaatgaggtcacattcacgggtaccaaggattaggacttgcacatatcttacgggaatctattcaacccactacaccagctgcatgaccttgggcaggttatgcaaacgttaagcctcaattcctttatctataaggtattaataataacaacactagaattataatcaagattaaacaagataacgtatataaagtgcctaatatattgcttggtttatagtgaatactcaacaattgttagctgccagtattactattattttcattattttactattaaacactctgcaggattcagaaaaaataaaacacaaatcctgtccccaaaagtcttacaatccaagaaaggatgaatgtacatttacgccaggcctgactttaactttgtaactcagtatcattaagcacatgggtgctaagacattttagggtacagaagacagactacaggttgattcttgaggtgctgaaagactaaaaactttccctctttaaaatcagcatgctctcctgtccctttcttctagaacttcccaaggaaagagcaagtgaaaaagaagcttttgctatgctccttctagttttccacaatcacaaatgaaacatcacttaaaattgctaggtacaagggccacttgtgtgagaatttacacaggcagcagcaggcaacatcttcccactaatcttccccactggctctagtttcttaccacttgtcaatacattgacatattataatacatgaaggtacaaatcaaacattatgtacacaattcattcttctcatactgtcggctgccccagtaagtcagcattgtcacaaaatgaaattgaatctcaaaggactcaaacaccaagtggaatggagtattaatgagtagaagatccaccagagtaatgtgttaggccttctgaagaaaagaaaatgcaaatgacacctgagtacagcactagtctcacaatgacatgtttcttagtaattgaacaaaatatgtaactattctcagttgcatttccctctcagtcctatgttcatttatttgtggaacctaaaagaaaagtagaggtttcacccaacagaaaaggagagatatcacccaaacactcaacaagatatacatacccaaataactggttattcagtgagttccaatttactaagtaggtttcatgtagtcaaaacagtcaaatagatttatatatagacatgatctttaatacatttatattagttattaattaatttcactccaaatcattgaggcttaatttaaatgaacccttatgaaaaaggtaataacacttacaagcttaacaaaatgaaaagtttgaactgggtggggagaaaggtttttgttcattgttttctaaattcttaaacaaaaaccatagacatgtaaggaggctttggaaaattttaaagcgaaaagatctgaggaggtttttgaccaaaaaaaacaaacccaatcaattttaatgtaatgcctaagatccaaggatgtaatgacaagagaaaacagaagccatttgtgtagtttgaatttagctattttttcctgagacttactctatttgcagttgatggggttaatgagtgggtctgttggcctggtggttatatgatcctatgcaaaagccacatggcaagagaaaccattccccatatgtcctgatttggatcactcctgtgctgtctgcagtaaaggatcatttcatccaaatctgtggtcagtggcaaaactatttgttgaactatcccaaagcacagagcctcacttattgatgaagtgacaactcagggggccatacaaatggttttgtgtttttttgtttttcccagggaagagaaaattagtgctggaactcaggtgcattcattacggaaactgaagtctaagatgtcaccacaaatatcatacagtgaatgactccaaatctggaggggtggaatcatgaaatgcaaggggaaataatattctgggatccaaatacacagccagaaatgggcttctctcaactgatttgtatgaggtcagagctttgctctggtatttgagtagaaacaaaatcttgggagtatgtttcctttttggaagtccccccagttctgcagtacagttgtctaggaccaaatctccttcaagaaaataaggagggaaattggtttccaattaaatgctgaatgtaccatcagaaccaagcaaagctgcctccaacatttaaaacattcaaaacactaagcaatttgacatactttttcaaggtgttggccttttagaaagcctgaggaatgttattataagacacaaagtgagaagcttatgtaccatccaccctttttaccagacttagaagttcctcccagattcttttaggagcagaagcagaaggcaactgaaggtgacatgaggtggctctactcgtttataagtttagggtctgtgataagggcagaaaaccatagatgatgaaggtacagacctttttctctgtcgtaatcatactcaagctctttgccaagtttagaggtttaagtacaaatgtcaagcaccctctctgaaatgttgccaccaagagcactccacacctccatctggaacttcagaagatcacaggcttttcataaatccctgtatcatcccacgagctatgacatctcagcagctacaaagtctaggccacttgtatatcagtccgtttttcatagtctctccagagttccttttaacctttctttcattgcctctgagaagagctgagttatagactctgcttatatataaactctatttatatagactctaattatatgaataattatttcttcaggggctcttgcaaattaacacaaaataataattaaaaatgaaacgaaattgaggatattcttagaaagggtgaaggacatgaaatacattactatctgggatttcaacctttccaaaggtcaataaatccccaaataaaatgtaaatccaaggctacctgagaattccatttctgttgcatctttgttcatgatgagcatatgtcttttcattttgaggactttttaaaagagaagagtgacacacaatgcaacatggacaaggaatgaaaattgctttagacactgcactttgaacatacaaacctgggaggtgccagggtctgacactgtatatttcttcctttgatctgattcttccaaacaggatccatgtactggcaaatttccctagtgttccctggtaagcatcaaagtaaaccactggttggcctcggtatttctacattggctttctccattgtttttatacataaaaaaaaaaaaaaaagaaaactcactgggcattttacatgtggtttccatattgttccttaatcattcagtttgaaagtaaatcaaagaggaatgaagagttaaagtgcttgagattggggtgaaaacttcagactcctgtaagtcaacattaatgtgtagagcatttaatacaattctggaacatctgcagggcagctgtcttacacagaccaggttctcaataagctttcattatgtgtcaccacagaatgggaaacaaatatgtgtgtgtgagttggggaagcagagggtggggggtgtaatttgtaggaaacctaattgatgtaacttccattgaaaacaagacagattattcaaacctattcacaacaatatgattatgaatactcaccagagatatactgagtaattactgaattaatgaatcaggaaggttacttttcccccatgtacattgggaaatcaaaactcagtcaattgtctttatggcagaacaaaacaactatgattcaaatatccaacaaagttggaaaaacctggcttaactgagggatgagcttattgcatgcctgctcgggtcacatgggacatctcagcccctttcctctccctcaatcttgtcccctctgtgggcagaagctcaccactcagcatctcttgtgcttttatccttaggttccagttagaagccatagacctctgctgcttctcccaattctgtcttcctctgctgatcacactgcagagttggtacctcaggctgcctactctctgcttttaaaaggcttcagagaacccttctttaactgtggtctctggaaattttctatgagatgttgattcttattctacaagaagagaatctcatggtctaatgaatgtgtaaaacatcaagttaaacagagttctttactacagagcttctcgaagcctttaatttaccactgtacattatggatccaggagaaaaagcagatttggtctggctgggtcttccaggggttcagacatttttaaaactcagaaaatagaattgttttgtgtttcttctttccaaccactcaaaatatttgaaaggtttgagtccgctccctgtaataacaaggcagtgcattttagtcacctgcaaagcatccttcatcttctacttagaagacactgggaaaaaatgagaagaaaacatttactcacttttcaggaatctgatatattaatacccaagttatttttacaaatttgcaattcattgctatgttcatactggttctttctgaaattactatttttctttcattctttttttaattatactgttcttatttgctattattaaaaagaaaaaagccccattatcagctacctaaagaatggcagagcacaactaggaaatgtcaccaacatgaaaaagaaagattaaaatcttcctaccaaatacctagactatgagtcaatcaggagttgagcgacttgagtttagccaggcagggctggaaatgactaaaataaaggacaaccaggctactgatagtaaatcacagctggaaatgaaattaaacttttaagtttaagattttacaatttgttttggtgtgttggtgggtgagtggtggtgtgcgtgtatgtgagtggataggtatgttactgtgtaaagggtaaaggtttgggggtaaagttttcagtggataaggaaacaaacaagatttaaaaatttagttaaataaatggagagtggagaagacattcaggtggaaaaatacaaaattaactttaaaaaagaaactgagggatccaaaggtctgtaagagaaatattctacaactggagaacatgtctaagacacacaaaactttatcactatgcagattgtacactatttcttatgcatcccaataaatgtgcccaaaggtagcactttaagctgcacagaaaataccaaagcccagacatatttcaatgccagttcctgggcaggctggccctcaggcaaaatattctggaacacctggttggctggcagattttcctggatggcagtgttttgggaccaaacaggcatttatttcagcctctctgatgctttcatatggtaaaggagcaatcaaagaatactggctttattttctgaagcactggttttgatccacctaagaggaaatggcaggggcaggggatgggaggagggaaggggagtaatgtgtttcacagcttcaaatcaaacactgttggaaaaaatgtccagaaagcaattcagagtgaaaatatttgctttctggctaaatagccagtagctttttattgcaaaatggaaataaacagtactgctcatttataccaaaaaagggcaatctacaaataacccaaatccaaaaataaaggtattgcccaacagactaggacatgattcactaaggtcttgacttcagagtttcaccaatggtcatggcacatggattagagtgggctgcggtcgtgattagtattaatagtaaaaagtctcaaatatgcccaagtccacaccccagaaggatatgggccacagtctgtgtgatccttacccttcactctatttattgaacagatgcattctctctctcgctctctctctcaccctcatcccatgccctgcgatgctgaagacccatgtccagaccatatgcagtgaccaaaataaaagaaaatcacactgaaatgaactctatgaaattgttctctttaatagccaacagtttataaaagagagtgaaaaaataaatacaaagctaataatgcttacaatgaggagacagaagttggccaagagaaagaaagaaatcataatagtattcattcattcaataatgcattaaatacctactacactgggaactgcagatacaaggaataaaatatatcatctggtaagaaatacgggaatcaacagatatatcattctagatgttcatgtataaactgatattttacatccaaatagcactttgaaggcttcagagacttttcagccacatatttcacctgatcctcataacatcatttagatatagatcaggcaggtaatatatgacactacaaagtcagaaaggttgatcttctttcaaacattctgttaataaggatgagaacagagattgaatctctggattcttgtgccaccctctatatatctagaaaatgaacagtaatttagtaagaaatctttctgtgtcgaatcactccaaaaatagctgttcctctggatcccatagtctgcactaattagtgtattagagctatttttggagtgattcaacacaataagatgacaattataaggaagcttgtttgttagcttttgatgatgaccaacatatatcatcttgtttgatgatgattaacataatcaagcactaaagaataagctacctaacatccatccttgaactttgtatgtaaactggagtcttctcaatcctctagaatttgtctgggtcactgccattccagaatctactcatggtaccttctgtatcaggcaggttttattctctgaggtttgggctctagtttccacccacattcacaaacaatgggcacagtcacggaggctctgaatgcaaagctgtggactcttctcagcatttttgtggttgtcttggacattcataaggatccaaatggaccgggtactttgacttagcaccagtctctacttttaaactattcaaaacatccctgtaaaacttagaaatggctcatggctagggttgtattaatcaaccttgggtttttaataaattctgtttgttagcattttgcaattctagaatttcacttgcccttaaagctaagtcataaagaatggaataattctagactacttttactgcacattagatgaaagacttcctcccagcaaacatatcactatgtagaattagtcacagctactagtattaaaaatcccagacagaatttggaagtccaaattgtgaattattatccgttagttcatccactgaaatcatacttagaatctactatgttccaggtgctcttccagacacaagagccccaaaagtatgaagacagtcaagctctccactttcatgaggaggaaataataaccaaggaaaaatatgcaagataattacagttagtgtgagtgcaaaaacacaataaaataagatgatatatgaagagtaggtagggaagaggactttagatcagatgatcagggaaggactcgagtaagtgacattggaggtgcacatgaggttaccagcacttggagatttggggcagagcactttagccagcaagaccagcaagagccaaggcttggggtagaactgagtctgaaactacacctagagcatggcaaacaaggggcatcgctagtccaagaggttagaagtgagctgtggtaaagagatgagatctttgtcctaagtgtaatgggaatccactggagaatttaagttaaggtagtgaagttatctgatttcagcaagtggaccccagaacccctaaatataggaaaagatgctctttaggaggcagttggcttattttcctgatgaatggaaatgctgtgtctgaataacttgcaaaagcaaagtggaaaatctgcaggtgccactcttgagtgcagagccttgctatttacttatggatcccagaggtttctgacgtggtcctggtataaaagattctaggcagctgtgaagagtgagtccaggggtagccaatcccgagttctgtctgggcatgtatcacagccacagtcacggaggcaagtttgtgaaggtggcttaacacacagcatgagtatcccagcatcgttgctgaaattgcttcctccctgctgtctcccaggaaacagactcactgacccaatctttttctgcatttctaatttctgccatcaatggccagtgattatctaaatgggattgctcaagtatgtctttactgtattgaagatgaaatagcagccacaaggcattttttaagcatgaactacctttagtataaaataaactatttcatttattcagctcatcatctgttatccttaaacagttccatatgcattggtttatatttgatatacaagactgctgagccatagcacccacgtggtaacagcaggcacacgttttaaacaagcttgatgttactgccctataatatcctgccacagagcattctttcctaagagtacaatgctctttgtgaatatcacctcattaattctgggagaggcagtgacaatccctttccccgcattttacccgtaaggaaacagaaccacagagagattcagagtgagccaagatgatgtgcagttacttgatggcaggatcacagataaattcctcatttcatttgaactgaagactttacatcctgccccacccacacgatgccaattcatcaagccctaacgaataaagctacctaacatccatccctgaactttatatgtatcctggagtctcctcaatcctctccaatttgtttgggtcacggccattccagaatctactcatggtactttttgtatcaggcaggttttattctctgaggtttgggctctagtttccacccacattcacaaacaatgggcacagtcatggaggctctgaatgcaaagctgtggactcttctcagcatttttgtggttgtcttggacgttcatagggatccaaatggaccgagtactttgagttagcaccagtctctacttttaaactattcaaaacagccctgtaaaacttagaaatggctcatgactagggttgttttaattaaccttgggtttttaataaattctgtttgttagcattttacaattcaagaattccactaccttatgtctcaaaataaagttaaattttaagaaagtattttccatcttgagtagcctaccagttactgttgatgtcaatgatgccaaatttttagtgacttgtttcaggtttgatgaagctcatgatgacagctgtcttttgtggcttgtagaaaagcaaaggaaatgcagaaaaaagacatctgatctgaaattacttggtgggtaaatgtgaatttgatatctgtgagaagcaagtaatattccagttgtcttcaggttattttctccagcaattttgcaccatcgctacatctctaatatcactgtaggttgtctttctcagtgtgaaaaataaataatgaaaatctctaggttggactaaagcaaaggacaacaatgggtcagccacatcaatctcccttgtgctctcagttctcctcaagtatttcgttttcatggcattcctcagtccacctaaccatctgggcccataaacaaaaatattcattagtcccttaacaaagaaaccttattcacatggttccaaagccatgagtacattctcaatttttaaaattttttaattaaaaaataaaagttgaatatatttatggtatacaacatattttgaaatatgtatacattgtggaatggctacatcaagctaattatcacatgcattgcctcacatgcttatcatttttaggggctgagaatacttaaagtctactctcttagtaattttccagtgtatgttgtacaacagatctcttgaatttattctcataagtgaaatgttgcaccctttcacgagtatcttctctctgcccccatcctctagaccttggtaaccatccctgtactctctacttccatgagttcaaagtttttagattccacgtataagtgagatcatatggtatttgtctttccatgtctggcttatttcacttaacataatgtcctccacgtccatctgtactgatgtaaatggcaggatattcttatttttttcaggctgaatagtatttctttgtgtatatataccacattttctttatccattaatccactgatgcatttagacatttaggttgatttcacagcttggctattgggactaatgctgcaataaacgtgagcatgcagatatctcttcaacatacttatttcatttcctttggatatatacccagttgtgggattgctggatcatatggtaatcccatttttaattttttgaggaaattctgtactattttccattatggctatactaatttacattcccaataacggtgtgcaagagttcctttttccctacatcctcaccaatagttgttattttttgtctttttgataataaccattctaataggtctgagatgatatcttattgtgcttttaatttgcatttctctgatgattaatgatgttgagcacctttccatatgtctgatggccatttgtatgtcttctttcgagaaatgtctactcaggtcctttgtccacttgtgaatcaagttatttgtgttcttgctattgagttgaggtccttatatattttggatattacccctcattagatgtatactttgcaaatattttctcccattctgtagattgttccttcactctgttgtttcctttcctgtgcagaagctttttcgtttgataaaatgtcatgtgtctagttttgcttttgctgcctatgctttgaattcatatctaaaaaataattgcccagaccaatgtcatgaaggtttcctcctatgtttttttccagtagttttacattttcaggccttatgtttaagtttttaatccattttgagtagatttttgtctgacgtaagacgggggtctaattttattcttctgcatgtgaatatccagttttctgagcacaacttagcaaagtcttctctccccattgtgtgttcttggcatctttgtcaaaaatcaattgaccatgaatgcatgatttatttctgggatctctattctgttctattggtctatgtgtctgcttttatgacagcaccatgctgttttagttactatagctttgtagtagattttgaagtcagatagtgtgatgtctacagctttgttctttttgctcaagattgctttggctattcagggtcttttgtggttctatatgaattttaggatttttttctacttatgtgaaaaatgttattcacaatttcatagggattgcattcaatctgtagatcactttgggtagtatggacgttttgacaatatcaattcttcggatccatgaacacagaatatctttctatttatttgtgtcttcaacttttttcatcaatgttttatagttttcagtgtacaaatctttcacctctttaaatgtaatcctaaatatttttatagctattacgtatgggatcattttcttgatttcctttttaggtaatttttttgtaagtatatagaaatgctactgattttcgtgtattgatttttgtattctgcaactttactgaattcacttattagttctaatagatatttgctgaaatctttagattttctaaatataagatcatgtctgcaaacagagacaatgaactttttcctttttaatttggataccttttacttccttcctttgtctaattgctctggctagaaattccagtactatgttaaatagaagtgatgagagtgggcatcctggtcttgaacctgatattagaggaaaaatctctgaacttttcaccactgagttggatgttagctatgggtttgcagtatatgggcttcattgtgttgaggtacatttcttctataccgaatctgttgagagtttttaatcaggaaaaaatgttgcattttgtcaaatgctttttctgaaactattgagatgatcatatggtttttatcccttctgttaatatggtgtataacatttattgatttgcatatgttgagccatccttgcaccctagggttaaatcccatgtaatcacggtgaatggtctttctaatgtgctattgaatttggtttgctggtactttgttgaagatttttgcatttatgttcttgaagcatactggactataattttctcttcttgcagtgtccttgtctagttttgttatcagggtaatgcttgccttgtaaaaagagtttggaagtattccttcctctttggttttttggaaaatatgagttcttctttaaatatttggtagaattcatcagtgaagtcagcaggtccttggacattctcatttgaatgttccatttttatgatgtcattcattgagctacaaaagaaccacttgatactagtgtccaaattccagtactttaatgaggtacacagattctcacctaaactctttacatgtacactactctttaaagatacttaaaataatcttaaactaagtgagcagtggatagaattgaggtaatcctgacatagtctacatacaagtgctttcttacagcaaaatagaaacaacagaatctgattctatacctaggtcttgtttcttcaataatctttgagttaatctgtcccagaattaatgcctgtgccattgcccagaatgctgaatgaccctggccgatacatgttgacttgctcagaagtctcttcaggggaagctagctaaacatgatctgggagaggactacgcttgaggacgtatcaggtctctacttttcatgtttttctcttcccattctactttccacaaaatatccagagattcttagaagggccaaatgttgaaggtggtcatgcacaggcctagcttgattcccagccagggtaggagttttctaaaaatactatccccatcagattcctgatacttataagtttaaaagttgaacaaaatcttatatacacaatgtataatgagtcttaaaatgttatttcctaggaaaaggaaatctatgatttaaagttaaaccaaagtataaatatgtggtatcagagataaggaaaatcatggtcagaaaacctgagtgcagacctcaattctgcgacttttccccatctttgtgaatctggacagtttatatatcttgaatcttagcttcttggtttgcaaaaaaaaaaaaaaaaaaaagcataataattaatgccatggagattttataattaaagggagaataaaactaatgcaccaaactaatataatcaatattgccaacaacgaatgatgtttagtcttcattcttactttatccattagcagcatttgatgtccttgacccctctctgattctcaaaacgcttttttcccttggcctcctggatcctacactctcctagggttttatcttcctcctttgactggttgcttctcagttttctttattgtttcctcatctttctggcatcttaacatctgagtgttctagggctcaggagtaggaaatcctcagcagaagcagactgcaaagtcaaacctttcaagcattcagaaccagcaaagtctgcctgtgggcagacagaagagctgtccactatgtagtgagaataaaactctacccaaatgtagatgtctgctaaactccaacggtgaaaggaatgggatgtgaccccatgatcaggattacccagaataatcctcacttcagtctggccgacatccacaagtatcttatatttggcccacctcgaactgaggaggactcagacacatgttactgccccagcctgaggccatcaaagaaaacatctcaaagattctcttttaccaaaaagattcatgtcagattttcagactaaggcccttggtactaatgaattttgagttggagtggtagccttggcaaaataatgatgacaattcaatttaggcctcctaatatgtggatgttcctggaggtggaggaagaaaacttggacacaactggaatgtgtgttagacagcagaaatagaggccatgaccagcttaggccctaggttcctgagatacaataattcttctgaaatggtgtccttttactctgtcttcctagaagaactcagctctacaagttttaaaacattgctgggaagaatgatctccattttaaattctggatacacggagctcaagatggcaacaaatccaacactaaagaaaccgatactccttaggcacttactttatgcctaacattgctatgtgtgattcacatgttatctccattaatccccataattacagggacacactagtatgacccccactttataggtgaagaaattgaggctcagaaaatggttaagccacttactcaaggttgcccagcaagtgatggagtcaagatgaaaataggcaacccgattccatagcccacatgctccatggccctggtgctccatgctctgtgcacagactggctgaggcagagctgcaacaggatccctgacagctaaagttgccattacaatgatgattcgtatccttcatttaaatatagatgaacaccacaaaatgacaaatgtatctttatgttaaaggtgtgtccattatgatgcaataattggcccttttagcattttcattgccacgaatcacacattatgtaactattactaagctaatcccactaaagcctattaatgtcagaaagacttgggtgtttcactactaaactgtctctgaggatgttttaacacttgttcttaggctgcatttaatatctgcaattatggggaaaggatgccatgaaaactatccttaaatccttttttatttattttgttttgagatggagtctcgccctgttgcccaggccggagtgcaatgtcacaatctcggctcactacaaccacctccacctcccaggttcaaatgattctcctgcctcaacctcccaagtagctgggattacaggcgcccgccaccacacccagctaatttttgtattttgagtagagacggggttttaccatgttggccaggctgggctcgatctcctgacctcatgacccacccacctcggcctcccaaagtgctgggattacaggtgtgaaccatagtgccggccaaatccatttttaacacaaccaaacaaaacatcaacttgattgagagctccaggacattgattgagagctgttgccatatgtttttaggctccagtatatcaaggctaaagtgctcaccattgctagaggacaaaaacacacagcagctgctcagcaatgcctaagcctgtggcccaagtcgaaaagaattagaccaagtattacagtaatcaggcctcaagcaagcaaaagcctggctcaatactaagaaccccctactaatggggagagcacacctccatactccggtgcctggggaaacatttcccaggagtgtggtggtgttctgcctgctgggagatagataccattaacctctcttcttactatgtttgaactccacttgcactcttatctctgaattttgtcttgtttccactaagtattgcttgccccttcttcttcatactcaaaaatatggatgtaatatacctgcctctaaggcccctttgaaagttcatcttcacccccaagttaaacagaaaaccctcatgcatgtgtgcagtctgatttcatcttatgtggcgctcctcctactgacaaaatatgttctcactctgagaagtttccctgtgccgctttagtaataaacaaatccacctgtgtttgcatcctaggcgttctcagtgtaccacacttgagctctgcctccccggttaggcatctgctctggaagcacgaggaatattgctttcagtcctcttatattcctgatacccttgactttgcaaggcctagcaatacgcggcacttactataaattaaataaataaaaatccatttaagtcaatcaaaccaacagctctctgtttctcctgtgaaatggagaggcagatgagtagcccagcattctgcatggttcccctgatgcactctccctgcccactgaagcagccctgcagttccacccagtcattccctgcttctctgcaccatagtgacgggtccacctagaaggaaactccctttaaaagttgctccattaaactgataagaacagatactacacttgattttagccaagaggatatggagaaataggaatgcttttacactgttggtgggagtgtaaattagtttaaccattgtggaagacagtgtggcgattcttcaaggatctagaaccagaaatactatttgactcagcaatcccattactggatatatacccaaaggattacaaatcattctactataaagacacatgcacatgtatgtttactgcggcactattcacaatagcaaagacttggaaccaacccaaatgcccatcgatgatagactggataaagaaaatatggcacatatatatcatggaatactaagcagccataaaaaaaggatgagttcatgtcctttgcagggacatggatgaagctggaaccatcatcctcagcaaactaacagaacagaaaaccagaaactgcatgttctcactcataagtaggagttgaacaatgagaacatatggacacagggaggggaacatcacacaccagggtgaggggctagcggagggacagcattaggagaaatacctaatgtagatgatgggttgatgggtgcagcaaacctccatggctcgtgtatacctatgtaacaaacctgcatgttctgcacatgcaccccagaacttaaagtataaaataaaataattataaatttttttaaaaagttgcttcattctggggacaagagaccaccaagctgttgcatgttagaacagacctactgggaggcagtagagggcactgtggactcatgcccatgacacccccaataagcacacctatggcaaagaggaagtgcctaagtccacaggtctcgagtttgtagtgcgcatacctcctgcccaagtctattgctgctgttgcttagccctttcaatattcttttcttacattttgtttttcttaactgtatcaaagcttgtgaaaaattcatatcagttatttcaatttttctgaaagattcagtaaatcagatattgttttaaaacaatcatcaccaaagccacgtggcttagtgaggattgttttaaaacagtcaatgaggaagttaggaaataattcttcatctccagacttaattgactaagtcccaaagattattaccctatattatctcttaaatcacaccccctcttacttaggacaggaacatacccctgaacaacagtgctcagctgagggggtgaacaaggctaaaacccagccaatcactgctggcaaggccttgagccctggctccaggctgcacctgccttaggaaggggcgtctctctacgacactgaatggcctcctgtggatcaccacagacctgctttaaccaccttaactgcaaccaccttgttcttggcccttatttatacgttgaccactatgaccatctcctaacactcctagaggtaacttaaactgcatacacacacatatattcataactgaacaagctttatgcatatttacaaattaaatgtgccatcactgaaattcaaattaaaagcattaatcaaatgtgaccaacatactgtttgactaaaattgaacctcttctgctccagggaggataaggagctgacagctatgttacaagatctatctagttttgtactatatagaccatgtgttatgcaatgactcaatatccaatcaatgttttctctgataaagtccttccaaactgtctgttggcatcatttggccattatgaagtttatgtttgttttagtctcattatgtggaaacagttaaagcagtcctactggaacccaaataatcttatgttcaaatgtctacttggacttaaatctcattttagtacacaggcaataaaataatgatcccgataatccagatccagataatccagaaggtgcttattgtagttaaacataaacaaaagtaagctaattgctaaatttagagcccaaaagggccagaccaccatcatacctgaatttatagatcaaaagaaaccaagttgaaatccaactctttccttacaggttttaatattagatggctacaggaggactcaggcttagaaaacaccacttctcatgcttatggtattaagccctcctttcagtaaataaggaaggggatatatcctccatgagaaacttaaataaatatagctgttcttccactgacctatatttcctatcagagaacaccaaatactatgtaaatagaaaataactctactgttgagataatctataagagggtcagcaaaccatagctttagggccaaatccagttcttgccttgtttttgtacttcctgaaagctaagaatttttacattattaaaggattattaaaaatgaatttataatggagacagtatgataggtcacaaagtctaaaattttctaccctgtctatgtaaagttttccaaccactgaactagataataccctaataaagaatattaccaatgaaaactacatagagctattcatcatttctatgtaaattcactgtcaaaaaatgatcatcagaaataagatggacatattttaccatccatgaacttttatttcttggacttctatgtaataagggttcatcagtgaatgtccatgtagaacattttttgtccagtcaagtctaatgtgtttaaactggccagtatttgataagactaacatctttatcacagcctccatcctgaactgcttgccttcatccaactcaagccccattacctaacgttttcctgaatgttagtcctcctgagagctcaatttgccctctttgggcagcattgccttgatcacaaatctgctgctcaagaccccttttctggctctgatctcaatttccatttgcaatcactcatttgattatgctcttcagaacaaaccaggattgtctcactaagtctagcccgttcttacaagacagttcttactgtacttactgtacaatgcagctgatgaatgcccatactgggatgaagccaggcatactgtcacccagtgacttggaaatttaatactcaactgatgatgccaggataggaagccagccaaactggctcagtcaaaacaaaaatcttctttcctttcttttgatttttgctccaaaatggctaattcatttgatggggaacttgagttttctttatagagtgaaattgagaaagataataattaattttgaaaatatatacagaaacattggagctctaaggcagtctgaggcaatgccttttaactaggagccagagatccctatgacaatgcttctcagtgtttggtccagctcacttaaaccagaattctcttgagtgcttattaaaaatttggaatcctgggactaactctctaatatctgatgaatcagaatttttgagaatggagtcccactattattgtggttgataaaacttctggaccaagacttaagaggccaacatatggtctttaggggattttcttatccactgaaattatttgcaaaaatacatgatggttgatggttcgaagtgcatttttctaaaatgaccctattcatcttcatcaaattatcaaagcaatctatagtttgaaataagaatcacttgttttaaaggaaaataaaattgaatcaaaatacaaagcttaaatttctctgagcaccatttcctgcatgactggtaagtcttgccttctctgggaagccattcttccttcttgcccatgtgccatacagctcttcatacataccagcagcttagacctccaggaatttccatttcacccagggaagcagctttggtaacttctctttgagatcagagctcccgtatggtgaatctggggtctcaatttactgttctctactctaaagtaatttgtatgaagtgaatgattgtccatgtctggggccacagggcctttctcatgggccacagctggccccatcagcttctaacacctatgagggaagcacagctgtggggaaagtattggactgttcagattttcctcctcagttggtgaggccactcactttatttctttgctccagttcctctttagtgaaataatttttttaaaaaatccaactctacttaccaaccaaagtttataagaataacaaacattagagtgagaaaggtagagattgtccagttgctacctaaccccaagctatcaaagctcagtgaatttaagggacccttgcaaagttttcagcttgataaaaactgtaagaactgtaacatcatttcattcgatcctcaagatgctccagtgagagatgcactagctgattttatcagatcatttagctctttccacttcattaaactagctcaaaaaggtataataaatatgcaatatcttcgacaataaaaggcaagtataaatataatgcactgttttactattatctcacctgtgactctgaatttgacttctgtttccaaatggaaataaagactcatcagccacatggtgtaataaacaggaggagaggtagccatctccctgtggaaaaggaccctttcttaggccactttcctaagtgccattgatttggtcactccttcattcctctctgagcaattatctgaccttttaaaacctgatttctcataaccaggcttcctatccacaaatcttgcctcaaccttttatgatatttgcttgaggtaataccaaacttccttcccagagttcatgccaccgggcaatgtagaaggctggaggagaaatgaggctgacgtggaatataaaagtcaaaaaaacaatgaggcaatgtagacagacaaaatctgacttcacacattcaacaaaacttctcattcattaacaagctgacaagctgatattcttgatttaatatgtatgtcaaagtagccacctgcttaaagccaaacaaggctggaaagagaagaagtaactgtgggctaaaaaccttggcaaaactcaaaatcccaaccactcaaaataggatattaacttattagtcatgtgagaaacattatgtcttcccataagtgttttccacaaactgactggggaatgtacacagaaaaggataaaataaaataagcatacagactattaatagtataaactccatgaagtccttaaacagaggatgccggaacatacttcccaaaccagtgtgtgtccctaaagaaagttcatattaaaatcaagttgaggctgggcacagtggctcacacctgtaatcccagcatgttggcaggccaaggtaggcagattacctgaggtcaggggtttgagaccagtctggccaatatggtgaaaccttgtctctactgaaaacacaaagagtagccaggcatggtggtgggcacccataatccaagctacttgggaggctgaggcaggagaactgcttgaacccggaaggcagaggttgcaataagccaagaccgcaccatcgcactccagcctgggtgacagagcgagattccatctcaaaaataaaataaagttgaatgtttgagtttttggaaaggacccactgtatatattctccactaatatccttgaaactttatactgtcagctctgtcctcagttattttgagaatgattaccagaattcactccctttccccatcctcctccctcctcctcctccttacctttccccaaccacagatcttggtttaaatattcttcacaagacaagcaaaataacaaatacatttgatggatttcattctgctcctagaccttgtgacataactgagttaaacatattgctaggagaagccaaaactagcaacagatttgtgttgcttacaatttttaagttcatattgaatgcaggaatgctttgttatccagatttaatctatcttagaaagtctgctagtgaatttatatattgggactgtatgtttcattattttaagtggaaataaaacagcaatgtgttcccaacccttctaaaaattccaaccaatttcccccaagcatcactaaaacactttgcaacatctaactaacaattcaccaattgtctaattatttattacgtaatgtgctccttagtggatatgtttatatgccagaccaacagtaatacacagttttcaaatattattacatcttccttctacactgcaacaaacatgtactctgatataaaggaattattaaacaacatgctaaagttagacaatgaatacaaataacacgtagcaagagaaactaaaaagtaaggcagtttttaaatagttgcttactgactgaagggttgcccgagcaaaatgtgactacaacaggggcttcttgatggtatatgaaggtgagcaagagtgagctagtaaaagagagacagtgggcatttgagttcacccatgtccaaatgcaaggagctgatggacggccttctcctcctgcatttgagaccccagaagtggtggttatggactaccctctgaagctatagacacactaatacataatcccttctaacctcttaccaatgcatggtcttctctagggctcttgggctcactactttcctcacagacttttctacatccttagaagaatatttgatttaataatgggggaagatgcaaggggattcagaagtgaagtactccatgtgtccacaagtagagaagaaagatattggtaaaatctagaaatgtttataatcaaccttaaaataatataatggataacacacacaagagtggattatcaaaactgggttgctctacatttaagaaaaagattaatcctagagacttacatgtgctatctaggccagtgaagggaatagaccattaaaccagatggaggactcagtcagtgacatttgaccctgacaatcaccatcatacataatttgtatttacagaaaaacttatacttccaaaaataacattatctttctggccccttaaaaacaacactatcatgtgggtaaggtcagctagtattttatccattttaaatatagacattatatattcataaaaattaatagacttgcccaaccttacacaacaagtcaacctaagaaataggattaggataccagcctcgacacctagtttcatgctacttctcctacaaaaagacaaggatggtctcctggtagcagctatacaaagcaaaaggcttcagggttggtttctgcttttattttgttgggtggcaaaatgttgagcccttttgggcattctgttctgaatctgcctatggtagatttacctctggcatcaagtgacctctcaccttcctatgattcaatcttaagagttggtaggaacaaaaaaagagaaaagaaaaggttccctattgccaatagtacccgactactgtcaatattaattttaattagtgcctcaatattatcaaaataaaaataatttgtttacatttcttaaaaaagaaaaataaagccgggtgcagtggtgcattcctgtaatcccagcactttgggaggtaggaggatcccttgagcccaggagtttaagactagcctgaacaacacagcaaaaccccaacttcacaaagaattaaaaaattagctgagcagagttgtgtatgcctataatcccagctactctggaggctaaggcaggagaatcacatgatcctgggagatggaggctgcattgagccatgattgtgccactgcactccagcctgggtgacagagtgagatcctgtctcaaaaaaacaagcaaacaaaaaagaaaaataaaataagaatggaatcacatgagaaaggctattttttaattttattgtgatgactgagttcataaagttttcatatctccttcagatttgagatggcatgaaaggttgaaggtgccatgctttagatgtggtttttccttgccagaactcatgttaaaagttgatcaccaaggtggcagtgttagggggtggggcctaatggaagaggtttgggccacagaggtggatcctcatgaaaagactactgccttcccatgggggtgagggagttctttctcttgggggagtggacttgttcccacaattgtagactgttaaaaagagcctggtttccttggtttttctttcttggcatgtgatctttttgcagatgcctgctctcattccactttccatggtgaatggaagcagcatgaattcctcaccagatgcagctgcccaatcttggactttgcagccaccagaatcatgagccaaataaacttcttttcattataaattacccagccttaggtattgtgttatagtaacactaactggtctaagacaaatgtcagtaatagcaagtcagccatagaaagcacaacagtagtcacaaaattttcccacttaaaaccctgtgatgaccaccctctgcctagaaaatgaagttcaaaattctaagtacaggcatagaaaatctcaccctccctgactttttcagtcttgtctccatctagttcccaacacattttatgttctcggctatgtctcaatgttcgtacacctctgaagattctaggaatgtcacatgtagctttgttcttggtttttccctctgcttggaatggtcttcatcacattatacatctgtcagggcctttgttatatttaaaattcaacctctgtgtcactttttggacttcccatagtttccctcattgcagcataatcaacatccattttggttaaccacacttctttgcggcttattccttcatcataagattgtttatttatatgtctcaaccctctatccctcctcacatggataatgatctttatgcaagtggggccacaacctacttatctttatatcctcaaccccagcacagaggctgggccattttttttttcctaaatgcaatgaacctaatgttccttttatttgattttctataattgttttgggaagaaataccagtgggatccacaattgtggacctttatgtattggttcaacaaaatcagttattaagtatatgtcaataaaatcaatgtcaaaacaatgaaaagccaaaatcaatctgggtattgccaactcgtgcctcgtggaatcttactcttcagcgagaagcaccagttattgctggtcaattggtctacagtcggggtaaggagaagttcttcccagtcactttgagtatgaacaattatggctgcaactaaactctagccctaggagaacatttttttttttttttttttttaagacagagtctcgctctttcacccaggctggagtgcagtggcaagatctctgcttactgcaagctccgcctcccaggttcacgccattctcctgcctcagcctccccagtagctgggaccacaggcgcctgccaccacgcccggctaatttttggctaatttttttgtatttttagtagagacggggtttcaccatgttagccaggatggtctcgatctcctgacctcgtgatccgcccgcctcggcctcccaaagtgctgggattacaggcgtgagccacggcgcccggcctaaggagaacattcttgaatgtacattatgtcagatcactaaaaaaaaacaaaagatataagatacaaaatatagacacttttgtcctctgctttgacaagactacaaaatgtaaacaaatgcagaacccctcattgctacgacaacctctaatgatctatccctctaaagatcatgccaaagatactcaaaccctgaagcacaggaattcatctagggtccaaagtcaacatagagatatggttccatttgaatgagagatctaaaaatgcaaattatctggagcatttttcacatagtttgtgatatacttccccagcttatttttggcttttgttacaagaacttagggaacggcccactgagggctcaggcatagacagatgccttggaatgtgcctgcacagtgacagaatttctgacaagtcaggatctctaacactggaaacagggttcctactgattcattcactcctaatatagctccagggggttcctacaggatcccaaagccccccactccctccgccacactgcagagtttaaggatatgccctcatagctacatagctctgacccaaagcccttccatgtggaaaacactaatccagctagttgccatgtttctctcactgggatgtgttcccatttctcctcttgtttagtgttttagaagatatgagaagggtacctgtctttgccctgggaggaagacatttttgtaaatgtcaaatggacatttgatagaagaacttatttaaggaatcttgaattacaagcaaaggggcatgtggagggggaaagatgaaatcatctacaagattttaaaagtgaaccaactacctgaattataaaatattatatatataaaaatatttaattataaaatgtaataaaaacttattacagccagacctggtctttggagagggatataatccgctgaaatggagaatgatcacccactttctacccacagattaactgcatatttcttatgaatatgcaaagtggctactccatactgcctgtatgtgtagcagggaattgatatttgctactttgaggagcctattttgatcacagtgatatgtgtacaacctgagtatactcagatattgaccattccagaaagaaaagaaaatacccttgatgtctctcctaagggtctctgctttttcagaatgaactttattttgaccgatgagatgttctttagtgggctcataatgactgagcaccacataagaggatcaaagcatggttcagctagttccctgtggctattggtccagtggtggtaaaagtgaatattcaaatcagatatttgaaaaaatatctcaaatcatccagaaatcaaggaaatgatatttcaacagaataattgtgtaggcagcagagcactgaatcatatcatttattttgacacaaattatattaatatattcatattaatatattattaattataaaaatgtttaatatattaataaattatatcatttattttgacataaatgtggtctcttatattgacctaattatctcaagtgtattttgattttattttctttaacagcactaaacatagtactggatggtgtatttattttttaattaatatttgtagaaataaattaagctggggcacattctcaggagaaagaaaggggtagcactcaactggggctcattctggtgcctagattttatttggctctcacttgcctttggattttgctcaagaagaacagggaaaagaagagctatgtcagtaattaatattccataacctaaagtaactgaactttagcagagaactaaaatctgtgcttagaggatttatctaaaggtgttttacgggcagatggtgccttctacatcaatcttcataaaattagaagtacagtgatttcaccccctggaatccagttcacactttaaaatcagacagagcaggatgctaatcccaaccctgcacttgccagcagtgtaacatcatacaagttgctaaagccttttaggactcagttttcctgtatgtgaaatgggaggaatgatgtttctgcctccggcgtggctttggaggattaaaagagatagtacatgtaatatactaagcacctatcacataataaatactcaagttaatatcataattattcttaaagccaactaaagccttcagtcccaaacttggtttagtttactgatcacaagatgtccaggtgctgacctgggtctggcctgtaggtaaggatctcattgttgatttcattcttctatctctctcgactaacacaagatcttactaaggtgaacagttactagtaattataataaatgcaacaggcaatacaaataagtgtccagattatgaaggaaacacttatagaagccttgaaagacttaattacaataaagcaaaaagttgtattcaaaactgaaatctaaattattccctaatctactggcttctcagcctccaaacatgactatattaataaacattgtagactgaccaattcatacatgaaaatattagcttctgccttcactatttataatgtttaattgttttgttaatgcacacaaatgggacattgatccatgaaattctgtttgatatttgagtatatctgatgttataatcccaaatcccacaagacatatctgctttgcccctgagggtgtactgccatgtaaaaatgcccagtattcactcctcactttatcttcccaagatttcctccaaggtgggcaggactgcccttatgaatatgctcaaacagaactctaaaggagactgtttttctctcgacgaaccagcctgggtttccatattcctctcacctcacacttggcatctgcccaccctcaggtgtgtccttccaggagaacggcttggaaaactacagagagtaaatgccttcagctgaattatcagccaacacaatctgaatttcacatctggaatacctttttcagacccacctttcttacataccacaaggaataataactatgtctgagttgtgcaaagagagtaataatgtgtgaattttttttaaaatttcataagcagaaggatttattaatggatgaatgtattttcagtcttcccctccttcccaagggttctttttttccactggcgctttctttactacacttaattctacctatcataagttaattggccccaatccatggacaataatacaaaaaatgttttttatattacatttttataatgggaaaaaaatgctttttaaaaaacttttttttgttttgttttgttttgttgagacagagtcttgctcttgtcccccaggctggagtgcagtggtgcaatctcggctcaatgcaaccttggcctcccgggttcaagtaattctcctgcctcagcctcccaaatagccgggattacagacacccaccaccatgcccagctaattttttttttttttttgtatttttagtacagatgaggtttcaccatgttggccaggctggtctcgaactcctgacctcaggtcatctacctgccatggcctccctaaattgctgggattacaggcgtgagccaccacgcccggcccataagtaatttttaaaagcatgtatagtcttggttttctctttgacatttccatgcctctcccgttcccctttgcatctcattggtgccattcttaagctccatcaaaggctgccatcctatgtcctatgtacctcgttccccaacagaggggcaaacctctcttttcctggactccacactgaatttcttctgtaagcttcaagaaagaattagatcaaattcagttaaaaatattgccatctcctttgaagctcttttggaaaaaaaaaaaatttatttaaaaacttacaatcactacccagaaattatactttttgaactcttctcaaggtctgcctgtaccttgatggatttctctcaaatggtgtcgtatcatgctctcttctcacgtgccacattatttagaaagaactcaagtgtttcaggagaagagaagtgctcacaagagaatgagattgaggaaagcacagctatatttttaccatcgtcacccaaacccccaaattgatgagctaatctctctgtcagacttagctcatccattactgctacatgttgggtgtttttatctccagccccaggacactgggttgtaatggaagtacctctgccaagagatactgatagacagaaaagaggtaggaccaggcaagcaaagcccctatctgatgaggcaaagtacatttttggctctaatgttattgtatgtaaagtaggtcaagaaagttatgtgaattttaagacagaaaaggagatgtgtttacactggtttatgacatggctaccagatgcaacttgttcctgtggaagggaaaggaagaagaaccatgtctcagtttaaatatttgactggttcctccaaaagctgttaagatgacaaagaactaggaaagcgcagagggaaaagacaaagagaattctagaaacttactccagacttggaaagaagtgtctaataaagggggaagaaaagcatctcagcttgcaacagcgattcattccttctcacaggctctctctcctcacttccccatcatcaggcattgtgtacgtttttcctatgccccatctgagagtctccttatgatcaagtcactggatttgacaatatcgttacctggacaactgaggtatggaaaacagagctgcagttcagataaagcttcaacagaagttctcattgttctcccagttaatgtccaccaccgtacacacagtagttcagattacatacagatttccattctaaatgagctcctaattaaaaataaagccctccctccatctgctcataactctcacaaacctttttttccctttgagctcaacctctcaagctttgtctgtgcccaaatgcagattacactgtaaagtctgcagtgctttggcatgaggtaagagtgacagaatgtatttttttaacttgattcttttaaaaaaatacagtctttgaaaataaataaggtgaaaataactttacatgctacctgcatactttgcatgttacgagttcagaagaacagctctttgtccaaaaactccgtcaaacaggaaggctcaaagctgattttgacgcacatgttatctattaaatttgtaattgcaaaatgtccaacgtgactcgaaagtgtgaaaaggtcattgcccaaccatgtggtgctgcagcttgtatctgatggggagagaggggtatatgtgaaaattatgaagcaactcaaaacggtttaggcagaagcagcttttgtcccatacatagagagaagagctttgtacatacccccttgaaattgcagaaatttgactttgctcaataccacagtgacaaaacttggacatagggatttccccttttcatctgtgcagttggttaactttctatgcattttgtttaaaatcaaatattaaaaattccctttaaaatatggtaagatcttctacttccatcctctgctcccctccagaacccaccccttcgtccaaaaggacaagtcaagaccaacattcacaggaaaggtaacttcccttgtgaacacataacatgatgcccataagcacagagcaactctggctgctggaaacatttccacagcattgcaaagacctgcttctcttttcatacttctctcccaaagttcaactatatcttcttttcaagtgctcctccttggaaaatcctacatgttttgaggatctggcaagctacctttttatgcatttatttcacctattattcttagggtaaactataagagtagttcctcctaggaaagggactgcatacggtccccttaactcagtccctcagactctcagggtccagggctgtactcagcatttgagttagtcttagaactaaagcaagcctgtgtgatagctcagatggcaccagtcccaggcatcctcacctgtgctgtcttgggaaggcctttctggaggccggactgcactccggcttcctgggagcatgactcttgacttaggacaagcagtgacaagtgacacagggcttgtgcattcctccaatagggctacagtgccagttggttgaggtcaacctaatcttggcccacaagactttgaaagtgagaagagtagagaagatatagccttcttttctgaggacccagaatccctattccttgtattcgttcattctccagcattgcttatcaaaaatagagtcactccatcttcaaaagaataacttgcaagcacaaagcaacttttgaaaaataaattgccctcctccaattgaattcttagattgatgttattttcttggagaagaagttggcaaagtttttattccatgaaacctcaactcatccaaacctcactcaaggatagtatgagtgtttcttccatcacctaaacctgcccatccagacaggttctatgccaggcacagtgaatgccaccgtgacggttaatgtgacaaccaggacttcttgggatatgcctacttgtgaaagacagtgaaaagacatatagcacagaatcatagatttataaaaccagaaacaaacagcaatggccacccagaagagtccttttcagtcattccatcacggcgctgagttttgaaaggtctgtgtggaaaagagtttgtcgttgactgggctgggataaacctgtgtgtgtgtgggaagctgttctacagaaacattttaaaaatggagtttatatttacctgcatcatattttaattcaaataaaagaaatataagcaccaactatcaaaaataatctctgggtttgcttatccacctgccctgttgttcccaagctcccgaaagccctttcagctttactcaacctgtgcctcagtctggctatgaccacccagtaacacactgtaccctttgctgactgtgagcttcgctatacccagtatcgtattccaagaccctattctccaaacgaaatatatcccattctaaaaaaaaccagttcaagtttgcttcttgcaggatgactttcttaacttcataaggtacagatcaaatgacagttacatgtctctcctgccatttgatttccaaaacaggtttcccatgaatccccagcaaagcatatggcccattcagaacttatttcacatgtaaactgtattaatatgcaactcattctagtcgagattaataggttagaagcaaaggcacaaaatcttgcttttctttccttagcatctgtggatgtaaatatggttactgtggatggaagatgggatgaaaaaaaggcaacagactgaaactctgtgcttgctgatctgtgtcctgggattaactagatatttggccttggatagtcacttcctctctgtgagcttccatttcttcatttgttatgctatgaagactgaggtatatgatggatgtataatggctaagtccgtaacaaagttctatgaagaaattatttcattcatttattccagaagcattttctgaacacctatggtgtgtttgcttctatgcttggttcttggaacacagctttgaaaagacaattagaaaactctctctctgattttatgtggcttacagtctagcagacatctaatagtccattaacataccctgtattagtccattttgtgttgctacaacagaatatctgaggctgagtaatttatttaaaaaaaaaaggtttgtttggctcacagttctgctggctaaaatgtctaagattggacagctgtatctagtgagggtctcatgctgcttcttgttatctgagacagggtctcgctttgtcaccaagactggaatgcagtggtacattcacgaagcactgcaacttccgcctcccagcctcagacgatcctaccacctcagcctcccaagtagctgggactacaggcacagaccaccatgcccagctaattttgttttggcttttaacatcgcagtgattatctgcatcaagctactgagtaaggaactacagggctgggaagcctgcatgtaggagggagttgatgttagtccaggcaaactccaccggtaagccatatggccttccctagctgcaaggagaaggctggggggtctcatccagttacatgcctaggaagaagaataaacagttttcatgaaaaactaaactagtctctaccagagggtcaggagaacagaagagatgtgaaaaagaaaaggagattctaaagaacagaatttagggaaggcagaattcacataaaggcagagaggatgaaagaggaaacagaaaccagggcaacccagcagcgttcaaagcgacagaactccgagtgatttttgcaggcatcgtgtgaagttctcaccacatgcacagcaacaaataaggtgaatcttccagaggataatggatcatcagagagtacacagcgatccgtggtagctaaggccatcagcaccacaggagataaactgataacacagtagctaaaagcccctaaaattaggcccaacaatttcagttcagctaagatattcatcaaaaagtctgcattcctggtgcaaaccagttttatgaattggtggctgcgagctgcattcaaaagtaggttggatgttttttggccaatagcatgatttaaacattggaaaaagtcaaatgagcaatgcgaatttttatgttctcttgaataatcaaaagagtaggcaacattggttcctcattcttgaatagcattaatcagaaaatattgcatagcctctagcctccttagagtaggtgtgctctctcaaatatatcatagtcccacagtttatttcatgtatattttctgcctgaatcacatagacatttgaatttgcaacgcctgatgtaaatatataaattcttaccaatcagaaacatagcaagaattcagggacttggtcattatcagggtatgacagcaatccctgtagaacactgatacacactcacacacgtatgcaacgtgagatgtcgctttatgtttactcaagcatctgttttctgtaatgaattatgaattattttgaaagcagggctcagagtacttggcccatagtaggtgctcagttaaggccattacagcaagtttataaccaaaggaatcacttgaaatgataatcaagagaatactgcaaaaggtactgaagtaacacccctgactagaatcagatcctaccaactgtctagatccagagcccaggtagaaactgatacccctgagtgtgtcagtgtacatgcttaccaacacagcagagagagaaagaaaaacatgaggacgggagacaacacatgaaagataaatggtgacaaaaaggactactaaaaaagatttaagaggtcattggcaaaggtaaccttgcctgagcggtgtcctgcctgaaatggtcactctggaagctgtgggtgaataagccattccagcatcactcctccccaaccccatcgaaaacctccaaagatctagagacctgtgcagcaacacttagaggttcccaaagagaccagaaaacaccaatgccacctattggaggaaattccttaagtggcttagcgaatggtttcattaaccactacttatctacattgtagttaagcaaagtttgattgggtagaatggaattgaaaggaactgaattgactttactgagagcaacttaggtagcagatatcctggccctccataagctctatgcaaagggcttgccccttcagaaggcaccaggaattacccaaatcaatcaagtacataaacaagtctcacagggatgattaatccttgttgagaagatgccacgggataaatgatgtgccaacaattctacgggaactctaatagttaaccatacagggagacagaggctctgacatgggctgccagaccaggcagatcgggaaatgctggcaaggtagctggtaggaccaggcatgtctgggctcagcacaaagatgttagcttagcctcctgatatttttcttggacaataatgaaagtcttgctggatgtatctttctattccctgtcatgctaaaactctccttttgactctcctagttttccaaaaggaagagaggcaaagttgctgttttctgaccttttctgggaaaactaatgcagagtcctggtcattttcaggatctgacagtagtttcactcattgattcaatcaaggtctatttattggcaatctacagcaatgtaagtgttagatgtaaagtaataataaagatgtggtatttactctcatagagcttactctctattttgggagaaagatagtaaataagtacacatatatcttcactaattgtgataagtgttttgcagaaaatgagtatggtgtgtgtgtagaaaattacaaaccatgctggtagcttaaaggcttttagaaaaacactaagacctgaaggaaagagggatctggccagaagagcagctaggaagattgttccaggcagggaagcagcctgagaaatcctcaggagtctgggagtccaccaggagaaaacaccaagagcctgaccccagagcagatgtgcacacttgagggttgcacagcctggcctgaaagtgaactggaagaaaaggaaagaaaattaatttgaggcatgtatgtaaccctcaggtgttagggtccttcatgggtttctgggtaaggcagaatggcacagagccaaccagaacccatgatcagcttaccctcacatagaaaagccactgtgcctgctcaaatgaacacacaaagcatccttctcacgcccagaggagaaacatgggtcagaaccagccctgctggaggcagctgggaggatttttgtcttgttcctcacacagcagccagtcacaaggtgctcaaacggaatttaaagggtgctggctgcgctgtggaacaaatgctcacagctagaatcagcagcaggggtaggcaactggcagaagcacacctgcccacggctggcccagctgaaaagtttagggtaggaaatgggtttgagagccaggtagtttattattgggtcacaagttcacatacgaaaaatataaacagacatccagaccgggaggcttttaacaatggacaaggttcatccttttggtctggcaaccttcagaggcatcgttctgagccatttcctttacagtccaaggagactgaagggagagattcattctcattgctatgattatctcctacgtagatgccctcaggcactggatgtattttagttttgttctattagaagtaaataaatttgtttaagggtaatatagcatgtcaaagggtcacctatgtggtaattgcaggccaataggatcaggtccctttgaaaaaatgttaaggaaggcctttctaaagggtaggaggttagggggataccttgaaaaactctaaatcaacagcttatttagtttggcatttgctaaaaagcactgactctctctggcaaaatttggacataaattcagtgttattcatgtacagattgagccgagtaactaaacttagacccagagctttccattctccctgatttaggttttgttgcagaaatagaggctcatgacatgagccagggtgcacacacatatccagcccatgtcattttgcatatgagttaaatctagccagaatccagtggaaggtctgcttggctaggtcagaacgaactttgatcaagcctgtatctccccaactgttcagatttgtttgatatttatttatttgtacgagttatttctgcaacaggagacctttcaacaaaatttctatatctctgtcagagattattctccccatttccaccacctgtatatttatcaatatgtgtctatgtgtttgtctgtctctgtgtgtgtgtgtgtgtgtgtgtgtgtgtgtgtgtgtctgtatgcctttgtgtgtgtatctgtatgtgtctatgtgtgtctgtgtctatatatgtgtatgtgttggggtgtgtgtgtgtgtgtgtgtgtatatactgaaactgaaaaacacctcaccactcaggcccagcagtgatgaggttttgaagtaggcatctttcatccataacagtccacaaacagactgaggcagaaacttaccaaatgtttggcttagtccctctgaggtgatgaaaacatcattttttacgaactttaagagcagtggaaaggctttccacagagtgataacataaccctgaacatgtcagcatatgcaatttttcaagtcctgacgtctcttctctgcaattctagacaggaatataatgtggcagcaggacgactcctgcagtgaacacaaagggcactgaactcctaacgcttttccccagtggcaagcagcaatggagaaatcagggttccatcctctctgcccatagccttctagctcaagaaaatatttagatcaaagacccacttgtcacattttgagatattgcaagttatcctcacttgcctaactaagtaagcatgcctaactctggagactgggaaggggatgatggggaaggtaatgatgagccactaaaatggatgcaagattgaattttttttttttttgagactttttttttggtcacccggactggagtgcagtggtgcgatctcagctcactgcaacctccgcctcctgggttcaagcgattctcctgcctcagcctcccaagtagctgggattacaggcacccaccactatgtccagctaattttttgtatttttagtagagacagggtttcaccatgtttgccaagctggtctcgaactcctgacctcaggtgatccatccacctcagcctcccaaagtgctgggattacaggcatgagccaccatgcccagcctgaattttatgtttgagatttgtcataagacctgccaagacaagggaaagcttgttatgtattccctttctctcacaaaacagctcttcagtgagtcccacatggtcacttatttgatcaacaaacattcattatgtgtcagacactgaggatgaataggacagaatttgcaatgtcagaaacagggatattggtcagggtggcttttgagcggtccctggagtcaagactcctcacagttctttacttttaatatttccccacgtcagccacactagactaacacaaaagttgggacatcagcctacagggaggaactgtaccatctgttcaactgcaagttcagtacaagacatagaacagtagactatatcatcactggtagactgtttcatcactatgtgcaaagttccttgggatggaggtgctgccgcctcattcccaccactcttcctcatggcccctcaccactcccacctcgccgccacctgccatcctcatctacccccgagctggctcctgctggcatctttatatattcattctgtttccaaaacctccctccaagaagctacacgtccaattgcatttcccttttctgcaaaaagttaagtacacagcaattgctacatgctttagaggtttgctttaccgggaaagtgctgcaaactggcccccaataaggaaatcagagtgagtcacttggagctcttggcctttacacttcaggctattaaatccaaaatcctaaggagtccaacccaggtccaagaagaggagcctgaggaggtccttcctaaatgttaaggcacctagaaacattagccaaacaggtcaaacagaaccccatgctttttgttggtagaatttgataaaattaccacacactgacaggatgaagagtaaagcctatcacatcttatttgactgtagcagaaaatttaacaattcttagagaaattatttcagctcctctgctttggcaagcatatgagaagagtaaaaagaaaagataaacactgacagcccttataatcttttttttttgttttgagacagagtcttgctctgtcacccaggctggagtacagtggcatgatctcggctcactgcaacctatgcctcccaggttcaaccaattctcctgcctcaggctcccgagtagctgggactacaggtgcacaccaccaggcccgggtaagtttttttgtattttagtagagacagggtttcactgtgttgccctggctggtctcgaactgttgagctcaggcaatccgcctgcctcagcctcccaaactgctaggattacaggtgtgagccactgcgcctagcccgtaaacttgaatataataccataactcaggacaccagtgaaatgacccagaaacttgtgaggggattgagaatttggaaattgagcaagaaaccgactagagttgccatcagcaatcaagaagtgactatgggagaggaaagaaggtgaaacgtctgttctcttgctcacctaccatgttttaaatacagcctttggtgacagaagcaagagtaaagtaatggagatgatactgggctcccagagaaacagacttgagttttcagccttcactaatggctgtgattctgtgaagacactgtctcctctctagtcttcaatcccccacagaagcaccccctcctccatgaagccctcttcggtttctcctgcccacacccatatcccctcttctgaatttctagaatacctacttttatgcctcacaatgtgaagctttttcaggtttttttcaggtgtatttgcctcttatttcatgactgaattttgatgcccctaaaataagaactataatgcctttttcttttgactctcctgcacagccaagttcagagctgaatatttcataaatatctagtgtgtaacgtggtggataatttgacatgagttttcccaagagccactgcccatggaggggagtcaatagtgtatttgcattcacttatttggggccttggtttacatacgtctgcttagactcaaggacacttgtttccagtttcaagatgaatccttgaataatatatcaaactaggcattccttgatgtttctctgtctcttttgtcctcacgcatgaccaaagcccatattccaaggtaacatgcacagcaaatgaagaacatccaatagtgatagagcccgtcctcatcgagctaatagcttcaaacttccggaccaaaatggtttgtccatttttcatcaaaactggagctcactgtgctacttttaagtataaacatggcccattagggggcaaagttggccagtctgatccaagtaaaaccctgtgttttggacacacagcagggttgctgagcaacctgcagacgacagtgctcttcccatgcacagatgcctcaacgggaaagagttgatcctctggtaaaaagcaaaaaaaagttatgtatgcaataagttaaaggcaggaagatatgagatatatagggtaatccactgtaccagtttgcctgagatggggactttccatgctaaaatcaggaaagtcctcagcaaattgggactagacattgcctagacactgactggcagattctaaaagtcagtgttcacccttttccacaggcctccctctctctactcacctcaactgcatcactggatgcaaagtcagtagctgctggcacccagggaattcccagatcactatgcctgtttcctttgaattgctgtcagtactcccttcactgcccagtttctctctaaagtctgtctgcagacagtctcatcatggcctgtggcttcccttcactttcataaatttcacccccaaatctatagcttggttgtgaccttcaccttcagctctaatctttctaactgtccatctcatatctgtatcctccatcctgttggcttcttaagctcagaaaaactaaactaaacccgatgttccctctttacctatccttttttatttgatatatcaggtctatgctaatggctctgttatccccacctccgctgccccttctccgcggcctgccttccaagtctactcacgttccagaggctgtgaacagacaattctcttgctgaccaccacctttccaggccttcagttgccatggccccaaccaatataattgtacccccttggcccaatttccctcacctctcgtcctgaactcacccagcacaccactgtcacagctctgattagaccattctctgctaaacacttatgacaaatggtttcttctttatcttcttatattcaagttctacatgcccttcaaaccccaaattatatcttccccatgaaagtgtatgcccctgtagaaaataatctttttctaaattccctgagcacttttctattctactgcatattactgttatttctgcacatttttatcttctcttcaaagccaaaataagggaaaacattgtatgccattcacgtttttatccccgcttaaaataatgaaggaatcaataacattctggtaaggtttaacctggtggcatactgctttgcacaggtgctattgtttaattttgacctatgtcttccatctgcttcaccccatgctggtgaatcataatcaaagccctgagagctgggggccctcactgaccttaacacgtgtcttaccactgcacaatttccaaatgccatggcaggccagcagggcttagccaaagggactttgcctctcggaattgtgaaatagagattccttgagaagcaatcaaattccttccctgccatcacaattaggacaccttcccaacatgggcccagcaccatccttcatcttcccgtcttccataccccctgggtagcaagggctctaagtttaccctgtttcgcgaaacaagaaaaaaatacttatttcttgtctcaacatttaattattttacacaggaaaagaaaaagactggcctgaggcggaaatagaagacacaataaatccttctgtgaactcttgccaaccatatttctccttacttctgtcaacccatccatcatggagcaaatgttcagaggacagaatatgaacttgtttgggggttgtttttctccaattgccacattttctagtttggatcccaggcctcaaaccccaaccatcataggaatggtgcactcagtcagaagaaaggcctctggtgaagaaactctctgggcacttgggaataaaggatcaaggctgcagcccaggccacggctgcagggcaagctgagcctcagtctgaagccacgtctgagtttcctttcagtgagcatcctctcaacctcttcatctaataaatgtttatcaggtgacattatcaaacacttgccatgtgatgttcaaaatagttcagaacggcaagacatgggcatggcaccagcgccagtcatttcgaagagccctgctgtgccatgcattgcaccttttgttcttgaattgtgtgaggggagggggtgggcacagttttcaggtgggctgctggggtggcagaaggggcactcagggtatataggagtcagttatttgcctactcacatggaattgtgtcagaagtttagtaactggcagggccagaccagtgtaaaccaactgaataggagtctttggtacaataatgcacaaaacggaaggaggtcctttacctcctggaccccacagtacagtacaggatatatatattaatcgaataatcacacgagcttttgtaaggtctcagtggggataaagattaccaaatataaaaccgtggctgtagagaatattacaaagaaaggcattcattgcaaggagagaatgtgatattagatttgaccatattagatggctcaggacaggcttcccaagaagcaaggttaggctaagcaaggctgaggatgactgggagttaacaagtcactgagggaataacagcactctgaacagaaggaaaaagacatgtcttgtgtcagcaagaactgaaagaagaaaagtgtggctagagaggagacaagagaaagaaagtaacttcagaggaagaaggaaggtgtagagggccaatgtggagccttgaggagttctgttcgtctcaaaagaatggacagtcactccaagatttaaagcagtgaggtggcatcatcagatcaacattttacaaaggccatactgactgctacatggagaaggacccatcatggaggaagaggctagaggcagacacttcactggtcagcaccaaggacccctgaggtcctgtatgtgcagcatgttactcagggaagaaaggattccctttcattaggcaggactctgacaggttctcatatcaatgaaaattaagtggttatgaagtggagaggaaagtgcatagtggttttaaaaacaattatatgctatcgacttatttcttaataaactataatttatttagcacataccctaagagccagtgcctaactaaacattcccattgattgcctctttaatattcagaacaacttagaaaggcaggcattactatctccagtttacagataaggacatcaacattcagagaattaactagccaaggaatccacagcccaggattaaagcccaggcctttctgattcctgcacttctgcttgtaagacagtaattgttatatgtgaacatggtgctggttctatatacctgctgggccttcgggacttagtaagatgctatcttgcccagaaggaagacagtctgatgaaaaagagagagagacacatacacacacacacacacatttttgcaaacaagtatattacaacatggcatgagctttgaggacacaccataaaacttggtataatatttttctccatgaaaaatttatagttagttggtatttggctcagtgcctctattaggtagaaatggacaaaattgagagccaatgttggtgagtagcttatgtgtgccaagtattgtgttaagtgctttaaatacatcaatttagcttaatcctcaaagcgaattaggaaaatggcaatgttgtctacattccacagatggagaaattaaggctcacgtaggtaaaaaatttaaaaaaataaaataaaataatttaaaaaaaacaggattacgagtaggaaccaagagaggacaaattactcgagaaagaaaatcaaagtaatatgaaagctcagtaacattaaatctatatgaaactggtgacatgctctgaaatggaaaattaaaccccatgtggatgcaagacacaacgcattaaaactgaccctaatcaccaaaccacaggagtgtgactgcaaaatacgttagcttcccagagccaggctgtatgggcaagctgtttctacttcttagagttgttttgacattaaaatgtgaaagttcgtaaaataaggagggaggtggaggctccaaggaatgttaaaataatctgtggcaaaacagagaaagctaaatattcattaaggggctttcatttcaaatgatcgttttaccgtatcagtggctaaattgcggagcaggaagaagaggataaaactcttacttaatcccttttctgaatttgccacagagaatgcagagaggagcccagggatattcagcctctcctgtgtgagctggggtctgagatcctgcacaggtctccctggctgctcatcccggcatgggggccaagctggctttgccaagagtcagcgtgccggcccctgccttctccagcacttaccgagggatcttttgcatatatttttctcccagaggcagagctttgttctgaattataacgtcattatttttcctttaaatccgaagaacaaatgttggactccaaaatcctaggaaatatctaacatccaacccaacaaatctccataaattatgtcctgcctcatagacaattgtcatttccaaaagtcaggcgcgtgtgtctgttcagggagcagtctggagtgaatgccctcccctctctggttttggatctaactggctggcaggagggagtaattttagctcagttgggctgggggcactggtagccttgctgctagaattaatcctctcactcactgccttcagagcagactttttgctggtttcctaggaggaaagtctacatgcccaaaggcctgcccacctgcctgccctcatattcatttactcattcgtatttttaatcatgaattctttgtctcttccttgaacacctatgagccaggcatggagctagatactgaggatacataagtgagagtgagagtgggagagaagagaagagaagacgtcttaccagggcacaataggccaggacaaaccagacttagcttggcaagggccagggacacctgagggtatcgttgcatggaaaggggtatcaatgaacccaagatggcaaaagagaaatgaggaggagctgaagcatcccagaaacaaaatgcacatgccccaaaaaggttgcatgggtaggccagatctctcactcactcataagcaccagctgagaaatcacaggataccatgctgggcactgaaagttacaaaatgccaaaagggtgagcttcccacactcaggatgctcaccacaaagggagccacccgactcacacagacacagggaattctaggagaagtgatccattaaagtcatttctctcttgactttctgcaatcatctcctcatgttccttcttgcgtgagattccccgctgtacccccttttcctccactcttccagttcatcttccacacccttgttagggttatctctaaaataccagcttggaagaccgcctgcaagggtagttccaaaatgttgttcagcagccattgaggtctaattttgctgagcctccagatccaccaaatcagaatctctggggataaggccttggaatatgcacattaaacacattttagaataacttttacacatattccaatttgaaaagcagcctatgagtagaaaagtttgcaaagaaggatgaataccccataacaaagtgggaatcttccatctcactttgtctcaccaatctcattctattatttgagtttatacacatatacatacttcttgaggttctcaagggtatgggccatatcctattcatccctaaattccaaatgcccaaaacttggtaagcatcctataaatatgatagttgaactggggatattcaaattgcacagataaagcatgtaacatctttccttttctcttttaaaaaaaaacttatttttcctctcaccttcaaagaaggtatatataactggggaaatacataagtgattgagtctttcaattcatgaacaaattatttcctctcacacacttaggtctctcatttctctgtaagcttctaaatattctggttagaggttttgcatttcttttattccatttgtccctaggtatttactgtttttggcatggtattaattactttatgtttcaaattctagttgtttgttgtagatacatagacactaactgttgtatattcaccttgtattcagtgaccttgttaaaatcacttcgacattttaatagtttatctacagattctttaaattctctgcatacacatataggaacagtttatctttcccttttcagtctttatagtttacatttatttttcttgccttattgcactggtgacttctagtacaatgttaaatcgatgtagtgacaatttatgtcattatttcattcccaatttcaggtagaatatcttttattatttcacaattaaccagaattaatgtttcccatagattttttaaaagctaagacttttttttttttaagttttagccatttcaatgggtattgaattttatcaaatattttctgcatccactaataggatcatatggttcttttcctttgtaatacatgcttatgtaataaattacatcaatttttaaatgtcaaaccaaccttgcactcctaagataaactcaagttgttcatgatacaaaatcattttcaaatgtcatggattcattttgctaatactttatttggtatttttatgaataagagaagttagcctgtgactttttttagcatatttgtaaaatttttgtatcaaggtttgctgtaatccattttaataatccatttttatgaaaaaggttgacaagagttttgccttttttactatggaaagactgtgattcaaccctctccattttagacagaaatggagatgttccttccttttcttttctcatacacaccttacttttcagaggaaatacattgatctatgagaggataaggtggctgagataaaaccaacttcacggacctggaacacttgcaaaaacttaatttagtaatacatccaccagctttgcattataagcatcacatgcatgttatttaatctgtgattgtatgtgcgtgcatgctttgtccttaatagtaacgtgtgaatagacttaaaatataacactgtattttattgcaaaatgtccttgcattttcatacctattaactccattgaccagtatacctacccttgagttatgtgagatatgcacaaaatatctaaccctgctctagtgtattcaagcagaccttcaatacagactgatggtattctgactatatagagaattattttatgtttttacccaaagaactcatttcaataaaaatgcaggctaatactccattttttacactccgtttttatgaaaattaattatttcagatagtgttgccattgttaatttgcttgataagtttgctttgctggttctcttctgttaaagcaaagtgaagtttagaatacagttatttacagtacttggcaattagtaagtacccaataaacacttaagttaatgaataaatcaacaatgaataaatggaaagttacccatcctctaacacaaaagttggcaaaccataccctgtaggccaaatccagctcactcactaattgtgtaagtaaatatgcattgactcgttcatttgtttacaaatcatctctttcggagttcaatgtctgctgctttcaaaattgaagagttgcaacagggaccatatggctcacaaaacaaaaatatttgctatccagtcatttacaggaagtgtgccaacccctgctctaaaacacaaagtttgatgaatagctagagagtagccagaaggtacccacactgagtatgcaaatgaaatctcctcgagtttgttgttgaaggaacaggatgataccaggggcatcaggtaacaaaaagaactgttttgttttgtttcatgaggaaacatggtaaagtctattgtcaaaggtaacaatgagagggctcaactctctagagctgacactcttttctaaatcaccttgtgctctccatttttttccccttctcccagaggctttggttaaatcttttcctaaatttcagtgctttcattgccttttttttaataacagaaaagtactgaactcacataaaacagtgatttagccaagtggattgtgacaattcagcagatgcttaggccataacaaagagcctctcacgtaaatctctcgtaatgtctttgttctcaaaacaaagaatccctaactcttgagccgaattggtcaagaatccaatgtgcccctaagtggaaattctacaatgttgtaaaatgcctaagcaacatttgttttcaattgccattatcctttctccccattaaggaggaaattcttgttagaaagaattctagtgtcagtatgtttcataacaccaaaggataaagtaatttggagaaaaccaaaacttactttttaaacacataaatgtgctgttttcatactgctattcatatttactgcatgacgtggtacacaaagaatatcaacatgtcatgaacaaatggtaaaatctgcatctattccgaaaaaaacaaaaagatagcaccacaaatgatactggattagtcttctgctagtcaacaaaacttagtaattaatgaatccctcttatgtggcaaatggtggagtttttctggcctttcaatatgatgatatctaatcattatgttaaattaaaagacggatttttcttaatgcactacatagtcccaaaagttaattatatgtaagagcaaaagaatagagaataattaaccataaaataatctagggagtcagacaataatgtttaataagtccccttttttttctaaggactattttgggaacattagaaaaatgcacaaagaaaaaacatttcaagtgacatacatattataattcagattttcattacaagtaaaataggagttttctttttctttggaaaatatttctttccaaaaagatttactagagtctttgtttagaaaaatgagcaactctgatagcttttttattcaattcataaaatttgcatttactttcaaacttttagcacactttgcgcattaagaaaagtataccttaagccgggcacagtggctcatgacggtaatcccagtactttgggaggctggggcaggtggaacacctgaggtcaggagttcaaaaccagcctggccaacatggtgaaaccccatctgtattaaaatacacaaattagctgggagtggtggcgagcatctgtaatcccagctactctggaagctgaggcaagagaattgcttgaacccgggaggcggaggttgcagtgagccaaaatcacgccattacattccagcctgggtgacagagggagactctttctcaaaaataaaaaagaaaagtataccttaaaatataaacttttaaagtcacaatttaggggaaagaagaagaaaataactaggaaataatattttctttccttttgcatgcttcaggcaagtctaattccaaacacaaaagggaaagggtatggagcacagacacagaagaaagaattcctgaatctttggtctgctgaccttcaacaaataaataaacatttaatgctcaagtgcttgatctggacaaaaagagttgaaatacaaggccctgtttatttccaaggactcttgtgaggaaaatatgacataaaataggttaagtggattttattaattgaaaatcatcaaatatttattagacaatattggtagaaaacaccaataagatattaaggaaaaaataccaatgtcttctgagcccctcaaatcaaactatagagagctatttattccatttttcatgcctgcagctaattagagttggcccttcatatttgcaggtttggcatttgtggattcagccatggattaaaaatatttgaaaatggctgggtgtggtggctcatgcctgtagtcccagcactttgggaggcgaaggcagacggatcacctgaggtcaggagttccagatcagcctagctaacacagcaaaaacccatctctactaaaaatacagcagtagccaggcagggtggtgcacacctatgatcccagctactcgggaggctcaggcgggagaatcactttaacccgggaggcagaggttgcaatgagccgagatcgtgccattgcactccagccaggatacgaagagcgaaactccatctcaaaaaaaaaaaaattgaaaatgaattttaaaaaataacaatgcaaaaataaaataatacaaattaaaaatatattatggtttaactatttacattgcatttacattgtattaggtattataagtaatctagagatgatttaaaatatacagaaggatgtatataggttacatgcaaacactatggccattttatgtgagggacatgagaatccatgaattttggtatccacaagggtcccctacagttacctgggaagggctgtatggccttaggccaaatgtctaacattttttttaatggaaatattctgctatttcgcaatattaatgcttattctactaagataaagtttcatatagaaactttgttgttaagcttctttgtgttgtaactttgtccagtggtgcaaagagacagatttcatacatcagtaggaattgatggagtataaatgggtaacaatagtatccctgaaaatttaaaatgtcctcatttctgtaaacaaacattacactttgaggaatttatcctataataaaacttgcataggtacactattttcactttcccttggtcatcttagtaagtataaaaatattaattacgatattattttaatagcctggattgtaaatgatataaatgctcttcaatacattaacacatacacttatttattaatcggttaaataaattatatatattcaaataacagaatgctattatagctttgaaaataataaagcagcactgtgtaaacttactaatgatagcccctaagatactggaaagtaaaaaaaaaaaaaaaaaacagaatattgcataatacactatttaaaggaaaaaaaaaaagatgatacatgtgtttgtgtttttgtgtgtgtgcgtgcacattaggaccatctctgaaagaattatacaagtggtaacaatggtggggcggggaactaggaaactgggggatgggacgtgataagacttacattttattttatacccttttattcattttgaattttgattcataaacacgtaattcaaaaactattttctataagcaaaattgacaaatgagatttcctatcacaattttaggttacttccctgatggataatggctgcaacattcagaaaaattcacaactaatttaaaaaattacattacaccttatttttcagaaaatctaaaacataatggtttttagtttccatgatgatttcagttgtttctcttctggaaagctgacgtctttggaagaatcaagcttcctaattagattgtcatctcatttgtgacaagcactgaggaattttcagatgataattgagagtcaaaaaggccacaacattttgcaaaggtttccaggctgtgtgggaacatcataaaaagatggttcttctcaaagctactgagatgactaccaaatttaaaaaaaagaagacaataaaataatccagacagattcacagaatcctagtggggactcatttctctaggaccagaggaaggtcatgccaaggatcgcgtattctctattttgccctctaccttggaggtaagacagcagtttaactggggccagtgggaaaagaggtgagaaaaaaccagggcaggtctgaaatgtggacatgaacatcaatggggcaagggacagggtgcaactaggcaggcagatcagggtcccagcatttgtgtccagtccatatggtctgatgtgaaaagaacgacagaagaaatatctaggccgtggtgaaatacaggtgtctggaattggcacagtctgagaatttgtggggagacgattttaatctaatttaaattaggatcctagttatagctaagtgaccctgggctagggtctagctgttgggaagaaaagcctagaaaacactagctgaggttcagctacttgggtgttaacctgggtagaggctgaatccccagcatagagtaagcaacattgaaagatgtaggaggtgaggatgaacttggtgagcagccaggagaagacctcaccctagacatatgggaccaagaagtccagcagcaaggccaaatccagaacccaatcattgggagaaaagtgtgagtaatttctaagtcatgatccttaattctgtgctcttttttatagttttatttttctttctcatggaactcagtctgatgtattccattattattacccgactaattactccaaatgaatatctcacagcctgttctaacaagcaatgtcctacactcctttccaagacttgtttatttctttgcttgcttgctttattctctaactacaaactagacacttcctctgggatgttccaccatcattttaaactcaacatgtcttcttaagccaaatgcaacaccttcctttcccttctgtcttagtctatgtctgctgctataacaaactgccttaaacttggtaatttataaacaacagaaatttctcatagttttggaggctgggaattccaagatcaaggtccagcagattcagtgtccagcgaaggcccatccctcatagatcgtacaatctaggtgtcctcatatggcagaagaggtggaagggcagaagagtgctcccttcgacctcttttataaggtcctattcccatctgtgaggattctgcccccataagttaatcacctcctaaaggctctacctcaatattatcacgtggacagttaagtgtcagcatatgaattttggcagacacattcagaccacagcatattccttttttcctacccctcttcctctctccccagcttctttgttctgttaccggtatctccattctgtcacccaacttcaaaatcatgtagctatacttttgccaccttcttaaaataacccagagtcagaaagttcagcattcattcattcaaatattacactgaatgcaaagttagacaaaacttcatttcagatactgtcccctcttagaaatgtaccttctttctgttcatttctgcttattcccaccactatacactcaaggtcttcataacatgtatccaattattgcaaaagcttcatatcaggcctccatgattctgatttctacaccttctaattcattcatttctttacattaattttaaggtacattttcatgtaggcactgcattgtaattccctggtgcttacctgcccccgtctctaaactctatgctctttaagggaaggcccacattaatctctcctaccatcatatcccagagcctatatcaggatatgaaatacaatagcttccaagaaaatttatttaatgcttgaaaatgttcaatatctccctgtaacttgttgcatcaaacctctacatctctgcttagttctcgtgtggccacagattgtctatttacccatactgcccatttcttcaccacctgctccctctgtattcctcaggcttatttattcactctatgctaattcccatcttcactaacttatccccactgtcctattgcctgaaatgcctgccttttccctcccttccagagggccttgactctgcactcagctgcagcaggttttccagctaaagagggcagttgcagaatgacagccatccctcttcctgccttctcagagaagcgttcattgccccctccctttccacagtgtcagagcaaggacgtgctctctccctcctaaggttttggcaactgaatgcaagtctgtcaacgatgcaaagggagccaaagggcagaaaataaaacctgtcagaggctacaaagaggtccttcgtccagcaccaccccacaacccccaagttcagcagggcaggaggggaaaagggcaaggaggctcacagactctgctacaccagaggttagcattcatttgcttcctaattccccagccaacctgcttcttgggtaaaaattgtgaacttggcaaacctgtattttgtcaacaacggttcttcaatcccctcagcattattaccatctgaaagctaagaagctggaacagcttttcagggatgcaacaggctagaggcaactgatcatttcagatacccttcacctgtgggttaaggaggccggagccacatcccaaacatcctttgcaattgccataaagcataagtttaattaaaacattttgttacatgccgtctcaagcaccaaactctgcaagagattctaagtatagagaggtgaagaagaagtggcctctggtgtcgcagcagccctggcatcccagcacatccacccacgaactcagttacaagcccacagaaggtttcccatcaccacgtttgtccctctggggataaactccctctagaacccactttctttgcctctctgaccttacttcaagccacttctgtagagttctagagcttttttttttttttaaagacagtggttctgtcacccaggctggagctcagtggtgtgatcttggctcattgcaacctttgcctcccaggctcaggtgatcctcctcccaccccagcctcctgagcagctgggattacaggcatgcatgaccacacccagccaatttttatatttttagtagagacaggattttcgccatgctgcccaggctggtctcgaactcctgacctcaaatgatccactagccttggcctcccaaggtcctaggattataggcgtgaaccatggtgcctgccccaagatctagattttcttatgcactgcccatcttgccgacttaatgttttgcattgttcacttcttccttaattccgaaagctctcttttgactttgcactctgattcccctttgcctccagcttctcccatacagagtcttataggtcttattctcccatacagattcttacaggtctggctatcagaatccaggtctgatgatgactgcacaacatggttggacttaatgccactaagttgtacacttaaaaaatggttaagtggtaaatgttatgttatgtttattatcacaatacaacatatacatatatatatcccaagcccagccggagcccctagacctggccccggcagcagaagccatcacctgctgtgaaggaactcagactcaaataggagatacacaatttaacatccattaattgagggagaaattactgaccatctactacacgttaaacactgggaactgagaattcagggaagaccatgaaaaatatactactgtctttatgaagcttaatctagtctgggacatagtcatcaagcagacaggcacaaaattaagtaattcattaaaatactaataaatgcaatgaagggaagtacagggtcctatgaaagcacagagctggaggatggggcttcagaggagacttccctgagaaagtgaccttgacactaagaagtgaaggacaagccatcatttcccaggcaaaaggggtgtggtggggatggtgagggtagggcattcaggcagggagaatggcatgtataaaataaaggacctgtcacaaaaggtaggaattaatgtggttcttttgagggactgctagaagccaacatagggcccaagcagagaggcacaagacatcaggccagctgcctgacacaagctccaatagcctgaagcactaaacctccatgaagagttaatggctcacatctgtaatcccagcactttgggaggccaaggtgggcagatcacctgaggtaaggagttcgagaccagcctagccagcatggtgaaacccctctctaataaaaatacaaaaattagctgggcatggtggcacatgcctgtaatttggagctacttgggagactgaatcaggagaatcgcttgaacccaggaggcagaggttgcactgaaccaagatcgcgccactgcactccagcctgggtgacagagcaagactctgtctcaaaacaaaacaaaaaaagagttaaaatttggagggaatcagagactttgaaatcagaggacgaaattccaggcattccaggcacagaggctacctgagcaaaggttctaacgtgggaaatgctgagggcatttggggacaggaagtcgtcctgttttaatgaagttcgcacgggaaggataaggagaggaaaatggtggatgtgaaagataagaagcaagttaaatagagtccttcgtcaggatggttggttctagaaccgcaggtaggagtggcctccccggctctcacctgtcttctcctaccgctgagggatgaccctgcaaaccaaaacaccagctctcaatcacttgtagaaaatcaacaccacaactgagagggacacagctctccaaggcctcaggagacagcgccagagggagccctctcctcgggttaaacagtttgaaagcagtaacaaaattagccaaagagttcaaatgatggcaggctcgggggccttggggccagcacagcaccagagtcctcgataccaatagaccacattgcttctttgagcctttgctgggatgcaagcagtcgaaagaattgagctgagaaaccgtgagatcctcagcttggtaggtggaagcattcctggctgcatctgttagccccagatttgaccatggaattctgaaaacctttgccttttgccattttgtgttcacctcaggctccaaaaactcttttgtctctgtggactgtaaacactctcagcaagctggatcactcacttatccaggtggaagccaagtatgaacacataaggatatcattagcctctttttcctgataacaaggaagactgttctccagaaaagtgctgccccagaggctggcctgctaggacaacaagcatccttcacatctgcggtaggaacccagctccactttcatgggatacctcctcctcacaggccctcggaggaatccctgtcctgctggctgggagctgccaggaccagagtgtactccccacagaagtgtactaagcgggcactcagggaactgggcctgcagaaacatggaggggggtctccatttccaccaccgtaaattgtgatgctggaaagatctgtaaagtttttcagttcagctcctctgctcctccaatgagtaaattagtccaggaaagaggaagtgacctgcctgtgcagaggccatgtctcccgtcactgtcctggctacttcatggttcaaatttccatcagaaaagttcatcagaaccagcatatttgtaaaattggactttgtacccattttaataattaaagatctagtattattttataaacaaatgacaaactttatagtaatatctctggttagtttttgaaaatggaagttgtagggaaattagaggcatttttctagcttcagagcgtaagttaaaaattatagaaccttttctaagaattaaatggccttgaagagtattaaaaaataaaggagaataattctcctgagccaggtagagactaggctgttgactctttgagggtgagattttacccaaaaaccatactcacagtccaagtcctttggattaaagcagccacttcagggacccacatgtcacctccccaccttcatttctacacacatcttcctaatagagttttatcatcattattatgaccatgtaaacatagtccattgctgaaccagggagcatatgatgactgcttttttggtttcttagacttcccctcccagagttaactctttttccccccaccttatttggctatttgaatcacatacaaagtcttcctataccctaaaactgctttgtaaaatgcttcccaatttcattttctgcttggataaattaaataaacaaatggttctattttttctctacaagcatcccttggggagcattttagatcatacttggcagtgacttgaattcccctgattataaaggtaaagacctgtaaacctgtttcccaggccttgcatcagaagtctgttttatagaaaaagaatgccatgatgcagaaattctaaagatgcttattcttcagcctagaaaaataattttggaagaaataaggtttctctagtgacttagagctcatttggcctgaaaccttgtagagtcccctgacttgtgtgcccacaggggtgtaacagagagtatagatggcttcatgtccgaaggctggatttgaatcctgcctctgccacttataagctatgccaggaaggacgcatcgctgagcctctttgttctttgatatagtttatttgtccccacccaaatctcatgttgaaatgtaattcccagtgctagatgtggggcctggtgggaggtacttgaatcatgggggtggatccctcatgacttgctgccgtcttcacattagtgagggagttctcagaagatctgcttgtttaaaagtatacggcacctccccaccaactctctctctcttgctcctgctttcaccatgtgatatgcctgttcctgctttgccttttgccacaagtaaaagttccctgaggcctccccaaaagtctagcaatgttggtgccatgcttgtacagcctacagaactgtgaactaattaaacctcttttctgtataaattacccagtctcaggtttttctttatagcaacacaagaacggcctaatacattcttactctatgaaatggaagcagtgatatcattcaaaataccaacaagaaatgagaaaatgaaatgtcaaatcacctaacagagatccagacacataactgatactgaattactgttaactgaattgaaaagcatcaacttactcccccgaccttgccagctttctggcaggacaactctgagatgccttaacattcatacaaccctcttaaaaatatgaatgcagactcctcagatatatggaaccaatttgtcagccttctgaaatcttgtcttctaaaaagtaccccatagcaagcaaaatgattttaggggacttgaatgtcagggttagtgacgactctgccaaagctttaaacacaggaaatttgaaaaaagattgcttcttacctgtttctgtgagagccatttatccaaaatcagctattggatcaaaaagaaaaataattgtccaattgtattcatcatcagtatccatcgatatgaaaccatagcccatggaataagtatttgggggaatttcgtttgtaatgccacacaataggccaacattggtttttaatcacccaatcattctttcatctattatttccatctttaacatgtgtgatctaggccaaattgaagatgattatgtctccattaagcctcttctaatcctcaaaaatatctgtttctgagtctatttctgagtttcaaatggactttgagattatggaactagggagggtaacatggaatgaggctcattctaatccccaaataaaccgtctcgaagtggaaccatgtggagctctcttctcacattctgttctgagccgtgttccctccaactataccaataacccagagatgagctaaacccagtctgaccactctgcttagccaggaactggccactctgtcacggttggaagaagtttaacagaaagtcaaatgaattctcacaaaactgacaagaaactgtcttaaatggatctcagaagatgccccctaaaacctactaaatttaaataattgatctagcaatgattttcaacatgtaaggtcaccaaaccttagaatttactcgttcagcctagaacactgagaaaattcctcccaaatgcatactctttgccccccagccacaagtgtagcagaagaaaaattaattaggaatctccctcaacttctagcagagaatttggatatggtaattttctataaacctggacgctaacattcttttgttaacatagttgtaatggaaaattgaacaaaatgcaaaaccacaaatagcatttcacatggcaggcaatcagaggcatggcacagcagaatagtgaacttagattcaagtcctgcttggccattttctagctctgtggctttagaaaagtaactttacatctctgtgcttcagtttctttgtctgagaaaggttaatacctccccagcacagacttgttttaaaaatgtaacaggataccataagtgaaagcaacttttgaaatgtaaaagctttatcctaatatcctgattattgtattgagtccaaatgaatatattgtgtagttggcatatatccattttctatttgagatgggataagttaggaaggccaacatttaaataattttgaggctctccagaccacaccattccatcaagatgatactcagtgaagccgcacaaaatgggtacctgagacttcataagtaaggtctcaggatctcactagaaaaagtcatttccctgtaatcctgtgctactgtattacacaaccacaacaaaccttacttctctccacgccccattccacttgcttagaacaggggacagccctttgtataatttctacatttgtagtacagctgacacatggatgatctttattttaggtttatattcgtactttgatgatgaccaggcaatttttctctcacctagtccagtcttctaatttttaactgaactctcaagggtaatctgtttttattcctgtctcttgtttttttggcctccctatctctcggtttctcagtctctgttccttttactgtttctctttctcttatgcaaacacacacacacaccctgatccaatccttcagtgtcttaattcaggtcctaaaccttccagtgagatttctgacttagcatctgctgagccacaattcacatgtgacgctctgcacttcttcccaggtacgtttcagctgcaggctctgtattattttggtgtgttatctgtacacagacactcacggcaaaagaaattactcactcgtggaaagagatgccaaacccttaattcaaaaacaccaaatgagtaattctcaaagcatatttttctccttcaaccaggacattttaattatcttgaagtaaacaagaagcctcacaagggttactcaaattgttctttcaaaattttccctcccctatacctaaggatttccacctgccctaaagttcttcatgaagcgagcctttgtttaccacccatgtgataaaaagcccataaaaatggggaggtaaactttgcatccatttctagtcccaaattggcctgaggactaaagagagcccagaaataagcaatgacccatctctttggctaagtgtgcactgacttggcccaaatggtcaggcttcctgcctgtagctacatagttagttgtgataaggagcaaagaaaaccaaacagcttcaaggactaaagcatactttctactgaatgatttgtgctgttagtgttgcagtctgataagcaaaacacatttcccttgccagtggaggcctattaccagagcagaggcacagggagctgaaaacatttcacacacagtagcaaggaggaaagacctgtaggtgggtggtttcaaacacgcatctagcctaactccgaactacagctgccaacaaaaggcttttacctcccctcagtgagtgatgatacagtcgagtcaccatagagccactgctgctaggaagtggctgagtactagaaaccagtcacagactgtttaccaaccagacaagtagaactgagaatataatctttgtaccatacataattctctctaatgagccaatgccctgaggttaaatagaatttactcaacccaattaaactggccagggtcaggggatcattaggaatttgggcccttcatatttcagcaatgaatcataaatcatttaaagtttcatttataaggatgaaattcttcaatcaaagggttaacatttttacttgtagaaactttcaggttacctctcaatattttttttactctttatttttctcttctctgggatttaaaaaatataatttggagctttcttccagatctctcagctgctcttttcatttttaaacctctttatctgctatcccagtcattcctttagttttatcttcagttcataattttcccttccactgtgtcaaccagcgatgggacaagggtaagacaagcaaggtactcagagtgtacaatgtaagaagtcactcactcttgggcatgcgctagttcagggttggcagcgacagtgagtgccttcttacattttgcaccctggataccttccttgcctcaccctagactggcccagatgtctagtctacagttcaccttatcacttgcaatttctatttcaatgactacacttttcacttccaaggtttctatattttaatccctatctattcttaagaattctttgttccccttccctcttttacttatttgatgattcaagaatccttattttaacatttaatattgcaccattatgtctggttcttcatgcatggactccacagattcttgggtctgttgactatcctcatgccagaaaatattcttgtgtgctttgtaatttttcttgaaagcttaccttgtttgggagggaatttgtttgttttgtttctttttggtagactcctctccctgtcaagtagcttttgggttggttgccttactctggtagtactccaggtttgtgtccccaagccaagatgtagtgtcttattcccagccaaagctcatagtgtcacattgaggctgatggctgcatgcggcagggcctggctccaattcctgtgcagatgtctcttctctctcccagaaccacaagcaatcaggtccaatgatcagtagttagtggagttttttcatgttcaatttactgttagaagctgtgaatactgatttcggctttctctgagaagtccatcacacgtgttctgccttttgtggaataagcaatgccttcatcagcaaatggtcttagaagctgtctccaatatttttgtgtctctgtgtgtgtgtgtgtgtgtgtgtgtgtgtgtgtgtgtgtatacgcttagtatatgtgtatatatatgtcctgtgtgtgtatacacatttagtatgtgtgtgtggatatgttctgtgtgtttcttatgagctaattgcctttagcctctgttcactactataggtttctgttccagatcatgaattaatgaataaaattagaattcaggagtccagtagataagcagggcaaagagaaagttctttcctacagcagaattccacctaaaaactatagaaggatggcagggttgaaagatcattcatagatgctaaacccagcagataacgttttatgagaaacaggatatttacacagcatccaagtatttcccccacaaattacttattaattaccaggggaagatagtaactttgcagtggagaaaactggcagacaccacctaaagcacatgatcaaagtcaacatcaccagtaatgggacacactgacatcatgtgtgtcccgatgtgccaagaaagacataacatcattttaatggcattttcaccaaaaatgtataacctgaatctaatccagacaaaatgctagacaaaaccaaattgagaagcattctacagaatactctgtactcttttaaaatgtcaagatcaagaaagactgaggaaatattctacaataaaagagactaaagagacacaacaactaactgccctatgtatcctggattgaaacctggctgagaaaaagtagctataaagagcattattgggacaattgacagaatttgaatatggactgtgggttaaataataatactatgtcaatactatgcccatgttcaatttcttgattctgatatttgtattttggttatgtaagaagcagcccttgttcttagaaaataaatactgaaatatttaggggaaagtacactatgtctccaacttactctcaagtgatacagacaaattagagggtaaacatcggctcttaggggatagaaatttcttagatacaatggtttgtggctccccaaaaggccacactacacaaacagatacacgatatgtctgtggtcttaaacttccatggggtaattagggaaaaaaaggtctaaaatgcctccttgagggaacaataatgaaaaaaaaagattgaaaaacacatgcagagaaagagaacaaaatcaaatgaaatggtgataacctggggggaggaagagtatataggaatttcctcttttaagtttgacatttttcaaattaaaaaggtacaagaaaattaaaaactaacccctaaaagttaaaaagttgctacactattatgcaagattaggagctcaatattatttagaagcaaagcatcaacagaaaaacatactagccaaggaaacatccacatagtcatgtacatgtttttcattgttgcttctctagaacacattatgcgtgtgtgtgtgtatgtgtgtgtctgtcattcatgtggctttgtgactcatgtatgctgggtcctctcactgtttgaggacagcagtggctcacttggaccatttacttaacttaggagaccactttatatggaagatggagacatttagtttcatgaaggacggaacaaaacaaaagttttgaataacggcaggtaggatgtaggttaaaatgcaaaatgaatgctttaagaatataagcatcgggagtagaagttactgagttggctataaaatattctctcaaagacattttaaagatattttaaccaggccgggcatgatggctcatgcctgtaatcccagcactttggaggatgaggcgggcagatcacgaggtcaggggtttgagaccagcctggccaacatagtaaaactccgtctccactaaataaaaaaaaaaaaattagccagttgtggtggcagacacctggaatcccagctattagggaggctgaggcaggagaatcacttgaatccgggaggcagaggttgcagtgagccaagatagcaccactacactccagcctggatgacagagtgagactccgtctcaaaaaaaaaaagatagtttaaccactagattcacatctgtaagaggacaattcaagggccaggagacaaatgagaagagtttcattcatttattgacgctttcagtgtgctaggcactgttggctcaaagctgggcaagacacgacctctatctatagtgaacttgccaactagcagaaagattattttaagatttatctgtcagtatcaatattgtcatcttatttcacagtcttggtctttatgacttttctctaacatttaaccattaccctaactgctgtcatcataattaacatgtaaatatttctcagtgccattgtcactgtacagctaccttcgcaaaatattttctaaccactagtgacagcacaatacaaaaacaggtaaggaggtctgcattctacaatgttgcagccaggtgtgttgaaatggcagacagctccctgggcagccacacaagattcagattactagaatcacttgaggtcctgcttccaggcccaaagtggaaaactgactctgttactgccattggattccctcgcttcattaattaactcaaaattgcctctcagtggcaatccagacctctgtttctaatttccttctgtgctgaaaagtaaataggcctaaccacattttcaagcccctgtgcgtgggtcttttgtgcttatagcagaccactatccactggaagacgtctgggccactgccaagttgagtattcaatttctttgttgtttttcaggataacctagctaaccgcaatccctttccaccattcctctgcaatgtgcttgaaatagagccaagactctatcctacaaaatgcacaagaaaaacaaaaaaggaggaaataaataaagaaggggtcatggaaaaaatcagagtttgtgaatattgccccatacgtattttcttttcacatttttctctcatgacttctcaaaaacattcagaccccaaatgcctggtcatattcaggaataactccaatggcttcccattctctcctccccacccaagaagattataggattataaacatgaggtaaattcctgggatcctattccttggggcatatgcgcaagcttttggctttgggaggtggggtgtggggtggcaaatgcctaaaaggttttggatgactatccaaagagaaacagatggctttagcacgcctgtgcccaacacatgatctgtgtgactcctgccctctcaacaccatctccgtgccgccccctttctcccacaccccagacaaataagaacaaaaatgagtctctgcacattcaaaaggtgaactttcaaggacaagtcttcccatatggaaaggataatggcatcatgccagagcacgtgcagtaaagaagggctcagggtgtttcacattttctcttccaatgggttccaaacgttctgatggacaatcttattcttcccctataaactttctgctccatatcccgctatagctgttaatacacttttcaattttcctcaggtccccaaatagtgggaacagcacgaacatcggcatgaaggcaagaaaataggaggcatgtactggggagagcaaatagttcagttggagaaagggcacatgaggagcagtagcagcaaataagaatgaccaggagtttgggatcagacacgtgggaccatgagtaccaggtcaaaagttcaaactttatttgatgatgaagcaacattaaacactaaaggtcaagtttcaggaatgtaactaattcagaagaaacacaatgacacataaaaaaagaaatagagccaaacacaaaaattagcaaaatatgaatgcttcacctcagcgatggattcttatgactgaacactgggagccagacattaaaggacaaacgggaagcctatctaaatcactatctgacagaaagaagctcatttattcttgaaaagagaacaaacatcctaggagaaatcatgtggactcttttaagtgccattaaatgacacaatgggaaaaatcttcaacaatatttttatcacaaacagagaggcaaagtcacatggttgcacagctctctctcatactgacatttaatacaggctccaagcaggaaagtatcatctaagaagacagctaatgtgattcattgatgtggatttctgatctttcctgatcatcaggaaatgatgaacttgagacacctggaagaatgaatatcatacttctattaaatgtcacttctgttggccagtcactaaggaaagcagataaattgctgtttctccacctgttgaaagtttcaaattgagtagtgtacattattaaacaaacatctctggttttagatagggtgaccatatataggttggtacttccctggtttatgcctcctgccccagaataattaggagcagcccctcctttctatccaaaactaccccagtttcggtgataacttatatgatcaccctagttctaaatatctgcccaagtagaagttgccacactattatgcaagtttaggagctcaattatcttttaacttagaatacaacccaccttcacaagcaatatctaacttgatgactactgaaagatttgctgaggctaaactcactggtgtatcatctcttggagcactaccctttgtcttactggacactgtgttctcatccctagcacaggcccatcgtatcacaagcatttgactgaattatttggttattgatgggcataacctgtgacatagctgtctcttcttggacaactactgataccaccatcatgtaagataaattgttacataaattaacagcttagatgctttttcctcattttttcctaaaaaggattttaaaatgtacagccaatttgtaactcttttatagcacatctacagatatctaacaaagattctcatcctccagctaaccaaatttataggttaaacctctagaatgtcacagtgatccagttcagggtgttatttcccaacagagccaaagccatctattttttactctgccaaaccagcaacatttccaacatgaaatatccataatgcaggaaattccagttctaggactcagacatgaatggtccctgcaattattgttaaattgcatgtgtcaagaagtagttttttcctgttggcggtagacagtacggcatgtgcattgtggttcacagaggcaataaaagtgtgttatgttactagatcctgaaagtaggtagcaaatacaaacagtaaatttaaaaggattatttttgtttctgattttgcatacaacttagaattttatgaaaattttctgagaatttatgagaactttatgattactgtgcccatgctttaggaatcattaaagaaagtttgtggattacttcttttgaacaacttacttaaaaagtattcaagttcaattaagtttgatatttgggatacctttatgaataataaatgaatctttatcactctatattatcttgaaacattcctaaggttatcagaactatccatatgatttctgtccttatacgttctgcttcaatggcaccttcaagcttgtctttgtgaaaatgcaactacattgcaagtagccaataacattatcaatgaaaatcttgtcagtagccaataatataacgttaaaatttgcttggttacggacaagagtcattctgagttaaagaaaaaaaaaatggtaaagcaaaaagagtacaaaaagaagaactctttcaaaaagtgtctcatctgtactttctgcctttgtatataacaaatgctaagcagatgttacattgaactgaaattgatactggtctgtcttgcattggccaaactaagagtgtgtgggcggggagggggcgggtggtattttggtttctacctgctttgcttcatcactgtttaaaagctgatacatattaaacttgctttttctatttaactttagagcccatagaaaataaaggaatttttaaaagcaagagtcatttagtaattcccattgagagctgtcttctattttttcactagagatagatttttctagttgaggttgaaacagaaaaaaaactccatgcatacctttttcatcctaaaaaatatttattgaaagcctaatactacataccacaaacaaataaaagacaggctttaatcttacaatttatccaaaaggatttatatgtgcttgcatatgtaaagggtgtcaattatattttacttaataagagggatatgtttaaaaaaaaaaaacaggaaaactaaaaataagaagtgattaattccattgagggatattaagaactatcagttttggggttaactcttgaacaatgagctagatttttattaaggtatcaaaaggaagaaataccataagcaaaacagagaaatacaactgttggttgcatatttaagtagattttgttcataattatatgtgaatggtaaggaacattaggtgagacatcaagaaagctaagatttctagattgggcaaataggtatgaaatgagaaaattatggtttctgttttgtgcagtgaactaaggttatctgggggatgtcccgccagaagtattaagtagactattagaaacatggacctagagaaataaaagagataatatatagaggtaaaaatgtggaattaattcaagtgtgatacacaatgaaatgattcatggccaacttcaaaatttcctattatcccaaaatttaaaggctgggagtggggtgtagagaggggtggggaggtggaagatgcaaacagaaagactgggggagatccaggggagtttaccaacatagaaaccaggaaaaaagcgagcatctttgatgagctggtcttcgccagtattgtcagatactgcagaaattgaatagaaggagagatcaaagattcaatattgtcagtggagtgctgaacttcactttgtaaagcttcctaaaatctattctaattagccagaaggaaatacgtagaaacataaatatcgttattatcagactcatcaatgttattttgatgtcttttcagtcttaatgaatgcttcaccttgtgttccacttacatcaaggattgatccttcaactgggtaaaaacccttcccaatcttaaggaatgtatataatttttatttttgccataactgtagccttgaaaattgtttcttcatgcatggaaatgaccttcaagtgtggcagtctttggagattgagggtggacactcactttgaactaagacttatctaagcctctaaatcatggaatgaggagagaaatgcacctagtcttctgagaggcttagtcatctttggataatgttagtaagttgtcctttcttgactataataaattttcgtatttggctcaaatattatgtagatgtctagtttttactctttaattgattaaatgtggaaaaattggaaagcccatattcaactaaaatttatatgaccaacagctgctatgtgataagagtggtagaagagagaggataattttctaagactgttttgccatctatccttcagtgtcttctttgatcacattatttatttgcagttgcatttttgtggtctggaacttgaacataattttaatagtcctttaaaaagaattcaagacaaaaaattcatggaaaacaatttttgcacaattctggaagcacctagagaaaatatcttgtttttctaattttctgcaatctaggaagatatccaacaggagatgaaaaagttaggacttgaaccggcatttcctcctaccatactggctgtgtgcttgagtccttaatggttaaatttatgggactacctttttgcatacttccccacaatgaagtcttagataatataacaagattcaatcaactctttccatcattcatttaacaaatattgtttaagtaaattaacttggaaacctcaaaatgaatcagataggaatttgccaacaaggagataaaactgaacaaaaataataaatcacagtataaaaataattaataggctgggcatggtggctgctgcctataatcccagcactttgggaggccaaggcaggtggatcatttgagcccaggagctcaagaccagcctggacaatatggcaaaacccagtctctataaaaaaatacaaaaaattaaccagacatgctggcatgcacctgtagtcccagctacttgggaagctgaagtgggtgaatcacctgagcccaggaggtcaaggctgcagtgaattgtgatcatgccactgcactccagcctgggtaacagagtgagaccctgtctcaaaatacaaattaatatactaagtataatagaataagtgacaagcaaaatttaaattttcatttataaaaagacggtgaaaaagatttgtagaaaaatctattttagtatagaatataaaaatactggataaaatataataaacatttctcaaagtcatggttaactgggacataaaataacgggaaaatattgccccaaagtgacatgaaattgagattatagaataagtcaaggctagggctgacatattctttgagagtacctgcacatttgagtggggctacaggctctattcagaagagatgggcgaagagagaattggtaaactgaaagacaaatatgagctataacccagaactaagctacacacaaagagatggaagatatacaagtaagagacatggcaactaaagtagaagagtcaacaatcacataatgagaattttagaaggagagaagagaaacaatgggggaaagacaatattcaaagatataatgactgtattagtctgttcacacactggtctaaaaatacctgagactgggtaatttataaagaaaagaggtttaattggctcacagttccacaggctattagaagcatgatgctggcagctgctcacctcctgggaaggcctcaggaaactttcaatcatggcagaaggcaaagggggaagcaggcacgtcttacatggctggagcaggagagtgggacagggaaggtgctacacgcttttaaacaatcaaattttgtcagaactctaccatgagaacagcactaggggaatggtgctaaaccattagaaaccaccttcatgatccagtcacctcccaccatgccccatctccaacactggggattacaattaaacatgagatttgagtgggaagacagatccaaatcgtatcattttaccccttcccttttccaagtctcatgtccttctcacatggcaaaatacaatcatgccttcccaacagtcccccaaagtcttattccagtattagctcaaaagaccaaagcccaaagtctcatctgagacaaggctagtcccttctgcctatgagcctgtaaaataaaaaaaaaaaaagttatttacttccaagatacagtgggggtatagacattgggtaaatactcccattccaagagggagatatcagccaaaagaaaggggttacacgtcccacacaagtcagaaacccagcagggcagtcattaaatcttaaagttccaaaatgatctcctttgatttcatgtctcacatccagggcatactggtacaaggggtgggttcctgaagccttgggcagctctgcccctgaagctttgcagggcacagcacccacagctgctttcacaggctggctttgagtgcctgcagcttttccagacacatggtacaagctgttggtggatctaccattccggaacctggagaatgttggccatcttcccacagctccactaggcagtgcccctgtggggactctgtgtggtggctccaaccctacatttccattccacactgccctatagaggttctccatgaaggctctgcccctgcagcagggttctgcctggacatccaggcttttccatacatcctctgaaatctaggcagaggctatcaagcctcaactcttacactctgtgcacccacatatcaggggaaattcagccaggtattgggcaaaattcacccccgatatttcacataggttcttttctattttccctaagtgtcagccagtttgagaaataaagggacagagtacaaaggagggaaattttaaagctgggcatccaggggagacatcacatgtcggtaggttccttgatgccccccgagccgtgaaaccagcaagtttttattagtgattttcaaaaggggagggagtgtatgaatagggtgtggatcacagatatcatgtgcttcacaaggtaatagaatatcacaaggcaaatggaggcagggcgagatcacaggaccacaggaccggggcgaaattaaaattgctaatgaagtttcaggcacacattgtcattgataacatcttatcaggagacagggtttgagagcaaccggtctgaccaaaatttattaggcaggaatttcctcatcctaataagcctgggagcgctatgggaaagtgggacttatttcatccctccagtttcgaccatagaagatggccacacccaagggggccattttagaggcctaccctcaggggcgtgttctctttctcagggatgttccttgctgagaaaaagaattcagcaatatttctcccatttgcttttgaaagaagagaaatatggctctgttctgcccggctcaccagcagtcagagtttaaggttatctctcttgttccctgaacattgctgttatcctgttcttttttcaaggtgcccagatttcatattgttcaaacacacatgctctacaatttatgcagttaacgcaatcatcacagggccctgaggtgacacacgtcctcctcagcttatgagatgacaggattaagagattaaagtaaagacaggcataggaaatcacaagggcattgactggggaagtgataagtgtccatgaaatctttacagtttatgtttagagattgcagtaaagacaggcataagaaattataaaagtattaatttggggaactaataaatgtccatgaaatcttcacaatccatgttcttctgtcatgccttcagccagtccttccattcagggtccctgacttcccgcaacacccacaagcttaacaccacgtgaaagtcaccaaagcttatggcttgcattctctgaagcagtggcccaaactgtatctgggcctctttgagccacaattggagttggagtggcttggatgcaggcaacagtgtcctgaggttgtgcggggcagcagctccctggccctggcccatgaaacgattctttcctcctgggtctctaggcctgtgatgggaggggctgctgtgaaaatttctaaagtggtttggaggccttttccccattgtcttggctattaagatttggctcctctttacttacgcaaatttccacagccagcttgaattcattcccagaaaatggtttttctattctatcacatgactagactgcaaatttcccaaacttttaggctctacttctcttttaaatatacgtttcaatttcagatcatttctttgctcatacatataaattgtaggatgttagaagcagccaggccatatcttgagtgctttgctgcttagaaatgtattctgccagatacactaaatcactctcaagttcaaaattccacagattcctagaacggggcacaaagcagccaacctctttgctagcacataataaaagtgagctttgccccagttcccagtaagttcctcatttccatttgagacctcctcagcctagacttcattgtccatatcactatcagcaatttggccacaacaatttaacaagtctttaggaagctccaaattttccctcatcttcctgtcttcttctgagccctccatactcttttaacctctgcccattacccagttccaaaattgcttccacattttcaagtatctttatagaaatgtcccactcctcagtaccaattatctgtattagtccattcttgcactgctataaagaaatacctgagactgggtaatttataaagaaaagaggtttaattggctcacagttctgcaggctgttaggaagcataatgctggcatctgctcagctcctggggaggcctcaggaaactctcaatcatggtggaaggtaggcacatctttcatggccaaagcaggaaaggaagcggggaaggtgctacacaattttaaacaaccagatctcatgagaactctatcatgagaacagcactagggggatggtgctaaactattagaaaccaccttcatgatccaatcacctcccactaggcctcacctccatcattggggattaccgttgaacatgggacttgagtagggacacagatctaaaccataccaatgactagaaactttcgagaatcaattaaagatacctatgcttaggttcaggaaacctaacagatatatatatatattcagctttacaatttattaggttttttaaaccttggaatgggtatctttcatcagatctggaaaattgtgtgtctgtgtgtgtgcacgtgtgtgtgtgtatatctgtgtgtgtgtatatatgtatatatgtgtgtgtgtgtgtatataagtatatatgtgtgtgtgtatatgtatgtatgtatgtatgtgtatatataaaggttttcaaagaaggcaaagagaaagagggcaggaagtgggagagagagattaattaccaaggaagtacaattagactgtcagctgacttctcaacaacaacaaagaaagtccaatgaaaataaaaatatattaaaaatgctgagaaaaaaataaaaaataactattggccttgaaatgttatccagtaagagatactgttaaaacaatagaaaataaagacattttcaataaacagaaactgagttcaataccaatagcaacttatgaaaggaattactaaaagatgtgccttagaaaggagggaaggctctgagaaggaagatctaatgtgacaaaaaggaatactgagcaaataaaatggcaaacttgtggtaaacaaatgttaactgcataaaatggaaataataaagtctaatttgagagtgaaaaatgatccagataaagtctagacaccaaaagcatctaaattagaaggactacagttggagttaatatattctaaagcagagattctcatattctaatatgcatacaagttactaggggatcttgataaaatgtagattcttagtcagtaggtctagggtggaaattgtctatctctataaacttcccagatatatccaggctgctggttaatgactcaaactttgactatcaaggtattgagatccttttattagtcaagagtacggttacaagattgttaaattcatactttgttagcatatatgcatgctaaaataaatacagtaaacactaaaagattaaaatactatgtactcccaaactaatggagaaaacgtaatacattttaaaaaaacaaaaagatctcaatcaatccaaaacaaagcaaagaagacaggtagtcagaaaggaaaggaggaagggaaggaggagaaaaagaaaagaaaacaaacaggaaaatgggggaaagatggaagagggagggagaatagaattaagaaaaaaagaaggaatggctagatgaatagaaaacaaaattaggtggtagaaaaattctaaacataccagcaaaacccgtcaatgtacatgaaatacactttctcttgaagggtagagatttttaggacaataaaacaatccaagaatagtttttttaattactttttaacaagatatacacttaaaacaaaaggatataaaaacattgaaaacagaaagacgggagctatatgccaggcagctatgaagctcaccaaatggcaaaggtatctattaataacaaacaaaatgggatttaaagcaagaacattttgaaaagcaaagatgatcactatacaattctccctgaaagttgtagaattttaacttatagcaactcaataatatagttttacactatatgaagaaaaaatgtaataatatataagaatatcatgattctatcatcatgatatggagatttaaaccccttttctcagtagtcaatagacatagtgaacccaataaatcagaaagcgtggcagtcacttgtgttattcacaaaaattactccttcatagtacatggcgggaaaatacttttctccctcttgaagttagatggggcttttgtggctatatgacttgctttggccagtgaaatatgagcagaaagtatatgtgctgcttccagacaaaagcatttagtgactggggtgagattgcagaagtcttttccctgctgagagcaaagaatgggatcctctgtcaggctggttcctcaataaagataatatggaacatgagccaaaaataaacttaattgtgagtttgttactgctgcgtaaccaacccattctcacgattacagtaaggatagagattaactgacacaactgaaaagataaatctagtgaatatagtatttaggacaccgcaatcaacaatcggaaaacagacatgctacatacgtagacataaaccattttaaaaaaaattaaatacattctaggtctcaaagcaagtccccaaattttgcagtttcagtattatacagcctgcatatattcatgataaaattagaaatccaaaagataattctattttggaaaaaaaaagtcttaacacatcatatgtcaaagaacatataacgaaatttgggggaggggaagcataaaactaaattataataaaaatactccttaataaaaccctttggatgcagataaaatgatatatagaaaagctcattttaaaagtatctttaaatatgtaaaaaagaagacacagttaaaattaatgagatgagaatggtggaggggaaacacagaactaaattataataaaattactccttaaccctttggatgcagctaaaatggtacttagaaaacctcattttagaattatctttatgcagaaaatacagttaaaattaatgagacaaaaatggcaatagaataaacctaaagaaagtagagagaaaaatatatcgaacagaatttaacgtaatagaaactatacagcaaagaaagtcaaaagctggctttttaaaagactaataaaaatagacaaacttttaacaaaactgatcttttaaaataaatggaagaaataaaatggaaacttaaccactgatactgcattgattaaaaaaatactttgaacagctgtacacacacaaatttgaaaacttagtgagcaaaaatatacattatcaaagagaagataaagaagaaaaagtcagaatagctccataggcattaaagaaatttgtgagttctcaaaacatcttgacttatgcaaactatataatttcattaatgtaaagtttaaaaacaggcgaaactaaaaatacctggtgttaaaactcaggttacttcaaactatgattgagggaggactgtaagagggtatggcagcccaattctctggtgctggcagtgtttggattctcgatctgggtgctagttaaaggggtgtgctcaatttataataattcactgaatgctaaacttttctgggtatatgtgatatttcagtaaaatgagcaaaagcaaaatctttacaaaaataaagtatcaagacacattattttagaggagaatcctagcaaaccttaagaagcagataatttcctttttttttttttttttttttttttgagactgggtctcgctgtgtcgcccaggcagagtgcagtggcgcaatctcggctcactgcaagctccgcctcctgggttcatgccattctcctgcctcagcctcctgagtagctgggactagaggtgcccaccaccatgcccggctaattttttgtatttttagtggagatggggtttcaccgtgccagccaggatggtcttgatctcctgacctcatgatccgcccacctcggcctcccaaagtgctgggattacaggcatgaggcaccatcttataccagcttttcagagagtagcaaatggtctactctcctaaaatattttgtgaggtgagtaaagccttaataccaacatgacacagaacagtacaagaaagaaaaattacatggtgatctgaccggtgaaaataaagtaaaaatatcctcaacaaaaacattagaaaaactgattgctcaatgtaaaaagagaaaatgaatcatgaccaggtgggggtgtattctaagaatgcaaagttaagtcaacattagaaattgtattaaggtaattcaacctattaatggactaaaggtggggagaaaccctgaataattatctcaaaacaagcagaagtaataactgatgaaattcaaccacagaagataaatttcttagctaactaggaatggcagggaactttcttaaactgctcaagactagctaaaaacagagaacaacagaagaaaaaataacaaaaaaccctgccacaaatatatttctcaatgataaaatgttgaaaacatcagtgcctttaaaatcaggaacaaggcaaaggttcactattactacatttatgctacttttatgcaacttaatgtcccagtaagtagtaaagcaaaacatgcacacacacacacacacacacacacacacacagtataagggttagaaagaaaacaattatttacagatgatgtaattgtttgcatcgaaaattcaaaataatctataaaatattattggaattaataaaagaatttatattagttgccacacataagattaattcagaaatcgatttcattttcatatacagatgccagcagttagaaattgcagctaaaaagtaaagatactatttatactaacgacaaaaatataagaaattcagacaaatccaacagaaattttggaaggactgtatgtagaaaaatgtaagactgtatgaaaagacattaaagaactcctaaacagagccatactatcctcattaaataggaggttcaacattattagagttgatctacattcacaaattgaactaaagattcaatgcattttttcatcagaattctagcaatacttttcatggtacctgacaagctaattgttaagccactgaagtgcaagatgtgactgggcatggtggttcatacctgtaatcccaccattttgggaggctgaggtgggaggatcacttgaggccagttcaagaccagcctgttcaacaaagcaaaacctcgttttcacaaaaaatttaaaaaattaaccagatgtggtggtgcatgcctgtaatctcagctatttgggaggttgagacaggaggattacttgagcccagaaagtcaaggctgcagtaagctatgatcataccactataccccagcctaggtgacagagcaagacccagtctctgaaaaaagaaaaagaaaagaaatgcaagatgttcttggagaaaaactaagtagttgcatttgctctaccatgggtcagggctgattataatccataatttataataagtaaaataatgaagtactagctcttgggtaaacaaattgaccaatagaatagatagtttagaaacagacccatgcatttatctaaaacaaatacgtaaacaaagtcggcatggtagtttggtaaggaaaagataggttaattagtaaacaattagttaatagttgttaatccataagaaaaataagcgaaaacagagacctacttcagaccactaatggattaagtacttaaatgtgtaaggtaaaagtctgacttttagaagaaagtgtagaagaatctcttttgaactttggatatggaaagacttctcaaacaggataccaaaaaaaaaaaaaaaaagaaagaaagccacaaacactaataggacaaaaaaaccattcagttacttaaaatttacaatttctgttaataaaagtacctcctcttgaaaataaaaagccaaaatatagaaaagttccactgtacataatgaacaaagaattagtatccaggacaaataaagaattaccacaaatcaataagaagacaatttagtaggaaaaaatagcagaagaccatgaacaggcatttcacagaataaaaaattattggtggcctttaaacatacaaaaagatgctcaatctcattactaatcaaacaaacacaaattaaaattttaccatctcacacctatcaaaacaccgataattaaaaagtcaatacaagttttggtaaagacgtggaccaacaagaatactcatcaagagctggtgggagcataaatcagaacaaccatttggtaaaagcaatttgaattcacttagtaaaatttaacaaccccatcccctaggacctgaaaatccaacttttacttatgtaactgatagccatagctctcaactctggcaacaccacagaatcacagcgccccatcctgcaagatcatgacgtaattgttcttgggtagggctcaaaccctaggttttgttaaaagctctccaggtggttctaatgtgcatcatgatcacctggagagcttattaaaacccagatcctgggtccaatccacagagattctgactcagtaatctaatggaggttaagctcttgttcaaggaccacaaattaagaaccaataccctaagagaaatgattgcatgtgtgcacgaggagacatgagttaaaatgttaatcagtataaacaggaaatgttcatcaaaagaagaatagatcaataaattgggtaatatccaagcagaaaaatttacacaagtattcatgacatataataagtgctccataaatgttagcccttttaccagtttactcccgcttctgcagtgctttgcactgtttctggtgctactgccctactcaatattaattacaagaaaatgaaagcatattttagtgagctgataatacactgtgcattacaatggcagtcagaaataagttcagtcttatatcattgtgaattcatgggaaaaacttgaaatgtctgccaccatcagcaagagctttgattctttcaaatatcacaatctaatccaaaccagtcagctgttagtggggttactatcatttgtctgcctttctataaacacattcatgtaacaactaaccattaaaacttactctgtgttcatcactgtttgaggccctgtggacacagcagaaaacaaggtagactgcattccaaaagtggatccagatagtaacaaacaagaaaaatacaggattgtgaaaagtactacatagataatgaaatggaaggatttggtagagtgatactggctggcttcgttagagagagtggacaaggaaggcctatcagtagaggtggttttcaaattcacaacaccttttaaaggttatcatcattctgatgccaaaacctggcgaagacacaataaagaaaacttcagaccagtatctctgatgaacatagatgcaaaaatcctcaacaaaatactagcaaccggaatccagcagcacatcaaaaagctaatccaccacgatcaaacaggctttatttctgagatgcaagattgattcaacaacacaaatcaataaacatgattcatcacttaagagaactaaaaacaaaaaccacatgatcatctcaacagatgcagaacaggcttctgataaaattgaacatcctttcatgtttaaaaaccctcaacaaactaggcatcaaaagtacatacctcaaaataataacagcagtctatggcaaacccacagccaacatcacactgaatggacaaaacctggaagcattccccttaaaaaccagaaaaaaacaaggacgtccactctcaccactcttattcaacatagtactggaagacctagccagagcaatcaggcaagagaaagaaataaaaggcatccaaataggaaaactatctctcttcacagatgatataacattatacctagaaaacccccgtgtctgcccaaatgttccaagatctgataaacaactgcagcaaagtttcaagatacagaatcaatgtacaaaaatcagtagcatttctatacaccaataaggtccaagctgagggccaaatcaagaatgtgatcagctgggcatggtggctcacgcctgtaatcccagcactttgggaagccgaggcgggcggatcacgaggtcaggagatggagaccatcctggctaacacggtgaaaccccgtctctactaaaaatacaaaaaattagccgggcatggtggtgggggcctgtagtcccagctactcaggaggcagaggcaggagaatggcatgaacccaggaggcggagcttgcagtgagccaagatcgtgccactgcaatccggcctgggcaacagagcaagactccatctcaaaaaaaaaaaaaaaagaatgtgatcctattcacaatagccacaaaaagaataaaatatctaagaatacagctaattaggcaggtgaaagatctctacaatgagaattataaaacactgctaagagaaatcagagatgacacaaacaaatgggaaaatactccatgctcatggataggaagaatcagtattgtaaaaaatggccatactgcccaaagctatttacagattcaataccattctcatcaaactaataataaaattttttacagaattgggaaaaaaatacataaaatttatttggaagcaaaaaggagcccaactagccaaagcaatcctaagcaaaaagaacaaagctggaggcatagtattacctgactccaaactgtactacaaggctacagtaactaaaacagcatggtactggtacaaaaacagacacatagaccaatggaacagaatagagaacacaggaattatgctatgcactataactatctgatttttgacaaagctgacagaaacaagcaaagggaaaaggactctccattcaataaatgctcctggaataactgactagacatatgcaaaagactgaaactgtaccccttcctttcaccatatacaaaaatcaacacaagatgaattaaaggctcaaatgtaaaacctaaaactataaagatcctagaataaaatctgggaaataccattctggacattgtcccaggcgaagacttcatgacaaagactccaaaagcaattgcaacaaaaattgactagtgggacctaattaaactaaagagcttctgcacagcaaaagcaactatcaacagagtaaacagacaacctacagaatgggagaatatatttacaaactatgcctctgacaaaggactaatatctggcatttgtaagaaactcaaatcaacaagcaaaaaaaaaaaccccatttaaaaagaaggggcaaaggacatgaacatacttctcaaaaaaagacatacacacagctgacaagcatatgaagaaatgctgaacatcagtaatcattagggaaatgcaaatcaaaaccacaatgaaataccatctcacatcagtcagaatggctattactcaaaagtcaaaaaataacagaggccggtgaggttgcagagaaaagggaacacatacacactgctagtgggaatgtaaattagttcagctgctgtggaaaaccatctgaagacttctcaaacaacttcaagaactaccatttgacctagcaaccccatcactgggtatatacctgaaggaatataaatggttccaccacaaagacacatgcatgcatacgtttgtcctggcactattcacaatagaaaagtcatagaattaatctaaatgcccaccaacagtagattggatcaagaaaatgtggtacatatacaccatggaatactaggcagctataaaaaatgagatcatgtcctttgtagcaacatggatgccgctggaggccattatcctaagcgaattaatgcaggaacagaaaaccaaataccacatattctcacttagaagtgggagctacccattgagtatacatggacacaaagagaacaatagacactgggccctgtttgagggtggagggtggcaggagggtgaggattgtaaaactacccagcgggtattatgctgattacctaggtgatgaaataatctgtacgccaaactcccacaatgaacaatttatccatgtaacaaatctgtacctgtaccccttgaacctaaaataaaaattggaaagaaaaaaataataaagagtgtctattttaagaactattttcaagagtgactgaggtatgaccaccatgcctgtggtcctaaaaaggtccccactgagttaaattttttctaataaaatatctgatctttacttgcaaagctttaattcaagataacacatttacactggtactgtgtattgtggcaaacaatgtgatattaaattgcatgtctcacatctggcagcagcagtaaaaatatgttatatcaaactcacatgtagcacttaaaatgcacaaggcactgttctaactgcttcacatatgagacctctcttaatcttctctaaccctatgtcataagtatcattattcccagtttatagatatggaaaactgaggcatggagaagtaacctgtttggcagagacagaaagataccaaccaatgacttttcagaggttatttctgagtgaacaaatttcacagacacaattattattccttatatattgaaagaactttaattccaaggaactaaagttctgtcaataaagtgttcacgcaatcctcatgatatccccagtaaagaaagactgagtgagtggggaaggggagaaggggggtcaagaggctcgtgttagagggaacaaaacaggttaagcaagcggcttcctcattgtgaacagtaaatcagaactaaataggcagataacagtttttggtattatattctgcaaccaaaaggcaaaactttgagaaacatgggtatcttagctcaggctattctaacaaaacaccatcgactgtgtgccttatcaacaaaagaaatgtatttttcacagttctagagatgaaacatcctagatcagggtgccagcatgatcatgttctggagggtcctctcctgggttgcagactgttgacttctcttgtatccttacatggtagaaagagggtgagaaagctctctggagtctctttcatcaaggcactaatcccattcatgagggtttcaccttcatgacctaattacctcccaagagaccccacttcctaatatcctcacatttggaattaaaattccaaaatgtggattttttggggggcaacactaacattcagtccattgtagtgggtaaggtgggaaaaggggagacatgaaaatgtaagtggatcatggaccctgcatttcacgtgacttgctccaagccttgaaccagggttggtggtatgtcttagtgatacatgttgccaacaccatgttattttatataaaataatttaaaattagtagcatagtgccaagcatacagcaaatatttgataaacgttaactgcccttcatgccctctccatcaaatgaaagtgtaaccatttcccttctaatatcattgtgatgatttaagtatcattgtgacgctttaagtatcattgtgacattcaggggcgtgctgtattctgaatctagccctgagtcaaaagacacaatgaattatgacaaaagtgggtgtattccagagatgggaggttagaaaataatacgaaaatgatattattctgaccttactctattactcagccccaattcccccacactttgtgaacctttttgtgagtacaatgctaaggcagtttaaaaaaatgcaactatatacaagttcatcaattccagatgtaaagtcaatagcaattcaagtgatgaccacagcagtaacctggagacctgcagtctcaatgtatcaggtaaaggtggcttgcaacattttcactcaattgaagggttgggaaggaactaaatggtggcttggctctttgggaaattgcccttggattggattcaaggctgcctctagatttattttccaaaaagaaagctctgtttctcttctgaaaggaatatggggaggggctaagaattggggagggcagtaggagagataagtacagctcgattatgcaggtttttgtcccatgttctgttctctgtggcccctgcaatgccaaaacacaggcttaaaaatactctcatgaaatgtcaaagttttattattgtacaaatccatctgggaatttgagaccgcttctaagtttctattgtcctatcagaattgactaatgcagggccagctgggtaggtgttttacagctcccactcagcaagccttggcaggttcctgaaagaagaagggaaaatggggatgaggggatatcctgttggtttctcctgtgcttctcactggagagcagactttgcatttgccttttcaacaagaagtcccataagactggtcttcgaagtctgcagctttgtggtaaccaccctacgttaactgctcgtggagcccggtagcgctgcctgctgctgttctctgtccacagacagctgtgggtgcagactcatctccacacacactctgaagtgcccgacctctctgagactgcaaacctaccctgttgttctcctgagatggtgttatgagctgaatcgtttctcccaatattcacatttttaagtcttaaaccccagtacctcagaatgtgactgtatttagagacagggcctctaaggaggtagttgagttaaaatggtgccttaaggtggtccctaatcagcgatgactggtgtccttataagaagaagggactaggacacaggcgcacacacagagggatgaccctgtgaagacacggcgagaaggcagcaatccgcaagccaaggagagagtcctcaggagagccaagcctgcccacaccttcatcttgaactgccagtccccagaactgcgagaaaatcagttcctgttgtttaaaccactcagtctgtggcatttagtagtggcagccctagcaaactaatgcagatggctccatttctttctagtgcctgagcagtataaacgccctagaaagtcccttctggccccaggaggaaaagcagtagaacaagaaaagtaataactgctgtaatggccctgacttctaatgtttaagaagtcctgatccttttgtgagacaggtgtttgaccttgcctccaggtgaaacagtccatagatatttattgagcagctaggacatcagcagaacatgagctctgtaccttaggaaaactgtactgtaaggcacatgggctcagagaccaacggtccctctttgaaatcccagttcagccactttcttgctgtgtgaactttcgtaagttaccttacttctctgaatctgttttctcatctgtgaaagaaggataatggtaccttgaatagtactttgaagtatgtgtgaggattagagatattcactgtaaaaatgtatctagttctcagcagggaagttggagttctataaatggtagctgcaataacaattgttattactattttaaataagcaatctagcactgaacctgatgactgttaaggttcaacatatattaacccttaacctttccatcaaccagggtacatttgagaatccaaggaccttaatatgcctgaaatacaaccataaactgtgtagattctattcatttttatgcaaaaatttatatcattcacaaataatggctttttgttcttttttcctaatccttataccttttattttttcttgctttagaatttgcataaagacagtgatacctgacatttttgtcttattctgtatcctaaacagaatattttttaacactttgccattaagtatcatatttgctgaaggtcttttttagctgctctcaaacaggttcaggaaatttgcattcttaggtagctacaaatctttatcatgaatggttgttcgactttataggtacttttcctgtatttatcaagataatcatacttttgttcactttaagatagtgaatgacattaatatattttctaacattaactcacccttgcattttggaaaatatccaacttgatcataatttattatattttgttaatatactgtggattcattttgctaacattttcatttagcacttttatatttgttcataagcaaaactgctatgtaatttcctttttttgtctgtcctaatctggttttgacaccaaatttttacccacatcatgaaataaggtggaagtatttcctcttttttattacctgaaagtttgaaattacctgttccttaaatgattggtagagctcacctctaagactagtggcgatgatgttttcattgtaggaagactttaagtaattagttcaattcctttaaaagttacagtattgctgggtgcagtggctcacacctgtaattccagcactttgggaggccgaggcgggcggatcacgaggtcaggaaacccagaccatcctggctaacatggtgaaaccctgtctctactaaaaatacaaaaaattagccaggcgtggtggcgagcacctgtagttccagctactcaggaggctgaggcaggagaatggcttgaacccaggaggcggagcttgcagtgagccgagatcacaccactgcactccagcctgggcgagagagcaagactccatctcaaaaaaaaaaaaaatacagtattattcagactttttctctgtttagtcagttttagtatagttttataaagatttatgtgtatatatacatgctgctataaagacacatgcacacatatgtttactgcggcactactcacaatagcaaagacttggaaccaacccaatgtccaacaatgatagactggattaagaaaatgtggcacatacacaccatggaatactatgcagccataaaaaatgatgagttcatgtccttttgtagggacatggatgaagctggaaaccatcattctcagcaaactatcgcaaggacaaaaaaccaaacactgcatgttctcactcataggtgggaattgaacaatgagaacacatggacacaggaaggggaacatcacacaccggggcctgctgtgaggtggagggaggggggagggatagcattaggagatatacctaatgctaaatgacgagttaatgggtgcagcactccagcatggcacatgtatacatatgtaacgaacctgcacgttgtgcacatgtactctaaaacttaaagtataagaaaaaaaagaaaaaaaaagatttatgtgtatatatttcatctagtttttttctaatttgatggtatatatgtatacaaagtatattttaataaatgcagaatgtgtggtcataattccttttcacttcatttactccctctattctccatcatttctttcaaaagtttttcaatttcattaaacctttttaaaggtacagtctttgtctcttgcactagcaggaacacatttgttcattgtggtatccccagcacctagaatcacgcttggcatgttgtagatactcaatacgtgctttttggacttaaaaggcaggggagatggcgaggtctttagccacataagaaagaagtagctaaagaccaagcagtaactaatgtccacagcaaaaatatatatgtctactaaatgcatggttctttcaagaaggaaaagtaaataatagcctaagatagtatatcctttgtttatatcaatattcgatatttgcctaattctgattccctagaaggaaatacagatcttgaaagatttcacacataataatttccttacaatttctagtgattttcataaagtgaactttattttcaacaacacatgataggctctggcattagaaacaaggaagatcatagatttgctaacttttctttgctgctatagactttagttaatatttgatcttatgacatagagtactgatccgtcactattgtttgtattctaatctgatgttgctgataggctggaaataaaggggccttagaaatgcagagaaacagaggaaatgttgaaaggacaatgagctttgctcatcttgcttcatgtagtccttcagatactgggttgtgaaatagagaagtttgggccactctttttattttcaggaagaactctctagtaatcagcatttccaatccctgcatttctgctcttaaatcaaatttaataaagaggaagagaagagaatcgcagttttctgcacttatccctctgcacactttatatgttcagtaggagtttttgggtgcaatttgagctagctgagaatcagattgctgcatggctctgtagctgtaaatagggacactttgaagattagattgggtatgttggcccaagcacatactttgtaaattctaacaaaatctttgtatcagatcacaacttaaaaatatctcccaaagtaaaacaccaagtacaaaccccaggtaaatgacggtcctgaggaacagatgtcaggacatcagatgtgaagttaaaggatccatctaaagactatctgtggcgaccaaagggagccacagtgaggcagccaaacgtgagcactgagatgaaggaaataggcccgaagcagcctgctcatgctctgagactggaggaagagggtgaacgcaatctctggagggaagccctgacttcaggcagctcaggtaagatgtggagtacaaggaagatgcacatgggctgtgggtggtagaaggacacactagaggagaaagtatactgtcctgaaaatatctgaagattaagtatgtgtttaagtatactagaaaagatcgttttaaaaattacaagtgctaaattacaagcacttgcttaaattttgcatgggatacataagactgcctgcatatttatttattagcacaactacacgacagtgcccagtgtataataggtgctcaattagtatttttattttttatttatgtttttgagacggagtcttgctatgtcacctgggctggagtggtggcccgatctcggctcactgcaacctctacctcccaggttcaagcaattctcctgcctcagcctccaagtagctgggattacaggcgagcaccacccacccagctaattttcgtatttttagtagagatggggtttcaccatgttggccaagctggtctccaactcctgtcctcaagtgatccacctacctcggcctcccaaagtgctgggattacaggcgtgagccaccgtgccgggcttcaattagtatttttagaaggatgtatagtataaagagcactggcttgagagtcaggagacctggattctaatactgactctaccgttaactgagtaacctcaggaaaatcactgacattctttgggtctcaaggtttccctctataaagcagaagataaattgaatggtcgtaagatcacttcctatgtgcctatgtctatgtctctatcagtgctataagaaggccaggtccctgcactacagtaagaatattctcccgagaaattactcagcagaatcacaaaggcagggaagtgaatgggactttcggtgaatggcaactacaggtagtctgatgtggctggagaaccaggttgtggaaagataatacaggcgaggacaatggcaggcctgaaagtaatcactgaaggggtaacgagtgaacagccagattcaggagtgaacaccagattcatcaaatcaccaaaatgatttgagtccatctaagacaaataatgtctgtaatttgtcaatggggatgtcatcctgtatttttatagggcagtggattttaaactttattccacataagaatcactttgttaaatttttttttagtaatggtgtctgggtcccatcaccagagactctaattcagtagaactggaggagaacctttgtatggtgctttacaggttatgaaagtttcaatgataccctttgatcctcacagctaacagaaaggggtcagagtggaattatcaccatttcacatatgagaaaaccgaggctcaaagaaatggcatctatccaaaaagcaggaggcagaaatgagactctgcaccaatgttctgaacccaggtccagtgctttttcactatggctcagctgcctaaactgaaaacaagggtttaaggtgaaaacaatttattgctcaactcaaaaaaacaatagaacagagaagcaccatttaaggttagcaaaaggataagttgaaacacaatggaaaagcacttctttgaatgtagttaagacattcatggacctattaacccaaagatgtagtaggtgatcatcaatggttcaaatgaggtttcagtaaattcatagatgaaggatccattctcttaactatttgagaacaacaccatatcatctcatgcatttgtccgagaccaaataccagactgcatatattatgttgctaattgtctacaagttatagtcaggtatactcagagcttatagtcttacctgcctcatccttctactgaaaatttagttatctgtgccctcagaaaagagaaacagcatagacaagtgaaacaaccaaatcagctacaaaatatggagatgtggtgattatcccaatactgcagaaagactctggaccccttgtgtgacatcagacaagctagttattacatggttaatatagggaaggaaacttatagttatcagatgcctacagtgtggtagccacattgtgtgcagggcactttatatacaccatcacatttagttcccttgggaatctcaaaaggccagtgttataattatctccttttcacaggtgaggaaaatcaggttcacagaggttaaataatatgcccaaggctacagagctccacatagtacaatcaagatatgtctgtctccaaagtttccactatttaacatttcttatagactaccaaaaggtgcgaaaacctggtgcaatgtaataaatgaccaagtgaaaagactttcccattatgagatggcctccgtatctagagagccgcaagtcagacgcttcagcagcagcttctgggagcagaactgtgaagctcatatcattagcagcagcatctggcacacaatcaggaagacagggcacctgacctacaggattgggatgcatttgatccttacgctggcacgttccccatgagctgagagtgtttcccctagtgtgggaaaccctgcctcaattagtcacccagatattgcacaacagatatggcatttccaaagcatggcacgctaactgtcaaaaataaataaataaataacaagagcaagaatgggtgcagccagaaggttgttaaataatcaaattttcactgccttttacaaaagccagagctcatagaagctgctgccttcaattttacagggttctaagccctaaggaaacagatagcattacacataccatccttaaatacaaacccagttgagacatacatagttggtgtggaggactgggtgccctcactttaacactgagaaactgccaggaaatgtacagcttagctagtactaattagtgctgatccaacaccccaaatacagtaggcatttaaagcattaaatcacaaagaaactaccacctcatctctagcttagactgttgaagtagcttcattcctgctatcccttcattctttaccacctttcaacccactttccaccagcagccagcccctcttcttgaaacacagatctgattgtgttgtgccactgctcaaaaacgtctttggtttcctgatgttctaataaaaaagttaaaacgcatgactagctgccctcatcagcctcatctcattccactctcccttgcacccactaagctctactttatccttcttttaggtccttaacctaaaacctgcatgcatcaggaccttatcacatgtcatgtccttgcctgaatcacaatcttcctccccatccccaccccaccatcttagctcatttcttttcattcaccattatttctgtctaaatgtcactttttcagaattgtgaaattctgtgaatacactgtctcctattatattttctcatacgactcagtgtttcaccttcaagacaattgcaattagaatgcaataattaagtattcagatctctgtgaatgtctgtttttcctactagaacgtaaacaatgagagcaggagaaaatgaccatcttattcattgctctattcctgttttgtacattaaattgttcagtcaatacttgttgagcaaataagaatggataaacatggttaacctttctctgaaaaacgtattttaaaattctaaaaatctagagagaattcaaaacaggtttcctgctggactgacagcttatccctacatgtcaaattttcactcccaggcacagaatgacccattacactgagtagatactcccgtctgctatcagatgcctgcctagtgtcacagcatctcatctgcaagatgactcacatctcgtctgtgagataacctacaatctgggttacatgcatctgcagcacctcatctgcaagataacccccaatctgggttataagcacagaactcatctcctcaggaaatgatatcaaataataagaaataaattgcttgccttgcataaaaagagccattcaataaatgttgtattataatctgagaattgaacaaggcctatgaaaaagtcctgcatttatgcctaaaagtttagttcatgacttcaaatattgaaacccactttttacaaagtagtatgtgtctttgacttttaaaaagtgcattttaccgtgttggttgagaaaatataataatcttagttagactcttcctctaacctcccaaatcaaaaccaaaccaaaataaaacagcactctgagaggtttaagctgtatataatgaagcaaaagttgctgtctgtactccaggaatctggagtcccagagaaggtgtggacattgttggaaattggcttctagcccacaaatctctgctctgtccatgtaactagtgataaccatagccatagtctgcagatacaccattgtagtgcaatgatggagggatagcacttaaatatgaaaacagcaattaagagcatatttaccattttcttcttagtatatatcctacaagtgtgcaggatagtttgctagatgctaaaacaacgacataaaaaatgacaggagggaaatgcaaataaataaaggacaagccccgaaaagcattaaggcagtaaccaagctgagtaaataaacaccagtgcctgtatttttattattttctaatacctagtaatgtgaagtacaggtgagatatggaaaaataagcttagtgttgtggcagtttcagggacagaatatacacaagaaatcacttaaaatattaagggaaagaaagacaaaatgcacatgccacagagaacaaacaggccagcaagtcagtgatagctcacacctgcatataaaccctttcctgctccagccacgtcagactcccttgtcctccccacacagcaaccaatcctgagtgtccacggctccagaggtatggttgggaaccccctctgtgagttttcacagatgcatcatcctagcatagcaccagctgacttggtgtctgacacagctgtcagagacccaccaaaatggcaatataatacctcaaaggaccagaggagtactgatcaaaaatgacttgacttttctctcttgctctctctctctcaatctaaggatacacacatcagaaaacctgaagagtccctttgcttttcctggaattatataaccaactacagtttcggaatatatcaaagcaagttcttatcaaataccttatctctgggtttgtcttccacataaaatatgagtcacagtcaggatcaaactattgaagtaaactttgtccacactgcagtttgctcctgcaggactgtgcttcatgtctcctccaagcccaagtcaagctaggtctcttgggttagaccatatgcagtcctgagtttactttggaggtcacccctcagcacctgtgtacatccagacagaggcaggaagagagaatcaagagtggaaactgggatcatcatcatcccctcggaggttactaagaaatcagataattggagaaacttggatcttattattaggaaagcctatgttatcactccacaacactagcagctggttgctgcccaaattactgatggaattacctgtcgttctgtttccaccattgtggtttaacacttttgagttttaatgttttttcagtcttaaaaatacccataaaaaatgcattttgtcctaggagggaccacacctcacagcttcattcaatgtttacttgaaacctggaaaggtctgatactgagataaggagatcaagaaacaaattgtgtttacttccaattttttctcatagttgtagtcaaaattatgccactattcactgtgagaccttgggtggattgcttaattgcaccaagctcaatctggctgtctttcaaaaacagagatttcaatctcttgccaatatcacaagatcataaaatctgctgtgtacatataggtaccaaatgtaatttaagaaaatataaaacatggtatttcctttaatgtttgaaagtaatttagcaaggggcttggtaagcatctaggtgccataaaaaaaatgcagtgaaaggcagctgcctacatttacagcagaagagatgagtgtgagttggagaagaaaaggctcttcatatatcattttaattatttcaatgttaaagtaataaaataatatattcttataaacatcaagcatatgaaacaatgcagcatggttaatatgttcagagtcaggcagtcttacagtcaaatttcagcacaaacccctgggccacgagaccttgggcaagctggtttactctgcagcgcagtgtctacacctgtcaaatggggaatacagtagcttttgtcataggtgctccacaatcagcagagacgccactaaaaatggaatgtgttgatcttctgagagtgtaacaatggaaggagaaagaggaaggaaatggtctcaaatgcagctcctatatggacccattcattcagcttctattcggtcactcactatgtgagagaaatcaagctagagtttgagagctcatctttaagtaaaggagcaagacttgcatacagaatagcttgcaatgagttcaaagccagggaagagggtggagggtgtcaaggctacttctcagaaggcggggaccaacagtcgagccttgagtggtggacagaagttgaccagggggtcaaagagattaaatccattccaagcacagggaagggctggtacaaaggaacagatgggaacagaatgtggcagctggcacggtcttcctcagttctgagtctaggaatgagtgcattacctgatacactcagatctggtgctcagtaatgtgtgtgattgagaacaggaaggaaaggaaagctgttccaggtgtgagagtgagaagaaggaccacagaatgaagaagcctgagatgaatatatgaggagcagaggcatgagatgaggaaaataatcgagaccagcactggccacggcatagcaggtggcatagagggagccctggatgtggaatccagagactcctccatgttcctttagccactagctgctagcatggccttcagtaagtcatcttgatatctcttaattccagtgctctcctctataaaatatgggagctaagcctgttgagctctgagatctctttcagttctgttcagttttaaaagcatttgctaaccttctactcagtgctgggcaccatgctagacactggggattcaaagatgaatgatatattgtcctggttcttctccacttgctgttcccacgggtcagatccattctcatcccttctccagcagcccaagtgccctccatctctgaggctggctatgatgatcacagcctctttccacaggtacagcttctgcccagcagcccattttctgtggctccagacctctctgtgattcagtaacaccattttccccacttgctcctccagacccacatgtgccaatagctgctcactttgctagtgtctacctcaacttcctttaaacctgcactaaagcatgctgtatagccttcattaaaatttcttctgttcaaccatgtgagtgaattctatttgtggcaggcccctaattaatacagagcttaaagtgcaattggaaggggagaactatcaatatttcatttatcccaatgtaaaatatcataagaaaacctaggagggagcaatgctggaagactgaagaagagaggctccagaggagtgtttgtagagagtgagttccaagattggggtggaagaattgatgatggacacaggggtgaaagaatggaaccagagagagtttattgttactgttgctaatgcagctattgttacattaaaaacaattttcaagaggtgcaacccaaagataaataaaatctgtcataccagaataaagagtagcacataattgtgtatgaatgatgggacaataggcataatttgagaagaggtataatttcagctgtgaatgtgaacatgggttgacttttgctgttttacatagatggatcattttcagtgttatcaactaagtgtgcaaattcagcaattgaaaatgcatgcaagctctgtacaaaagacaaattctttacatagaataaaaagtcagctgggaagccaaaattgacaaaaccaacaacttctataccaaaagcaatgaaatgtattcttaacctctgatacttaacattgtgattccacaggctggggcagctcctcactttctccactgccacttgtgctgtcatcaagaacatgatagcttcctttgtggtctttgaagggcagatgtttcactcccctgccttgatatcacccaagttatgagcagagtaagaagatggacattgcgtcacagaaccagcgatagcaagctaacacgcaaggagagccagcaatgtggaagttcaggccgttggtttgcgtcatattggagtgttcagctcggagacctggaggccctgtgaccttttctcatgggacagaatagggaatcattatcataaatctagccacaaaagcaaaatcacaagtcaatgaagaatagagacatcaaaaccctctgattttagatcttaagcagttatctcatcactctgagcctcagcttcttcacccataaaccaaggttaataatacttacttcatgagcttattgacaggattcaatgaaatcatgtaagtacaagccttagtctggggtgtgccatgcaattggcctgcaatatggcgaccatagctctgctggtatgactccaacgtactggactcagacaagctcttcaaggcctacattaggttaggcccaagggttttgagatggtccaacatgatcctcatcattttcaatctagaaaacattcaggtatccccagctctcagagggcttcaagcagtattttcagggcaccataaagtcacaactgctccaaaagcacctctaaccagccgggcaagtcaacaacctcctctcttttctaacttgaaagttccattatttgagtcattccattatttgaggctcccacagctggataagtaatggccaggcatcttacaccttttctgttctctagctagctagctatctctgtcacacacacacacacacacacacacacaaataagcgcgtgctcggaaacctggacacacacatacacaagcattagccagctatctgtttgcaccagaaatgatcagattgtactgactcaaccacaaattccattttctgcaaccacagttgggcccttgatgttgctaaccccttcaccccaacctggtcttaacacctgactaagcagctaactcactgctagcagatggtcacaattctcaccacactgtgaccaaatccacacagggtactatctcaattctctcctcctccactttaaattcagggagctcccacccctgcctagagttttttgttcccttgcctagcagaaagtaggcacctaggagaaggagagccacaaggcaggaagaagaaaaagaaaacttctccaggctcagaaaggaaaattctagagcattaagaggaagttaaactgatgaactgacattttaatagttaaattaaacttaacttataatagtttcaagttaaacttgaactgccattgtaataagcttcatgaattggtcattcaaaggtatctgcagatttaaaatctttgttacccaaaacagaaattgaaaaaatactgagaacttgagaaatctaagggagtcacttttgggaataggatcttttatcagtgacatccatcctctccccattatggggttacctccccatgaggttgaccttaccatatgaagagtattcttagaggtggttttaaaatccatcatcttctagctcatgttaaaaattataaaattacctgattggaatttaaaagctgtatatatttacagccacaattctttgagtctaacacctgtcatttatttgtttttaacagcagcaatggcctggcatatgataggtactcaagagatgttccttaaataaatgagtgatctggcagaggaaaagctaagccatgcccaggtgcttggagaccctcagcctcctcccttgagctatgtttgctgtgaagatccagtaacctctaatcgaacagttctacatgagcacatgcaagctgtaccttgtgctagatagggaatcatacccttcccaaatttgcctgggaaaaagcagagactccaagcaaggcgtgaggtcccaggctgctgagctaagcctactattctcatgatcagggcagctcaggtttctctgcagtggggaatagcaaactctctgaaatatctaatatcaaaaccgtatgcctttaaggtgaatagtcatggacacattctcctttgggagaaaaaagaaaaaagttctactaaaactaaagtcccagctgatttccgacacactcagcaatgaacaaattgttaccaggccagccttccaggctagaggttctgacttcactccctcaggaccctcctcccaagtggaaactaacttatttttaaatgtctgtgttccctgtcaatgcaggcagacattttaaggagactttagacactatgcattgttacatgaataaccacatctgcatgcaaagcagtaagagatactaactccaatagaccaaatgtgtgcttttccccattgctttcaactccaagaatctgaacaaacagaaaaggtcattctgatcttttttcttcaaagattaacaataggaaaacaggaatagtatattttcttatgataaaagcagaagcttgttggcaacttcttttgaattcttactaccaaccacagtactggtgttaaattaaaaaattactcatgacacttgtgtcaaagaacacaatttcaacaaattgagttttaaagatctaattggcttttactagtgattcatgaaccaggcagcatccagtctacaaaatagacaggagctccattggagatggcagaacagtcagtttttgtaaggtagcttgagcgggaacaaggcaacagcctaatgcaaaaactggattggttaacatcaggttacctcaggttactttcctttattttactacaggttactttcctttacgggttaaagcagtggagactgctttacatgctggcttaggtggactgggcttcttttgattggttgctgtgaatctcttattttttcagaaaactttcctgcttagggttttggttataatctctcctgatttctccaaaggtcagatcttacaagtaaacagcttaggtttcagttcggtgacagggaaccttagcttgagtgactccattttggttggtctcttggagcctggtacaggagctcagtccaatcaatggcctaccacacatttaacacttgttaaagatggtaatgcaaactttattcaaggggcaggggacatggctacaggtatagaaaccaccacagtggggtcttgcagtgggggagagaggctggctcaactctgactccaacaaatacatgacaggttttatcaccaaggagcaggtgggcagggggcagtggatagaaaattactaacaggaaatatcaaggataaaggttttctggctaaatcaacttgataggattatggccgaaggcaggccagggtgataagatatcaaggaattccaagggtggagaattttttctaacctgacttaggaggattgttgctcaaatgggattctataaggacacagggggaagttcaaggtcaatcagaggactcagaggagcctgactaaagttttggtcaagggaaagtctttgtcactggtaatgtagtaggtacccaataaataattgttgattcaacaaatcaacattcttccccagatccgccagactaattacttctcacaacaactttgtgtggcagcacctatctatggcagtggttaaattctccctccctcggagctcattctgtattctatcaagtcattttctaacagaattctttccatcactcgtgtactttcttaagagtgaggaaattaaaacggggagagaaggttcaaggccatgagtcagtccaaaggcagagtagggaattccattaataacttaaagcacaaatccaccttcctttgccatgaggatgggtctgaaagtgctggcttgttactccagctgcaacccacacattgctgtatagtcatccctgttatcgcagctcttgggagtgggaaacctacagagcagtggcgatgacagtgactcagagaacacatgagttcttgttggttcaaggacctcaagaaataaaacactcaaaatcaatgtaatatgtaacacagtaaccattttaacaccctcctaatctcctagggccaaagtggagaataccgatatttgggattagaaaaagacactggatagctaattttaagaacaattcaagccccgtaacttcacaagcattcctcaatgctcaggaaaagaaaacatgacaaagaaatattttaagtagatattttccagtccactaaattttctattgcaaaattgaatgtcctttttaaatcttccagtagccttttaaatattcgatgacagggatgttgtcttcaattttttgtttttttggtattgctccttggcaactaatatagttagtgcctcctaagtttttctgagtaatttctctaaaaattaacagctatttttaaacagcaatattcctccacttatgaatttattgaatattttttggcacctacagtatgcaaatcacagaaccaggcaccatggcacatgtgtaagaataagacagcatctggtgtgaaaattagaaggggagtgcattcatcatcacctatcctagaaaagcagaaaccatttgtatttcaaaataaaagaaatttaatatatgggaattgattatacatgtgttgcaagaacaaggagcccagaaataaacaagagcaggtgccactgtcatccctaggcaggaaaacaggagactgtgctcccagaacccaagggcagggaccaccattagaggctggaactgtcagctgcaaggtggagtctcaaaagagatacagctccattgacacagcttccaaaagccagaagggagtgggagaagaccctggtttctcatgctagcacctgccattgttaccacccggtgcgaaaccagttgacacaaaagtctgggcagcttagccctaaggtcggcccctgtgatacagaacagagcagggaaaggccagggtttgagagcaagcaggccatacatagggagctttgacaactgtataacagccaaattcaaattagtgctatcacagggaaagtaaaataaatattcaataagcttataatattgccttaactgaattacaaacaacaacaaaaaataataataacctcatgacatttggaaaaaagatatatcaattccacttagaatggctgatgctttatcaaagaggcagcactctggaaatttggagaaaaccaatagaatttcaaaagctacaggaggaataggaaggattctacttgcaaaagcatcaacacatagatattctggcatcgtctggtggaaccatattgaagatgcactgaagtatgatgttaaggaatgtaaattttttctggtagatcaggagtcactgaagatttaggacccaaaatcttcagtgacagaatcacagctgtgatttaaggattcatctggcagcagcatataaaatcctttgggaataaagatgccaggtaaaaggtaataaagtcttgaaccaagggggcatccacggaactacatggaacgttcttgatttagtgttatccagttggaagcactgtgcaaagaactagaaatgggagccctcccatgatagcttggaaaagatgtctctgttgtctgcatactttggggcacatatgaaaagtgatgagggtttaaagcctggccatggataacattatgcagagggaaagtcagaaaagaaatgtgtttcatcaaaggcttgagcatagaaggaaaggtgcttaagaagagaataggggcagtagcggaagggggaagacccaggagaatatcgcatttcagtagaaagggtttccaaaaaaagtgaacaagcaattatgtaaaatgcagcagaaaagtcaaggagaatgaatattgaaaaggggtgggaggacttttaactttatagaaaatttcaggaagcatccagaactgaatttgaaatcaaaacgtctgggctcaagatacataaaataatttctccctatgtattacctctactccctcataatttcactatacatgtagttctttgtgtcctctttgactattctcttcagcataatcttccagtttctacatccactgctaatgcttccatattcttgatatttaaaaagcaagtgcattgtcatgtcatgatgcccacagaagccagagagagtagggtcacaccatatataactgggttacctaaagacttgtccattagcatatatttagaaggggctatgggcatcacaagcaaagactgacttgtcaagttaaagctaacatataacttctatagttaaatagcaaaatttagcaagcatttggtaataggctcgattagcatggtttccatttttttctagcaattgtatacaaagcactgaaaaagagaaaatgcaaagaagaatgtatagaatagcacatttatagactagtgtgttggcctcttcagaaatccagcattgtagagaagatatcatccacagtactaagtttaaaccacttaagctgaaattcaaaaccctacacaatttgataacagcctacttctctaacattatctctctctagccattcagtcaataactcaaattcctataattcaacaaacaagcacttactccattccaggcattgtgccaatcactacactaagcacccacaagccaggctgctcccatctaaaacgttactacccctactcctttactgaccagtctgttctcagcaggaaagcctttgctcttctctgtgcatattgaaattcctcgattattgacagcatacttgggagacaggagcaaggctgtgcaacctgactgctttggatttaaatctagttccacccttaggcagctgtgtgaccttgggcaagttacttaaatgcttcaatttcctcctctgtcttccttcgaggaatgtgatgattaaacacatatatgaagcacttagaagagtgtgtcaaggtatttaaaaccataccaggaatttagcaactgtttaataaatgttaaaaagtagtagtagtagttgttgttgttgttgtattgtgattctcagctgcagatgcacctccttcacaataccccacactcataaatctaactcatggtccatactcacatggttcttatcatatgtgtctttgcatatgttttatatctgatacatttttttggaggcaggctattatgcattttttttcttccctcagcacacagccacatgcaccacagtccctaatggtaatagtaaactgtgtgagtgtgtgtgtgtgcgtgtgcatgtgtacatgaattcagtggaccctaaggaaaattctatggaagagggacagtcatggttcttccatcaccaagaaacatcaaagtttggggtcaccaaaatgaaggaaagtagctatagcatcttctttgcaataggcctttaatactgtgtctatccttcttaccagtctggattagtttagattcatttctactagagggcagggaatgaactaagtaatttgtaattccaccagttcaccccttcagaacacctccagatcatcacaactcccaattttgctttgttaaatgcagaccagctgggaaccagcccaggaccctgtatccctgaagttaacccacactcatattgcttggaccagctggggctggcctgtttctggtgagacaaagagccaatagatgatggtctgacatgccaagaagtgatcatagctgcttcagaggtcatcagtaaagaatgtcagaaggaaatggcccaaggcagtagaaatgcttttgccctcttagatggtagtttcgcaagccaatagacaaatgacgagctggagctggaaatagcacaggactagtattagtgatagtactgggaaacggctttagcctgaggctggaccacatatcttccaccccttgctgagaggaaccactgcctaaaacagataagtttcccaacatgactaacttgagtgactatctttttgccgcttttcccctcacgctgaccagaaatgaggcatcaatgaaagtacacacttaagaaaaacctgctgttctgagctgcatcctccctgggacaaattctctggggcagaagtagacactaccctcagttgagtgggctcaccattttcttcagccccttctcaagccagaaccaagggaatagaaccagcattctgttcactcctgaaatctatgttaactccagcgctggattatcaatacaaattaaagtacagaatttgaggaattacacattttgctttaataaattgaactgtggtgagattagccctgcaacatcattgcattcactcattttcctgtctatatgtcactgtttcccaagttttattctacagaatagtgccacgaattattaatagggaatccctgaaaaaaaataaaaggttccaggtaaaacaagtttgggaaacatggtcatatgcttccttgaatgggagagaaaggaagagaatggcagctgcagtcgagtcattgcaggagccctgggttcaccatagggtgggcaccacacacaggctaagaccatcaatgaaatgtgtcgggagccttgaggaaggatgcttctttttgtgactttgggaggcctacaggaacaaccccagcattccatattaaaatgcatgtccaatgtcatataaaaccagtctaaaaactcccactacattcttaaaactcttattttctagaaaattccagaaatatggatctctattaaagacaatcttgaaagaaggttaaaagttgcctgcaagagtcctacaaagagcaggagcgtacacactgtggatgattccagaccaccacctaccttcctgtggttctaacgtattagctctataagcaagaagtcagtcattaaatccacagattgagaatgtccctttattgattccagaagggaacctgaaacacaggttaagtaataacctgaagcataaagaatttattatccagagcaagtgctgactcttctggatcatattggaacgtactcccttcctgctccctctttaattatcatttttaacaaaaatccagtagttggccaaaattctctgcccaggcaggcccagaaatgcactgaggggtagagggagaagacgactttcacccaaagggaacaatgctccatcactctgcttcttcatcacacaggaatatgatctaatttaacatcacagctaaaattcaccttgatatttatgtccctatctggtatctgtgaggctaggggaagggcagagacttttaggccacagacaggagactgttgagggggttgtagccgtaatgtctgcagacctgcattaattcactttgttaatttaaccaggtaattgggctgtgagtcctaagagccaagttagaattctggctctgctactcatcagctgtaacaaagggcgatttccttcccatctcagtgcttccattttctaatacgtaaaatgaggtggtttgtactagatgatctcgtggtctcttgtggctacacttctagccactagaccatggctctatgcaaagaggaaccacatctttcttgttctgttgtaaatctagcaccaagtacaatttctagaatataacaggcactgaaatgggtatttttaagtgtattaacgctcaaataaataaaatgctaagttcaacccaaaacatgcagctaattcatataacgtaagacagtgtccctcttttccctcatttttgtctcagcttcctagatgataccccaattgccccctcaccagatttacttggctggtgctttaagttccattgtcacctatcagagataatacaagtcatctaactggacctttagaaagaacatatgaataatacaatgtgtcagatatattcactgatgacaacagaaatcactgttggaaaagagcatcatgatagatggtgatgacttgtcattggaggttcagaaagtgaagaaacattctacaaaaaaaacctggttgctacacagaggttctcagcaagataaaaataggtagtactagcccaaagaacattgcaaaggtcaggcatttgtttctatatctccaaagttctctttccagtctccttcccaaattcaacaaaagactcatcatttaccatatttgcatgtttaagtctttaatcttgtgcaatttaagacatatgtttaaggaatttcagacaatagaaaacagatggggagatttctggcaggagagttcagtgagaggcagagaggtcttcatatccttaacaccgcactacgcctaaaactggttttaaaccaaaactacctatacaaacttttccagtgccctgtggtctaggggttggagtgcaacaagaagtgacagaatgcttacgtgaaaggaacaaggagttgcctggcctgtttctatcttcctgctcctgcatggccagactcagggtgcagggctccctctgactgagccctttacccttcctgaggccactatcccagtatagggcaacccaattccctcaaaaagggtaacgggctttccttacaacattattccttagggaagctcagcttctaaggttcctgatcatctagttctctaggactaaaccaatctgatatggtgactctagttttctgcacgagatccatgggctgacccataatctaaaaaaaacctgaaagaatatttgaaattatgcctgcatcacaatattgggcatgctccaactcagtagaagaccaggcagcttgaagcattagcatggggtacaaaaagccccaggcctgctcaaggaaaagaaagccaagatcaaggacaagagaaccttactgggagtaagatctagaatctgagtgtgatcatatacatgttgatgataacaaagaaaaagaacgcagcatcagggaaaattattcatgatgagacaagttattagtaccagtggactaaacaatgggggaaaaaagttctattttttttctataaaagtaatactaaatgtaaccattgcaatactaaatataaccatacacccatcaatgtatggccaaatacaacagaagtaacgtatattttaatgtgacaaaattgttagttttattaaatgacaatgctaaaatgaactgcttattcttcttagcctgtaatttgtggttgtcaatttgttcctaaagtaataaaagacaacattattgaaaaatcttgatattatttggtttgtctacctctatgcaacgccacatccttatctccaggtattatatgaaatatgttatgttattctaaatccctatcattttgtgacttaagattatattgctattttgaactgtttgagagtttttgagggttttataatttccactggcatgggcagtattgtatttaagaaaatgatgttgttatcaggtaaacttcagtatgaatatcacttaagaaatattcaaacttgcactgtgaggtattactttacctctttacatctcagtgtgcttttctataaaatgggtataataattgctatgattgaatataccaactaatggtactacataagggttgagacttataaagtctcatagttgggcagcccttagattatccaagtgatcatctaatcatggttgtagagatcatcttttcttatgtatagtttttaaaaattaaataccttggatgataatgctaaaaaaggacaaatatgtaactgggatatcagatgtgaggactgtttagaaggaaaaaaatgtttaaatcactgaatctacactggtccaaacaaatggaaatgagtcctatttctgaagaacttagtctacctaggagctctttgaatttatacgaagtagtgagcttattaatgtagtcatgctgtatcttaaagttaccttctattttttcccagctctgtttattatcatagctaatgattccagttctttcttactgaacccaacttctgccagacacagggcttggtaagatggatggatggatggatggatggatggatggatggatggatggatggatgggtaggtggatgggtggatgggtaggtgggtaggtggatgggtaggtggatgggtggatgggtaggtggatgggtggatgagtgggtgggtgggtggatgggtggatgggtgggtgggtgggtgggtagctgggtggttggatggatgggtgggtggatggatgggtgggtggatggatgggtggttggatggatgggtgggtggatggatggatgggtgggtgggtggatggatggataagtagatagacagatagataaaatgataaatatacataaaatctcaggtaattttaagaacaacctttaacatggttactattaattttccctcattttacatatgatgaaaatgaggtttaaagatgctaagaaatatgccccaaatcacaaagcaagtaagatatttcaaacaatagcaaataaatgcatcgttacttttgcaagacagtgggataacagtatcatcaagtatctatggactattatccctataaataaaacttgaatcattaattctccttcgaaacaaaactagaaatctactaacctatcccatggcgtaggatattcagtaacatatctggaaggaaaatacagaaaaggtcactacaagcaataaaaactctaaataatagtagcaggaatcataacaacaatgatgatagcaagaggaattaagggaaataaagaagagccagtatttccttaaacatctgcaagtgactttgtggaatctccttgagatttttccaaaaaagataggtaaatgtgaaatagagatactcaactccaatgaatgttatctagaatactttagtgagatctcacagcctacgcaaatggcacaagctatgttctctaatgtgtttctcaattttggcaagtatatggatgtcttatggatatggtcatcaaaaagtcattgttaatatgacactagaatcctgtgactacaacaactctagcaacaaattttcttcagaataatatctctgactggtttatggcaagtgattggtttatgactgctaagtccatcctgatatgagcttagaagatgttttccatattggtcttgaagaaacttatactttcatcagcaggggccaggacctgaagctcctccaagattttcccagtatcaccagattcctaggtctatgactcagttacaacatgttcaataaatattgactacgtgcacatgattttcctattgctgtgctctctgcaatgaggaatggcaataaatgaaaacacagtaccccatctggaaggaaatgaaatatcatggatttggagccatgtgttaattattgctaaccttctctggagtccctaggttaagaggacactccaaagcctcacagtgccctggagctatcatagatagtaactacgattctcaagtatcttttaggccccagtgctccgaccccaatcgcacaatccatttgtattggctcccattccagtaggtgcaaagctacctcattcaagttcttccctgcagatttctcctttcaagatggttgatttatccagaagtacaatctagctttttctagtaaactatagggcaaatagtattgtcgcacacttctgagttggaagtgataaaaccggaaagatacaacagaataattgaacgcctcttcttgtatcccagcaccaccgggtcttcctcagcctattcctggacagtttaaacctcaagcaaaggctttctgtgctctgacactccaggctcacttctcctcacgacctttaacttgctgctcccctgtgcctggggtgctcccccaaaaaacggctgtggcattcctttccgcactgcattcagatggctgcttaaataccaccttttcagaaatgctccccttggccaccctacctaaaagattaaaatctcactatcatcctgactcctctatcttattttttatcatttttaaccccttgaaaaaacgtatttctctattttctgtctcctcccaggttacacttgaatgtaacctccctggcaaggggaactttgttttctgcaactgcccagtttcccagacctaggaagtacttcactgacatatttcgagttaaaacaaaaaaagaaaacaatgggtaagacagacttatttgcttttgagtgcagagatcaattgtctgagcagggaggcaaacttatctttaaaagctggctctacctactagattattcaggtggtgttttctttttgccctggcatcttgtaccttgcttctcacttccaggacatatttagcccagagcctcaggaaggatttggagagggcttattacaggctaagatttagacctatgcacatacccagactcaagatcagacttgcgttaaaaccacagacacagagcagccattgactctaccacaatcaaagtttgatcataacatagaaatgggagattaactaagaggaagccaattagccaggacactcaacctcttggaccacagctgattttgaaagttaaatgtttgatggaatcttgcttcctcattctcaatgacctaaagcagaggcacagggaggtgaaatggtttgcccaacatcccacagtgtatcagcaaaagcgatgggcttggaaaccaccaggtttccatttcctgtctatgaccacactaagagtgagaatcctcaagaggcatgcagagtaagctcaagcactgatggtaaggtaggaggaaggaatcacacacacaaactcacactttctctcattctctctctcacacacacaccccacatactactgataaatgtgggcttcattaagttgcccttcccaagttgtctataaaattgcataaatatcaaatcttttccttgaaaatttcctggatgaatgtgttctttcctctataaacttgctgaaggcttagctatttctctaatctttgagtatatcatttcagttcttgccagcatgaaactatctcgagggagcactgaaaggagctaagtctcttgcatttcaactttccacaatccaaagtcaacccagattattacaagttttctcacatccttcacttcccccagagagaactatcttttgaggaacctatttcatctatgacaaataaatgatctgaagttttataacgcccctcaaagagcaagtttaggctttgagcacttcaacaatcagaagaataaaacaacctaacaagagatgcaaaagacctggaaacaagtggcaaaggcagattaataatataatttctaccatcttatttctttttgtcctttctctcactacctggttaatctcttattaatagttctccatcaaatatctcccctcgccctttcaatatcttcaaactccaatctgatgcacaaagctaacagtataatccttcagctgatattggtggaccctttacatccagttataatcagtactcctcactgtgatagttaaggatcctcacagtctgggcccactctattgtggtggtccctaagaggaaggggaggtgcattgtgcctgcatccagggtacatttttgtcatgactccaggtatgctagtggtattggcagtatctaataaataaagagcagagatgctgctaaatatcctacaatgcatgagacagccccctgccacaaagaattgaccagtctcagtactgctgaggctaaggaatcctgttctgcaggcttcgctccactcctttgtggttgtgtagttttgttttgttttgttttttcgattgactctttaatagatgatttgcaatcccctatacctagacattgtttatgagttcaaacccttggacatcatccttgcccctcttctacctggaagccttagaccctttctttagctggcagacccctgcctttactttaaggcccatcttctccttgaaagcttcctggatggatgtgctccttgctttctaaatttactgagtgctttgctagtcctctcttatgacatttatcaccattatctggaattacgtactacaggctctaagaaagtaaaactcttgtttgttcaaggttatatggccagtaccttcgaagagtggaatatagcaagtgctaacgaatacttgttgatcaaatgaggatttatctgtgatgtaaactcacaactctcctatcaaagttccctggaactggaaacatctttagctcttctctgaatcatgtatcacttcttcctagaaggtgcttaatgaacaatgcttatatgtctaaatatttaaatgaatacacatagagtataatagaaatattaagtaaatatgtaaatacaaaaatacatatattacatattaagtaaatacacaaataaggcttggcctgtagaaattcaagtcctaggcaacagttcacccatctcaattttcaattacttctaagaatcatgtcacaagtatgtttcaatgtctgacagttcctcatttttaaaaagaacaccaaaatgagcatttaaatgttaattgctcatctggagagcacatgaaacagaaaacacgcaaagacaggatgtgttgctagttgtgcctgagtagaaactaatatactgccctgaaacactgacttcagcttctagtgacacatcacaaacctgttgcaacacaaagtgcaggctaaacataaccaaattataatgacaatatttaagaatagagagaattgactgggagacaacagtaaacttggggccctagtggaaattcaactttacagctaatttttatctaatgtgctgcagtttgtcaaaattttcttgtagcccgtattcagtgaagatggagaagagccccaattctggggaataagtctatatatttttgtatagcaattcatactccctcatcttttttgccagacacactgattccttcatttttatcttttatcataggtgttgttttctgctttatagtcatccttccatataattcctaatattttcacaaattgcatacatagagaaacaaacagcattttaattagcactcaccttgctaagcccgttacatgcattatctcatttaattcttaagagagccctaaaacacaggtatgattattattccgtgttcacattaggaaattgaggcttggaaaatttaaggaacttgccccatgtcacacagcttaaatgactcagaggttttgtatgctgcgagcggcttctgtgacagtttttaaatgtctttgaattcatcaagcttctagtaattatttattgggcaccagtaaagactcaggctttgtgatggctttggagagaaagtggaaagcaataaggcatgtggtctttcctctcaggaagctgacagctactggacaaggtagatgttaatcaaattctcataatgaccctaaatgtacaaactgtttcttgatgcacaagaaacagaggctctgaaaatatgtaatcgaagaacctagctataactttgaagttaggaaaggcttggagtggttaggaattaatgattaatgcagaattcagaggcacagaagatgggaaacatctcagaaagaatgagcagcacctgcagaggccacggcaggcaggagtgtggcacagtcaacaaacacagagggacctcgagagggagtgcaggatgagggcaggtggggccagattgagttgggttccctagacacagactctgagacaaggactgggttcaagtatagtttaattagcagatgatttcagagagctcagtgagggaggaggaaagtgagaaaagacaggaggacagcaacagtggatttccacctgagcaactgggcctcagtcccgctaggacttctgagatcccatgtaaaacatacttcagagttgtctcactgagggacaagaaaggtgggccactcatccccaagccccaggctcaggggtgctcctggagaccccagtgtgcctcctgggagagagcatgccagggcaggagctctctgcatgtgggggaactgccacacatgtcgtgaggctggagcatggtcagcctgtgctacaggacttaggcaactccaccctaagagtgatggggagctatgcagcaacctcacctggggcgaggctgtatcctgatcagatttaggtttggaacattgcaatgtggacagcagattggagggagggaagggcggatgtcaagaggcagctagaagttaccagaggcaggaccagctgcataacatgtaaagaccagtgcaaagcaaaatgaaaggacccttgctcacaaagaaggataaaagtgcgtttaaaggtaggaaaacattaagtttattcctttctcctgtgctaatgggtcctgtggtttttaaattgctactgagtattacgctctcttgggcacagggatactcctggggtgagtgcagattctcactggcactcaggagggagtaccaccctgtgacaaagcccaactgctccagggtcagccaccagcttgaaattccctgccccagctggaagtggggaagttgagccaggtgtctgcccttcccatgggcctgccaccccaacccacaggagaggggaactcacaaagaattgtaacctccacattaggaagtaaatctgggatgtgcaagaagcacacccctgctgagtcatgtgctaaatgtgccatggcattgccagtccctggcagggatggtcatcaccattttcagtcccaagaacccacacccaaccccaaccctcctcacacctgtggccaggtacctgttagaggcaggaggcggcagcagccatcgaggtgggcaagaggagaccagatgtagcctggggcaccaggaaccagggagtgggtagccaagaaccctcaagggaagcagagaggcagcaggagatggaacagtgtatgagccaaggcacatggtcccatcactctcctcttacaaaatgtaagttcagagataaaattggcattaagcagtgcaagacagctcatgcagagcataaaatcccaagttgagggtcctttggagtaagggtccctgtatgactgcactggtcacatgcttatcacgttggtcatgggtccaggacagaaaggacagtaacttggtctagcgtctaagatatgaagaaataagccaacctgaaaaatgtttgggagctaaaatgacttcaaatcatggatttcatatgaatgggtatgatggagcaagatggggaaatacaggaggatgcctgtgtgtccatggaggcatgctaccagatgtcccttcaagaaagagcttgctatttggctgcaggaagtgcagttagctgataagctccagccattagcaccttcaggatttgcttcagcttttgtgctcaagctacactttccccaggcagctgttagccaatgaccgcacacagcagggatattagcgcccattcctttctacctaaggcaggactcctgtaatcgttttctctggagcccccttttgggtttccctagactttgtcagatctgcattatagtttgagactcccgattcttagtcctacttcctcccccttttccttccacaggtatgatattcgcatgggtctctgaagacatcccctgctcaatcctgtgttcttcccctttcataggcattatccctccactccataaacctctagctccatctcagcattttcttcccagggaatccagctgacacagtgtcaaagacatgtccgagttatctgtttggtgcatctgcatggactgatcggggatactaagaaacagcaggtttattgtgcctcagttatatcacctagcacctttgcaaagcactatgcttgcttcattggagaatgtagactaagatcactgttcctcaagaaggctatcatctagatgggaagacaaggctcaagacaaatgagcagatggcttttccaaagacctgaagagaattctttgcaagagataaaaacctccagatgtttaggcagaccacacctcaaagatgacacagcaagttttctctgccaacctagatataacttctagattgtatgtgtgtgtatgtgtgtgtgtgtatctgatgaatttgtataacttctcaactctgtgaaaggttagtatttcataagccaccaagaaacctaccttgacttccagaagagtctaaaacagcctccaacactatgtccaagaggttgctaaatctgtattttcaacaggtccccagagagtgggtatgaactgggctttggtgtgggcctgcaaaacaggcctagctatccttcctaaaggcccaaatgccctgctccaccaagcctggctgggctaatttggaaagttactcacgaggacttgcctgtttgatccaaggatgacatcaaaggattgatgctccatctgtcagctctcacttttatctatttgctctttatttaaagcaaccatttataaacagaggcttatggaattaataaactccaaaaaagatgatcattcactatatctctgccaggtgttacaatagaacaaagagaagtgttgaatcaaatgccaagctttgtaatacttaattcggaaagcagagttttcccggaatgacccccactttggacagaacccctactgcacactcatcctatctttggcaattcagcaacaatgtattttccatcttgtggagagccagaatgctgttggagcagtgggatgtgcactcagcctttctgcacatggggacctgatccaaccatccgcacgtgaccacatgttctctgaggagctattgtgcattggcattgaaacatttcaaacatttcagatcatgggcgcttcttggcaatggtccttagtagtctaaataggcagattaaagaactagatagcagccaattgccttgcaggttttgtataaactattcataacaaaagtgttggagggaagaaattttctttacttctctcccaggtgaattgagggaggaccagggagaagcaaagctgcctgtccctgggtcttcactctcacctgtgtttccatctgaccgatgaaggcaagcagagcagacatgaaggaggggtacatgcggtggatgggtccgcgcctagagaaatctcaaccacaggtggactaaaacggacatatcagaaggctatgaaccatgatcacacacggaattctagagaatctaagtctataggattgtatcttttattctttctttctttttggcatggggttggggtgtgcatttattttattttttattttatttatactttttatttttccataagttattggggtacaggtgatatttggttacataagttctttagtggtgatttgcaatattttggtggacccatcacctgagcagtatacacagcaccctagttgaagtcttttatcccttgccccctcctatccctttccccaaatccccaaagtccattgtatcattcctatgcccttgcgtcctcatagcttagctcccatatatcagtgagaacatacgatgtttggttttccattcctgagttacttcacttagaataatagtctccagtctcatccaggtcactgcaaatgctgttgattcattcctttttatggctatgtagtataccatcatatatatatatatatatacacaccacagtttctttactcattgattgatgggtatttggatggttccacgattttgcaatcgtgaactgcgctgctataaacatgtgtgtgcaagttatcttttttgaataatgacttcttttcctctgggtagatacccagtaacgggattgctggatcaaatggtagttctacttttcattctttaaggaatctccacaccattttccacagtggctgtactagtttacattcccaccagcagtgtagaagtgttcccttatcaccacacccacgccaacatctactgtttttcaattttttgattatggccattcttgcaggagcaaagtgatatcacattgtggttttgatttgcatttccctgatcattagtgatgttgagcattttttgcatgtttattggacgtttgtatatcttcttttgagaattgtctatttatgtccttagcccactttttgataggattttttcactgatttgtgtttgttgtggattctgaatattagtcctttgtcagatgtatagattgtgaagattttctcccactctgtaggttgtctgtttactctgctgactgttctttttgctgcacaaaagctcttagttcagttaggtcctagttatttatctttgtttttattgcatttgcttttgggttcttggtcatgaaatacttatctaagtcaatgtctagaagggtttttccaatgttatcttctagaatttttatagtttcaagtcttaggtttaagtccttaatccatcttgagttgatttttctataaggtaagaaatgggttgtgtcattttaaatcccattagacttttttctccaagcttaacaaaagaaaacaggcatgtggattcaaagtctctgccttgctgttcctaccttgctgtggtaggttagtctgattcatgcaggcacgacaggcccaatcagatgctgcatatacaaattctacagctgaaaggggacagccctgagaattccaaaaattcttttgctaggtgacagcaagggcaaatcatgctgtacaagtccccgttcctcctccacagatcctctcccaacactaggcctacattcataaacttagcccttctccatgagatacaagcagaaaagaataaagtcatttgctagacgattctaaaagtcaccacagctattcacaggaaatcatcatgccaaaaggtgtagggagacactcatatgaggggaggtggagaattgagtggggagatggcatactcaatagctcagctaaaaaacaccatcatgatcatcaaccccaagccttccttttagagatgaatacattgaaccccaaagatatgatgggacctgcccaacatcagtggcagggcccctgccagggcctgggtgtcctaatcccagtcctgctgtttccattcctgccactgatgggcctgccacagctgctgatggaccctgacaggagacgtggtgggaatggctgctttaaggaccacatcacagagtccctgggcccctctgtccttattttcatctctctccatgactagagtcaaataattcttctttggaaatcactttctaataccaaactcaggggcttcctggacaaaaagccagctcagtgcactatggcaacacacagcaggagaagggaagaaaaaattacccgttaagacatgtaatgccgaatccagacccaagatggccgaataggaacagctccggtctacagctcccagcgtgagcgacgcagaagacgggtgatttctgcatttccatctgaggtaccgggttcatctcactagggagtgccagacagtggatgcaggccagtgggtgtgtgcactgtgtgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccgacttaaaaaacggcgcaccaccagactatatcccgcacctggctcggagggtcctacgcccacggagtctcgctgattgctagcacagcagtctgagatcaaactgcaaggcgacagcgaggctgggggaggggcgcccgccattgcccaggcttgcttaggtaaacaaagcagccgggaagctccaactgggtggagcccaccacagctcaaggaggcctgcctgcctctgtaggctccacctctgggggcagggcacagacaaacaaaaagacaggagtaacctctgcagacttaaatgtcactgtctgacagctttgaagagagcagtggttctcctagcacgcagctggagatgtgagaaccagcagactgcctcctcaagtgggtccctgacccctgacccccgagcagcctaactgggaggcaccccccagcaggggcacactgacacctcacacggcagggtattccaacagacctgcagctgagggtcccgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaacgcagagtgcctctcctcctccaaaggaacgcagttcctcaccagcaacagaacaaagctggatggagaatgactttgatgagctgagagaagaaggcttcacacaatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgggaagaatgcagaagcctcaggagccaatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccagtagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagctgcataagtgaaggagaaataaaatactttacagacaagcaaatgctgagagattttgtcaccaccaggcctgccctaaaagagctcctgaaggaagcactaaacatggaaaggaacaaccagtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaggcaggggttgcaatcctagtctctgataaaacagactttaaaccaacaaagatcaaaagagacaaagaaggccattgcataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaaccagacagaaagtcaacaaggatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaatgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacacacttgatagactgctagcaagactaataaagaaaaaaaaagaatcaaatagacacaataaaaaatgataaaggggctatcaccaccgatgccacagaaatacaaactaccatcagagaatactacaaacacctctacgcaaataaactagaaaatctagaagaaatggatacattcctagacacatacactctcccacgactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagctgggcagagacacaaccaaaaaagagaattttagaccagtatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctctgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacagagtgttggaagttctggccagggcaattaggcaggagaaggaaataaagggtattcaattacgaaaagaggaagtcaaattgtccctgtttgcagacgacatgattgtatatctagaaaaccccattgtctcagcccaaaatctccttaagctgataagcaacttcagcaaagtctcaggatacaaaatcaatgtataaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatgtaataaatggtgctgggaaaactggctagccatatgtagaaagctgaaactggatcccttccttacaccttatacaaaaatcaattcaagatggattaaagatttaaacgttagacctaaaaccataaaaaccttagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatcgacaatgaactcaaacaaatttacaagaaaaaaacaaacaaccccatcaaaaagtgggcaaaggacatgaacagacacttctcaaaagaagacatttatgcacccaaaaaacacatgaaaaaatgctcatcatcactagccatcagagaaacgcaaatcaaaaccacagtgagataccatctcacaccagttagaatggcaatcattaaaaagtcaggaaacaacaggtgctggagaggatgtggagaaataggaacacttttacactgttggtgggactgtaaactcgttcaaccattgtggaagtcagtgtggtgattcctcagggatcttgaactagaaataccatttgacccagccatcccattactgggtatatacccaaatgactataagtcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggtgggaggggggagggatagcattgggagatatacctaatgctagatgacgagttggtgggtgcagcgcaccggcatggcacatgtatacatatgtaactaacctgcacaatgtgcacatgaaccctaaaacttaaatttaaaaaaaaaaaaaaaagacatgtaatgcctagcagtgacagcagaagagaagtgaaaaaaagagtttctttcttccgttcagcaaatatttaccaagtgccaaaatgcccaaagtggtgcactaggcactgtgtgtgtgggatgggatggactggggagacatcgccaatgaattcataaggctcttgtcctcagggaactcaccatctgatagaggggcacagaccttctctccaatgcctaggacaatcatggggtggaaggtgctcaaattgaatcaaaaaagaccaaagtgacccagagctcacttttatgtcttacaccagccagcccacaagaggaagtgaatttcagaagtgaattccaaacacaaagatatgtataaatgatatggcatgggaattgctggtgttttaactttattttccctgactgttcgacatagaattgtgtttgagtttgttcagttctggctgtaaatagcatctgtcaaccgcgtaacttttagtatcatcagtgacagacctgtagcatcaggctagagtgcgtgcggctgtggcagcgtcttccagtcctctgggctctaagtctctgctctgcccattctggttgctctctacggctggtgccaaatggttcccgtcgcttggcaacagacagcctgcagtgatctgggtctcgtgtctgaggctgaactagggaccaccctgaatcatctagggagagaatacaagaacggagggactgcccctcaccccagctttcctgtggttaaccaaacccctagctgtgtttccgcaactagcaacacccgctgcatttgtcatcacagctgcacacgtgccgccgcctttgacaaagacatggtatctgtagcatactttctgggaaatgctgtctgaaggtgctgcatcactgacacttgccgtccaacttgaattgtgtaagaagtattaggcattttagaagctcatgcagagactctgggctttctcataagctaacacaagcagaaaaatctacctgctcaggctcttttctaagccaaggatgccagaattccaaccaatttctgctttggccaaagagtatctcaattgcatgctgacaagagcttcagcacagctacccatcttcattttcaaaacgtaggtgcatctagctcagaaggatagggtcctggagacccaggagagaaaagacagatcctctgaatgtcagaataggacctttttccctgtccttgtgctgtcagcctgactctctgagccacagctccaagaacagccctggggttatagaggtgcagggcttctagataagaagccagaacagacagtcccctctgtgtcatttgtcgttacacaatatcctaacctcacgcctctaggggggcagcccagcaaagccagcaatagccagagactgctggctctttctgagccactcatggtttcaaggtgtcccagattttaagaggctgaattttctttatgcttcctgagtgcttctatctctccactttaacattgacatatgcatgtattgcagtaatattatttattcaaatctaccatgttctgggcactggaacagtgcctggaactgttgctggaactgttacagtgcctggaacttcttagagtattatgtattcaaagtaatatcatttattcaacaaacaatattatataactccttctagggcttacattctaatgggggagcacacgataaacaaataataaatgacagtaaaataaaacaaataatcacatatgaagaggtcctctgtgcaggatgtgaggaccaacgtttgagcactggctctgacatagagtatgtggaacccttattcgctcatgcaatccccagggaaatcctcttaggaggtactattaagcttcacttgacaaataggaaaactgaagtccagactacacagcctaaaaatagtagaacacaaatttgaacctgggtctgatgcccaagatccattatcattccacttcaccatctctccccctgaagcaaggtcaagagacaaggagaaggaaggccaggactttgagcctttccacctcatgcaagagtgtcctctgagcctccactgctcaactcaagcacgtgtttttaaacattccaaagcactcccagttgcaaaggagatgttgtaggatgttaggtctcagcacaaggaacccaaaccttcaggggctctcctctacattatgctcccatttttctcccaaaatatcgatctccacccaccctagacatagaactggagaataagttccagtttcatccctttgcagatcttagggggacccatcaaattcccagccactgggtgaaaatcagcagcttctttataggacctgagttgccttcctagaggatcctagaggaaaaaaaaaaatcttatccttcaaatactgctgtcttccaaaatacgtaaggacgccacggtgaatcatagtggacaccctgcattggttgggttattatttatcctagaagcttgggttcttggagccctagcttatttaagcaacaaagtccctcacagcccacaggtgaggaagtgagtgtaacaaagagatcattggacctaaaatcaaaacacctgtcaaatcccggttctgccacttactagttatgatcttgagccagagacttaatttctttgagcctcagattcctttctgtaaaataaacagttgtgtgacttaccttacaaggatcattgtaaaaggaaagaagacctatgtaagattctgtgttgaaagagctcagtacataatcatgtattttaaaaattagatgtggctttaatttttaaatttttctcattaaatttgacagcaaattatgttacttggctatgaatttaaaccttgcttacgtctcttatttctgggaaaaaacaaaaaacacctgcaaggttatcccactgctgattcctgaggggaggtccctcaagggcacataaggtgacaactcctccagcatggacaacagccacccagagatgccagggaagaatagagggaactctcttctttttccaactttccacgtaatttgtaattgttgtttaaactctcaatcctcctggtgatatgataggctcaactttccaagatactgaagttgaaagagtttaaaaaaaaaaaaaaaaaaggtataaccaggaaagttagctttaataatctccattccagacattttaacccacttgaaaggggtaatacttaccccccaaaacctaaagggtgactgttttgagcatgaggtgtggggaatagagattagcgtgagagggaggaaagtgttaaaatagaaagaggcagagaggaaatgaaataaccttcctacctcttatccttgagtgctttcaagagcctgtctggggccaggagccccaggaaacaccaaggctgtttcttgccttcacctttgggctgttttttactgccattcattaagaaaatcttttccatcagccttatcatccttttcttggctcttggtcaggttgagtcagacgtggaacatttactttcacaaagactaaccaatcttttgtctagacgcagatgtcttccaccaaagcttgttgatcagggtcatgaaagaggctggtaaacacgtaggcccttttgtgtaactgaacactgtggggggaagactgaggacagaggaaatggagaaaatggggggagctaggaatttgttgatagcatataaaagtgggcaactgaaagcactgtgaactctctttgtttgaaaagtgtaaggggactagtttgtagtatccctaaaaaggtttgcagatcaagagtggaactgggtttcaaaggccccagggccttttcttgtcctgttgcctctgcctggaccattttctgtccttcctctctacttcctcttcccgggccaacttttattccctctcccagtcttttgctaacagccacttcctcaggaaagctttccccagcccctgcggctagggcaggttgccccattacccactctcatcacaccctgcactttgccagtgcagctgtcttcagtactataattaaatgatgatgtgtgcacagctatttggacaatgactacccatattcattagtcgttgggcattttgtaaattatcttataattgagctaattgtaatctttaagcagtaatattacacaacaaaaacgtgtataattattattaaactaataatgttgtctctctggctagatattaacctccttgagggcagggactgcttggacctgtatgtaatggggtgcccagtgcctgatactgtgcctaacacataggtggaggtcaaaatatatgttgaataaatcaatgtatgagtttgtccatgagggcaataaaggggaaaacgtaaggggaaaagcatccagagaatagttcccactggtttaggctagacaagcaatgtaccaatgttttggttgccccagagtccctagtacggagctatttcctacatcattcaccatcctgagcacagagaccttctgaagtcttattccattgttgcctttaacagcaaagaaaaaagaaacttggaagccagctccctggatgtactgtatatcttttgaaaacaaaaagtggtctttggtcatttcagagaaattttaaattcatggtaatatgaaaaagaactcattgtttaagaaaaatattttggccaggcacagtggctcatgcctgtaattccagcactttgggaggccaaggcatgaggaacatttgagaccaggggttcaacactagcctgggcaacatagtgagacccccacttctacaaaaaagaaaaagaaaaagaaaattatccagacatggtggtacatgcctgaggatagcttgagcccaggaggttgaggctgcagtgagttgaggaaaataaacgtctcatttctcattccaaaaccacagggacactttactacaaaagtatgattgcaccactgcactccagcctgggccacaggaaaaaaaaaaaaaaaagaaagaaaaagaatattttcaaggagtgaattagactatagttttggaagtctgattcatccttcatgtagtgtatgttatgttgcattagccatctttccatgaagttccatcactagataaatgaaattgagcatgtctctgcataggtttggtccttcagaggtattgttgattctacaaaagcagagacagtctcatgcctatcttttgtaaatccaggacactatggtgtcttgggcacagaataatcactgatgagatgaataggtgcaccaagtcaagaggtccttgaaaggtcccccattaaacctatgttatccccccattagtttacctcacaaagcatgattccattcttaggggaaagtttcacaaaatggctctcatatctccctctctgtagactcctaacttattgcagcctggtttctcctggccttcatcccatgatgtgtaccagctcagtgtgtctccttcctgctctctcctgctcagccctctcccaatcctccctctatctttttgatcttcaaaggagtcagacaaggagcacatccccctccaggcagtattctctgccagtcttttcagatgactgtattttcctggtcacaaaacgtccccagtgtccaacatcttcttgagtaagcatctacataaaggaagcaagtcatttcatgtgtgcacttccattaatagattctcaggatcagcaccccagggatcttttacaagctcagtggaagtattaatagcatcctacattaaaagatactttttaaaaagtctgttaatttagtcaacattcttagcctatacatcaatgtcaaagcaatgggatagccaagatccttgagcactggtggccttaatgtgctgctagtgcgatggtgatgttcttaaatttgtaatatgtcttcacttaattgtagcttgatttcttttgaatgagcttatttattttaagacctgggtctgtgctttgtactgttcattttcatatataaaaagaaaggtgagacagcacaggccagtgtctataatcatttgaagttatagtccaaaggtcaagaattatggaaggaattttaaagaaaatccataaaattgggcaaatagggaccagatacaatgaataaagttctctcagagtaccattgctgcctttttgagcaaacataagtgcacctacctctgaaaactggcttcttgtgaattaagctagcaggtcatcggccactcaacacagcggccaatgacttggtagctacaacactgtgctctgaaagactgagaatgaagatgaaaagaaagcatgccaccctgttaatagtctatggtaagaggagctgtcagcattgcagcattaggaagagggattagtctttccattattcaacacaactcatcttttttgtgccaacaatgtgttcagcactgtggaaaacacccaaagagtctgtcctcaagtatgatcacgttgaatgtacaaagggaactggcaaagttcctaaaacctggcctcttgcctctggaggacgttgtgtgtagtatcgtttctcacaccctacaactaagtaaggtcaaaagagaacaggtggctcttacatagctgaccttcaatgtccattctgtaggcatcaccccattatcaggagtaggtactgtccttcactcttgttctgtgtctagcagccaggcaccacccagctaaaccagaccacatgctcagtttctccaacagctcagtctcccaactgattcctaggatgaatgaatgtacagatgaaaggcctaaagagcctggtgcataagaggtcacagcaaacgtgagtgtgccttccctgccttcagtacatccagcaggcactctctctgccctccctcagttggacatgcagcctcagatgctgagtctcaacttcccttcctcaggggagctgctatagagcaataggctagcttgcctttgttctgcatcccacacaagcagagaagccaatagacaggcatggaggaagttggggaagagcaggaaacatcacttgtgcactttcatcagacactggtgtagccgttttgtagatatgaatgcatttaatcttcagaaggatcagaagcagggtgttttgcacatgaagagactgagatttagagaaatcaaataaggtttttaagttcacacagctagaatgtaagggaagattttagcctaagactttctgatttcaaggtctttgttttctcccatgaaatttcctgagaaaataataccagggctcagaagacttctaacctggcttccaaactcaagagacctggaaaagaaccaaattggaagagcatgatggttgttgattcaaaatttctccgaggcattctgactggccaccaacatgtcaccacaaacttcgaggctccagaaactaatttgaaattccaaaagaaaacattgccctaaaaatatgctagtgacacaaagacaaaataaaaataaatctcttttctgtgcatattttaagtaaagtcttttttcctttagcattgagtgcgtatgcctgtgcgggtatgagagggagaatgaaagcaagagagagagttgagagggactttaaaatgtcaacattcttggtagtgttgggaacccaaacacaacagtcttaggtcagtgcctgagaactagtaaggcaaaccaactagacaataaccataaacatggtcccttttaaaattgatgttgctcgtgtctctgggagaataaaaaacaaagtcaaacaaaaactatggcttggcaacacttccaacttttaagagggttaaacaaacaagagtttgggtcagagaaagcagtggtcattttcagagatttgggatcagcaagacacattttgaaatattttgacagagctcgggaaggactggaagcttccaaatgaagtagtaaaagatcatttaccttgccctagttaattctgtaggaacagaaacattaaaaaaaattattcctctttattggttaacaaaaaagccaattatcagaggtaggtagctagagttttgaagtaagagtcttgtgactctgctgaaaagatgccactggttagcctcccgtgtcgatagggcgggtccctgctgagtgggctgacccccaagatcagatcagagagcatcgtcttaccagggcctgggactcagagccacagaggggccgttgagaagctgtccaaaggcaacttatgttccctcatggacttggcaagctccaaaggtcatatttcagcttgacctaagactacagcttcctccatgaactctaattcccctttccttgactccctcccaccacggactgcaaacagcccagttcagtctcccacatcaaagaattccttttattaaagcagtaaggctattcctttgggtccctctaccatatatggcttaagagaggaaaggcgggaaggaaagcacctcgaatatttgctgttaactttcaaagggcaccctgtttgcagaggggttatcttgtgtccacaccctttgttttccctgggcctgaaacaggagtttgatgaagtgagcctggatccctttgactaccacagagatgcttttctgagggcacctgtgataaaattaattttttaaaaaaaaaatcatgtgcttccaggtcacatctgaaagaaagaggacacctggaaaagtcttaaccattttggatggaatgagggaccacagttgcgtatgttctttttagctactgataaataacagcagaggaaaccaccagggttgtcctgcattgggatgctgatctatgcaaacaagatttcaaaacaaaaacgggagcctcctttctctaaggaagctcctggatttcccattctttttcctctccagcctatatggcatgagcacatagagagtactcagtgaagacttcttgaatttaaaggaattaaaatcaaagcatgggcacaagttgccaagaggaaaacaaacatctcattccttattccaaaaccacagggacactttactacaaaagtaccttagaagcacgtacataaatcctccagtatatgacatggttctccgttttgctaaattcttcatgggtgtgcctctttcctgtcaggatttcctacatataaaagaaagcacaaaaattcccaatcatctctggttcttcccttgtggggaaaagggccaagacataatccttgatttcccactttggaaggcgtatactaaaattttaactctgaaagcaaagaagacacacagaaatcactgaacccttttccatccccagtatcttctggttgactcttggaagtaatattaaagataaaagaatccagatctgaaaattcaggtttgttgtcttgagtcaatctactttcctccaaaatatttccaaaacacctaggagcctagactcctgacccaagtttctgcctttcccttgctggtttatcaacgagtgtttatatcatgcagtcagtgtgaggagatgggctgtcagagacagctcttctaatttgcaaatagtaagatagttgctgtccaagcaaagagccaaacaaaatgctcacatattttaaataagattattattaatgcaattgtcaaaatatttctgactcaagacaagcagaatttttttttaaaaccctttaaatgaccttgtatacaacttccttaaaaagtgaataatttaaaagggccctaaatcaggggtcagcaaactacagtccacaggccaaatccagtctgctacctgtttttgtaagcaaagtttcactagaatatagtctatgatggctttcactctacaatggcagagctgagtgtttgcaacagagactatactgcccacacaaggcctaacgcattgactagctggctatttagtttcccaacccctgccctaaattatttcacacgcttattttcaaacaagtggtctctaactgtttatctctacctaatatatctcatgccaggaaagtatccaaaattacaacttctctttatagaaacaagagagaacacttcatcttcatactcaaggaaaagagtttattgccaattctaaaatcaacacacagaacacagtttttctttaagttcgggatatatgtgcagaacgtgcagttttgttacataggtatatgtgtgccatggtggtttgctgcatctatcaacccgtcatctaggttctaagccccgtatgctttaggtatttgtcctaatgctcaccctctccttgcctcccaccccctgacaggccccaatgtgtgatgttcccctccctctgtccatgtgttctcattgttcaattcccacttatgagtgagaacatgtggtgtctggttttctgttcctgtgttagtttgctgagaatgatggtttctagcttcatccacgtcgctgcaaaggacatgttctcatccttttttatggctgcatagtattccatggtgtatatgtgccacattttctttatccagtctattgttgagcatttgggttggttctaagtatttgctattgtaaatagtgctgcagtaaacatatgtgtgcatgtgtctttatagcagaatgatttatagtcctttgggtatatacccagtaatgaaattgctgggtcaaatggtatttctggtactgcgagtcaaatggtatttctggttctagatccttgaggaatcgccacactgtcttccacaatggttgaactaatttacactcccaccaacagtgtaaaagcatacagaacacagttttaaaggacagctatatttctcaaaatgtttgctcagaaaggagagtgagctttctcctgctaacgtatgctatgttaggtaagacttggagggagctcagaagtagaaaacttacatggaaagtctatcaatgtaaactgtaaaaggggtcgctggacacaggtgtgatgaggtgacaaagtgtctgaagcagtagagtgaagctagacaactgccttcactgattccctttggcagaacaggagctgctgcaccactcatatgtcacatctcatggacactcatcaggatcaagatgaacggcgagaacagatcccaaaccccagagactaagcataaacagggctgatatggaagcctctccgtgtcaagacccaggccccttccatcttattgttctggcatcttcagtttgttgtcctttcacatggcccaagaaggccccagcatgtctgcactcagttcagagggacaggaggggtggggcagggaagaggcagcacagaccagaactgagtcacttgggcaattgggcatgaggagctgcagaagaggctgacaaatgtcgtcttttattgtaggaagccgtggccccagaaaaaattcaagcatcctggtgcttgaaggactggtaccaggagacgactagcatcctctactacaatggagaaatattgcctcaggatgaatgagtctaacatatcatttcttgagaaaagacgtgaactgggagaaaaaataacaaattctgtaaagggaaaatgaaggcaccatcatatttggagaaaatatccaaaaaagaggtggatgagcctggtaatagacttccccaaacttctcctgggaccaacattaccccatacagttttgagttttttgtttgttcgtttgtttgtttgtttgtttcaagattcatatagtccctagtctggttccagatcaaagggcatgaccttcctactaaaattcagactgtgtctggtgtgggctgccagccatcatgtgatgtcctgcttggcgtctgcgacacagaagtgccagcacaaggcagaataaccaggaagctcacttccaaagccattcacatggggtgagagcacagtgctgcctcagccaaagctcggacagctctacccaatcggcaaatcaaaaacaacaggaaagaggtgggcagacctgctccccccacacccaggatccaccaaacctgtgccagatgaaacaaaaaagaaaggaaaaatgaattcagacacctgtggcaaagaaaaaggtacaggctgaccccacattccatttatttcaggcttcctccaagccactgcttgtcattttgaagctttacttgtcaaactgcacatagtcaatttttcagccttaccaaaaagagaaaagaaaaaaaaagaaaaaacaggacccaaaaatgaaatccatctttgccaaagggagttgcaccatcctgtgtagcagcaggcacaggtgctgctggtacaatccaagtacgggagagaaagaaatttgttatccagcttttccacattttgccactgacagggagacccttttcatatttcctgtgaggagatccctcaagtggggaaagaaggaaggtgcagttaaggtctcctctgcccaggtggcaaatgcacctggccctgtcatgctggcttcctgagtgggtgctacacattctgagaaggagggatgtgactgcgtgaatctcaacaccccacgcagcactccaagctgctaagcccagagagatggtccagggggagaaccgcacccgtcacccagcacctgtggagtagccaaaaccaaggccagcccttgatgaaatcttggagttttaattgtctcaagtttgctttcagtgtcctttgccctctgttttgcatccttctctgaggaatcccagactgcttatccaccacctcacccacgcagcccatatcagtactgtctgagtctagacttccctcaacatcccccgctatgaaaatgcgcgtgcagtgcctttcatgttactgcaggaaaatggtctgtgttagaaagaagctgataaaaacacttccctgaataactcttgagtcaaagaggaaatcaaatttgcagtttaagagtttttagaggggaaaaaaagggacatttacaaaactatatatcaaaatgcatagtctgcgaccaaagtttatttagaaaaaaattgtggttttatacataccttaaacattgaactagaaagaactgaaaataataagctgagcagaaaatagaagaaaaatattaataactttgagaaagagaaaagagatatataactataaaaaaattacaaggcaataatgcatataattctatgcattttaaagtattagaaaattttctagaacatttaaatggacaaaatgactgactgagatagaaacattaatatgctaagtgaaattggagggaaaaaagtttaaaataatacaataaataattaccaggcatagatgctatgtaattcctaagcttttgagattatttcagagaattcagaaagatggcaaggttttcattaattttaaaatgttagtacaagcctgatattcaaaacttgactaagtcaacacacatacacatcacaccacaaacatggacacacagggcacatactatacacaccattaatataatgtataatatgtaaagatcataaatatgtctttcaatgtgatcaacctaaatattaaaagaatcattcaaaatggttaagttttattccaaggatacacggtcattcagtgttaggaattctatttgtataatttattagtaggtcaaaggaaaacagatgaccagctcaaaaaatgcctaaaggacatttgacaaaacataacgttcatttctccattttaaaaagttaacctgggcatggtggctcacacctgtaatcccagcactttgggaggccaaggtgggcagatcacttgaggtcaggagttcgagaccagcctggccaacatgagaaaaaccctgtctctactaaaaatacaaaaaaaaattctgggtgtggtggcatacacctgtaatcccagctgcccaggaggctgaggcaggagaactgcctgaacccgggaggcggaggttgcagtgagccaagatcacgcctctgcactccagcctgggtgatggagtgagactctgtctttaaaaaaaaaaaaaaaaaaaaaaaaaaaaaattgtagtgaagttggaaaaagacattccttaaaatgataaagagtttgtctattgaaagccaacaagctagaatagttgaggcactcccatcaaagtcacattaaacaacgatgcctgctaccacaactattacaatacattgttacagaagctctattacatattggtagacaagaaaaattgtcaagtgaggtattactattggaaagaagaagataaaagtaacattctcagcaaaacattggattattcatttggaaaatttatgagaatcaactaaaagaccattagaatgaataagatttcctgacagaggccagttagaaaataaaaatacctcctcaacatacttgcaataacaaatttaaaaataaaacagaaaaatccatttaaaaagtaataaagagaagctagctaagaataaactcaacaagaaatgtaagatacctattttttattaaaaaagaaactgtaaattactgaaggaaataaaaggagaattgaacccatgcataaacactcaatactcaagatgaaaaaacttaataccgaaagcatgccattaataaactgatccataaattttacacaagtccatccaaaccccaccaagctgttgtttttgttgttattttagttttattttggttttttcagatggagttttgctcttgtcgcccaggctggaatgcaatggtgctatctcagctcactgcaacctccgcctcctgggttcaagagattctcctgcctcagcctccctagtacctgggattacaggcacccgccaccacgcccggctaatttttgtatttttagtagagacggggcttcaccatgttggacaggctggtctcaaacttctgactttaggtgatctacccgccttggcctcccaaagtgctgggattacaggcatgagccatcgcgcccacctgttgtttttaattgttctttgctgcggctgttgctgaattttaaaacatgaatatgatattcatcttgaaaaatatatatgaagtaaccataaaaatcatgaaaaagacatgtaatgagggaggacttacacatgtgatgacctataaatggaatgttaaaacaatgtgttgctgttgcaggctataaggcatataaaactgtttatgatgctatttttattctcaagtaagtctcattcttttaagggaaatagacataaaaatgaaaaagcttcataaagtacaatattagttataatattaaataaaaatatgaatacgaagtgctgtagggttgcaggaaggggctccccactctgcctgtggaacgcgtaagctggcgtatggagccagagtggggatccctgggggagaagggtggcagggctcatccgagcttagggagggtctgaggacgtgtggctttgaagagagagctgtgggactgttgagtttggcacccactggggaaccctgcagtctaggaagctggcataggaatctgctgccagactggggagggatttgaatgtctttggaatgcaggcatccagggatctaaaagatttctttctgagcaaatttaggtgcccaggagccatgttcagaagttgtgatttgcttcaccgttggtttaggctcacagtcagggttgaaagccactgtttaggttatggggagcttctgaagcaaagagtttatgtgatttaggctactctggcagctgcatagaactattctggggaaaaggactattggaacaatggaggaagttaagccccagagaggagaacacacctgcctaggttggcatcatgacccacctgtagcatgggtctcctaactcccaactcagtgtccttcactctgctagatggaatttctaaatgctagcaggctgtggctaaggtatgtcagacccagccggcaacaactacatgctgacctgctaggacagtttctgaccacctctcactgcaaaataatcttcaggaattattaagggtgaaccctgtttatgaggacaaatgctgaagaacacagagaaggttagcatgaggacacctgcagatcctactcagcagaattcacatatttacaaagcagcgggaggaacaaaacaggattcctcaaagtgattgaagaccattttcatagcatgaatgggcaagatggatatgaatctctaaatctgcttttttcttccctttcccaaaaggcctgggtcactgaagagtgtgtgtgtgtgtgtgtgaatgtgaattctgtgtacctttgagattccttatgagattagaaaagaagtctttcagaaatccagaagcctcacttatcctgcacctccaacctacacccacaaatgacaaaggagtcgtgaccaccaaaatctatcctagtcagtatttgatttcatactaactatgcaggacctaaggaagatttcacaatattgagaagatggtatcttgtcacttgctcttaaatttctatcagatgagtcagaaatattttcctaaaaattatttcattgctgataaacttgacatcattcccctcgtctaaaccacacattatagcattaactatagggaaaccataactaatatcattattttggaagggcaggaaaaaaagaaagaagaaagacaagaatggagagaggaaagaaggaagaatgcagtaagcaggaaggggaaaacggtctacctcttttgacattttccccttaatgtgcaacatttgagaactaagtattttccaaaaagatattgatgacaacaagtagacaaggccagagaagataggaggacagtaatctcaaggtgatcctagatctagatgcaaattctgtcctctaggatcagactctcatctgagagtggtaatcaataatcccaccatgaggatacgtggttggtgctaacctggatctggaaaaaaataaaacatcaactatcccttgaatcttcatagctgggagtctagaactatactaccatgacaatagcatgtccataataactttaaagctcaaaagtatagggtacaaaaggttcctggaagatacgagaagagtcttgtatcaaatgaatcagagggcttgagacctcggaatatgtatttcatcaacatgggaagtgtaagataagtcaaactcagtgaagactctgttaccccaacctaccctagtgagagtctccagtttccctcactcccttccctggtgctctccaaggcctgaaattatctcttattcttctacacatggccagccatggatgggatgcaaccaagacaatatttagggcaattaatacaactgaaggaaactgactgagtaatgtcctcctgctttttaaagccacttcaaaaggcagacactcattatgcctgtgcatttttcacactcccccatatttagactcactctgactctgccccacatcgctgcctgctcttcaatgtggcttttaatgatgcaatattatgttcatgagcatgaagaaacatctgggtgccaattctaccttcaccacttgctagtgggcaatccagaataagttaaacttgccgtacacagtttctcatttatacaatgagaatactttgcgcatacgatgattttcaatgattaaataacatcatacacgtgatacatcttagcgcctggcatctggtgtctgttatgaatacatgtcaatggttttcaaattctaattgacataagaatcacctagagcttgatgaaatacatattcccaggtctcaagccctctgattcatttgatacaagactcttcttctatcttccaggaatattcatttacagaaacaatgccatatgtccaggtggtctggagattaccttccgagaaactctcctacgagtgctgctacctaaacaaatacttctctgatggcctggagtggcaacagttgggcaggtcagcccccaaaagccctcggagacctcttgatccaaaagtattcctattaaggaagtccagattccaattttcagaagaggtgaagaggttagacccagcaacctttgagatcttttccccaaggccgtcagtgacagccagggaaagggcaccagtttcatcctcttatctccatttatttagtgaagttattttgctccgttgctaccaggagcccagcttaatcccaatctgcccattatgttgacatttcacatctcagtggagaggacgtttactgctttcccagtggacactgggaaacagggcactgtttccagctccggacacgcattccaacgggagcgtcagactctattatgacagagcccgctgctgggggaaatggcagagcacgtgcatttcatcatttaggtttggtttctctcacactctctctcaagaattacagagctgtacagagtgctttctgcttggaatgctcccaatttcaaagtccttaccaaaagagaacaagaaaaagatctggtaaaaaggatccaggaacaaacattcatattggtgatggagaaaagtagattccaacaagccaggacccagggaaaagtagcattacctgggatgggagagccggtaatcagcttcttcgtgtactgaaaagtccctaagctgcggtcccttagactcttcagcagattggaaaaatgctgcctccctggggctctctgagggatgggagtgattcaaattcctgctgttttctggtcttagctgtggtagaaatggccccaaactcagcttcctggcagaattttatttgtcttatctaatttcctcagtagttgaacaaccaagaaatcctgtcctggcatcacctgcaagggtgactttagtgatgttccttcatgtcctcattgggctttggttaatccatctataaaccaaagtgaatcatgaactagctcaccaaagcacattagaacacacacacacacttacgcggaaggtagaactgaagatttttttaaatcttgttcttcttttgttagtccatattttcatatttatagacttgatgtttttcttaatattttaaaattttaaaaattactttaaatgaggtagcattaaaaataaaaattttaaaaaattaacttaagattctgtaataacaaattaaagattaaatttttctttttaaaaaatgaggtagcacagcacaaagattaagaacataacacactttagaagtatgggttcaattacacctgtttctgctacgactagctgagcattttggaacaagttatttaatcactttaaactaccctttcctcatctataaaatgaagataatattagtacctatctaatatggtttttgtgagcaataatagaatctgtgtgaagtacttacacaggtgctcaataaattgcacactggttttattattggtaacgtgacctctttatgtataaagatacaacacctgtcaagtaaacacttacaaacttgtagtcccaaaaatagaatgattcatctggcatacccacatcacaacacactcacgcattctcattgagcccccttgctatgacaccacccatctgtaagaaggttaaagaggtggggcatgagatctatggaggtagttgcatctcatgaacctgtacaagaattgaacccataaccctgggctcattagcacctcatgccatctggcaggagtcaaatagacattatgagcactagttatctgaaatctgtgactgtggagatgggttctatgactttgccgccctgaaaatccggatttaggaaggatcccagatacttaaagcaattagcaactttatcaatgacagagattacacacacacacacacacacacacacacacacaccagaaagtttaatagaagtatcgcagggactctcctgaccacatacatctcactagagagttggctgcactctcacctaaagaggaattctcccatcactcttcactgggcaacaattgacaatcactgtcatggtgagcaactgtgactgatgacagtatgttacagtagaaaaatatgatcaattatcttgatctaaataaaaccaacaagaaaatcatcttacttttttctagcacacatgcacgtgcacacacacacacacacacacacacacacgcacacactcagggctctatggacctttgcatcacaccagcatctttgatgccctctccccaagaataacaaggggtcccaggctcacaagatgcaactgtctcaaaagatctcatgcccaatctctgtaaccttcttacagatgggtgctgtcatagcaaggggctcaatgaaaatgtgtgagtatgtgtgttgggggatgagtacaccagataattcattttacttttgggactacaagtttttgaatgtttgcttgacagatgttgtgtctttatatataaagagggcagattaccactttttctgatcacaaacaagtcagatcttctgccatgtgctatctcctacttttcttccacttctctcctacccagcccctacctgcacagttcctgaatatccactttctcctctgtggtttctattgaacattgcagccacctgcttggaggacctcctatgcggggaccaatatattgaaattctcaggtttccaaagctgtatcctctggtgtcctcagtccacaaaagccacactgtgttccacacagacgtgagatccacatctcttttgtggacgatccttgcccagctgaagactaacacaatactgctgtgtaaggatggcttacagagagttgaatgaaagactccattttcaccatctgtctcattctcctgggactaaggcagtactccatgaaaggctgggcaagaaaaaaagccaagtactatacagtgtaaattattcaaaagccttctcctcccctccgaaagccaaagatgcatgctctttcactagaccaagcacatctgatttcctctccccttaggatgagttgtctcctagcagccctcatcaagcattcatgcaaatacattctttgcaggctccgtctcaccaggagtcctgacctgtcttcaagaaatgaacactgcttaagatcaaactgggacctccccatgcacaaacatacaaataaacttttccagctcctttgcttcccatctgatttctaaaactctgaatatgcacaccataaatgaaaagaacagatattcgctatccccaaagcccatcattttaaaggtgtaaattagtaaataaagggctggggatttaggatatggtttctcaagggcgagttgaatataaagctgccttgatacaaaactgtgccttactactcaccctgcctttggcaggggcactgccctgacctccctgtcttaacccagcaatggcctggccctaaacacctttcaaaacgtacctgtcttagattcaactcccacaggccctaaactcctaaactagccagttcctctttcgctgtgagagtgaactgatgaaataatcctctcagcttccatcgttacctttaaacagagtactctagagtaacaacttaacctaaagatcccatggatgagtctccatgcaggagatggtgcaaggctagaccagggaaggatggcctttcccagaggcccaccaacctccacattatgactgcaaagccctgtcctattattttgatttcttccttcttatgcccagcagccttttaagagaaagtgaacgaaataatcaccaaagcaagcattcggttgtttgattttacttttggtggttttagtttcaattggtactcttacgtatcccatgctcctggcccttgtcatttttcctatgccagccacaacttgaataattctgatatttgaatgaattctctagcgagtccagagctgtggagctttggcccttctttctctcctgcatccagtactttcactctgatggtcattatgtaaataggaaaatatttagctctggtttcctggaatcttctgcgtaaccagatctgcaggtgtgtgggagatcaaggcctttgtgtgagtccacataaacatatgctccaaagaaaggaactaaacctccctctccttgaccctagagccaggactcttttcccttcgctaggcaaaacccctcacacttgtcttaaaaggtttcctgaaccttgcagagggaggcttacaccagcatgtgctgacccactaccgagccaagcatcatggctgaagagaatgctcatctttgagatgataacttacaaagatgaaaaaagtactgattttataagataatcctcattaatgtatcttctttttatttttcaacagccaagtgtgcatgtatagtaacttcaacaacagaagtatctaatagcaattctcagccagtctcccaacacacagagctctctagaatattttaatcatataaccagaaaatatgtacttttgtttcacttacctttgtcgagaatccatgtaaaaatggtgtttaacttctgtgaaacaataactcgattcagtgtgggggttagaggtgtagatttctaagcttctgggctattgtgaggtttggatgactctctaagccttctaatcatttgtttcatcaaattattttctcaaagtctacaaggggtcatactagaccaaacctaaaagtttcttcagtgtgcctacatttctaaacaagactaggagaggaaatttgaactcacagctccagccaataccctccttctgcccttcagtcttcattgctttcctccaacatagtagctcagatttcatttgtctgtgaatggtagaaaaccaaaaatagcagtgtctaaaataatacaaaagttgacttatgtctcagtgtaagaggttcaagactgtcctggtttcttcacaaacctagagctctaggtccctttaagctaattgcccccacggccttggcttcatgatccaagatggcggctgttacacttctggcaacaggttagagacaaagggcatctcatgctgtctcttaagaatttcaccaggacctttcatgtgacatttctgcttaaagtcccagtaaacaaaactttgttccctggccagacctagatatgagagagtctaggaaatggtatcaccattctggagattacaggtccagtcaaaagtcagaggctctctcaccatggaaaaaggagagaatagatattaggggatttccagcaatctctttcacatgaccagctattctcataaattttcaaatcacagcgaattttgaattaagagatgaggctggctgaaaggccagcagtagatcagaggagcaggtggcagactgtgtgctgagaaagagaacaagctgaaacagaaaaacaaacagagctgaatgcaagggcatgagtgaaagaaagaagctgatagtgaatttaagaattattgagaacctaccagacatcaaacactaaatccataagaattaaaaagttgataacaattcagaaaatgccaaataaatcaatggaagagaatagaacccagaaacagtaccaggtctatgtatgaggaaggacgggttatccaataaatagtttgatgacaaatggctatccatgtggaaagaaatagatttggatcactttctctcttagcttgggtattttacaaacagtacctgaagcaaggcttaggtgctagtatttgttacaagatgcaactccaggagagtaagggtaagggaagagaggtgagataaggaagcttggaaggccaacatgaggcaatggatactgagaaggccactgctttatgaagagacacagctggtcacacagctaggcaggacatccacaaacccactacataaaaaacagtgcttctgatcagcccatcggaagaacacaaggagggagagtttgtcctctgacttcttcctctctgctcttacccatgggggttaactctccatgcttctgggttctgtccccgggccaaggctacaacttctggggacaccagttgtactcctttcctagtcttggggtgaatgagaagccagagatgcaggctccaaatgcgagcctcgaagacggcatgaacacggccatgacagctgaggtgggggagtggctggggtcccagagactggtgaggctgagagaatgcacgaggcgcaggagctacattcagtacactgcctcacattctacacagaaacaaacgtcaggtgaatccaacatacaaacataaaaacagtaacagccacgtaaaagtaggaaaaaaaaatgttcatagataatcttgtgaagaataggctttcctaagtataactaaaatctgaaatcatttgggggaataaagaaggcaagcttggcagatttgactgaaacttcttcctggaaaaagagacatacatacacacaaaagtaaaatatcaagtggataacataggtatttgcagcacagagaaacagataaaatataaatatcagtaggcactaaagaacttctacaaatcaataagaaaaactaagtggaaaagtaatgtgcctagaaagcagacagttagcccaagatgacaacagtctaaccatctagtttaaatagatccacaagataatccttttcacagtggccaaactcctaaaggaacctcagatggaagaattgcaaagcaagcaaagagaaatagtgtaaatactccactggatttgattactttatagcgtgagaaccagatttccaaagttccactgaatgaactgaaaaattgcccctcaatggtttcatttctgcagccttcacatgagctaaaatcccagaaggttccatctattccaagataactaggcttcattgaatgtgtctgtctatagcaaactccacccagattgaattctgacacatttatagcaaaggccattttgcctgggcaccctgccctcacataattctgtactgttgatttatattgcttcccataaaaaagttctttttatcataataggacaacattaagctacagcaaaataatgccttacatttattggcactttctcaaagcattatctattacttaatgggatcatcacaagaacattgataggagagtaagatttttttaaatattcatttggcagaggaggtttttaaaacacagattatataaaggacacaccccacgtcaaagagccaattactggcaaatccagaactaaattttaggtgcccactagcttccaatcttcagtgttttccatcagatttcacagtttctactgaacaacgtgtaagtaacacgattctacaagcagggcaatgggttgttttcaagatatatacctttaggtattcgtaatggagtttggcagcttcagaaaaactaagttgtttacattcaactgtctcttaacagcacgagctaactgtccaaatgcagtcagagatgttagaattaatactgaacgccaaagaacccatcccttttttaatatcttgaaactgagccagtaaaatgtcttccggttattaatttccatagtcattttccttttattccataaacgggggaaggaagagcaggaaaaatcccttttctcctcccagggcaggattactagtatctactattgagaaatccatcttcaggtcagaaatgtccatcatccaatgttgattgagcaacaaagtgtgaagggtcttttgccaagccctaggcaccagacactgtagaatctcttagtgagattctaaattcacccaggctagacatgattgtcttccaattttggccatgattgataaaagagaaaaatcagtggaaaagccagaaatgtgaaaagaatttgacacttctgaaagctatttgtttgggtttggtttctattggatgtagaaatcaaaatctcaaataaaattttacttgacctgtatcttatctatattttacttggtctatacccaatagtttctagatcaaattaattaatgatgaccaagaaaatttccatttaggttttcactcactataatgggagctaacacagagcagggatttttgcctggtttcttgactgaattttcccaagtgctttgaacagtgcctgccatacaagtgtttaacaaataatttaataagtaagtaaaatctgtggcaagatatttctttctaatgtcacttggaccttgagtgaacaaaagaccgaatctccagtatgctcacattttttagatatagttacatttttgcgagtttggggttattgccccagcaaaactctccatttggagaaagaggagaggatgaaatctcttgaactgagccagatgtctcagatattttcttaacctttgagttgttaagattttgaaacatatctcatgcttattattttacataaaagttttaaggtttgcctttactttttaactaggcccagtttaagaacaaaacacagtttactttttttgtttgtttgtttttgagatggagtctcgctgttgtcgcccgggctggagtgcaatggcacaatatcggctcactgcaatctccacctcctgggttccagcaattctcctgcctcagcctcccaagtcggggaaaaaaaaatagaaatctattggaagaacacaagatagactagaaaatttaggggaaaattgaagaatggactccgaaggaaaggaaattaaggtatttctggggatctagggaacaaaagccatggatagcactgcagggtacacctgcttgggaaacagccacagtggtcactctattcagtatttgaattccagacagaaaggctaaggaagcgtgaggcacttggacagaatcccaccaatactgtaaaccatggagaaatgcatatcccaaagtgggtgactattaccagcatatcgggaaatggaccctgaacaggcaagaacaggtgtcccttacaacagtgactccacaagtacatgacctacaactggaaaagcatatcccatcctggacagaacatacggctgcccttcatgaaggtgaacactggtaacagatccaaacagcaactgggaaagtctttagggggccaaataaaaacagtctattcagcaaaatttatacacaatttgttaaaattggtgttgcatcagggacatgtctcctgccctgtgaaatgcaagagctctgaaatgtaaaaaaggcaaggcaccctatgtaaacagacttcattttacgaatgaaattgtcaacagaagcagattcgtgtatttccccattatgggcttttactggtacttcgtgtctttggtcttaatcaaaatacaggaagtccctgctttgcacgacagcacagaccatagaaatgactgtgcaagatgaaaccatgtaaagtgatctgaataatcaatgaggaaaattataattattccacagcctttaaaaaatgttgtcaaagcattaaaaacacctcctgtttgttatatatatgtaaatgaaaagataaaattatatttatttagtacactattatttaagtattagaaataattagaattaaaatattttatttctttgcaaaaaaaaaaaatgttacccacagtagtttgaacagggcttgccttctttttctcatggtacaattatggaatgagcatcttttctatgccttggcaaagtgtaatgcttctttctaaatttgggttagtttccaacattttatcctttgtgctttcaatgttgtgaaatatctccaagagttcctttaacatgaagtgatttcttttgagcgtcacttcctctgggacattttcatctttttcgtcacagccactctcctcctttacgtgcataagtccatctttactaagtttccctggctgcatatctagagtgtcagcagcaaggtcaccaattccacagtcagctatttcttctaattccattgacatttgattcaaattttacattcatcattatcaaattttgttctttgctttatttttatctttagtggtcaattcccattttctaacattcatttttataaaatgtcacatgaatttattactagtgacaaggagacacagattggtgacagattatgaagggcatctgtcactgatgtagcaatttttcttctgcagaggcagcagcatagtctgtgcttcatgcaatcactcacggttaatataccagggtaactgaaatttgaaccatgctgttagggactggtgttattgaagcaaaccgtggtaactgaaatccacacatatcagaactctgcaaagtgagagctgcctgtattgtgaaatattctgctggaagccttttaatgggccctgagacctcttatgacttctttattgccctatttttgggaaattcttagataggaaaacatcgtgtcttatcaatatttgcttataactgtaacacagagtagattatatttgatcactgactgccttggaactatccaataaatcttatgttttaccctctgccaaacaagttagattttggaacatcaatttattctatctgcaatgaagcaagatcatctttagcttctacctgtaaggttgaaactagtgaaacactcctcgcccttcaagacccaactcaaatgtcaccttctcaatgagcctttcctgcacccatcagttagtcacacatcttgaagaacaaagattcttcttgttcacctttatgtcctttgtaccctgcacagtgcctagcccatatgagatgcacaaatatttcttgagtaatgataatttatctcaaacttttttaaaaagtgtatttttctagtcaataattggatgcttcccagcatgacattgtaagtaaaaggcccaaaaggaatagtagccaagagacacagtttgatggcctagcatttacatccaagagtaccagaatctagttccaaatactggagggccatcttgggtgtgatggtcaggacagactggggaaagccccactgagtgggcgtatgatctgcatataaattttgctgactcacgctggcttcggtgtttgcagtcctctcaatccataatggataacacatgggggaagagagttatgaaaaaaacatagtcatatggttcagtgtatagatctgaggaaaataccttttaaatgaaattgagccaaacgtctgtctcactctgtttgcaaagtacacagtactgtatggactaatcaaactttatagctctcctgtgcaatcttgtacattcctaaaaacatgtttctcccagagctgtcacttgttggaaatgtgtcactgaccaaacagtgttttctatactacacagaatgaaatgtaaatatcatacaaagtccatttgaccgagctcatgggaaagcatgaaacaatatacattccacattatgtctttctctcacaaactacacacatgcaccacacaaaaatcagaaacaaaagcaagaaagtatttggctcattgggcaagttacacaacactcatttcattaaattaattcttttatctgcaaatccctacaaatacttagtaaacttcacctgatgaaagggattattgtcattttacagaaaacaaagcagtaagcgtttgtccaattgcacaatggaactcagaaaaacccagctttcctgaacccaaaagttcacacagatgtaaaagctatacaagagaaccataagaggctgcaatacatctttatacatgttgtcaccacacagtcaagctccacagagtcaggaggcatgtggatgtgtgtctacacattcaagcacatgcatgaagatgtaagagcaggtagacactcccacatggagattatggcttcagcaaagcatgaagaaggtagtgtgtgcatgatgagtgtgagaggcggatatagtcagcaagccaaagagtgacatgatgggagagtggcagaatttaaatctgggcaaagtcaactagtattgtgaagagtttcaaatgtttcatctcaagaatacagtctatagacaatcggacctacatctccagattttgaaagtgaagttatatgaaggcgtttcttcttatttgaagaagcactgttctgcagcaatagagcaagcatgcactttcgagttttgttgttggcagtggcggtggccatggtgggagtggtttttttttttgtttttttctggcagagactatagttctgatctggcaggcccagtgagaactttgcaatatgtcaaatgtatgacaacaagaattcttacctaatcatgttttgaatattagaaatcagtagtccttaatggcttaatatattcttagtaaagcagccctaagacagagttcttggtggataatacttgtccgtaagttcagaaaaaaggatttgcatctatgtattaacccatcaggaagattggctcacactcggactctactttaagctacagaggcaagggctgcatcaacagactcccagaaaccacaaggacttccatcctcacagctctgaagatatgagagtggcggtgaccagctgtccacgcagggacttgaggctcagctgggaagaggaggccttggtttggccaccggacactcagtttacatttcatcctgtttgcccagagcctgatcacattctgcctcatatccatgctgcactcttcacagtttgcctctagcatcttcccgaagggatagactgtgccccacaagctcactgctctgcacacaccaggcacaaagcgggtgtgtgagtagaaggaaagtcaccaagaatcttttctttataagatataagaaatgtaatgttcagtgtgccttaggaaacaaactgatgtctttctatgaatggggggtccccaaggcacctcagaatttttttttacaacatgttttgatatacaactacatggtgaaatcattactattgtgaaatgaattaacatgtctattgtctcacatagttatttttgtgataagatacctaaaatctattctcttagcaaatttttagtgcacaacacaacactaactatagccctcgtgctgtactttagctctctagacttctttatcctacataactgcagcttcatacgctttaacctacatctccctccatccgctcctccctgctgcccatggtaaccactattctactctatttctacacattcagctttttttggatctctgcacttgtaagtgcagtcacacagtatttttatatctgtttcgggccgatttcacttggcataatgtcctccaggttcacccatgttgttccaaatgacagaatctccttatttttttaaggctgaataatatttcattgtatgtattgtgtgtatgtatatatacaccacaatttcttttttttaacttttaggttcaggggtacgtgttcaggtctgttatacaggtaaattgtaagtcacaggggtttggtgtacagattattttgccacccaggtaatcagcatagcacatgacaagtagtttattcattcttcctgcacccttaagtatgacctggtgtctgctgttcccttctttgtgtccttgtgtactcaatgtttaggtctcacttataagtgaaaacacgtgatatttggttttctgttccagtgtcagtttgcttaggattaaggcctctagctccatccacatttgttcaaaggacatgttctcattcctttttatggctgcatagtgttccacagtatgtatgcgccacattttctttattcagtctactgttgacgggcagcaagattgattccacatttttgctgttgtgaatagtgctgtgatgaacatacacatgtatgtggctttatggtagaatgatttctattcctttgggtatatacccaataatggaattgctgggcccagtggtagttctgctttgagttctttgagaaattaccaaactgctttccacagtggctgaactagtttacatttccaccagcagtgtataagtgtttttttttccccacaacctcaccagcatcttttattttttgactttttaataatagggaacctaactagtgtgagatggtacctgtttgtggttttgctttgaatttctctaatgattagtgatattgagcattttatcatgtgcttgttgtccatgtgtatgtcttcttttgaaaagcatctgttcatgtcctttgcccactttttaatggggttgtttttggcttaagttccttatatacttctggatattacacctcccattctgtaggttgtctgtttactctattgatagttctttcactctgcagaaactctttcgtttaattaggtcgcatctaaccatttttgtttttactgcaattgtttttggcttgttatgaaatttttgccaggtcctatatccagaatggtatttcctaggttatcttccaggatttttatacttttacgtttaacatctaaacctttaatccatattcagttgatttttgtatatggtccagtttcaatcttctgcacatggctagccagttatcccagcaccatttattgaatagggtgttatttccctgttgcttgtttttgtcaactttgtagaagatcaaatagttgcaggtgtgcagcattatttctgggatctcaatcctgttccattgatccatgtgtctgtttttgtacaagtaccatgctgttttggttactatagtcttttattatagtataaacttccttaacatgatgcttccagtattgttctttttgcttaggactgcgttgcctattcaaggtccctttggttccatacaaattttaaaatagttttttgtaattctgtaaagaatgtcactggtagtttgatataggaagagtattgaatctataaactgcttagagccgtatggccattttaacaatattgattcttcctatccatgagcatggaacgtttttccatttgtttttgtcatctgatttctttgagcagtgttttataattcttgttgtagagatctttcacctccccggttagctgtattcctagatattttattctattactaattattacagttgagtgtggaattattacatcatctgttttagtctgttcaggttgtcataacagaataacacagacaggatggcttataaacaacagaaatttatttcttacagtctgaaagctgggaggtccaaggtcaagacactggcagattaggtgtctagtaaggactcactttctgattcatatagggacatctgctcactgtgtcctcacatgaccaaaggactgagggatctaagatctcttttataagattactaatcccattcatgagggctctgctgtcacaacctaatcatctcctaaaggccccatctccaaataccatcacactggggattagggcttcaacatatgaatttgtgtggggagggacgtaaaccttcagtccgtagcactaattgccaatatcaaacaagatctcattttgttcaattcattttaatgaaaagttcatctttattgtcataaactaaccaaaatgcaatttgttctgctgtagccatggagagaacccaaaaataatacagggagtaaaggccacatcattgcccctctgaagcacacagctaatgatgactacaatggccatactgatcctaacagcactgacgatgtgtggggcacgcttctaagccataagttattgctacatccatctcattggcctcaaagccaaaggaggtcccttgataacctatgaacacctgtctgagaattttgtggcttctcatgtgggggaagggatggctgagggtgcactgtgtataggatggtgatccaagcatgggctgtaggtccaaatggcctaggtttcaccatgtgacaaaagccaagtcacttagcccctttgtccatctctaaaaagcaccaacctggggttcatgtgaggattaaatacaaatttaaatgattaaagagcttaaaacaggccctggcacgtagtaagtgttcagtaaacctttactaggatgatcatgatgagcacataaatgttcgggtcactgtcattagatacttccgcctaattaatcttcctcagacccagcacaccatggaactgcgatggaagcgtgcaaatggagatgaaggatcactcataccactatgctgagcaagtcattgtaaaaggaacagaaggtgtcctttttcctagcttgttagttcccttataccacacaaaggaaagagcttgaagacagatgcggaggttaaaaacactctgccccacaaaggctctctctctctcacacacacacacacacgcacgcacgcgcgcacacacacacacaccctgtctcttcctctcataaatcaccactagttcactccctcattcctacatctgtacccagagagcctccagccctccatacaagacagggatttccagactctagtccttaagcttggtcaaatgagcagacccagctccaagaataaagggataacaggggatctctttcccgtccaacactccattggaaagagctacagtgatctcacactagttaccttaagaagcatgccactgcgctatggtgggcattgtattttctggagacaccactcacccctgtgttggctctatataaggaaaggctattcctcttctgagtgtggctttgctctcaatgtgttcccgatgcaccctggctgaggatgactcccctgccatctcagatgtttgcatggtgtcggggagaggaatgcgttcattctcagttcattctacctcatctctgattctcacaaaaactatgtccctgaggaggaaatgaaggcatagagaaggtaagtgactccattaaggttacacagcctatcgtaatccagataagctaaatcttttgttctctccaccatgtttcctgcctgcctgatgtttaggataaaagcagaattcatcaactcttacataaacacataaagactgatgctataaagcctggttgctccaaagagttggcttcccttgacggatacagcctttacttactgaattgctagcagagaagaaagacatgaagagtccaagcttcagaagtcatccagcagctgttcagatctcttggcaaaataccaagaagcctggtctgcataattctctctcaaagaggcaacaccaaaatgcttgtccccaacttcattctgaagactaatttgtcaacttcaacacaacagctctttcccaagacttatccctattcctagtttcatgagtcaaaactttgggctccttaaccctgaagagaaccttgttcttctcactgccttcccacgggttgggctgaggccagtggaaaatgcagtagccagtggaacatccctagtgaccttgagctccttgtcttggctctgaaataaactctgctccacttttttctttcctgtttgatttccttagaatttatttttaaaatatacacacagtaaaattagctctttttactgtacagctgtgtgttttggcaaatgcctagagacaggtagccaccaccaccaccaggatacagaacatttccttcacccctagaaagctccctcatgattccctcttgtagtcaaaccctcccctcactctcaagccctgccaaccaccagttcgctgtttctacaattttgcctgctctagaatgtcatgtacatggaattatacagtatgaagtttgagtctggctgctttcatgtgacacaaagcagtagagattcatccaagctgttttgcatatgactagttcatcttttttattgcagagtagtatgctactgtatgaacgtaccacagtttctttatccattctcaagttatagaacatttgggtggttttgcatctgggggtgattataaaaaaagcttctgtagacatttgcatacaagtttaatgtaaatccatttttatttcttttggacaagcacttaagagtgagattgatgggtcatatagttggtgtatatttaattttataagaaaccaccaaactgttttttcacagtggctgcataattttgcatttctaccagcaatacgtgagagttccggatgctccacatcctcaccactttttggtattgtcagaaatttttttctcttttgtcttctagcctttccctgagaagaggcacagtcatgaagctgcttatccaaagatactcctgtggaaggggtggggctccacagacccacaggaaggctgtaggcttggcaagctcatagcagatcagagggtcaggaatatgagtgctgtctgtctagcctcagccaaaaagagccatgacccaccatgagtcatgaaagaaaatgtctaggtttgaaactttctaaaaatatgaagttaggaatattaccttatatatccttatatttccctatacctaatgccatgtctaaacttacagctgagtgaatgccttcacttggttctcctggatttcatatattttccagatcatgaggaaagccccacatacaggaaatgcacaaactgactatttcagctgcagggatggtccctagtgccaaggtatattctatgtgcagctggagccaaggttgaaaggcctagaatgataagacacagtctaaaacagcagctccaaacttttggaaaagtcattaacccctctgagaatcctgaagaaactctggactctctcatcagaaaaaaaatgaagaaataatataccaaagaaaaagttacattcatccacagaccactactactacccagaaggagccctggctctaataagcaggcagtcatttctgtgaatattttgctctttcatggggaggaaagggacctgaggactgcttactagtgaggccagggagatacttgtaccagtatgctaagactgtcctaacaaattaccacagcctaggtggcttaaacaatagaaattcattttctcacaattccggaggctagaagtccgagaggaaggtattatagtttgttttgtctgaggcctctctccttggcttgtagatgccatcttcctccagtatctacacactgtctcccttctgtgtgtctctgtgtcctaatttcctcttcctacaagaacatcagtcatgttgaataagggcctactcatatgaccccattttactccaattacctctcccagccctcatctccaaatagagtgacattctgaggtactggagattaagactttttggacttcaacaagtgaatgtgatgcaggcacaagtcagcacataatatcgattcttgcagtttcttagaagactaaagctgtagaacttaagacttcagaaattctaacagtcccaccactgaatgtatttctaaaggaaatgaaattagtatgtcagaggtatctatacttccatgttcactgcagcactattcacaatagccaagacatggaatcaacccaagtgcccatcagcagatgaacggataaagaaaatgtgcaatagatacacactggaatactattcagccttaaaaaggaaggaaatcctgtcgtatcatagattcacctgcagaacattaagtgaaataagtcaagcacagaaagacaaatatcacatgatctcacctaaatgcggaatcttaaaaaaaaaaaaaaaagaaaagtcaaactcacagaaaaggagagaaaagttgtggttaccacaggctgggttttgaggaattaagaagatgctggccaacagataccaaatttttgttagacagtagaaagttcaagagatctgttgtacatcaacgttgacaacagtaaacaacttcatgtatacttgaaaattgcttagattttcagtactctcaccacgaaaaagggtaagtatgtaaggtgaggcatatgtaaaatagcttgatttagccattctaccatgtgtacatagatcaaaacatgttgtacaccataaacacacaacttttacttgtcaatttgaaaagttaaactagaagttgtgtaaagtctgtctaataaacacagacagtgcttataatgtataggcactctgcttaggtgctttataataatcaaacctttaattttcattttttaaaaactatgaattaggcactatttcttattttcccccttttaaagatgacaaaacagagtaagggggccaggattaggacccaagctccctgcccgcaagagctcatcttcatatccagtactctaaactgcctctccctaagcaataggctcttctttgctgcctttcttgacaaggaaaagtgaagaactaaacaaccatccaagctatctattcaatgcagattcaaaaaacatcgctaggagattcaaacacagttcttcagtgcaatttttttcctttccaactacttgtaaccttgctaattgcttaaccttcctcaaatgtcttactcaaaaccagtgtctccctatagatcaaatctaaaccgggcaggctggcttttaggcttctaccttaccttccttccctttcaccatctgtaccagacatctattgctgtataacaaattatccccaaaacctggcagcataaaaaataaacgtttattttctcccacagtttttctgagattcaggaatctgggagcagcttagctggatggttctggttctctgtcaagaggttgcaatcaagaggtcagccagggctgcagtcatctgaaagcttgactgaggctggaggatctgcttccaaaatgactcattcaaacagctattggcaaggggtctctatcccttccctcatggccccctttatatgctgtttgagtatcctcacaacatgatagctggagctcacctctctagagcaagtgatgagacagagagagagacaggcggagacagacaggcagagagagacaggcggagagagaacaagagagagacagaaagcaaatgggaccaaagacacaatgcctttttacgacctagtgtctgaatcatatcttcacttccatcttattcactggaagcaagtcattatgtcagccctgatttaaagggagaggaactaagctccacctgttgaaaggagcagtattgaagaatttgtggacatgattttttaaaaaatcaccacaccatctaaccttatttcccacaattaccccaatatacacagcagcaaaaccatgttgccatagaaattagcactggttcaggagacccaattctatgcctgtgaccttggggactgcactgcacctatctgatcttcggttttctcctggagggtgaagggttggatttggagggtctagaagcttttccctctgactcctgtggtctgtagctctaagagggcagtgaactagtttgtttgggcctcctctcattggctacacccacgcttcctttctagctgtggcttggagggcctactccaactctttctcctcccactcatctctttctcttcaaaatcccaatcaactcaggtcatgtgagcctcaagtaaaaacaaaaaaaaaaatccttgtttgtaaatgttaaacagcctcgccttgctctttcctgtggctgacatgtgcaaattttgtctccccatgggccaaagatgctgcaggctggagctatttttcccacctctttgatgcctgcccgtgttttcagtgaacagagtttagagaaattatttgccaaataatatcaggctcaactactctgtccctcagggttccttcaaacagaggagctcaaaccctcagcattgtgtccctgcagccagcattctcaagggaagagatcatcttcacttaactgccaatgacaaggggcttagtttctaatttttaatcttttccaaatgtcttgttaaaattaaaccataaactaaagaaatccctccccagattaggaaaccaaatgggaaatgtggccatttggcatgaaactgtcaaacattttcagcacacatacatcccaacccattggatgagacagcctgcgtcacaggccaagaggccgtggccccacacatatctctgcaactgcattcagaagccctgaccttgggccactgctcaggcctccatcctcacagacgctctgaggcggcagctggaagggtcaggcccagtcatgctctggatgggccatgtctctgcgactgcagctttcagagccacctctaggcctggctcaattttagggccacaggagactcgctctctctgctccagaatctgtcttcagagtaaagcccgaattttaaattgggctttgttagggaagcagcagaaataagtctcgaatgaaagaagaaacaggtcctctgaggagaatctcaaatcattaatcctggggaaatgaagctagaaaatgattccagaaatattacgaatcctaggcttattcaagttgtttatttcatagcagaaaaagatgctgctcaggcaaaattctaaattcagctgcttttcctccctcatctgattctcttgcctccttccctgggcctgggcctgggcctctgtgtgtcctggtcccaggtcctcgcttcccatctgctctttcctaccttctttggaaagactaaagtgcctggcctacacagaagcgctgagttcaaatggtgactctaaagctaagatcctcataacccgaaggattgaatgacaaacaatggcatttccagcaccaaaacaggggtcaggacagacatttggtttagaaagccacctttactcctaactctaccctcctgttcctgctcccagagcccccctgctgggggatgtgacccacaacagccccctccccagcctggtccctaagaaatgcacatggcacaagtcagcaggccagctggccatcccaatcagggagcaaaccagaggcctaaactagagcagggatttctaacatagagtgccagacctcatgggatccatggatggaactgaggagggctacaaacccggatgaaaaaaaatatctaggccaggtgcgatggctcacgcctgtaatcccagcactttgggaggccgaggtgcgcagatcacctgaggtcaggaatttgacaccagcttggcctacatggtgaaaccccatctctactaaaaatacaaaaattagccaggggtggtggtgtgtacctgtagtcccagctacttgggagacagaggcaggaaaatcacttgaacctaggaggctgaggcaggagaatcgcttgaagctagaaggcggaggttgcagttagccaagatcacaccactgcactccagcctaggcaacaaagtgagactctgtctcaaaataataatatctattacacttttttccccactaatgtctacctgaaatttagcatttctctttccatgatgagcgtaggcgtgcaccttagtagtattagtagtccttgtgactttatcaccaataaaaattataggtattttcacattacattacagttgccacagaaatttccagatatcatgtttctgtatcattattttgaaattagaatagttacaagatccactgaaagatcttgctatttcatgcattaatgaagaggtacttatattacatattacattttttaatttcaacaactatatttcaataaaattattatttgtaatgctatgtacattattttaatgtttttaaaaatctttctaagtaggccactatagacctctccaacatcagagagtccacagcacaaagaagattaagaacctttcaattacaggtatatatggatttacttatctcccgaccttcaccattgggccgcataatccccactggtagagtcaaacctgccttaaacatgttccaaaggaaagaagagaagttcaagagttcatcagtgcagcacaagttgatcttgttgcaagttccgtttttgccttgaattatggatttcctgtaactggattgctgcctggtcccacagttcctctgtgactcagaccttgccttgtaccccagcctctgggccccttctctgagaaacctaaaagacgtcccataagttcatatttccaaggtttctagctcaatgaattgggagatgtttgtgctgaccctgttttcttctacagaaagccctaatgctgaatggccgccaggagacagttcatgagatattgcaggttgaattatacataaaatgagagcagtcccttcctgtgcaaaaccccaatctccattccatcaggaagaattttttagttgatcacgttcacaggagcactggtcttcaccacatttagtccaaggctcccaaaggcactggagttgtgtgcagtagaggagctaatgagacgccatgtcttctttctcaacgtatgcttgagaaatggattaatgtaattcctagagggcaagactagaagagctgtaaaatgacctcatttcttttttaaatgtgaatgtggccctcaatgatcaagactgagaatattacaaaatcaaccataagcataccacagaagaaaaggaaactaaataactctgtgaccagataaacaatctggaacttaaaacaacaaaaagagttgtccaccaaggaaaagttcttgctttccaaatatgaagattttcttctgaggaaccaccagtttggaagggcttacctataaaaaaactaaggcttcttctcaccaccattttattaaagctgtgaagagccttgaggaaatatggggcctggatgaagacaaagggagaatattcaagtataatgctcaacacaagacctgttcaagtcacaaagaagacttctcagaccttcagtcctccctgataccttctccagatgtcacactgtcgccaggttaatgtacttgagtattgagaaataagaaaacgtgcattgcttttatttacttcactgtaaaaaaattagctcacattgtaatagaaatggctctaagttctttcctatagagcccatacagatattaagacttcaagccatgctaacacttaaaacctgggggttactacagagttacttgatttatttccatgggcatactaaaattagtcaatatagaattagaacacaccatgctagacattttggacttacatgaggtccctccttagctcccacttcctcagtaatgttgatcctacaaagaaaccatttctaaattcatctttaaacaacatgctatcaaatactactgaaatgaggtttgggctcctcggagtagtacatttccttggttttcatcttctccacaggggctacttacatggaaaccaaattgtttccccagagatagccccttttcttttctccaagtaccacactgttgaatatggctggggtagggaacattaaatgtagcgaaacatggtaatgaattaacccttcatcctgaagggtttccaggaaataaacatgaattcagccatgaaaaaaaagagtataaaagtcaattatatttcaatggcttccaaataataaaatatatttttaagaacaagtcaaacctaacatgatggctcacacctgcaatcctagtgacccaagaggttgaggtaagaggatacctctggcttctcctaaacttagaaaataagtagattaaggaaaagaaggaaataactaaatctgctctcccatgtggccttctagctcctgccctatctttttaccctcacatgctcatctactggtccacctcccactcactcatcagcccactggcatctgacctctatcactactacttcacctaaagcaccattgccaggatgcacatggtccctttatgtagagtccacaggagacttcagtcagtatcttactggatctctatcctgcattacacacatccttgaaaccctgtcttctccgttatccagcactccacatctccccattcttcccctccttctctggttgctccttctgtctcctccagctgtttctctccccttgcccagctttgaggtgctgcattcctcagagatcttgttccacttcttattcacctcttggtgggtgaatcacatcacgtaaattaccaactctatgttgacaacttccaaatctctatttacaggcggtatttctgcagtttcaaatctgaatatccaaccatgtagtcaacatctccacttggtttcacagacatctcaggctcagcatgtccagagtgaatttactctttcccctaagcctgctcctctccttgtaccccctgtccttctatgctcctcagtaaatggcaccaccatataactggttgctcaaattagaaaaattgacgccatccatgtcttctttctgttcttcagtctatctagccaataaattaccaggtcctactgattctatctgctaaataatatttttgatccatcacttctttctattcgccttgcaaagtgagaccaccatcatctccactgatttatggcaatgaactccaaatctcttcccagtgtccagacttaaggccctccaaccgttctctacattgccaccagattaatctttcagaaatgaagtgctgaccttcccctaaataaacacattctaaacccttcatatatagccaaggacaatggctcaaaactgtaaccccagcacttcgagaggctgagatagaatgattgcttgaggccaggagtgcaagacaagcctaggcaacatagcaagaccccatcttgaccagaaaaaaaattaattaggcaggcatggcagtgcacacctatagtcttagctttgagaggccaagacaggaggaccccttgaatccaggaggttgaggcttcagtaagctatgatcatgacactgccttccagcctgagtggcagagcaagatcctgtcttaaaaaaaaagaatctttcatatcttccccagtgctagaagctcaacacatcaatagctaaaagaagttacaaggcaaatttacaaagtttctgccaggtgggatttgtttttgttttcaatatattgcttgggttccgttttatgattatcagacatcaagccttttactactaaaaagctgatgaccaatattttgtcatagatctttttaaggaaaacaacaacatattttctcactataccaaagaaggtctgtcataaactctattcagaaacaacatgaatactatagtaatagggaaatattccaagagttggagaaaaagtatttctctcccagacctctaaaactaagattcagaattatttctgtcttcagatcttagacattagtgagaacaagaagcaatgtctcttaactgtgcatgctgccagctgatggctgaaaaggaaaagatttaggcctgtccctatggatatcatcagagaatccagttcagacattcccaggcagcgtgcaagcatggaggtttgaggactagcttacaggcatgtggtcttggaccaacctcagaagcaaattatttatcaaagtaaagcacattaggatgaccatagttaacaataatttactgtgtatttcaaaataactgaaagaattagaatgtttccaacacaaaggaatgataaatgtttgatgtgagagatatcccaattaccttgatttgatcattacatgttgtatgcttatatcaaaatatcacatgtaccccataaatatgtacaacaattatgtatccatgactacaaataaaaaaaaatctaaagaaaggaatctttagctatctcaacatcaaaaagaaaaaagctgaggttttcaagaatgtgtgcacacgtgcagtgtgtatgtgcatgtttgtgatttattgagggctaaaaagagagctgatattccctctatatacactaaacttataaccactctcacctctaacctaggaccaacactacacaacacacacacatcccactcatatattcatacaaagtgtactgagtccatctgatgaactaatctaatgatagatttgatatctaatcctcacaactacattgcaaggtatatactattttctctactttatagaagatgaaactgagcccctgaaggcctaaggtccggcaacatgtaataaaaggaagctagaattggaaccctggtgtgttcaattccgaaaccagcccttcttccactactccttcctcaaaaggccttctaagtcgtcactctcctagcactggttacaagaaatgtcggtgggagtggttgttttacgataaaccactctgataaaaaaaatgctccaatgattatttttgagatgtcagagctgaaaatgtacagatttcactggacgaagaacctgccaagtggtgattgcacaaccaaagcactgcaaggaaccaaggaggccaaatgtgtgttggaaaaatcacagatgtcatctgggaatgctcagagccttgggctttcacgctgagacagactcgcttccaccggaacctcagccttttaaggctaaatcaaggccgtgacttcctcagctgaatcaacctgacactgttccctgagctcactgggatcctattggcagagcgtcagccccgtcatggaaagaatgcctccaccagggaggactgggttagtccccatcctgaactggatcataaacacccaccttgtcataaagctgctgtgagtcttacaatgggaagatgggggaggcagcacactggggtcaggagtggagatacttaggctccccagagaaattagtcacaagtcttatcccttcatctccatttacagccatttatttgggagcaacatactttaaatgagtgataaacaaaatgtctccccacagcccccaccccagcatgtgttctgaagttcacaggaaggcttctcctcatttgctttggggcccgcaggctgcctgctaacagctgggtcttcccatgaacaaattagacagttaatgttccaggatgaagagggcttcggggaacagaatctgccgtttatttgacttgcttcattagacacagtgccatcataccaaaattagaaaaaagaaggaactcagcggaaatcagctacacaagaagaacctctcagttctgagaattcacattaaccagtgattaagaaatattaaaaaggtatgagcctgtgaagttgaacatacaagaatgctttagaaaatggaatgttcacactgttgccaagtgacgttccttctaagtattgattactctctacagattatggaaaatatttgtctgagctcttatttcaactgctccattctcagctagtgaggagagtaagatgtagtgaggcatgtgttcagaactttctcccagaggtaaattactgatgcatgacttttaaggtgctaggagaggtaaggaaacttttataaaggtcccagtggccttctaagaggaaagggacggcaagtgtttaatggaaagtcatcagggtagatttaggtgaccccagtcaaggcccaagaaggaactactggcttctttaaaaacaacaacaataacaaccataatatcataggtagaaagagattggactagagggcaggcctgtacaccaagacggacctctgagaatgagtagtaagtggttctgattctctgaggccaaaactgtcaggactggtactgacccagccctactggacacaagtttgctccctagagaagggagatataggggaaccaaatgcaacacaggccaacttttgaaagctgcattcttgggtcaggaaatagggaagaactactgtggctagggggctgctgagaaaaggtgctctgctacccctccctccattgccatgaagggttaacccatttaatttgcattttcctgagtaagaggcttgacaccagctctcccacttggcagcctggtattgcattgtaaagcaaccagcttcagggatgtttatggcatcttctagcttcatggagtgtggtagccatgaaaataagccacatagacttcctcctatagaaggtagaattaatccagggtcccaactgctgtattttaagtctgttgctgtgtttgtaccttgacctcactttccaaggctgctgctggccaatgatgtggtattgtgaggggaccccctcctctgagaagctgggctccttctttagctgactctggcacacggactccccagtggctttgctggagcttccttccactgagcggcagtctagcattctaagtttccacccagtcttctctcagtctccccttcactcagggtcaggctaacactgtgatctgactgctagcccggccttctccacctcccttgctgtgtcatttcacataggcatttcccctaataaattcctggaatacttactagtatcttgatatctgctttggaggaccctaacaaggcagaatggttgaactgtgtctgctggggcaaagaggaagaggctcagattattccctagatataaattagtactcctgaaggtttcttaagattatcataagtatggaagccagagagcactgtagaggagttcaagttgattaattgcatctgtgatatacatatatatgtgtgtgtgtgtgtatatagtatatatatgtgtgtgtttatgtatttttatatgtatgtttatatgtgtgtgtttgtgtatatgtgtgtttgtgtatatgtgtgtgtgtatatatatattttatatatatgtatatataaatagagagagtgtccactatacaagtctagaccagaaaggaaacatcaagtgaaaggcctactcccatagcaggaggaaaaatgggagcagataacacatacctggaagcaggctaatgtcttagccatggtgatctcctaaatgcaatgggcatccattcatagtatccccctgtgacctacaagcactgcttgatttctatatgtggtgagagttgaggaatttcctccagatcccgttggctggatcctacacttccagtggcctgaaaaagttctccagatgctgctgcattgaccactagtccttgagccttgcacattctgcctggctcaactaggagtagaatgagatagttcttctagagagaaagacaatctcagagatactcactttccactaagtgccccatttacatataactgataacataaattttaatccatcaggtattcatcatgggcaaagcattttacgttcattcatttcattcatccatttactcattcaactcatttattgagcttctactacatgccagcagtccccaaggagctatacatagagcagcaaacaaggctgaaacaacctagttcttatgaaagtttatattctactggggaagaaaacagaaagaaaaaaaaagcacacagagatatatgttttgggtaatgatatatactgtaaagaaaactaaaacagcagagtaaggtgctaggaagttatgggcagacagggagagtctattttatgaagaataggcagggaaagcccttctgaggaagaaatactagcagagatctaaaggaattgaggagttcgctgtgtaatagtcaaagctgtgaacagtgcatttaatctcctttaatcgacacaacaaatccatgaagcagaaggcatcttcctcctattatgaagaacttgaaaatcagaaagtttagacattcaactggatctcaagcagaagctcatgttgttaaccattatgccttgccatcacggtggattccagaattttcccactttctaaaatcaaagagaaaacctggcttctgtttttgctggcaccctttgtggcctttccgatttactcgttggggtgcagaggagccacttaacaggcgacaaagagctagctgtgctagaaaagctctatcccccctttcccacccacaacacacacctacatctaagacagcctggtctccagcaatgtctacgggcttcctttgaagcaatgcaaagaccctctgcctctcctctttaggaggctggcattgcctgggggccttaattcctgagcagtgtacgctgggaccaagaccttgaagaaactggccaggtcttgtttcttgaaagggtattcgctgcataaacgggcaaggaaatgttcaggtagaacaaatagtggagtcttgcttgggcttatacatggaaacttatgaagctgtcagcaacatgtgtgaaaataacaaactgattaaagcttgtaatggaaagatgagccaccagtagcttccacgatcataaaatatgaactcaaaaataactgctgagtgctcttaattttacaaattttttaaacagtccttgacacatagtaagccctcaaaatgaaagctattcttattattgcaatcatcaataattatcattatcatcataactccctttcctatcccaaaatactggtggttagggtaagagagtgacaaaagggacctttagggacctcaggaagttgtatatttccctgtaatggttaactagcctggacagaggtcccagcggggaagctctaaaaccagccttcagcaagaaaatttgtgacttactaaacccatagatatttatgttgttcctgctgcaaaaatgtccatttctcctgggtaataactaagtcccataaatagattctaaacttctaccagttcaccaaaaataaactagtaggacttgtagacatgccactagctctattgcatcatatgatttttgtcttcttcccattacatgctttatttaaaccccagtcaaatccagaggcccaggcaatattaaaagatccaaagcctctgtacccatggtttcctgagccctgagtcctcttattctgttaccgataactttgggggttgattttttttttttcctgagcagacatttttgtttcactagcaccatttctgccatgtgatttaaatatctgtttcactgagttttgtgataactgtatggttgtcttcaggatggtaaacatgtttgcataacagtcatctaaactgagaactgacatagctccctgaggacagagatattcctgattaaatcaaccctagagaattccaacagcaatagggtttggaaatcatatttctactcacttttccactcaaccaatggggcaattttttatatacaagttggaatttacatctgataaggatttgatacaccttccttttcttccctattctctagggctgatagtccactacgttatcaagttcaaagcctaagaaatattgaacatttccacacatgaatgtgggtactatgtttaatttgagaatggccaactgtcctcgaagtctcaatctctttggagcctaccagctccgagagaagtttgaggatgctgcaaaaccctcccctgcaaatccatctactcctcccacttctatcctaatgggtttgtattgaccaagtcttctcagttatgtattacgtacttgataacggattacagaatagccaggcactgatcaaaaatcctcctagagtttaaaaggtggaatatatatatatagcaggcaaaatagtggtttatcaggcagctacaataagctgttatattttcagattgtgcttcgtttgttggactgcattgtattttccctcttttgtgaaaaggtaaataacctaggcatgcaggaattaacttgttaacaaggaacaagagaagaaatccacacaaagcaaccaggtcactgagaagtcgagaccctttcctcttggtgttctcccaccattctcattaacccaaactgcagtgttttcctttctcctggccctaaggtccagtgtttctgaccttgtcttagaaatcccttctcagcccacaacctcagttaagagttataatctctcatggttggcagggagagtaaaggtgatgtagttcaagtcctcacctcccagtaccagaagtcgctcttcagtatctttgaccaaagtcatctaagtctttccaagtccttctatgatagatggctgagcaccaccagttaacaggaacgccctccttaggttgagtcaaatctccctctctgaaagtttcatccatttgccatcatcctgccttctcttttcctttctactcttcttgcttccactacctgaactcacgcactgcattcccaccaaactcccactgttcagtgtagagactacagatatgtgatgcattagcctcttggtttgcaccctctggaggctaagttctcagtatctgtcttatgtgatgcctatggctggggacatgattctggatatggtcttacagtgcagagtacaatggggccattttctctcatgatcaggacaataccacttggtctatatctatagcccaggaaaacattaatgtttactagcttatttgcaaggctaacagatgttgggataatggccatttttcacaagaattcttatcaagcaaactctccccgtgtgttgatggctgtttactcacgatggtctatgtaagggaaccattaagagtttaaaaaaaaaaaaaacttataataagactctataatgagaaagttcactgtgtattttttatcatttctgctactatacatagtcatataaatatttgttcttaggagctttctaaaacacagccttaactttcagttttggtttccactcccaggtatagttcttggctgtgctgaggatctgtaaggcaccagatgtgaaagtaaggaagaaagatggatgtggaagaaagtcactgcccagagaataaggagacctggattctaatctcagctctgccattaactagctgtgagactcaagaataactaatcattttgataactcgtttttttactttttaaaatgaggagccaagtttagacaatgagctcggctcttcaccagtgataaagtgtctgggacatgcttccattcaagcaatgctcttccttcttggtaagacagtgagatccccatgatggagccagtgtagtattgcccagtaggcagggagatgaagagccctggaatcccctttaatcaatggcccttagctcagagaccatttctgcaccaggctggagggaagaagcccttctctcaggttcttgccgaggcctgctatttaaaacagatggcacacacgggcagtccattcccacaccccttccactctctaagcactttgaatatattaaaaccttttcttacctctcagttccaatttggtactcaagcccatgtgaacactaaagccattaacccaaaacttttccttgctgcttcttctcgtattaaaaaataatctttatttttcttatcacttaagatatgcacatttaatgttaatatatatatacataaaaaatgaagatatgctgctaacaccccatttggacatcatgagattttggtgtctattatttcagaattgtgtgtgtgtgcatgcatgtgtgcatgtaacacatgcatgtacattgttaaaattaggccacactgtgatgttttgtggtctgctttttcagttagcaatgtgtcatgaccactttgccatcctattacgtagtcaattgcatgaatcacccatgatggtttcaactgggtctgtgttgttggacattgcagctgcttttctagaggctgctcttggattggtcactgcacctctttgttcgccttgcagattctggcaggtttgcacattatgatcataaaagccaaatgttagaactgaaagagggtctaccttacacatcaccttgttcaaatcctctcttttctttttcagtctatactttatccaagaaagaataaatcatttccaaatattttcaaaggtaatagaaatccaaaagccattgtttgcttgatagaaatgaaaaatatttgttgaagtgtttgttcaaagagagaccatgtataagatatttgatgaaaatgctactgaacaacagaacctgaatcagtatgtaatttgagagcaatgtatgcttccaaactattggcgtaacatatatactattgattaatgcacagttatttggccaattctaactactgtcatcctcaaaacctaagccaatatgcccctcaagacatccttgcttttcttctcatttttttcctttggtttgctttgctttgttttcttagttcatctgaattaccctattcccttatttctagaggtagagatttgggcaagttaattatttaagttgtttgaatacagtattttacttccattaacataataactctaaaaaataagaaaaatagaggaagtacttacaaaattttaaatagaccttatacttattaaacaattctatgtttctgttaataaaaattgcatagtggttacaaggtggatataggaattgcaaaatgtacaaaatcctgcaacccttctctttttgcacagatgaaactatggctcaaaagggaataagagatcaaggcaagcatggacatcttgtacgtggaagtgcagaccagaacttgtatcacagccagtcatatctggtgctttccatgctacttttacatacatgtatccttaaatttgatcctcttctagtttagtctaaactctttactttgtaacttccaaacctaaaaggtgcagcagacattgacaatcttaattcatttgtcaggtcatttggtttcttggtttcctaagggactgtatccttcctgccctgctaatggggagactttttgttttttgttttctgttttccttaataagtgaggccaagtgctgtgtgtaactgtggggtgggcaaaattaggattcctgaatcacttcactttttgttgcctttctcttgggagaatggttaccattgcagagaagcatagttaaaattgcttttgtgtttcataaacgaattcatacttagatgtcattgaccaacaactaaatagtatatcagagatgaaaggcatcctagagatgaccaaatcaagctcttcattactcaaaggagaaaaaaatccagaaagtggatgacatatgttgaactagtgatggaagtagaacagggtagtgtattttctgcctcttaattcttcattttttacactaaaccagatattaggtatatgactaggaagatacgtgaggtaaggagcagagggtttggctccaaactcatcatgtagtcatcctcctccaagctctgagagcttctctcacatgttaattcagaggcagtaacaaaagaattaatgctcctgaaggtttctcaattttatcatctggaaagtggagtgaacctttgcagagtccttctgaagagggctgaccttggactgcactaggttatattcatttgctattactcagcaataaaaagtaaatgcaacaatataaatgaatcttaaaaacataatatggaaagaaagcagccagacacaaaagaatacctcctgtttggtttcattaccataaaacctagaacagacaaatgaatatactatgattttaaaaagatcattatgatcagaaagcacttgcctgttacaggaaggagatggggattgactggaaaggggcatgagaaaactgtatgaaatattatatatggtttatatcttgtttgggggtggatacatagctgtgtataattgtcaacagtcattgaactgagcacttaaaatctctgcattttagtgtatgtaaattaatttttaaaattattttaaaagaaaagtaaaaggatagaaaaagatataccatgaaaacagcaatcatacagagttggggcagctatactaatactagataaaatagtctgtaagacaaaaacttattagagatgaagagggacattttaagtgatgacaatttattcaataaggaagatgtaacaagaataacaagtatgtatgtacctaataacaaaatcccaaaatacgtaaagcaacaactgacaaaattgaagggaaagatagacaattcaacaataatagttgaggactggaatacctcacttccaacaataaagagaaaaactgggcagaaaaccaactgggatacagagacttgaaaaacattgtaaaccaagtagaatcaacacacatctatagaaaactccacccaacaacagcagaaaatacattcttctgaagtgcatacggaacattccacagaaatatatgatgtgctaggccataaaataagccacaatagataataaaagactgaaatcatgtaaattaggctctatgcccacagatttagaaatcaataactaaaagaaatgtggggaatacacaaatatgtggaaattaagcaacacgttcataaataaccaataggtcaagggaaaaaaatatcacaaggaaaattagaagatacttgagatgaatgaaaataaaaatacagcatacaaaaaaaaccatgggaggaagttaaagcagcattagagctaaatttatagcaataaatgcttatttctttaaaaaatatctctaataatctaacctttcaatttatgaaactataaaagaacaaatgaaactgaaagcaagcaaaaaggagaaaataataaaatttcagtagaaataaatgaaataaaaaataaaatacataaagcaacagttggttcttgaacaaaattgacaaatctttagcgaaactttagcaaaaaagaaggaggactcaaattactcacatcaggcaagaaagaagaaacttgactactaactttacagataaaaagaattcaagggggataaaacgtaaaaaaaaaaaacctctattgctaacaaattaaataaactatatgatatggacaaatccctagaaagacacaaattattgaaactaactcaagaaatagaaaatctaaatagacctataacaggtaaaaagattgaattagtaaataaaaacttcccacaaagaaagattcaggcctagatggcttccactggtaaattctcccaaatatttaaagaagaattaataccaattgtttataaactcttttagaaaatagaagaaaggggaactcattctatgagttcactattaccctgataccaatgccagacaaaggcatgagaaaaagagaactgcacacctttatgcatccctatcctttatgaatatagatgcaaaactccaagatgaatcctgaaacaaataaaaaattgtaccacaactaagaaagatttcttccaagaattcaagattggtttaacatctgaaaatcaatttatataatatgccacaacaataaagaaaaaaatcacaattacttcaatagatgcataaaataatggataaactccaacactcatgattaaacaaaaaaagaagaaaacgcttaaaccaggaacaaaaattaacttcctcaaactaccagaaacttacagctaacatcatactaaattgtaaagaatcaaatggtcttctttcactctcagatgtgaaaatctcctatgtagaaaatcccaaggtatcgacaaaaaacaaaaaaaaaagctattagaactaataaatgggttcagcaagtttgctggatacaagatcagtatagaaaaatcgattgcatttctatatattaacaatgaaaaaccaaaataaaattaagaaaattctatttataaataacatcaaaaggaataaaatttttaggaatagatttaacaatttaagtataaaatgtatatgctaaaaactacaaaacactgttgagtgatactgaagattaaaataaatggaaagatacaccatgcttatgaattggaggatttaatatcgttaagatggcaatacttcccatattaatgtacaaacttaatgcaattcttaacaaaactcttctggtgtttttacagaaattcacaaggtgaccctaacatgtatataaaaatgcaagggatccagaatcactataacaatcttgaaaaagaataacaaagttgatggattcacacttcccaattccagaacatactacaaagcgacagtaatcataatggtgtggtactggtatagggataaacatattaatcaacagaatagaattaagagtccagtaaatcctcacatttatgttcaatcgattttcagtaaataggcaagacaattcagtgggcaaagaataatctttaacaaatagtgctggacaactgaatatcacatgcaaaagaatgaatttgcaccctgacttcacaatagacacaaattaactcaaagtgtattatagatctaaatgtaagagctaaattacaaaactcttttcaaaacaactacaaaattcaatcttcatgatctcggattagggaatgactcttcaaattagacacctaaagcacaggtgataaaagatggctaggttggacttcatcaaaatcaaaaacttttctgcttcaagggatatttttaagaaagtaaaaagataaccctacagactgagagaaaaattttgaaaattgcatatttagtaagatacttacacccaaaatatatacagaactcttacaactcaataaagacaaacagcccatttttttccatgagcaaatgatttaaatagaaatttctccaaagaagacatatgaatggccaaccaataagcacgtgaaaaatgtcaatatcaatagctatcagggaaatgcaaatcaaaatcacaaagaaaccagggcagagtgccagatgctccgtaccttgaaaaggttcaaggaaacttgaaagatcagatgacatttttagtgtaatctacaagtcactcttcaaatgacttgaagatgactacctgaatatatacaataaaagttggaaatattcatagataatataaaattgagacaaaaaaggtctagaaagactgcaatgtcaagatatgtatcatcaattcctgtacgctacagttaaattttgttctgagttttctggtgccaagaaaataggaaaggggtgggcaatacagtaagatacaaagaaagcttttatttcatgacacttaattctaaaagaataatcaggtgatatgaagccaatttctacagatatggtctctgtcctccaagagctcataactcagagaaaaataaatatgcaaatgattaaaatcagtgaggtaactgctatgaaggacgtatgtacaagctatactggaggcataagagagagagttaccattcagatgaggtggactcatgctctgatgtggtaacatatgaggtagattgggtaggaaggtaaggccagtagagggtgggagaacattccaagcatctgcagagattaaaattacctaagacgtttgagaaattgtaagtggtctgatatggctgcagtactggatgtgaagataaaattaatgatagctgagggtggcaggaaagctgggatcttgccatgtatagccttatatgtcatgccaaggactttggactttaacctgtaggcaaggggaaccattgactggcaagccctgagtagagagtctaggccttataatgggaagttagtttccagagataacctaaagaattcctgcctttaggtttaattccaaaagggtagtaatccacaacctagcactccataacagtgatttatattggaattactctccaaattggaagatatggttaatctgggattataggacgtgtaagctcaaagtaatttccattgtaactcgtatagctttctactcagcccatgacattcctacctggttccagttcttgcaattcaaagagaacaggtcaatgtcagtgttaacatgtgggtatgaaaacagcaagtacccgcatatgaattggaactgggctcactgaagaaagcatgtaattggagtgggaataaaagcatccaactattatacttgtgtgtgtacacacacacattagatatactgctacagatatagatagatgccaggtgtgctggtcactttgcgaatctcatcacactttaccttcatgacaatccagaaaggtaagtactaatcccacttcacagatcaagactattcttacttacagaagttaacagtgctctctcactggctggattggcatggatgcctatttttgatagtatttctaatccttaccactgaaagcattggaatgacacttcatgtatttttttcagtagagaagtaatagaaactattccccttaaatggcagatgtgatatctcaagcacaaaagcttgggtgactcactcaagtcaataacaactgtaggacaggagcatttccagttggccccgtattccttctacttagtcttttttgttctcatgtaaatacaaagtcataaatttgtgggggttcatattggctttgttccttttcccatctagttaccacaagagacctttcactctccctagtgacaccattcaacctctacataaccctacaacaaatacccacttcactaccatatcacatggccagaccagtggtcttttcctttaatgttacatagaataatattatttctccatcaattaactctgattggaatcatgattatcactagttttattcttcaggcttgatagagtaccagctgtgtccaacaaatgtaacaacagtggcttccagccaagtgcaactgaggtttttacaagaatagatacttcgtgtattctaatgacaaaagcacataaatgaggactaatattctgtctgtggcagagagaaaatcctcttgactttgaagaggttcaaaggcccacacacacagaaaactgagtgctctgtcatgctatctggatcaagggactcccccaaggggccggcatcccggccttagaaagatgtctgggccctcatcactgaggcctttgaaaccttgtaccagaaacccccaggggtgcctctccagcctgctcccctggaacttctcaggtacccatgacacagccagataaccagccagttgtcacctaccatctaggacagtctcttactcctacctgtccatgcatgctcactaaacttgccctgcagcagaagtatgaatgactctttattaaaatagacaggaaaaacaatagtgtctcatctcacacctgcactaggaaaaaatcctctgtcttcctctctcccttctgggcccactccctccaagtcatctcagagctgctgccagcagcatgtaaaatatgaatctgactttttgacccatctgattaaaaactgaagttggagcacctctggcagcagattgaagtccaaaccccttcaaaaagtattcaagggccttcacaacctgatttcaacaatatcctgaacagttttcccatacactggagctctggccttcccaggtaactcactaccccctgaagatgttgtacattttcattatatatgatttttgttactattcaatttatctagaatacatcacatcccctatctcacctcactcacctgacaaactcccaatcattctttgagaactagctaaaatgttctcacccctctaatgctttccctgaccatcccaggccaaattaaccagtccttcctctgtgactctgcctattgcacttattctgattttcccagctcaacagatgacagagccaagactcaaaccctggccttctgactccaagttctaaggtctttacttaaccccttgcctactgtgcaatattacaaatggaatcatgcgtcaattctgaatcccgactggcaggccaattgtgggtagtcagtaaacttacagtggatgaatgaatgaacaacaacctgaaggaagcttctactatccccacccaccccccaccacacacacacacacacacacacacacacacacacagagtttattcttcgaactggaatttgtaaagacagcttggtttcccagatgcatccaactcatcaggtactacaaattctgtaaccaggccccaatttagggatactacaactatgcatcatgtaatcatgtaggtcctccagtgatactcatcttgctcatttggccatggataaaggagaaaagagagagaagttccctttcagcaccctaacacatctcttaatacagcctctaagtctttgagtcctccaggagccagcagccaagtccaaactaaaagcatcacatgttgttttggagaaagaagccagggtgtccacagtaatataaatacagagacagataggacgagcaggccctatggagagaggccaagcctgagaaagtcaaagggctttgagctctgaattatgctctgtcaaagaaaaaaaaaagtagaagataaaagagaaagaataaacaaacttcttcatttttacttttcacaaaaaagtctcttctggaagcagcaaataaaatcttcccaactcactgggtgctgagtagagtgttaagacactagcccttgaaggaagaatgaataagcaattcaaagtgggcttttctgccctaggctaaatctgaaatcatccattttgccagcagtattctgtctgccaacctacctgcaaagaaaggggccatttaaaacttcacatccacccgagatggctgttgtacaaaacacacactcacaggctcccctcaaagcctagtaaggaagaaggaagaaggaaaaagcaaaggaaatatctggcagctcctagactttaggaattccacaaacaaagccattgccaacatctatttgacaggatgtatagagagttcataaagtaagtgtttatagaaattccaaaatgtttaaaactatctcttgatttttgaaggtcactgtaatctagtctattggagaatgctattgtagagtctttggctattgttacttatacctgcatatatgaaatcaccactcctaaaaaccacgaattagaaggctgatttgtttaaagaaatactgttgtccatgatggaagaaggatgctaactcacagagagaatgatgctgcctgtggaacagagtcggagctggcttttatggaacctattgtcactttgattatacactgtctaggacaggactgaggcccacataataccaagcataccacaaatacgtaagttcgctgttgagtttgtttctttttattgtttaagaaaaaagaatgctggggtttgagttgttcttttacacccagaacacactacacatcagagatgtgctgacaccgtgctttttcttttttatataacaagaaaaagtggcatagagggaaaaagaggtcaaattaaacatcaaggtagctaaaaggaaaattgtgtccgctgctctaatatcacaatcccaaggagaactgcagacatttgtcctcgagttcctcaggttggtaggcagaaattacattattttcctgaatattcctactgtaaaatagtcatggtacttcctgctgggagtgcaaagatgaataagaaatgccttctaatcttaggggattcattaggtaaagttcatccaggtgaccaactactgccctcattttggccccaaggattcctgccttctgtgcatctttctccacccttacatgacttgatctggcatcaccttgttaatgcttccttggatctataaacctgacaatgacctctcacctctcccaagaggatttgcataaatccaaacacctataggtggatgtcttcccattgcttcaagcatgaactaagccaggtaccttcctttgtcagacttccacccatccaaatgggcttccttccaagtggctcccttccctgccataccagctccactcttttagtctcctactttttactcctacttctccttcagccttttatttctatcctgtcaccaagtcttagcatctgtcccatcagcgatttttaggtctatttcaacttagatctatgcctcactaactcacaaaagaagaaactggcatctttgtcccttccaactaattttgcaagatatgttttcctaactttgcaagatatgtttttctaaaagcattcatcattattttcctgtttatgaaacttgatcgatctcccttttctctgtcttgtcaaacatacaccctttcaaaaccctctatggcctaacctttctctggctatacaatggtatttcaaccaatccctatcatcctagtctattccaatcaggctgttaccatctcaatgcctttgttcaaactgtcctccacctcaccaaatcattgtccaggaacatgattcattcagtcaagtattcagcaagcatccaatggacaagatacactatgctggacaccaggacacaacagagagcacgacaggcccatttcttgccctcaagagtcttatatctagtgctgcaacaattagcccatctcccaagaaaaactttgatcctttcctcatgctttatattttgaaaaccttggtagagaaaaagtttcttttaaaaaaagaaaaacatttcttaacaagcaaaagcaattaaagtaatgtatttaaatttaatgtaaagtatgtaaattgaatgaatatttatgtaaatatgcatgtaaatttaaaacattttctaatctggttggaaatggatttccaaaaataagtaatagaaaagaaacaatagaatgttaaactcctttatagcgtcatcacccgcctcccccaggaagctttataaaacaaaattatttttaaaattcacccattacggaattttccttctttaaatatccatggtccttagtccagtgcttagttatactcttttgttttgtgtatgatcgcttttgccctgtggacacatacgctctaaatagagacacacagcttggctctgtgcttgttgtgtagccctgacaataataaagcaacgagcgagcttcacaaatatgccacagtggatattacgctcacacataaaaacagacctgtataatttaaaactcaacctcagtaatccaaaaacccagtatagcaggcttgaacttcaacatccatcaacattttcaactagaagaaaatcagactctgttgagccttctcgtcagcctttcctgcctacagccaagaggatgacaggcaaaaagaacggggtggaaaagcaaagggcaattcacatgtgaactagattatagagccatttgtttctacctctaaatttttatcatgcgggcctcaaataaacttgtcaccagacatcatgtgggcttttggacctaaaacctctagaagtttttgatatgactcttagtttctgacacaactatttttagtgaaataacattgcctctgcttctgtgacatttcccagaacaacagttaatctgaaatcagacagagggaattttattttgatctaaactttcgctcaatgagagagtcagggaaagccatatcctgtgtgttcaagtcccataataaaagctgcgtaatttaaatggagtcaggtcacactctgttcttccttgagtcagctgctcacctagattcaaaaatagggaccaaaaaagataaactggcttggttcctaactgctaatgtggtctctaggaactgaaaaaccacatgatccaccctaactgaagcagaagattacaaaaagcaggtcccgccttgaccatcgcctctgtttctaatcctttcccaaagctgccaagtgcatcctggaagggccacttaaactctctaagcgaaagtcaaaatagaatggaaaattctgggaactctgactatgcaacaccttgttgtcattcaaagttttctctttaaaaaaaaattttattgctgctgtttagtcatttgtatacctctactgttacaactaacatgtttgtccactgttgagtaagccatagtgcaaacacagtttcaaacacctcaccaacagtccaaaatgttaatcttggggcttaacaaatgttaactacaacctggagatatagttccaatatccttataattaaatagtaaaattattatgctctttccccagtcatgtctgcactattgtttctaaatgtatccacaggttgccagtaatgatgtttctggtgatctggctcagaaggctgagctgatgagtgatcactcagaaatactgaatcaggcaatggaaattctgaatcggtgggctctggagaaggaactgagggcgaggtgactcggggccggagggctattatggactatggacaagctgaaggcatgggaagcctgaccagtagatagaggaatatgaacttggtggacagggaaaagcagggacgtcatgaacgaaagaccacagaccctctgttctagtccatggggccaggctgtgctccactgcctactcttggattccccaaagaatgctttatgtccttataataaatccacctttccatggacaaaaatgagtgtgtctctgtgtcttcaaacctgagagctaaaaccaaaaaacataacttatgatgctgtagaagaaacttctacccctttgtacgcatggagatgtttcccaaatctacacaatgatagaaataacttgctgcgttaaaaagtatagattgtcaagctcctcctctgtagattgagtccaaagttctgacttgggccctgagaagatgtttgtattcttatattcaggcaagtttgggccaaattcattgaagtgaattctgagatcctttcaattgcaaagtcaacaaatacaaactaatcattcctctatacataggagtagtttaagtgcacagacgtagaatcaaagacctatttcttgtcctcaaaaaataaaaaaaacttttttctggaatatactagactaggccaatcaataaagtctttagaaattgaggaacaaagctgaaatatgtgtgtgtgcatctgtgtgcgtgtgtgttgatctaattttagagattagcactcaaaaaacatttgaactatgtctacattatacatcactgaatccatataacctgtaaacatgtgggctctacctccccaatacacagagctgaacattacatagtttattttatagggaggtgtgtagtctatttgaaaaagaccaagaaaaaaaacactgcaaatacggccagaaaaaggatttgaaagtgaagatttcgtgacagtagtgcagagcttaattagctaattaatgtgaactttgcaaagttgctatgaaaatactaaatttgaatttcagagacagtgtgacccaaattcacaagaaatgccttatgggattttggaggaatagacataagtttcagcttgattgctttgcctcagcttctagttctcataaaagctataaataattccatgatttctacttagagagctctctctcttctgacactaacttaacctcctacttagaagataaaccttcaactcccagaaactcagagataggcaatgttccaacacagtaagagcttactacttgagccagatacgggcttaaatccatcagttctttagtcctattaattgtgtgactgaccttggtgggcaaggtccatttcctctgagtgtcacttttttaatctataaaatgaggttaaaaccagctacctcttagaagcactgtgagaattaaatcagataatatacggacagcacttaacaaagcatctggcacataatcaaaccttaataaatggtggctatatgcatatttagaagattgttctggaagggcccgtggtgatcaatcaacccaaccttcacattgtgcagatgaagaagctgaggcactaggacaatcaattgccaacgacaccgatgggcaaaatctgggaaagagcccagtcttgggctgtccagttagtgttctaaaaaaaccattcaattatatttgtttgacgccaccttaactccaacagaaagtgaattataactacattcttttaaggtattccctggaaattgattggagcttgtcacatttttgcagaaaccttttttcagaatattctcagctttacatgttgggaacaggactgcagataaattctgtgaaaatctttgctttttgtaaattaaatctgcttttaaaaaaccaggctaaaaataacatttaaatgcagggtgacaggaaagagaattgacttggtggtggggttggtagttacttgagtcgatgtggtcagaggagagcttactagaaaagtgacgcttgggctgaggtcttcatggtgtgaaggaagcagccaagcaaacacatgggtagatggaagtgcaagtgcaaagtctctgaggttagaagagcatggtgcactccaagcattggaaagtctttcagtgtgaccagatgatactggaaaacagaggaaagtgcttggtgggtgtggtccaatgccactataatgtatgaaaacagtttgacatagtggccacacatatctatgttgaataaacagctaccattaagtatacctttggaggtctaaaccagtatttgtaaatcagacactactcccagaagactataggccctcaataaagggtagttattgttattagacaataaaagtaattagggtaaaattttaacacagtgcttggcatatagtaaggattcaaaggcactttttttaaaaaaggcaaagtatcattattaaaataattatgtaagacattaatgtagcgaaggtttaacagatatttatgcatttgttaaatgaacaagcactcaacatagtacccagtagacggagcagcggaaaatctaagtattatctggcctatctcttacaattagtgtttctatagtggtaaaaagttttgttttgttttgttttggagaaatagtagctactatctaataaggaattatgagcggtagggccagaatatgaactgaatgtgatatgaataaagtttgtgcttttcatttcatgctgatggctaaatctaacatttcatgtctttttttaatttttagaatttttattctttgagagttttttgatacaaatgtatgggatacatgtgaaattttgttacatgtttataatgtgcagtgatcaagtcagggtatttagggtgtccatctcccaagtacaacacatttttgtttaactatagtagtcaccctactctgttattaaacatctaatttgttccttctatctagctgtatgtttgcaccctttaactcacttttcttcatcctcccccaaccctcacacccacccttcctagtatctgttctctatctttccactctcaacctccatgtgaccagattttttagtgagaatatgtgatgttggtctttttgcacctggcttattccacttaatgacctccagttccatccaagttgatgaaaataacatggtttcattagtcatccacccttcattctttattaattgggaaacattgctggcaaatcactacactggaccccattcttcaagacacacctcagctaagctatttactctttgctattgctggtggaatagccacgaagtgccaccccacgagctgtcacctctcttaatgttcacaacttttgaaggcaggtattattgccacgtgttatacatgaggaagccagcacccaaagacatgaaataacttgcctggaatcacacaattagtatgtgacagggcaagaatttgaggctgagcctcttgtctgctccaggtcaacaccctgaaagcctctgtgtggcacacagaggctcctaaggcaccagcctcctatttctcacccaggagcccagctgccagagaccacacagcaagagagaaagcctgctccttccggtgcaatcagaagacaaacccggcacattttcaaattccacactgcatggtgaaaatattttcatgactttagccctacagtatttcaaggacttcccttcctctgcagaaaacatagatgctgaaattccaaatgcctccctcaagagaaaataaacctcttgttcttgtttcttccaaaagaagctccatttcttttgggagaaaagaatcaatctcttatcatcaaaagaatggatttaaccaatattctttgcctttttcaggttttcttttgcttgggctctctcccaaccaaaagccatggaacatactcgccccaaggcaccatcaatgtgtcctaaacactactactcccccagctgggctggagatagctccatccagcagaccctgccctggcagaggtgcagccagggaactctcacctaattaaaggacaatccggcagctcctacaacgtcacttgagtctggatggagagaagacaggaaacacaggattccaaaattacagcctgaggcttttattccagagtccctttcaaaggcatggatgtctatttgggtacatgtggtggtcatcagagaagagtcagaaggctcagacccctcgggaatgggcaaagcaaagaaagacacaataagcctggcaagacctcgtatctcagcttagaatgttttttttcactcagtctcatgaacagatttagaaataccatctgcagctctcctccaaggtttctcaaaggtccttggagttatctggggacaaaaatgccaattttgtaaataaagaaactgaagccaataagaaggtgactagcttagggatttttggaaatttctttgggaaactgggaaagaacctatattggtctccacatcattttctctgaagtcaggaacttggatgggcagctcaggactgccacctaagcttcagtttactcacctgtaaaataaagctactgataatacctacctcataaggatattgttaggattaaatgagacgaccttggtaaaagggtgtagcagtcaggggcccatgtggagacagaaagcacacagcaatgtgaactgaaaaggttgattacaaagaactattaatgggaaattagctaagaaaagggaatttaaaaagagctctaaagaataccccagatctgagagaaagaacctaagaaacaaacttggaaggggagaccctgccccctaggctgggattcagacctccttggagagggcatgactgcagcacatggatggcagggaagctgttggccagaacggggcagcaggcagcagagcagcaaagcacaagagggaaacctcccctcctgctgagatgctaccgatcagagaaccacacacctgcactggcaagctgggataagcaccagtgggtgtccatgcactgctggccactacacgcctcgggagcaggccgaaagcagaacatcagaaccagggagaaggtcccccagggtccctccaatgctctgccagctggcagtggagaaatgttccaatatgacaagcaaggccacgagcagtggatttggagctgagcagtaataagctggtaactggcaaagaggcctcattatcatacatctcctatagagtcatattgccagaggatgtgggcagtaggggtgcagcgtgagtgcaactgctatctacctcaactctgaattgggcttatcttccaaatttgcagatgggcacacgtggtttgggaaacagcattgagtgctactagaaagctgtgacctcctgctctacacaccaggatctgtgaagctctctctctctctctgctaagctgtacactcagggaaagcctccacaaccatttgagtcaccagttgttctttcaaaggacccacccaaatccagagctgtgtaagtaacattgatcatagacatgggacagcactggcaaaaataaacataaaaaaaataaaatcagctagaatgaaatctacttctgacccccatcttcctacccaagagtctcttgtagccactgtagataacacaggaagaggaggagaggcaactttgcaccatcattcctgaacatgaggcaatagacactgacttaccttgcaactaggtggatttgaatcagacctaaagaaaaatgtccataattgcatgagaatcatactgggtttggtaacacccgcaaaaagctgcaaagccttctttttaaaagaagatgctttctgatggctccagcctcacccagcttgtgagtaggggtttggctgggataattgcttgaggtactttcctgctgccagctcctatgcagaggtaacaatgtgtgccataactcgggataaaacagaaagaggggctgtggagggaagacctttgagggcctcatttcccttcccagcatgtgccaaggacagtccctcgcaacagccccaggggtccttagcgggaagctgtttcaggccccacgggagacagcaataacccaccattactggataaacagtccaggacaaaacaactgagaaatgatgacattctgaaataacgcagcagttcttgtgtccaggaatttctctttgaggaagaaaacaaggggcctcctacttggctgtgtgattggcaggggagaaagagcatatttcagctcagtatgtatagatgtgctccaggctgggctgggctgggctgcagtttttccatctacatttttgaggagcttccaatttcttctgaataaacattttccaaataatcctgcctgaaaactgtccctcatcaacttagaacatgctttcctttctcaaggtgatgccacaagggagttgtcaagacccatagtaccccactagcctggaagaacttgtctgaaaactttggtggagcttttcagaatcacaaggctctagaacaaggtggggtagatctcccagagcttgtaccttgtactttaaaatgaacttgaaaatgaacactccaactggcttattttccaaatgaggcatccagggctcaatgtggtaatgaacttgtctgagaacacacagtcagctaacagtaagtagtgaatctgacatttctctctcccttacctcaccctgggccttcctccaaccccatattccagataccctaaagcatccagagatgagcgtccagataatcttgtttggttttttttgcctgtctgtcctgagttcaaccagtcatgaaaaatgactttggttggataggacacagcaggagtagtggtcagggctatggctagatttagggcaagggctagggtttgggctaggatggagttaagagaataatccaaaaataaagtagcatcctccctaaatgtatctcagtttccattttcatctggtctgtcctaggtccttggatattaataatatgaacaaaattagcaaacagagacataaactgaccagttttagaaggaagagtatatagcttggttactctacagtatcatggtactaaaaccagtgtgtatctgttatcaattactgtgtaacaaactacccccaacgtgcttaaaatgcaaccattttattgcataaacgtcttgaaggttaggaatttgggcaatgctcaacaggaacagctcatctgtgttgcacatggtgttggccaaggcagctaagctggggctggagaatctaagaaggtctcactcgcacgcctgggccatggtgctggctgttagctggagagcctctctctccatgtggcctccccctccagcagaattgcctggacttctgtacatgatggttgggatccaagagggaaagtggaagatgcaaggcctctttaaggtctgagcacggaagccccagaacctcacttccaacacattctatcggacaaagcaagtcccaaggccagctggaatcaatgtggggagagaggctctaccacttaacaggagagcagcaaagttatgttgcaagggttgtggacatagggagggaagactttggagcagaccaatttttgtcattgtctccataatgcttgtcacggggaaggatagtctgatataacagagagagaagagggacccagtgtggtgtgagatctgagtctactctctgccctttgctgtcagtgtggcctcaggcaagtcacctccagagctccctataagataggaactttcttctaaaatagggatatagtggcttagcggggaagaacaaataagatacatgaaataaaaacacgttgaaaactgtgggctatagtgcaattctaaaaatgtttaatctatatattaacactgtattaccttattcatacctttcctctaacaagcattcaaggcaaatggtggctggctggcagaggggcattagacagtcttgaaaagagctgtcctgtcccccaatctgaggctgcaaacccagtttcgcactttctaacatggtgaatccctccccttccctgacttccagtgtcttcattggtaaaattacatttcggtgaggattagggtttttgtaactttgatttttataaagattatcccaaaattccccaatcaatactaaaattattttaatcaccattattgttcaaacgtttagattgtgaccaaatctgaaactcacaacttgaacagtcaaaattcctagaaaagtaccagtttaacctctgccagaatggctttttagacttagattttatttttgaaacaaaaccaaaactagaacctttaagttaagatcctctaaaaaaaaaaaagaaaggaaaaagaaaaaaagaaaaagccctgttactgaagttgggttttgtgattgggagtgtgagaagttccatctcaagcagcagccacctccttttggcctcgggctgctgggccaccactgtggccagggagtgtcttctttgggcccatggtttgggcagagacacagacaccatgctttatataacttatcccaccccaggagctagtcttcctgccagtcacaggggccacagaatcatatctaggtatttaagcccaggtctggcaactcaggaaagatgaaatggagagttctgctcccacccaccactctgcaaatgcttgacctgggtgtagctgctctgctgtgctttggtggtattcagtcaggctgaagaagtcttccccattcacactgtgctcaaatcccacccgtcctccagccccattctctcttgctgctgcttggacctggcctcaggcctcatgatcagcactggacttggctgctcacacaaattggtgtggacagccctgaggaccggggtcctgggaaagggaaagagggcgaggagatgactaatgaaaaaggagggctcctgacatgcttggcttcctccagccaagcagagcctaatcctgaacagaactgaggggatgggctcttgagacaaagcagtccccagatgtagtcaggttttctcctgatctatatttgaggattctttagaaagctcactttgaacttgagcagtagaaagccagaaaccatcatggtttctgaaaagagcaacaggagtgtgtaattgatactttcatttaagctatgatgatcagttaatgttagttatccaccctggctgtagaatcacctggggagtttttaatttcctgcctagacttaatcagtttaattggtctggtgtgttaagtactgcaggtgactctaataggcatcaggattgcgagttctaagttagagggagtgagcctagagccatgattctcaaatctcagcatgccttagaatcacgtgcaggggctggttggagcacagatcgctgagccctaccctccgaatttctgattcattagatttgtggtagggccgagaatctgtgtttctgacaagttcccaggtgatgctgattgatgctgatcagaaaccacaccacagccagaaaacaacctgatgctaccaggtggaggctttgagctctggcctggggttacagcagtgctaatgagggcagcagatacatctgaggcatttgagaggcaggacacgtggctctccaggtattggtttgcacgattagtcagcaatggcaggtggtgtgagaataggcttggtgatgtggctttgagcctcatctgcacagagacagaacaccttggagatggtgtatgtctcttttgatttcatacagctagaggtcagatttctttgccttgcattccaaactactattgagtagaattcttaatataaatcaatgccatccaaatggtgaactcgatttataatgctttggaaacatttgccactcttttctaaaaacacattgagtttttccagatctgggtgaaactttcctcccacttacaaactttcatcctgtgttgttcagccagcttaagtttctcttgccagtgtccaaactcaaaaggagactatacagtatcattgctgaaagaaacttaaggtcagcatcaagttactacagaattgtggggaattccagtaaaatcacacagtaggagaatctggctcatgtcgtcgcaagtatatggttcttgctgagataagctatgaccagggaattcctatttgggaaaaagaatgttcctttgaagcaatttagctattccttcctcggagaaagtctaagctaaataaccacccttgagaaggcaatataaataagatagtaacagcattagctttatctagtacagggcccttgcaagtccaatccagttagcacatgtttaaggcaagcaaaatttttcaagaaaaaaaatgagtcaagatgatttaacaagatagactgtcattcagccagccatttgggtcacgcagtgacaccagataggtgacagaggggtggggaaagacagctctggagcctacctggcaaaaaaaaatccacacagataagagggtgtattagtccattctcacactgctataaagaactgcccgagaccaggcaatgtataaggcaaaaaggtttaactgactcacagttccacatggctggggagtcctcaggatacttacaatcatggtagaaggcgaaggggaagcaagacactttcttcacaaggcagcaggagcgagtaatacaagcaggtgaaatgccggacacttataaaaccatgagatctcgtgagagctccttcattatcacgagaacagcacaggggaaaccgcccccatgatccagtcacttccctccctcaacaggtgggaattataattcgagatgagatttgagtggggacacagagccaaaccatattagagagaaatgcggcatattccccaggctggcctactcgacttctttcaaacatactggcaatgagctgagaaagccctgagcataggggcttatggatttgtctctcattgttaatattcttgctttggggaggaacccaaatggcaagcaagtgtggcttcccaaaacagccaggtttgggacgctctgattgtgggcccattcattcattcattcattagttcattctacagacgtcacttgactgcccattacatgccaggccctgtctaggcaggggtgtgacagagacaagttaaatgtcagtggttcttgtcctcagggaagtcagagtccagaaaccagaagagatgactgaccatttggtgggcctgcaataaaggcagatcatctgcattaacagctgaaaaagtgccactaggtttgtcaaaatggaagtttaaaaataaatacataaaaggttggcccctcggtctggctggcagacatcaacctattgacagcaggcaagaatgaagaaaaatcagctaattttgcttttttattgccaaaattaaatgtaagtgggaaagaaaacttgccacaaaagcattataaaaatctggccttcaaaaaatagtctgtaattaattaggccacggtcctcccagaggttgattgtactaaataacaaaacatgtctctcatgctctcaattcaaaaaagtaggcctggtgcaatagaagactgcgagctcagggaagtgggcagagaacttcaagtaatcaataattgctaatatttcctgggggtttaccatgtgcctggtactattctaagcagtattctacatagtaactcattaatcttcacagctgccgtataaaatggtactgctaccagcctcattttacagaggaagaaacaggcacacaaaggctaggtaacatgctgatggtcacacagctagttcatggcagagctatggattgagctgagtctgtgcaaagggccctgatagcctggctttccctgtagctccaaagggggatgtctgtgattttggcagcataaactagtgatgtagcaggaattttagaccagaaagcttgagcttggatcctgattctaccactcagtggtgtatgatttttggtaagttatttcacttcttgagtcactgtgtcctcatttgtcaaaaagtactagcaatcacttttaagattgtcatgaggattaaatgagataaaaatgaaatctacacggaattccttgcctaggagggagcagttttgcctgaccatgatgtttgttccatacctgtgagtttcaattatagttcatccaagaagtcacatgttatccagagatgcttcaaagctgtgacgattcacacattagcaggtctgattcatctgcatcccatggtaaaagccagtttcctaattttccagaccttctgttcaactcagaattatttactttaaaataccagaaagtacagtcattaatttaaccaaggagattagcagcttgtatcactacaattgtagagaaatttgaagagttctggattgtataagatgactgagccctcttattagcaacagaagtctcatcctaatccaaacaatgaccaaataccatggaggtgaaaaagggttcacaaggaactgatattgtatgcatacgtgcattcacagtagaaaaaggtattcgcattttcacagagctttaggactgggaacagctacatagaagtcctaaagatcccctaatgcaaatatctccctaatgtttgcagtggttagatgaaatgtgagctgaggatccttcaccttaatattctatgattctttaataaagcatattgatttcttataaacatcttcagtgctcatttctacaccctgctctatgcttggtgctcagtcagtatcaaactgatgaattctgagactttccaaacagactacaggtaattaagttgggttctatacagttcaaagtattaaaactctaaaataatactcaaaatcaatgtgtgccttttactggagagaaggtatacaattttcactatctccccatggggtttgtaaacagaccccaaaaaatacatgtattaaaaactgggtttctatagatagactggccaaattgtgctagtgcaggccacctttttagaatcagcatataatgcttatgtggaaaataaaataaactctgatatatttgcaaataacaaacttcagctgcctagagcagaaaaatttggagtttgctactgagttgggaacacaaatgagcagcatgcacacaccaacatgaaatacaaggttctgctatatatctcttggcttttgtatttctaacatgaatattcatagctcattctttgattgctcttccatttattcagagccacactattttatacctaactatagggatattaaatatcagaaaaacaatataataaagagacaacagattttgtgtcagacacacctgggttcgaatttgaattcacatgttattacctagatgccttggacaagtcattcagcatccctgagcttcagcatcctcacctagaaagtacaggtattaatgcaaaccacatagagtttctctgaggacaaatgaaataatgtacagaacatacctaaaacattgccaaggatgtagtagatactccataaatacttgttgaaatgaagctaggaaagaatgttcttatcttattgaaaaccactgaaagcagattaagacctacaaggattattcagcaacaactacaatgatatttttgtcttgaagtctggagggaaggatttcaacagataccacagtctagtgggtgatacaaacatccattcattcattcaaaagtattcactgagtgtcactatatgccagggatacgatgaggaatagacaaacattaatgaatatataaataaatgtaagaatgaaactgacaagggctcaaaagaaagattcttgacacaagagtctgtaatatggaggagtcacaggggcatggagatagggacacttggcctgagatctgaatgacaagtgagtggattccagtaagaaaagtggggagcaagagaattccaggctggtgatttcagtcatgatggagaggagatagggcaatggctagagatgagcagtcaagttagagtattagcattattgttactggaagttttgaatgaaataccaaagcaacagatagaacatgccaaacataaggcaagtgatcaaaggaggtattcttaaaccagttgcataacctttttataattcttcacccgtcgtgagacactaaacaggtcaggggttattggagatgaggtgttttggagacagctgttggtatgctatgcaccctaccccactccaagagacaaagcatgggaggtttcctttctgtaggtttgttcatcacctcaaacctacagaaaggagtttcccaaagcaacttggaaagcttcatctgagaccccctaatgttcagggaatagtgaggactggtgtttaacccagctgggtggctgaccagatgctctgatgggacagcaaatgtattgttgctgctgcagtgagatcagcctctgctcaagagaagatccagagaggcagagtccagaccagtctaaggctccaatattgagccacctcccacagaaggaagctgaagacaccaactgagccccctctgattacaaaagccttactagccactctagcctctagtgaccatccattctgcacttccctccaggaccagaaaagaacaaaaaatgatagcatttcatcaataccatctaaagccactttgaacatttgtgaggttaaaatcacggcaaaacagttacccatgagcaaaaagataggactatgatggtatggacagagacattagagatatttaaagttctagtttttctgggtttttttttcctctttggtaatgttgtggtggctgtttttgtttgtttgtttgtttgttttgaacggctaccaggaaaaggagttttattaacacagtttatttgtacataggataaagtcaaagggaattataatggtaggagacagagaatactccacagcagggaaaactcaaaaattacccttgcttttgtgacttgaagttgcttaccacctgtgtcattgggaaagtatgtctgcatctcaagaatagctcatatgtgatctcctcaccattattatgataatgtagcattaattcagcatttaccatgtgccagtcattgtatgaggccttggtatatggtttcttaaaaattgttgttaaggcaaagacaactcttctccctcctgcctttcttctcagcaccatttttgtttgatgccacacttgtgacatttggaactcgcagaggtcctgccttcaaagaaaaagctctcctggctcctcttcagagaaggccattctcacacagggctcacctgtgaggctgtgggaccaagagctccctgagtccacaaaccagacctgcctttgcggccactcctgttggggttgtgggttaattgctgcactgtgttttggtgccgattttaaggcatatttttatatacacattttctcaaaagtgcaaatttggtgtcaggttttatatataggtcaccataatttgtattatgtcccctcattcaaggaaggtgtctgttaaacttgttaataaaaacagaaagaaatggttttttttaaagttttgtggttgttgtcatcgtgaagcagtaccagtattcaaaggccagatttgtctggttttacagttcatgctcttaaacacaagaccattcaagttccagagtcatattcgtgaacagtttacacattggttaaaatttatgagcaagtttctccccaattgcccttcattctctctcacacacacacacacacacacacacacacacaccactacacaccactgaccctcactctttctccctgcccagggagacaattaatgccatcatcacattgctcagggagcccaggctgaatctaacggtgggaagcttcctactgccctctgacgtctcctgtctctttcacagactcttctccctttgtccagcccatgagtgtgtttggttcttggaattccatctctggcccagtcttcttcctaccctacatgctttcctccccacccttagcttccacccacacgcaaccctttgctcacaccacccccatccgtgactccaggcaagatcttgctcctgacctcaggctgtgtaactacagctgcttccttccctgtggccacctcggcctagccactggattgtgaggtcctcaaagatgagaaccacgcctcactcagcttcacgcatcctgcatttcatatatttttaaatataatatataaacatgtaagtgaatgaataagtgggttcaattactgtctgtttcatgaataacaagttaaggtaaaaagagaaagaaaaactttaaaaggagaagccatacgtagctttgtcttctcacctaagatagaatgtgctagagtggattccacgagatagaacaggtgtgctagacagtggcatgggcaagtatgcttgccaaatactagattttaaaaataattaagcgggacattttgatcctctaatatacattactacagttcaaatattcaaaatatatacataaaatcaggtatcacttaataacagggataccttctgagaaatgtgtcattaggtgattttgtcctatgtgaacatcagagtgcacttacacaaacctagatgatagagcctactacacaactaggctagatggtgtagcctatcgctcctagattacaaacctgctctgcatgttactgtactgaatactgtaggcaactgtagcacaatggtaagcacttgtgtatctaaacatatttaaaagtagagaaagtacagtaaaaataagatatcataatcttatgggaccactgttgcatatacagcccatcattgatgaaaatgtagttatgtgccacgtgactatattttacatttttcagcacttgttaaatgtatttgattacatttctgtttgggtttgtttgtttatttagtacacattcactgttctgcagactgagattctatagttaaccaattgggagaactacgccctggaatataggatccttgattagtcactgctcataagaaaataatttttaaaacaacaacaacaaaaacccttcaaaattgacacaatggttgtattcagagcttttaaccttttctaagaacaaatcagtggatctatgcagacacaaaagagactgagacttggcctcccgggaaccacaccccagagggcgggggatctggacgtggccacacttcaggtcgctcgggttttctatccatcaggccaccactggcaactcacttgctatgatgaataccgctttcttcctgcagccgcaagtcagtgacattttggtcatgaaacccacatgcactggctctaaactgcagcgcctctctggggtctgggggtggagggtgactcctcatgctacagcagctgcaggaagcgctgggtgacatcacctccccctaagccaagaaggtcaggcccagagcagccatctttggacagaaaacacacaaataatccacctctttccaccctggagaatgagctcacaactgcggggggcccagctctgtatgcatgccaggtgatgtcagggtgagtgtcctggcatcctgacactctgcaggtgctccattcatggacaccccacagtccacaccagatggcagcgtgggagagggacatcagctctagaccttccctcacttctagttataagcctttgggggactgactcgcccattttcttggactgtgttatatgaatgttgggccaatcataatgggatagatactggggtagggtggggatggagaagggcttctctagaggtttctgtacaaataaaattcctggcaataagctctcacttctatcatcaactgctattctctgggtcatggaaaatcctgcatggttggtcacacagggggatggagtggaaaagttgaaagagaactgattggctctcggaaaggtgaacagagctataatagaatggaagagaagcccacacaacaagttggacaacctgacacctaacctgggcttcccgattccggactttgctttgtccaaagccaagtggcaaagagagttcaaaattaccctgtattttgattccatgaaaaatgagattttttgttgttgttcaattgctgatacacttggccttactataccctgctttctcatcgcaaatagaaaatgggcatgaatataaatagtgtgtttctttgaatccctcaaaagaaaagtttccagtttgacacccacatttaaattgcctataatttcctcattggaatctttgaagcccaaggcctttctgtgtcaggaggtgactgttgatctgcctgacagatgacgtgtcggggacactcacatggttaccttagaaagatgtacccttaaaaggaagaagtcccatcaagcattgactccagcatttaatctcatgccggaagctgactgaggtggctatttaaggaaggaaaggagacaaggaagacaggagggagagaaagcaggacaaatggaaagaggaaatggagagatggtatggggaaagggaaaagaaaggaagggaagcatggagggaggaagagatggaaggaaggaggaaaagggggaagaaaacttgagctaatgaggagcccattggattctgtaaataaaccacagaaacaatgaagcctggttcttctgaaaagggttcccactttccccaacttcatcctggttcaaccagcctcaagactgaggcgactcaggcagctctcagcggcttcagcctgcagtcccagtgggctgtgagtcacgggctgcgctgcaagcaggctgctctgagagagccctggagagctggccgtgggtgttcagaccattcctgctgctggtcaggaacgtcccttcaggaagttcgttcactccaaggtcgttctctttaggatttaatgaacaagccacaaaaatgaaggggacccaaggtttgaatcctgaagccccaaacaatatgccagccagtttatttttcctcttggagcttagcacatccttcaggaaactgcagaaaagagtgacctcgtcgtgaaggttcctgcctgtaaaagacacagtcctttcatggcacacagatgcctctggcagggcagaggaaaatgcttcaacttcgacaaaagaggcatctctacctgctgtcaacagctggctcctggcagaactgggaaggtccagggacaagaatctgaatcctacatcctcagcctactggggccaacagcacctttgcctctcagcacccatcaatcacagccctccaccagctcatcctcgatgagttgtccctaagcagttcagccccatagccttctcttgggatgactccaggctttccccacacttctgtcattaccaagctgaacaaaacagctcctctcctggaattcatccagctgccgacttgcgagggtacatgagcagctgttgttacagtggagagaagagggtgtgggctttagagtcagacagccagggctcgaattccagttctgcaattacttgctggtgaccttgggaaagtaacttaacttctctgagactcaactttcctatgctagaagtcatgataataatagtagggtcgttatgaggattgcatgtgtcatctctctgagagcagagaaactgtctatttattagtgtttaacccacataaagcattgagtaaatatttattgaatacatgcaaaatgcttcacacagtgtttagcacatagacgactgcaatgaatggatagtattatcttccttctctttattttctgcctctctcaatgcttcccatggaggagcttattttgacccttgtgtcagtcagggtcccagcaggaaacagatgttgtgttccaaatggggagatcttcatgaaggagccatctgcaggggtggctgagagaaccaacagggagagttaagcatcccacaagtagccacagcagaaaggtgccaactctcctctccctggagggtcaagcagggagctgctaccagagccctaagtgagagagctatagctgtgaggccagctgcagaggatccaaacccttcagggaacagcagagcagggagggaaaaggggaaattaacacccaagccttcctctcctcccactctatgatctcttgctgctgcctcccaatggccaagcccaatatccactgatgagatccttgtaaatcagcttccacagagcagcccagagaagggtaggctggatctagcagtgcaaatggagaaaatctagcacagccattaaatctccaaggatttatgtgaatagtcatctttcctcatctacataggttcttctgcagatttacactacaaaagacaatatcttctcaaaaaaagctgagatcaacaggagactttagattcaaagatgatatgaaccacaatttcaccttgtacgtcttcctgttgggggaatctaaacaactggagcacagctgttccatggagctggttccacagctgtatcacacctttgctgccctttctcatactacaaatttttacatgtaaaatctagaaatggacatatttccatgccttgaaaacaatagaaggtgaatccaggcatgaataacctataggtaattttctatgtttgcaatatatgggtatttttaaatacataataattaaaatctactgacactttcctgtcatctttgtattgcatattgtgtttgtaagaagaaattctaggcttgaagagctaaataagtccactgctaaagtgctggcatattggtggcaggggataagccagatagcaattggaagccagttctgcagaggccccctggtctttgaaggttggcattcactttcccaacactgcacaggttgggtggacatcctgctaactggcattcagccctactacccaacagctgccaagaggcccaacgccttcactggatgtggaactcagtgctggtatctgaacactagccctctagagggtcagcttcatctgttaagtgtatgcaaaaatgtataaagcaagacgataaccatgttaaaatgaaagcatactcacagtgaggcatggttagttcttcatggactctgcttcaatctagttacctggccctgagaaaatggctgtatttagaaatggatggaagaaatgaaggtgttgatgaggatagccaagaattttggagcatttcttttgttctagacactacactaactgactcacataggttaactcaaccccatggccccctaccccgcctcgcaaataagcatatgttgtagattttcctttagagatgaggaacacaaagccaagtgatattaagttacttgcctaagataacaaagctgatgagtggaagagctgggattgaaaatcaagcagtctaactccagattgtacttttaaccaccagacgattctgcctctgattatgttccctaaatattcagagagagagagagaaaaaaattggaagaacatgtatttttcaacttaaaagcagcttgcttcagagagtgagataataagtgaatgtttctctctactttctacttttttgctctttattttatttaggagtcaatatattaatttcataatggaaaacataaacttcatgtcaaaaacctatttgaggaatctggttctgttatgaaagtatgagtcccctatagcctagacctcttgcagatgacaactgcaaaccctacacagaatagaagccaagaataggccaacacatatatagtcaactgattttcatttaaggtgctaaggcaatttaatgaggaaagaatagcctttccaacacatgctaccaaatcaattacctatccataaaggaataaatgaatattgacccctaactctcttcatatacaaaaaggaatttgaaatggatcacagacttccatgcaaaatataaaattacaaaacttctaaaaaagataaaggagaaaagttttgtaaccttggagtgggcaaacttttcttaggaagaaagtaaaaataatggagcatttattagaaatgttgtttgctcaatgctacttcatcacaattaaacacttttattctgtgaaaaataccattaagaaaacagacaggcaagccactgcctaggagaaaatatccaaaggacttgtaaccaaaatgtatagagaacccttacaactcaataattacttacaattattgaactagacaaacaacctattttctttaatgggcgatgaaagttgaacagacacttcaaaagagtatctatcaagggctaaaatcatatataaagatgtttaacatcattggtcatcagggaaatgtaagtgaaaaccacagtgaaatatcactccacatccatcagaaagatttaaattaaaaagaccaaccatactaagcgttggcaatgatgcagagcaagcagaacttgtatacactactggtggaaatagcaaatgatacaaattttttggaaaagtgttttgtagattctaaagctaaacataaacctaccatacaatgtttggaatgacccagcaattctacaccaagtaaataaaaacacatgttcacataaagactcatacatgaatattcacagccactttatctgtaacagacaaaaactggaaacaacctaaatgtccatcaataggtgattagataaacaaattgtgatatatctatacaatagtactcagaaaacagagcagactgttgatacaacaatatggatgaatctcaaaatcattattttgtgtaaacaaatacaaaaccccctgaaaatagaatacatattgtattattccatttacatatttatataaaaatctaaaaaatgcaaactagtatgtagtggcaaagagtagatcatttgttgcctggaaatgaaggtggagggaaagatggattacaaagaagcatgagggatcttttcagaaaaatggaaatctttgttatattggttatagtgatggtttcatgagcatatacattcatcatagctcatcaaattgaattaaatatatgcagtttgttgtatatcttcaaagttgctttcaaaaaaaccttttctgctgagatccttgtcttagcaactagacagcagctgtagcctcagcaccccgcaccctagtttgctcttccccaaaaagcaaccattgggtttatcatggcagttctgactcaccattctgggaagccgccttttccttctctgtcttgcaacccttcacctttcatctgtatagccctttgattttttttttcaaagcttttactgcactgtagtcacatgcatgcatttaacttataagaatgcaagtatacacacacgaggtaataaagaaaagcaattacagcctgtacaagaaagagaaacaatgggtggttccatctaccatttcattccaagagtttgagaagggtgatgtgaccgcttttcctccggctggttccattgctcctatgtctcctatgtcattttaggagaatctcatcatgtgaagtaaaattctactggtgtttgtttgtttggtgagagggtgtcactctgttacccaggctggagagtagtggcacaatcatatctcgctgtaacctcgcactcctgggctcaagcaatcctcccacctgagcctccctggtagctaggactatagatgcacaccatcaaacctggcttctactgtttaaaagacaccttttttggtacaacagagcctctaaatgcaaatcaagtggttcatctgttgtggttgttgttcactttttagattttttttcttacctttgctgataattgcatttcataatcacatcaactttaagttgtgttgaatttgtgttgctctcagttatattaaatcctactttttgataagccattttatttattaagtttgttgcatgaatgatgaaacaatgaacacaggagcaagaaaagaaagcaacatgggtgaaacttaggttcagttttatttccagtttaaccatgcttccttaaatggaaatgctaatatatccctttttaaaattttaggttcaggggcacaggtgcaggtttgctatataggtaattgtgtttcaaaaaggttttagtgtacacattatttcattacctaggtaataagcatagtacccagtagctttcccgtgcttcattttatactcaactgaagaaacaatgatctgtccagaaatggaaaaatgttgattgtattggacttatcaggaaaaagaatgttcatctcctacatggactcttaacaattcatgaggataattttactatacttgattatcatcataggtgatgattttagaacccccatgtaagatcaaatttactacatcttttggggttttcagaatagccccataaggtggccagagaaaatattatccacacttgacagaggaggaaacagggcctcagggagattgtgacttgctagttacacagctaataagggacgtccccctttcaagaactcaggtcttcagaccgcaagtctagtattccttgaaccatatcaccacctccacatgttgccattttgcttatcagacaaaggcattattatggcctggatttgccctgagtcccatggagaattctcacagtgaagataacttattttcacaatggaagccaaaactgctgctaacaactcttggctctttcttctcttaactaaaaaaggaaaatgtgttaaaccaaatgtggcagttttgtcactcttaccccctaatcataatcaaaatttactttaattgacaaccaagctgtcagttatccaagcttccagaagaacggacacagataaggccaaattatgatatattccacaaactcagaggaaccaacatcctggaggtagtccccattcagcccagaggcaagggaaagggtcgagtacatatctaaaccaccgtgagctaggcactccccacccatctgcatacactttgtcatctttgcaactacagcgtttaacaagggctgggagatttcaactaaaacagacagaatgaactttcttttagggatcttagaacattttgcatggataggtggagaatttgaataaaatgacctatagggataactgtctttctaaaggtctaaaaacaaactgtccccagttcattaaccaacatatttattgccactagaaatcaattttcaaagagtggtaaaaatgacagggactgtagccactgcccaaaacccgactgacagggtctcagcactaaatcaagtaaaatttaataagtgtcactgtcccaggtgtgacagctaggatagaaatcattccatgtctggcccagacaggaggctaagggactagttaccctgggcagttaggaggcatacacttgagggaagaggaagttatgctttctatagggacatgtttcctatccttaatgagtttccctcctataagaagacacacaagtttaggataataaaatttacccatacaactttacaaatttggcagcaatctccattaccctggctgaggctgaagggttaacctaagctgccatgtttggggaaccaatgtttgtgctcactctttctctcactaaactcagttgcagcacagaggaaggctccaagaatcagggaagatcagggatcctgagctctcatagggcagtcataaatgtaatgattgactgttaagagggatgcacagcactgatgctaatgtcctttgtttggttgtgtatgcatttcagagtgagaagcgaagcccaatcacattataatctgggcagtttaggttcttgtttaccagccctcatccaataggcaccagctggaggcttggtatgtggattttgtttagttgcattgttgtctttttatatcaaaggaatccttctattaccccaatttcctcccttctggtccagtagcaaaccaggaccataacagacaggttcctaatgctctgcagatgaagggatgtcaggaaaataaacaaatttgctctcttctgttgcattcctttccttaagggaagaaactaaaagaagatgacttagaactaaacacagaagttttccaacaacacctatcttgccagctcctgccgagatcactagctttaaaagtgctcttcgggcctgagttcaggatggctcttaagcaactctgtctctgtgcagagctgccattgcatttcttcagctgttttccagttgcctgaaagaagcacccacttgcctgggccaggaacgaggagcacagagaaacacagagtagaactgtttcttcctccagagtgtttttttgaaaaaaaaaaaaaaaaaaaagccttccccagagcatagtctacttctctacttgatgtctcacagagcattggatgcagaagtttggggatggttctctgaataggggtgatttgcaccaggtttgaaccactggaagccatacccttagaaagggtagatccaagaaggtttaacaccaagaactgcagacactggcagaagtcattcagggaagagtcatgtagacaaacatgttgttttctccaaagcataaagcgctcagtatatagatggagaaggtgaggcacaagtacagcccagtgattatccaaggtgttcatgatggtgtcagtcctacagccaagacaagactatgtgccttctatgctaccagaacacattaactcttgggcatcgtgtcctggaaacaaattgagtggggaaaatattctattctggaataccagggtatcttggtattccagaggaaaactattcgtggtccactttcataatctgtttttagggatttgtcatttactaaggcagaaattttaatccttctccctgctcagggggggatatcagaatgaggcttcagatagagggtgagtcaatcccaccaatagcaaccttatcccaacacagctttatcagtctccatttgtcctcacctggaaaatcaactggtgaatgtggcagtcagggcctcctgggtatagaagagccgctgggtcaaatacttccatcatgcttcattataccctagttaggagttgacttcttccacctgtctgagtctgaactagatggactcgccactgagagaggatgacagtcaggtaggggtctctctgcagcacctcctaccagccaaccagcagcagcgttcctacccaggtgtccacctgtcaccactgggcaggggtgatgagcacacagttgccttttccatggcagcattgttctttgtctaactttcatctctctgctatctcacaatgctcttctaaaataaggtatatttggcagcattatcaaataaaggctggcaacaaaactcaagcattgtgaatgtgtgtttcttcaatttaatttagatctctaatgtcttgagatttaaaaaaagatactttaatttttttgtgattcaagttgcatttggattgtgaagacattctttataagttcgtgcctgaagtaagttatttctgagtccctaaatagatgcacaagagcccccaaacacctgggaaacgtggtctcccttgaaaaactcactgtagcatggcctgagtgcttagaatttgtctcataagaaaattccctcatttgatgaaacgatttaaatgtgactgtggtctcaatggttggcgggaaaggccacttacaaattctctttatgagagacatgagtttactattctacctgtgaaggaacagcctctcttgttgggtttaagaatagttttttagcagaatatcttctgttccaagtcaaaatcatctaaataggttcaatattcagctctacatctgtttctaatgcctaaatgaaaaaacgtttttagttcatgggccagtgggtgtacagcttgaatgctaagtcaggaagtaagaaacttgattattagagagatgggtatccaaatatttaatatttttaattaatgcttacacatgtttggaagtaagaaatgggcttgcagtctcattccagagccaacgcatctaaccatcccccctcatacactcattgcacattaggtttctctgtaaaagttagtacccatccctgtttactatgtttttttttttcttttgagacagagtcttactctctcacccaggctggagtgcaatggggtgacttcagctcactgcaacctccgcctcccaggttcaagcaattcgcctgtctcagcctcctgagtatctgggattacaggcacgcaccaccatgcccggctaattttttgtatttttagtagagacagactttcaccctgttggccaggctggtctcaaactcctgaggtcagctgatccacccaccttggcctgttcactctttctcatcaaaggagactagcatttcagaatctttatcaacaataagaaattgttatgctctgatgtttacagacctgtgctagactctgggaggcagaggtgaaaagacacagccttgagggtcttacagtttttggaacagctgtccaaatacacaacgtacaacgcagggcaatcagagccaagggcacacaagaggctcaggcagagctcctctgcagagggccaaggctcctggaccgcttcctggaggatgcctgcatccttaaagaagggagaggcacggacacaggacagcattgcagaggagatgcacggtgggctggtggtttgatggtttgaacaaaggcagtggttggcaagtacacagaggattgaggaaataagtacctcagttaaggaggatgagagaattcataaaggacagactgggaggtgaaaccaaagaggcaagtgaaggcacagatggccaaggtcataaagccaggctcatgtgcaccaagtgtcaacccagtgcccctttattaaacttccatctaccttctgtcagtgttaacttaggaaatcccgatggagtgtttcatttctttcttattgttgtttttggtttaggggtttggattttttactcccgataggctttaccttcaggtctacaccatttgaacttgatacggtcagcaattaggaaaaatagagaatattagaggattacatttattgatttgcgtatattgaaccagacttgcatcccagggatgaagcccacttgacatgattatctcaatagatgcagaaaaagcctttgacaaaattcaacaacccttcatgctaaaaactctcaataaattatgtattgatgggacgtatttcaaaataataagagctatctatgacaaacccacagccaatatcatactgaatgggcaaaaactggaagcattccctttgaaaactggcacacgacagggatgccctctctcaccactcctattcaacatagtgttggaagttctggccagggcaattaggcaggagaaggaaataaagggtattcaattacgaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacagacagagagccaaatcatgagtgacctcccattcacaactgcttcaaagagaataaaatacctaggaatccaacttacaagggatgtgaaggacctcttcaaggagaactacaaactactgctcaaggaaataaaagaggatacaaacaaatggaagaacattccatgctcatgggtaggaagaatcaatatcgtgaaaatggccatactgcccgaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagatatatacatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaacttatacaaaaatcaattcaagatggattaaagacttaaacgttagacccaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatcgacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacactttaacactgttggtgggactgtaaactagttcaaccattgtggaagtcagtgtggcgactcctcagggatctagaactggaaataccatttgacccagccatcccattactgggtatatacccaaatgactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtccttcgtagggacatggatgaaattggaaatcatcattctcagtaaactatcgcaagaacaaaaaaccaaacaccgcatattctcactcataggtgggaactgaacaataagatcacatggacacaggaaggggaatatcacactctggggactgttgtggggtggtgggaggggggagggatagcatcgggagatatacctaatgctagataacgagttagtgggtgcagcacaccagcatggcacatgtatacatatgtaactaaactgcacaatgtgcacatgtaccctaaaacttaaaagtataattaaaaaaaaaaagaatattagaggaatcccatggccttaatcacgtgataaagcagcaacttaactcccaaacaggtaaattaaagaatagtaattgaatacttttcttgaccacctgaaacacagatcccattctggctctattttaagttggtatttttaatgattcaatttttaaccaatcgcttcattctgattccgagagaaatacctaatggacaaggtagctgccttttcagtgcaaaaaataacttgcttctattcccagagcactcgctaattcacaaaacgcctcactgtgtgtcccatttgatcagcagtaccatctcccagggcagctagggacagaatattatcatcagccccatttcacaggtgagatagttgagcttcagatagatcgtgtgacttgccctagatcacctggcttgggtcagtcttgggtcccaaccctccatacctatgaggactgtgtaaggtcttcatcaagatcccactttttctctacctagctgattgcttaagattttttctcgaatttctctaaactttaaggagctttttgatcttctgcaaaccacgttttagaccatacctaccccaaggaagaaaactttacaccttattctctgtggctatcaactgatcagaggcaatgttactactcaaagcactgttttttaatcttccacaacacccctagaatataggaattgatgtccagattagacaggtgtgaaatgaggtgttgtgttggtcagggttctctgaagggacagaactagtaggagatagatatatatatagtagtttattaaatattaactcacatgatcacaagtcccacaataggccatctgcaagctgagtaggaaagagccagttcaagtcccaaaactgaagaacttggagtcagatgttcgagggcaggaagcacccagcatgggagaaagatgtaggctggaaggctaggccagtctagctttttcatgtttctctacctgctttatattctagccaggtgtgctggctgctgactagatggtgcccacccagattaagggtgggtctgccttccccagccgactgactcaaatgttaatttcctttggcaacaccctcacagacacacccgggatcaatattttgcatccttcattccaatcaagttgacacgcaagcttaaccatcacaggtgtagagcaataaggtgatttgatttgaccaagctcacttagctcatacttgaaagagtaggaatcccaaagccctcaaccacactagcagaaaaatgcccaaacagaggtgggaaggtgtaaagcagtgattctcaggcaggatttctggctcccctgcatcagaatcacagaggactcctgttaaacttcagattccttttccagaatgtctcaagatgaaacacacaccagggaatctccattttttcaggtcctcagaagatttttaccaacaccaaaagctaggaaatactggtaggagacatggccaagagaatggtgtatagctcaaccccagaaatacagggcaaatatgaggaaggaggggaggatggagggatggagggccaggtggtggaggaccctgaatgaggttggattagagagaacaggaaagggactagaggaagggacttgaggtgtcccaggagcaggagtattttcatgtattaggaaaggactagctttggtagaggaaaaagatcactaaactaagaagatactggcctttcaatcaacaaaccaagctgcctcatcttatttctcctgtaaaggaaggaggcctgacttgggaggcagatctggatctgtttccaactctgcctctaacccctctgtgactctgagctaatcacttgacatcttggaacctcagctgaagttcagcatcagtaaaatctcgccctggctggggaaggttgggtgggggagcagaatgattgctaatatgtcatccaacaccaaattttcgggagtttccaccctctccttcattaagctcatctctatccaatgtctttagtgttgcgttctccagcaagactcggcaggaagatttagaaggctctaaagccacagaagtgttgtgcagagaagcagcttaagcccaggtcacagtggaaggaggcagcctccagcagaatgatggtcaggtgtggctgtacggttgtgacctctgagggcacccagcatctggcagccatcctcagggagagatttcctaagtctttattggttttgttgtttgtttgtttgtttgtttgtttgtttgtttaagacagggttactctctgtcaaccaggctgggttacagtagcatgatcatagctcactgcagcctcaaactcttgggctcaaaaaatcctcccaattcagcctcccaagcagctgagattataggtgtgcatcaccacacctggctaatgtttaaattttctgtagagatgagattttcctacatttcccaggctggtctcaaactcctggcctcaagaaatccacccaccttggcctcccaaagtgctgagattacaggtgtgagccaccacatccatctgccaaagtccatatttgaaagctgcccagcccaggatttctgttaagagacacgttctgagctccaggaatggcgaatgtgctctttggacagaaactttggacttaacagtggccaactggaagcattccgactttgagtaaaatttaagcacctgttataaaagtctggtgcatgtcacactgtcacaatatcctttctgtgggttatggaaagctggagaagcattgtttcagacatgggggcaaacagaggactgggacctgtggttctgccatcccggtttggaaatgggagaggtctgatctgatctgatcaaggcagaatctggattaagtagaaatatattcagagctaagacaacaatcttggatatacatactccatacttggaactacattctccatgagatggaagaggaatgttccttccagccctcctaaattatttaacatatatgaaagatattaatctctagccactcacacccctcaaaacttctagggggaggttttattattcagtattgagaacacccagttctgctaggagagctgaatattagatttgaaagatgaatttactcagggtttaaaaaaatagcagaaacaattcctcctacacagttgaccctcaaacaacatgggcttgaaccgtgcaggtccacttacacgtggatgttttttcaatgaaagttacaccaagtctatctgcccctcctgcctccccttccacttcctctacctcgtcctcctctgccacccctgagacagcagatcaactccccctctttctcctgctcctcattctactcactgtgaagacaagatgaagacctaatgaatagtaaacatattttcgcttctttataattttcctgataatattttcttttttctagcttactttattgtaacaatacagtatgtattacatataacgtacaaaatacgtgctaatcagctatttatagtaggatattagtagttaagttttgggtgagtcaaaagttatactcagattttttactgagctggaggtcagcacccctaatgaactatgttggagggtcaagggtcaactgtattagttcactagagctgtcataataaagtaccataatgtgggtagtttaaacaacagaaattagttttctcagttcaggaaactaaaagtccaaaatcaaggcgtccagagagttgattttttctgaggactgtgaggaaaggatccattctagaccattctccttggcttgcaggtggctgtcttctccctgcatcttcatgtcatctttcttttttttttttttttttgagacagagtcttgctctgttgcccaggctggagtgcaatggcaagatctcggctcactgcaaactccacctcccaggttcaagtgattctcctgcctcatcctcccgagtagctgggattccaggtgcgcgccaccatgtccagctagtgtttatatttttagtagagatggggtttcactatgttggccaggctggcctcaaactcctgagtcatctttcttctatgtgtgtctctgcatctgaaatttctcccttttatccgtttctataaggacaccagtcacagtgaactataacccattccaagaatttcatttcaatttggttgccactgtgaataccctacctccaaatagggtcacattctgaggtaccagaggttagaactccaacatatcttttttgaggagaatacaattaaacctgtaacacctccctttccacaaaatctagttccatggttctaaaggagggaaagagcatcagaattaatgccttctcatgaataaggcacactgggggcactaggagaagggattaagtcagagagagacatgctctagaaatccagccaagaagaaggtcctgtgtaacctttacattttctttgcacatccaattagaaatgagaaaatgggaagactctgagttcctcagcaaatgactagattgtgagtccattgactgggtaatttataaagaatgaaatttatttctcacactttcagaggctaggaagtccaagatcaaggcgctagtaggtctggggtctggtaagagcccagtctctgcttccaaggtggggccttgaatgttgcaacctccagagaggatgacctctttcctcacatggcagaatggcagaagagagcaaacccacttttctgagccctttttatacaatcgttaatccattcatgaggatggagccctcatgacctaaacacttcacattaggtgccatctctcaacactcttgcattggagatgaggttttaacctgtgaatcttggagggaacacaaacattcacactgtatcatagattaatagacttgtccatagatggccctcaaatgctagaagggctctgcacaggaacccagggacaagacccatctatggtctggctacagagagcagaaagaacacaggggtcaatacaagcctgcatgcatgcatctggggcccctccccacccaaataaggccctacaaccactttttggagaggagaaaaaacagagataggagcctgaaatgttgagaatttaccccaaggagatgtttctacaaaggtgactattttaaactgaaagacactttcaaaccaaaagagtgagtctgagatgctttaattggcaacttgaaaaactagaaacatgttttcttttctacccatctgggggagggtactggagcaagattagctccattatggaaaataaaatttacattttctttgcacatccaattagtaatataaaattgtcagcccttattcctaccacacagggaaatggagttacagagaccaagtgagaggacattttggggagcatttaaaaatctaaaccctgaacagaggtagatgtgaaaccaagaatgacgtgaacactaagaatgagaacatctgcatagatgttagactggttttcaacgtagctaagtagatacctttactccgagccaaacctaccttacgtaaagtctcaactgtgtggccatgaccatactggccattttccccaccagggaaaatgtcagggttctctagagggacagaactaataggatagatgtatatataaagtggagtttattaatgagtattgactcacatgatcacaaggtgaagtcccacaacaggccatctgcaagctaagaagcaaggaagccagtccgagtcccaaaacctcaaaagtagggaagccaacagtgcagtcttcagtttgtggccaaaggcccaagagtccctggcaaaccactggtgtaaatccaagagtccaaaagctgaagaacttggagtccaatatttgagggcaggaagcatccagcatgggagaaagttgaaggccagaagactcagtaagtctactcttccattttctcctgcctgccttattctagctgtgctggcaactaattagatggtactcacccagattgaaggtgagtctacctctcccagtccactgactcaaatattaatctcctttggcaacaccctcacagacacacttaagaacaatactttgcatccttcaatccaatcaagttgacactcaatattaaccatcacatcatcactttcccaagtgctttcctgtgcaaccccaagtccatcttgctcttcctcctgaactctcctccttcctcccaacctgcctctggattttaaccattctccaatgtcttagttcattttgtgttgctataaaggaataccttaggctggataaattataaagaaaaaaggtgcatttggctcaagatttagatgactgaaaacttcaagcttggatgtctgcatctggcgagagcctcaggctgcttccacttgtggtggagggtgaaggggagctagcatgtgcaggagtcacatggctagagaggaggaaagaaggagggaggaggtgccaggctcatggaaactaatggtgagaatttactcacctccagggaagacgccaatctattcatctgccgccataatccaaatacttcccattaccccacctccgacattgaggatcaaatttcaacatgaggcttgatggggacaaacaatcaaaccatagcaccccttgatctgtgcactccctcttttagaacacaagcctaatgcatgcaaaacaaccacatatcaaaagcattctccaaatgactctctttcattgtgaaagggagcttgctgttagcacaagagcgaagcaagcaacagctttcgggaagtgataacatcaggatctgatagtggagcccatgccaaatctcagcagagagcctcagggcctgcaaggactgtgcatgagacttggcactggtatcctcaagccacagaagaaccttttctggaaaagcaaatgaaagccagagggcaagggagccagaacagcagtgaggcactgaggaccctgagctcagcccacaagagcactcccctccaagtcagcacaacaagtaagcacaggctttctacctccttcaggccagatgtttctctccccgttctagctgagggctgaaatatcccttaactagttctgagagtgtgttgttggttacagcttctctctatattgctacagcccctgcctctcacatccacctgctccagggcacacagccctttccctgcaggctgaggtcctgctgctgggctctgagtgtcaaagactttagcatttttagcatcctgctactcaaatctcaaattgtgggccctacaccagcagcttcagcatcacctggatgcctgtcaagctccattgcagacccactgaatcggaatctgcatttcaacatgaccccagatgattgtgagacagagtcaagtttgagatacactttaacagacttttcaaactggatgtaaatggaatcacctggggagttattaaaaatattgatgcttacctcccacctcccaaaattctgatctaactgacacagggtgagatcaaagtattaagggttttaaaagctcagatgattctactggggagcatagcttgagaaccaatgtttcacttctctcccacttggatcttctattttttcattgattctctttccagttattgaacaaagcaaattataagctctctttttctatttaattttatttttaacttttattttagattcagggggtacatgtttgttacctggatatattgcatgatgccgaggtttggggtatgaatgatcccatcacccaggtaacgatcatagtgcccaatagtttttcaacccttgcccccatcttttcctccccactctagtagtccccagtgtctatttttcccttctttgtgtccatgtgcactgaatgtttagctcccacttagaacatgtggtatttgcttttctgttcttgtgtttatttgcttaggataatggcctccagctgcatctatgttgctggaaaggacatgattttgttcctttttatggccttgtaatggttcatggtgtatatgcaccacattttcttcatccattccaacgttgatggacatctaggttgattccacgtcttcactattgtgaatagtgttgcagtgaacatatgagtgcatgtgtcttttcaatagaactttctttttcttttggatatacacccagtaataagattgctgggtcgaatggttattatcattctctttttagtaaaccaacttataaaaagattttaaatcaaagctttgtgctgctaaccccagtgagtccagagcttatattttttatcttccatgggggtaggaggtctgcagaaggtggtggcagacacaggcccagcccaggaactgacagcttttcaaccacagcctggtttcccctccaagggcagagcaagggtttgtactttagtatctggacagaaggagaactttagcggcagagcaggcagttgactagcctgaagggtatattgggtccctggttaagaatcaataactccccggtggaggggctaagctccgtccctttttttagatcaagcctagtggtcatgaacttcagatgaacaccctcaacaccagcaagctctagtcacacgagcattagcccaacctgggccccctccaagaatgacaatatcaaccggcaagaggctgggatcccagctgccatctatgggggaataagcccaaggaagctggcaaaaggggctctgcttacatcaaaaaaagtcctgccaggcatggtggctcacgcctgtaatcccagcagtttgggaggccaaggcgggcggatcacctgaagttgggagctctagaccatcctggctaacatggagaaaccccatccctaccaaagatacaaaaaattagccaggcatggtggctggcggctgtagtcccagttacttgggaggctgaggcaggagaatggcatgaacctgggaggcggagcttgcagtgagcagagatggcgccactgtaccccagcctgggcgacagagcaaaactccatctcaaaaaataaaaaaataaaaaagaaaaaaaattagccaggcgtggtggcaggcacctgtaatcccagctactcaggagactgaggcaggagaattgcttgaacccaggaggtgggggttgtgatgagccaagatcatgccattgcgctccagcctgggcaacaagagcgaaactcaaaaaaagaaaaagtccaagaaggagtgtgggaagccccagcctggagtctttgctgaacgtgagccctttattgggccacagggtccctctcatttctcaaagaataggctgcctgactagggtcttcccagatttttggacccaagtaggcttcatcttttatatggaaaattggcttatattacaatctgagtagttttatttatttattgtaaagaaaatttgccccaaagtgggtatctgaaggaaatgaaagaaataggagatctgtcccccagtaatcttttttaaaagtacaggttctcatccaccaggtacacctgggaggaagaaggggggcaatgcctcagagtggttgtatgaccttcagtgagtcatctcccagatctgagccttagcttcccaatatgtaaaataaggggactcagtttcaatgatctgtaaggggcaccttcctatttaagtggtgtatggtcctacctaaaggctgaggcttcaatttgaaacacttggcaataactgttacaatcccaaaatctggtgacatagttcctcctgattggaactttgtccgtatgtccatcaactaaggaatgtgtagaaaattcctgagaggatgttaggggagataatacaggcagaacagggtatcatcagccctgactggaggttgctgatgctcttgttttgttccacttcatggagcagcaaagactaatgaatcttttgagcccataccaatcaggctttcaccaccacccctccaccaaaatatgtcctttccaaggtcaccaacaacttcacattgttaaaatagtggcagagcttgcccttagctgactacacctctcagcaacattcctcagggttgacccctcctgcatccttgaaatactgtcttcctctggctttcaggacaccccacatgcctgattgtccacctacttctctcaccgctccttcctggtcttctttgtctgtttcttcccatctccccaaatacttagtgttacagtgcccctggtctttcaacctcttctcttttctctctttatctactccccctggtgatttcacccatctcatggctttaaaaccactaatgatttccatcattacatctccagccctgacctctccctgctacaggatgtcaagtgagcctcaaatgaccagagatgtttgagataaaggagcttgtattcccagtgcaagacagggaaaaaccaccttgaggctagccagtttttaaagcttcctttgtagaggagaatgagtacttactgcttacaagacaagcagcatgtttttcaaaagtcaaaagaaagcttgtgaggaacaaggtaatactctctagatagctggccttgtcttatgcacattcattaattcattttgtgcacagaaataacatgtccatgaacctgggggaaccactcttttgagagaccttgatcttggagttcctctgactcaatattaggagcaagatagagtaagacacctatttttttatgtttgccattacataagaatgaatgaaacaaaggcatagttctgcattggttaataaaacaaaaagcccgctaaaaggcaatgttatatattcggcaatcacattttgaagaccaactatattcaagactcatggcaggttctgcatgccactgatgcatctgcatgacctttccaaggctatttgtcacagcagccccgaaatcgtggcctctaagggcctaagtgttctggagtaaataggccaggccagcacctctgagaaataggggctcaccccatcctgagccaccttcccagtctctgagcaacctcagcatcagtggccctctgaccgcatcagcctgtgggtccctacttgtctgaacacatacaattttctttcttttaattggcaagctttgaaaaacaagtacatgagtgaacacagagcaaagagtttagtctgggagctatttctcgtaagtctcttttgagaaagagtttctagcccttccccactttcatgagattagagagataagaacaggaacatggagggaggggtccacactctggaaaacacttttggatctgataaccaccctaatgaagccccaaagctatcgcctttggatgggtttctcaaacatggaattctaccaggatttctgtcaacaggcctcctaatcccctctcgcctgccaagccacatgctacacaaaggtgaagaacaagaaaggcattgagacacgtgttctatccagccaggggatgcacaatgtctgcccacgcaggctgcgttattatcagcaggaactgacagaggggtctgttctcccctctccaggcagtggaggggacgcttcccacctctgacctgtggctgagcccagcccgagcagaaatcccagaagaggtcccggccttgctcgcatcctgcttcctgtgctaagacctggtcggaatgaaagatagtaaaagttctttcacattgggaaggcctttacaaagcttgcctttactattttataatctctacattttattgtccttttaaaatcacaaaagcaagcagaaacatgaggaggctgctttatttgctctcccattcaacaactgggctgctgagttaccagttccccctactacttgatttggaaatggacactagaaatttttcccacttgtgactgaagctgcagaaacttcaacctgttttcagttaccctgttgtacctaataagagtccatcctcttttcagtggaaagaaagccatggacgaggcattgcaggtctagtgtggctctcagactctctgggagcagctgacgcacatttaagaacagggagtccctgaagggtggctgaggacagatcacgagaccagaggtgagaggcgcccgacagggttggagccctacttttgggtgtgagcagtggggtctgatgcaccacggtgaaggcattcagcagccaggtcctgagtagcagaaacacaggatacacagagggcaatgtcttagagccacaccaactgggtaggactgaacagatggtcattcaacagatgatacacctttagggtgtatcagcaatccattggaaaacttgttaaaaggcagattctagctcagccctagattctgatccagcaggcaggaatctgcatgtttccagtttttccagctgattctaatgtagatggactctggattgccatttgagagacactgatgtagaacaagatcggttagactggagacattggccaaggtaatttctagagaaaatgtgcttgctcaaagtcctgaggacaaatttaagatcagagtctagagaaatgaacatgaacatactcacagcttaaaggctaggttgggaggcccaaaggaagcacatgttcaaggcacaagcgagtcattacagtgaacaagcctcagagaagcttctggaagcccatgatctggcagatggcacacacaatagtatggcagatggtacataccaggtaaaccctaaatgcataaggttcgtattacacgtaggaaaacaaggcataagcctaagcaaggggcctggcccctccaaatctacaggtaatgggcagagtcctttagaagcatgggtgcattagggaattttaccttgcctcaacagaaactatggtaagcgtaggtgctgcaaggaagccatacttcaattgctctacatctattattccagcaaagatgatgctaggttctatgagaaattctaaagacgacacagctctgttgtcaaagagcttacgatataatcataaagcactttagaaaacttggctatttaagtaagcccaaatactggataatattgaagcagttgactgcaatctagagtacaaagtgggtcctgtgcagccaggaaaaagctcacagagtaggcagagggtcgagactaagtgatttaaagccctcataattctttctgcatggcccctttttccagcaggcctgaccatgttctatgcaattcacaccatctgaaaatacatcgcagcccccctgttcccctcacagcattagttctcaccttgaagcttctgggactcacattcagcttcttgccctgttcctagtctcatcttctgatactccaccttccctgttaaggttttgccatgcccttgaacatgacattagatacaactccagttttgactcttactaccctctctctccccattcacggcacaatgatgatttgcaaactccctccagccaccttggatatataatcacggtccctgatccaaccttgcccctgacctttgcatccttgtaccttggtatggcaccttgtacctccatgggcagcagctccatgggaattttccagtcccagagaattcatgcattcatgaagggaaagaacaaatgggatgagtatgaaggcagaaaggagagttggaagataaggagcaatagtcagacaggagaacctacattttgagatcaacgataatgtcttccctctcaatcaggatacttcttaatctcaagtactctattgggaaggaagagatcagctgtttctgggctcaaataaaggtaatctttggctggaagcactaggcaagcacagtcttctacatcttgatggagcctcataggaaggtggaggctaaagcacaaatgacatgtaaaggaaagtctggtgagattgagcattagtggaagaactttggtggcctggcctgattttcacctgagccaggttgctggaggcgtgttcttgctgagtttcatctgtggccccaaagcctttggggattcagaaccaatgggtactctgcagtctggcctccacatgacccccaactggctttgtgatgaaaggaatcatgttccatgtaagaacccatcttctgaacaccccactgcactctcactggtagaagacaaatctgatgctctagggagttatatagtttatttcttctcatttcaacctttctatttctcagacacatatgcacaggtgcacacacacacaagtgcacacacacacgtgcttgtgcacacacatacacacacagaggactttgaactgcctaagggcaagaataattccgtattcatgttctacaatgcctggagaaagcttttcacacagtaggccttcaaaaaattccactaatgagcaggattcataatagtaaagtaaatgatgctgctacaaatctgagccatgggaggatccatgaagaatgccaggtacgaatatcttcagggtccgtctcatagggatgcagtcccatagatgtctataagccccttaactcacagcctcaaattaatcaagcaaagagactaagagaaacttgtcaagtcttgtatctccttaattttaccttatgctaagtttccatgacagggagcagctatgactggtcagcagtcaccagccatagtccagcccttggaggcttggagatctatagcctagattgaagagtgtggaaatggctaggaaagtaaggataggtaagaattatctattgtatctactctataaaattatagaaaagccactcttcactttcccaagaacccctcattgataaagatttgcagaaagtgtctgtctggggtccctgttgcttcctttacttgtcctgagtcagccacagctgtttccctccttataatcatctcattgtcattggatggcagcagagactttatgagaaagctcatgtggctacggccctgcctcctttgcacgaggataagaggtttcaagaagacctttttcacaagggcttgtccaggatttgggccagtcccacagcattccaggtccttgaagtctggctgaaaaccttgtgggaagagaaaaccttctaagcaagagaaagccaacatatattaaaatgttcttgtcttcccggataggttgtgttttgtgaatagggcaatatgtcatttctcccaggaaaagaaaacacaaaactgattcaaaatgtactgaggtaaaaagagttgcagaagaaaattaatcttcagattccctaactttttgtgtcccataaataatctgtggccttgtcccagagagaaatgtgtctgccattttggcaaaccaggtatctgagagagagaatagagttgccctgtcttgaggaaagaccacaaggcaaacataaatgaaaagaacaaagactctgtattgttgagctgaatggccacccaaatatcccaaagaatgaactttaactttctcaacagaaaggcaaccacaggaagtttggcagctcatggagaaagttccttcatgaatatgtggcctttacagtgcttcgtctttacacagaattaactccgggcctgaaagatgtgtgccttttcctgttttgttttaatggcagactcagaacacagggtacagttttgcttctgtctttaaagttgtccttgctttgccctccaaggcctgtagccagtcgagcatttttggcaagacagaaacactctccagtcccaagaatgcccaggaaccaacagacatagatggttcctaagcttatttcctgtgttcagattcaagagtggaatcccagtttggcctggctacagaggctggaaggtagaaaaggtgaaaaattctctaaaatgtttccaggttttctatttactggataagcaacaaaccaatagctgtttggagtagctagctggctggcagcaattttccaagaatttccaaatagcagtacgtggcctaagaaagggaggtaccaggaaaggagtaagaagggagcaaagtaaaaaatgatttattggtgcccttggcaatataaagttgaagtggacagcgcagccaaaagtatcttgctactgcagtagggaaattagccaagggtggtgtcaattagagatacaaggggtggtaatttcactggagaagccaactctaggtatgggtgctgagcaattgccccagcaacctgccaaggtatgttctatttgttttcaccaggactgtggataggggtgtgtgtgcgagagagagagagagagaaaaaaaaaagtaggtcatcctatcaaaagagaaggtgaaagggttgaggaaggcctctcttctctctgatttattgtagagcaggaagagtcactgtctgcaatacacaaaataatacatcaggaaaacaggaagtcaaactttcaagaatgcaaggggaaatcaaaaccagagataggacaaggatgaatgaaaacacctggcatagaagtgaaacgagaaaaaaggaaacttttgctttcttggaaatacacaatcggtctgagcctcattctttggaagttaagtccagtccttctgaaaaagatgtgtggaccactgaagaggaaccatgatgataattcaccccctgcaggctgtgggagaggaggtttggaagacaggtaggaagttggctctctgaataatgtagacaatgaggaggtacatcgtcctttgagaggtgataaggaggcggccatcatttagcaaaattctatgcctcctaatgatagatgtgcttaggtatttctataccaatggttgtaatgaaaagagtataaacttgagtcaaacagaaacaacttttctttgtgtatacaacaggaataatgctgattaccccaatcttggctacagagttagaatgaaatggcacctggaacataatagatgttctttggatttaatttattgtcttttcctcttcatgccgagataaaagagtaccagtagaagaagtttgagacacattctctagagacagaaaatgtaaatggcataagatgatcagtggctttacccattgattcttccaacgaaaggtcgggtgtaatggacaagaaaggaagggatgagaaacaaaagacagtggacaaacggaattcaaaaccagttgtgtatttctagttctggatttcagacactaaatgtagagcctctagttaagagtggaacatctctcacaatgcctggagaccaaatgaactaattcagaagctttaactaatgtgaaagaaatgccagataaaaaaatgaagagaagctattaagaataagagatgtggcaagaaatataaagttggaaaggtgatcagtgaaccacatgaagaaataactaaaaatcaggcaaaaacaacactaatgaactcagatctctatgttccaatgtcagagcatggacaacaaaaaacaagattccaacattgaatggaaaatctgatctcaaaagcttcaccagtggccaggtgtggtggctcacacctgtaatcccaacactttaggaggccgggactggcagatctggcctgaggtcagaagttcaagaccagcctggccaacatgctgaaaccccatctctattaaaaatacaaaaattagccaggcatgatggtacacacctgtagtcccagctactcaggaggctgaggcacaagaattacttgaacctgagtggtggaggctgtagtgagctgagatcatgccactgtactccagcctggccaacagagtaagactctgtctcaaaaaaaaaaaattaccagaacttcttggaatggagctcaacattgaaatattgcaaacatgctgagaagggaagacaaagtagttataggcctaaataatgctctgtgttgctgatggcattactcacacactgtaggcagagatataaaatggtacatatttcatagagggtaattgaaaatatgtagtgagtgttctgatgtgccatcagactcttccttcagaaccaagggagccattctcctagttgcaagaggatagcctgctgcattggtttctgatagctgctctcacaaatattaccacaaatttcatggcttatgttttaggcaaatgctaaaactgtcttaaacaaatgtattaacttatagttctaggcatcagaagtctgaaatgggtcttgtgtggctaaaatcaagacgctggtagagctgcattcctttctggaggttcttgggaagaatctattttgtttgtttctgttggttttctgggtttgttttttttttttactttttttttcttttgtcttttccagcctttagaggctgcctgccttcctcggctcatggccccattccatcttcaaagttgaatctttcttacattacgtcattgacaccctctcccttctgccttcctctttataaggatccttgtaattatactggacctacctggataatccagtataatatctacatcttcatttcatctgcaaccttcattcttctttgccatgtaatctaacatattcatagatttcaggaattaggatatagacatctttgggggctgttattctacccgccatgtctgacagctgctcacagctgagtctctccccaggagttatctttggttgaaagcagctgcctcacacaaggttatgctccacaggaaaaactggcatccaatgactggctgatttgaaggcccaaaggtccagcccccctcaatgcctcagtatggaacaatcctcactagccatcccagctccagggtgcccttgaatcaactgaagccactgctgcaatgtattccaaaattcagcttttttctgggactagtcttgtaattttaggtccctccaagttgttgttctcaagagctctctccaatatcttcctgctaacaaatctctgtctcaaagtgtttcatgggaaaaccaacctaaggcagtggatgtcaggaatggtcagaggaagctgactctaaaatagaacttaggagatgggcacctcctagcccattaacaatgaggaccccatcactagtgaaaactgaagtttgtatggccctcacatgttatactggagtgttaaaatattccttggtggtcagtgggatgggatataagtggaaggaaatgcaccaaaggatgcaatatctttgacatttgagccattctggggaaactgggattgctgatgctgaatattatctatgtgctgggaaaaaagaagggaaatctgggaaaggggagctgatcaattgtctattgaaatcaaattgtgatagccagaggacttccttggcagcactaaaaagtgactctcatcttgtgtagtttgaaagcagaaaaatctgagaatcaggccaacgacttaattataagtatagtacaactcaaaaaaggtagaattcttaatcccagcaaatcttgaaactccagatcccctcagaaccatttgctcctgtagaagtgatgcactcctcttcaagtaaagaccccttagttgaagacaacacagggttctctgcctgtaaaacagtatgtcttctcttgggatttggctcacatctaccctcctggccactagagagtcgagttgcaatagaagctggccaggaaagtgctgagtcagctaggaaaataaagagcccaaaccccaaaggggttgtaggtcccagccaaaatgtgccagcagaggtcagtaaactgtaaatgggactaaagcctgagaagcctggatcaaggggagtataatacaaatttgaataagggagagattgttgctgtgaagctactctcttacaatacagggttcaactctggtaggcacccaggcagatggtggttaatgttctgctagcatagctcttggaaactaccatattctaccataatatattataaaagaagaaaccaaaagactcaaaggggtgggcataaaatgtagagataaaatgggagctggaaaacctaccagcagatgatgttctaagacatatcagaaagacattgtgctcaccagagcgatgagagaggtaatgggagcacagcagcaacagcgtcaagaaactcagtgttgcctgtcctctgtaggccaagctgattataaaaattgaaaagtgggccaggcatggtggctcgtgcctgtaatcccagcactttgggagcctgaggcaggcggatcacgaggtcaggagatcaagaccatcctggctaacacggtgaaactccgtctttactgaaagtacaaaaaaattagctgggcgtggtgacgggcgcctgtagtcccagctactcaggaggctgaggcaggagaatggcgtgaacccaggaggcggagcttgcagtgagccaagatcgcgccactgcactccagcctggggaacagtgcaagactccgtctcaaaaaaaaaaaaaaaataagaaaaaaattaaaaagtgataatcctttacccagtttccaggactaaaccagttttcagatcttccagtgtttgactgaaggagagaccaggtacccagaaggaacagctctgcagtgccacagcaagtgtgtaaggtaatgactgcctcagtttttgcctaaaggacctatagccgtttactcaagtaactctaaactgaggaaaggggaatatcctgacactttgaggttgatggatgcagggtcaaaaataacatggatacctagggaactgaagcatcatcatgcttcccttgttagaggacataaagagggcagataatagagctgggcaagttggaccaatgaatcttacagtgggttttttcaaaagataaacaaaattgacaaaactttaattagattaaccaaggaaaaaagaaaggactcaaaaaaaattacaaatgaaaggaggtattaaaactgataccacagatgtacaaaggatcacaagagactatgatgaacaattacacaccagcaaattggataatctagaagaaatgaagcatacattcctagaagcatacaacctgcaaagactgactcatgaagaaatagaaaatctaaacagaccaataagaactaaggagattgaatcagtaatcgaaaacctcccaacaaagaaaatcctagaaccagatggcattattggtgaactcaatcaagcatttaaatgattaacaacaatccttctcaaattcttccaaaaaaatgaagagaaggaaacacttccaaattcattttatgaggtcagcatcacactgataccaaagccagttaaggatgctacagcaagataaaattacaggttgatattcctaatgaatgtagacacaaaaattctcaacactagcaaaccaaattcaatagcacactaaaaggattttatgccataatcaagtgggataatcccaggaatgcaaggatggttgaacatatgcaaatcaataagtgggataaactacattaacagaatgaagatttatgatcatctcaatagatgtttaaacaaaagcattcaacaaaactcaacattgttttataataaaaactctcaaacaagttgggtacagaagaaatatacctcaacataataaagctatatatgtcaagcccacagttaacattatactcaaatgatgaataatcaggaacaagataagggcacccactcccaccactaccaatattattgaaacttatagccagagaaattaggcaagaaaaagaaataaaagtcatctaaattggaaaggaagaaataaaattgtctctttgtagatgatgcgatcttacacatttagccagaaaaacattagaactaataagcaaattcagtagagttgcagaaaacaaaatcagcacacaaaaatcagtgtgtttctatataataacaacaaagtatcagaaaaagaaattttaaaatatgttatttacaatagaatcaaaaataaagtatctaggaataaatttaatcaaggagagataaaagatctgtacactgtacataaacataaaaagatctgtacactgtacataaggaattgatgaaacaaactgaagaagacataaataggaaggtaacccgtgttcatggatttttaaaaattaatagtattaaaatgtctatactacccaaaataatctattgattcaatgccattcctatccaaattcttcaagcatccttcaaagaaataggaaaaacagtcctaaaatttgtatggaaccacagatgaccccaaaaaagccaaagcactcttgagaaagaacaaagctggaggtattacatgtcctgatttctaatcatattacaaagctaaagtaatcaaaacagttaaaacagacacatagatcaatgaaacagaatagagagcccagaaataaacctacacatatagggtaaactaatatttgacaagggtaccaggaatgcatattggggaaagaataatcattttcatacacagtgttgaaaaactggatatccacatgcaaaagaatgaaactggacctctgtctcatagcataaaaaaaaaaactcaaaatcaaaacacaaatataagatctgaaaccataaaactcctacaagaaaacgtagaaaaaacttccttgacattggcttcataattacttttttgatatgacaccaaaacacaggaaacaaaagcaaaaataaataaataggactacatcaagctaaaaagcttatgcatgacaaaagaatcagcaaaatgaaaaggcacctatagaatgggagaaaatattggcaaaccatgtatctgttaaggggttcatttccaaaatatataaggaactcatacaactcagtagcaaataataataataatttaactaaaattaaattaaatttcaatttattaaattaatactcaaattaattttaatgtattaaattaacagcataattaaaatggtaaaaagacctgaatagacacttttctaaattcataaaaatgtccaacaggttcatggacaggtgttcaacatcgctaaccatcaggcaaatgcaaatcaaaactaaaataagacatcaccatatacctgttcgtatggctattaccaataagacaagaggtaagtgttggtgaggatatagagaaaagagaaaacttgtgtacccttggtagaatgtaaattggcacagccgttatggaaaacagtatggtgttgcctcaaaaaattaaaaaaagaactaccatatgacccaccaatcccacttctgtgtctatatatccaaaggaaataatatcaatctctcaaagagatatcttcactcttgtgttcactgcagcattattcataatagccaagacatgggaacaacttaactgcctgtcaacaaatgaataaagaaaatgtggtatacatgtagttaaatattattcagccataaaattggagaacatcttgctatttgcgacaacatggatgaaccgggagggcattatgctaactgaaataagccagaaaaatgaggacaaatactgtattatctcacatatggaatctaaaaaagtcacactcaccaaaacagaaagttgaatcatggtttccaggggctggaggttaggggaaataagagtatgttggtcaaaggatacaaactttctaatataagatgaataagctctgaggatctaatgtacagcatggtggctatatttaatgatactgtattgtgtatttgtaatttgctgagaatagatcctgtgttctcaccacaaaaacaaaaatggtaactatctgaggttagggatatgttaaccaacataattgtgataatcattccttcacaatatatacttatatcaaataatcatgttgtatattttaagtgtatacaattttatttgtcaattatacatcaacacaagtgggagggaaaaaacgagaaaattgcatgagctaatgacccaagtcctcatgtcattcaccactgttgcaccagctatggctatatgggcaccacttatgttcagctgatagaggaagggaaaagccaagctttgttcaaaacagttgggccagtttgatgtaggaatacaaaccagaaaaggtctttagtattctcagtcccactcatgaataaccctaaaagacagcagtgaggggacatcctcccaatggacttcaagtgatgcacctggccactcactttgtgtggaaagtggctcaaggtcaaatatatctaaactcatgggcaattgtaaatgggttggctggttgcttagtggcctggaaggagaaagagtgaaagataaggaataaggaggtctggggaagaggaatacggaagtggacatgaagtgcaaagagcttcatgaagatctttgtataccatgttaacgcctaccatggaagaggcaatttctagtcaaatggacagactgatttggccaggtgatgtcagacagccctttctcattaatcaccccagtgctggcaagcaggcatatgaacagagtaatcatggtggcaggcacggaggctgtgcaaggcagcttacaaaataggtgatctagtttctgctgctgctgaatatctatcaggaacagagattactgccgagcccctgacaaagaacaattcttcagagagtccaatcggccatgtggtggcacagcaattacattaaacctctttctccatggaagggccagcaattcatcttgaaggaaatcaacacatacttaggatacaggtttgccattcctgcccatagatcctcagccggcaccattatctaaggacttacttcatgtacgattcactaacacaggagcccacagaacatcctgttgtacccagaaactcactttagaagaaaagaggtacaacgatgagcacaggaccagctgctgactttataaggtaaaggaacacccttttgaaagtattgctgaagtaccacattcaatataatacttaaggctggagtccttaagcatcccgcatcctccaggatgcagtgtccacccttaataataagtgactattatacagtactgtgtctcctctatatagattacatggttcagggtggaaatagggctaatccctcctaccatctcactcaataacctacccagggaattcatcccttccatctccacgactctgagctctgcagctctagagagtctggttccaagaacagaaacacttataccaggaacactacacgaatcccattaaactttaagctacagctgttggcactttatgtttcttgtgccaagaggtcaacaggccaaaaaaggcatcaccattttggcagtggtaattgatcaggagaaggttgagctattgttacacatggtgacagaaaagactatttggctcccagaaggacttcttgggcatctcttggtaataccctagccaatcgtaatggtaaatggataaaagtagtagtcatggcttgagaagggcatgatgactacaggctcagatccttcatggatgaaggtttgggtcacccaaccaggtaagccacctggagcagagctttcagccaaggggaagagaactctacactgggttgtaaagaagggatttgatgagtgtcagttgtgtccctgagaacagctgcattgttgagagctacagtttgtcccattaatcttcctcttgtacatttccctaggaaaagaagcaaaccagagttctagaggagctcttcccagatagggtgatttttttaaataagaaatatgtggtccaagagttgaaaggggtaactgaaacaatcactttgatgcaccacaagcttccccgcttcagttctgagggcttattcccccagtggccagatatgttatctgctgacagctagctgttgagtctttcttttggaattgctcttggccaaagggagatgcctcacccaaggtcatgacctctccctggagacaacctgcatccaatgagaagtcaatgcaagagcacaaaagctcggcccccttgcctcagcttgggacaactcacaggagagctccaaactccagcgctcctcaggatcagctgaggccattgttgcaatacatcatagttcatcttcttcctttgcccagtccttttcctcaccctctcaagggcgttgagggcactcctttaaaaaattcccacacagagactctctgtctctgagtctatttcattggaacatgatccaaaacataatatatatcaaaatccttgaaaacattcatccattttaacccagtactctcacatctaagatagtctaaggtaatgagagattaaatcatagttttgagtttgctgttgtaacattataattttttaaaaactataaagaatctaaatgttcaaaaagaaagaaatagctaacataatggtatagaattctttacagccattacagttcatatttttgagaaatatagtgacataggaaaatgttcacaatataattttaagtgaaaacagcaggatatagaactataaaattataaatggtttgcaaacatattacttaaagaactatcacctttaagagaaatgcaatgaccccagtggtaaatatatttaaaaaaatctaaggagatagtcaaattttgtttaattgagtaaaatttgatctcatagccagacctatttttaggtaaaataaagatagtaaattctctagcactggatatttgaagaacagcacaaatgacacttggcttgctgtagagtagaattaagcatgaatttaaaatgtttaaggtaccattttgccctccggaattccattctgcagtgagtgtcttagagatgtgtggttttggtcggcttgcctctgctttcccttggctggcctggctttggttgatttgtcttagttaacaacttaactcttgaagacatctgacttctttggctaactttgacaattaggcaagaagaaatttgtttgatcatctccacctcaaaaccctactacctttagacctttatcacaagcatagaggaaaagaattcaaagaaaagaaactcatgtgagatgttactaccaagtatctctaggcaataggaaggagtaacccagacccaccattaagggaaggggagtgcttttagaaaataagattgtatattgagacaaactaattgtgatgttgttatgtcacatgtttaaataatcccaggtgcacattctctcactttcatcagaacacaaccacaccaaagcaggtcaaagaatctgactcctttccaccaccaagcctcttaacattttctagacctgaatacaaaccaaacactctcattttcccaatttcttactcccactcaagatatttcaaacacgtgaaattgattatttgaaggtttaagggagtgaaatttaagattaaagacattccttccccaaccactgctccgcactcacatggcaacttggcctatgctatagacaggggagatgacatttaagctccatgcagagatgagccctgtctttgagttctttgtggcctttccttcagtgaagagtgtcagtccctgtctgtccctgccctgccccttctaaccacagatgtcctagcctggccatggatgtggagttcctcagagcaaatagagtccatgattttgtgttctcaggggtcatcaaggtgtgctgatagctttatcttcccttttcacttcatttttctctaatatgtgattaaaatgcagggctatcccagaaggagttgactagagaactaaaaaacaaacaaacaaaacaaagggaccccaaaatgacttcatggttaaaagaaaaacataacagtgaaaaaataaaggcattataatgaactcttctccatactctctagagccctggggaaatctctttgatgtagaatcactgaatgaagaaaagcccatgtgaaaccagaacacttgggtttatccaacagatatttttaaagcacttgctatgtatcaggcactgtgctagatactgaagatacatagacctggacactgccctcatggaaattatactctagcaactcagatttatcagtcccacaacactgggtagaccgcacaacaatatcaggcacagtagtgccgtgagcttatccatcccgtacatgttcccaggagtgctaagaaagggaaatagcagccagaaacatcctatgaaaagattacctggaacgactcaagaaaatctgcccaggtgcatctgtttacctctcctcctctgccaagcaggagaacaatattgaattggagaacacatatgttaataactccaaagagaggctagtatctcagcttgagcaccagctccctggatgctactatagttctgggcaaaactgcaaagcagccaaagttggtcttgcaaccatcccaactttagcccattatcaatctcccagacatcacatgcacatagcctaccctaaatctgccccaaatccttcaatcagcctagacatgcctctagactagtgtctggtttaaaatgtaaatgaggtttaaccttaccagggatgcctcaacatcccctggcagaccttccacccagacaggaagaggtggcataatggagcaagcatgggtttggggccagaaagacctggttttctaccccagtttcacaacttactattttgtgaccacaagcaagttacttaacctcgattaagcctcaatgttcttggccacaaaatgcagataataatgtctgcccaaatatatttcgggaagattaaatacaaacaagttcttcatttcttatcctatccttcctcatctcataaggggaaccaataaagctcagcaaaaacacaaaaaagacattgattttatttatttataggcattggcagaaaccccatcatgaacagggaaaccctttggaattctgctgcaattgattgccttggctgggagatgtgaggttcctggagcaatgtgaagaaatccaggggatcgcctgggcaggacccaggcctctaggcaaaatgtgtggaacaagccatcggttttataatcctcctaagaaagatcatgaaaagcaaagtgcattcttaattatttcaaagagctctggattctatataatctgtcctggaaataatgaagagaagaaagacaaaacttggctttatttacagaggtgacgttacagggattcaccatctattattacctggcaataccttagggctggcctccaccactgctttttatgaagagtaaagtacacgtgaagtctgttgttcaaggccctgacccacatccaacctggactcccaccactctctctcaggcattctgggctaagctgtaactcagccgtgtcttccctacactagcgacagtcttctgcttcatcctgcccttctctccacctaccaagccctcctttcatgtcttcccatcaaccttctccatatagccaagcccctgctcaaatggaccctctccatcagggagaggtaacagaagctagaacccaggctcagggtccatagaccaggccccagggcctactggggccagtcagtatggtggtctcgataccacagacctgggactcagtccataatgtggctatcaaccagggtgcccttagaattaactcaggagcttttagaaacatataaatgctcatatccccaccccaaaccttctaaatcaatattccataggggataagaaaggtatctgggtatctgaattttttaaagactccaccctggattctaatgcacggcctcagctgaaaaccatggctcacagataggaactcctctataaaaaggaaactagatactatgccatgacttcatagactctacaaatagagctgatggaaaataatacaaaaaacagtaattggacaacctgaacatttacaaatcaaaggggccaggtgataagtagtttggggtgttcaaagatctgagtaagaaaccagtgaaaagtttcattatttctcacaacttactgggaagcagatgggtggaggggagtggaaactgaaaatgtctggacatttgttctgaaactaaccagcacctgtaaatctgtaattagcaaagtaaggatagttgtggctaaaaatatagtttgtaaatgtatcaaggacagtggaatgtctcaagcaataagcaaaacggctttcttaaggacaaaaaaatccaaaacaacatgatatcttgttttggaaagggtaaccatatgagaagacaaaagaaacacagcagctgctgtgtttggggcttgagttgcagcatttcatacaacagctcatgaaattttaattgctgacatttaaaggttcaaattggcagggagagcaagtcacatgggttgaacactaacaaaagattacgaaggaaaggtgaggctctgtggcacatctccagcaagaagaggtgcttagcagggtgccctggggtcagtgcttgctcactccagattggattctgcattctaattaacaatgtggaagagagaacaaaagacccctgaaagataccagaagaagacttgcaaagggggatgagggcaacccccagagagaagagcaaaatgagacaggtgagcccacaaggcttaatctataggaaaaaacagcagacagctgagactacttacaaaaaggcaaactagctcattggaggaaaattcactagaaccccttatattttagaaacaaaaggacacagaccacaaaaatgtctcaactatcaacatgggtaagagtgtccagcaccctggagaggaggtcaggctgtacaggaggcagccaacccaccttcagatcaggatcagcagaggcattgccaagacaaagtacattcagaatactaattaatatctatcaatggtttctctctagaaaaaaaaatgaaatgccacagggaatgtctattaaccaaataatccacttgaagatctttttgcccaactgctgtcataatttggtttctctttctaatttcaggttaagttcacactactgtcataatttgatcagcatgtgcaaacagccaaaaccagaaacacatccatacctctacagcagcctaatctaagaagaaaaaggagaggttgggttggtggtcaaagggagaaaggaattttcattccctgtatctgcccctgggctaataacagccaccatgagctgagtgcctggtaagagtcaagccctgtatgaggcacatcattcgtattgctcactttaactgcaatggcagagttgtgaggcagttattagacttatgacttggagaaactgagcaacttccatacacatctagcaaatgcaattgtctggatttgaacttgtgtccctcggacttctcaatctatgctctttccctgcattgttcagtcagcccctgttctctttaagagggttttctccccagttcccccagctccccactgccctctattctgcctctgtgcctgagaggccttgagagccttgagagcatcactggacagccctggcatacagaccctttcactggggcccggccaataagcaagcttttcttttacacagaaatgtttgtggcagtctccaccaatctcactgtcccactagctccctgtggagtcaggaagggcaaagatccccttcttctgggtgtgatcctactccttggaaatgcttcacgtagaattctatggattccaactgctggtgagtcaatctctgccccccctggattaagaatcaggtagaaggaattgaaaaggagctctgcagccagcaagcatttaaaaggccatagagaaaaatgcaggaccgcttgagaagggcagatagcagagcagctaggagtgcccctgctggagctagagtgtgagggtgtaaatcctggccccagcatgttctatgtgcacttgggcaacctgcccaacctcgctcagcctttcttttcatatcagcaaaataggttgtagtgagcaacagggtaaagcacttagtaatgctcaatggatgctagagaaacaaaaacggagcagaggcaaagattccagaagcctcaggatgaactttcggcatccctagatggagaactttcatatacttagtctcccttgttcacttctccagggactagtccttgcttctcttgtcttgtgtagactaatatacctctgaagttgttcttgcaaccatttcccctaagtagatgagggataacaaacaagcaaaatatgtactgaagttgggtggctgcaagcaatggacttctttgagtggagaaaaaaagggaaggagatgtggggtggggaagaaggagaaattatcataaaattggattccaaagcattcagtatgaacattcccagcaatagcagatgctttttgcctgctttagataagacgtctatgatttagacctctgcgcaaactgagaagctgttggatgttgaaacattaaatctaaacaccgaatgcctgaacccaagcagaagaacaagcccaaacaagcctgcaggccccgctacccatcacatctcaccatgaatcaaaaacgcactacttaggccagctgccactgcagctgctgccaaagcacaaggtgggtgggacctgagcagtgttctaccatcaaggaaagaactggatgagggtcctgcttactcggtgggtgggttccacgtggaagggtttcctgccacacacagggtccagcatgagaaatggcaaaggcggggaacaattcaggggtgcccaagggagagaatacagtcacaggttcttagttgctgtttctggttaggccagtaaagccccttcctcatccctcttttccatttatcactagagacagaaactaaaagccatggcttcaggctgctaaaagcctaaaacaaaataaaaagaacaacaaaataaggcgggttggacgtgccaactaaatgattgtatatactattttactatagctactgcccccaaaggcacctttggatgccatctttggatttctcacgatttttcaatatgtagaacatagtagattctcacacaatatctgcagaatgaaaaaataaaagtgtgcatgcaaaggggtggctgggtcactgtagtccaccccagagaagacgggaaaatgcattttgctaaggcacacagtgatgagaggcatcccacatggtagaaagagaaccagactcggcatccagcctctaaatgagtatgtaccagaatttcccaaggctcttgttaaaaacgcagatcctggtcaggcgtggtggctcatgcctgtaattccagcacttcgggaggcctaggcgggtggatcacctgaggtcaagagtttgagactagcctggccaacatggtgaaaccctgtctctactaaaaatataaaatcggccaggcatggtgacgtgtgcctataatcccagccactagggaggctgaggcaggggaatcacttgaaccctggaggcggagcttgcagtgagccgagatggtaccactggactccagcctgggtaacaagagtgaaattccatctcaaaaaaaaaaaaaaaacacaaatcctaagtcttccctctccaggaactgaaattctggagtggggcccaggaatttgctttcctaacaagctcctgggatgattttgatccaggtggcctgtggttcatattttaaggaacaaccattccaagtctcacttaatggtagccttaccttgagcttcaaagatgaccagcatgctggccacattttcccccaagggggtctctttagcctcttaaatgctaatggataccagcagcctctaagacctatgtgccatgttatgttctggaggagatgacaggcaaacccactcatcaacaaagggcttatttgtaagagaagttcctggtggggccagtggtaagaaagcaggggtagcattatctgaaccatagtccatgccccactaaaatttctgtcacaggaagtaagagccttctgcgtaaaagcatgtgtcccttggagagaacattcctggaaaacatagaggtttttattgcttagttttagaaaggggacagggtcaatccccccattactatgaaatatgggtaaattgagagcgtagtatgctgcaaagcatcataaaaataattttacattgttactggcttgactttaatggtgggtttttaggaggaaaaaaataataagagaaatttttctgagtgctccgacaggagagagaactctcttcagagttaagagacatctgtcgcaaagctgactgatcccaagaggggtgaattcttggaagcccaagtccaagacgcacaaaactctgagttcaggaaacagcccctctctggagaaggagcctcaccaggtgtgtgagagtgaagaaaccaaacacaagactaaggaggaactattaatagcaagcttagctcccaacctaaagccaatgaagtgaaatgcaatctgcaccctgtatctaggccaaggaaccaggaagacaatgctgtgccctcacccgtgctggatgcagtctgtcagcctcaggctcagccctctgcagcaacctgatgccctgccttcttccaaaccaagactgtcttctattttgttctactagtgtttattgagtgcctactgtatactcttggaagtgtgaagaaatgatcctacctgcctagcagtgtgtatacctgtcattccagaccagtttccagtctcatctgagatcataagacacccataaagtcccctgcagaatgttaaagaacaataaatgatgagaaattcacattacaagatctagaagcacaagatacgcataaatgagttgtatcccaaaactttctttttaaattcatagtttaaaggtcagaacccattttccaaagggacagtgctgtaaatagtcaggtgtgtagtctaaacctaacaaattcatagtatagctaaaattatacacatgtgccataaaaacaaggaaaacatttctgctacattattataattacatttaaaataactcaaaaatatttttgagcagttatccttagtgatgacatccttgggaaataatgtttaattagaatttaatgaaagagagatttctgtagaaagtatgaggaaactggactcataaggactttagattcttatctcacattctttaaaaattttttctctttgtaaaaatactacatggttttgtggaaattttggcaaatacattaaaattttaaatacagatataaaaaataaaatttaatatgaaaccaaaaattaaaagctaatatgtatttctgtccaagattttttaattctaaatacatatgcatgtattttttacttgaaaaacaagtcacaaatatttttgtaatctactttttcacctttctattatcaaattatctattttatcatagtcttctcaacatcgtgtattagctttcttcttaatccttgccaaattgctcaattaaaaattatatctcattttaatttttatttattcgatcactgttgaaattggtctttactcttctccaatttaatggccacttgtattttatctatatgtaattataattaattatcttttgcattttttacctacttttctgctggactgcttatagttttcttgagctgaaaagattgtgaatatataataatacctccttggttatttacatattgtaaatattttcatggtttgtcatttaatttttatctggttcatggtgttaacatacagaaattttaagctttatacagtcaaatctatccagtttttcccttttagtttctccctatgtttttaaatattgaaactattttcccgggtgatccaagttcatttgcgcttatatgatgaaaaggtcaaatctatatagatagaaatacatcgacaggccttgcctctacccctactgtctgcacctcatttgtccccatcacctgtagggaaccaattttatttgtgtctcactgatccttctagcacatctttttgcaaactttaaaacaattatctaattgatctttctggaataggtacatggtattgcattttgaaaaggttgttttttccattaaattttgtaattgtttacagttgatatcaaagaaaactgttgatttctgaacctttattttgcctacattcatcttgttgatctagtaattttttagttgattgtctcgggtttttagatggacaattatatcatttttatgattcatattgataattttgtcttctacctccaaatagtatgttgttattatagttcttattttattccatctaaataagccatgattttactttgtgatggctttataattagcactatttatggtttttaatcataattgttatctatcttttctagttcttaaagggcatggccgtgccacatctggagttgctgttatcatttatgttagataggatgggctaaactgtgttgcttttagtaaaacaagcctaaaatctcaagagcttgggacagcgaaaacttatttattacttaagctacaagttgatcatgggtcatggtcaggtcaggtcatctagatccaggcccattccaccagagcttatacaaccaaaggctgtcatttcggccgggtgtggtggctcacgcctgtaatcccaccactctgggaggccaaggcggttggatcatgaggtcaggagatcgagaccatcctggctaacacagtgaaaccccgtctctactaaaaatacaaaaaaaaattagtcgggcgtggtagcgggcacctgtagtcccagctacttgggaggctgaggcaggagaatggcgtgaacctgggaggcggagcttgcagtgagccgagatcaagccactgcactccagcctgggcgacagagggagactccttctaaagaaaaaaaaaaaagaagaagaaagaaaaaggctgtcatttactgtgactgaagctagaggaaggaaagctggaaaattttgcactgtcttttacaggtttctgtccagaagtgacacacatcatctccaatcacattttactggccaaatcaagtcacttagccatgttccaaaagggcatagaaattcattcctaccatttgcctaaaagaacagcttggaaatatgggtggacagagctaataagttaccatatcactctaaagcacacacatttgtatacacaccacaaatgcacagaagagattccttcactattggcgataggttttcaatatgtcctagatttttggaggagacagagtgatctaaactagttgcacagattaactagatgattgttaaatgaactctaatccaataatactcaccttttataaagattagagtcaactcaaagataaaaattttttaaaagcatgagttaagagcttttacttaattcttctcttccccttggaaagcataaattaactaaagtttactatgattactagtggctgaattccatatttaaatttataatcatgtacagcatagctaataatttaattataagtgtaaacaattcccaagacgccaatagttcattgtcaaatcttacctgcttcacaaaatttgggtaatctatggtctagaaaagacactgccttttataacattgaataataacaaaatggccatatattcaataaatactaagtaattactaaataattcagcctggtaaaccatttttaattgtgtcaaaagccaaaggtatcattcaatctttcctcatttgagatgtattgcatttcttatatgtgatggttaattttaggtataaacctgactggattaatggatactcaggtgcttggtaaaataatatttctgagtatgtctgtgagggtgtttctgagagattagcatttgaatcagaggactgagtgaggaagattgccctcaccaagaagggtgagcatcatccaatccatcaagggccaaagtagaataaaaaggcagagaaagggcgaatttgccctcctggatctgggacatccaccttctcctgcccgcagacatcagaactccaggttctggggctttaggactcagggatttacaccagtgcctcccaccccccagattctcaagccgttaacctcggactgagaattataccatcatctcccccagttttcaggcctttagactcagactgaattatacctttagcttccctggttctccagcttccacctggaatatcatgagacttcccagcctccagaataacatgagtcaaagctcatgtaccccgctcttagagagaaagagaaattctattggttctgcttctctggagaaccctgtctaatacaatatacaaggcaactctttactgtgaggaaaatggagtcattcaatcctcaccatcccaaacagaacaggctcttccaccacagcctctatcaggcccttgtcggcaggcctggggcatgaaatcacataaagtggactctggatggagaaggcattcaggaaccagtgcaccggtctgcagtgtgcaataacctcactcatgtgcccctatacctccattttctacctctctctaataagaacatgagggattgcttttaatacacagattagcatttgggccattcatataaacatacaacaatcctgtcaacagtattatagttggtgtcctatagttgtgcctcctctaacctgtgaattagcaatagatcatcctatccagaggcttggtctgtgtgcttcttctaaaggtatcaaaataaagaagttgtttcttcttttctctgctccataatcaatatacaacacaaagcttcattcatgcatagtttgagctaggtcatagcatgaccatgtcctagaacttactttctgccttccgatatccatagtaaatagccaaaatatgtactcaatacatccatttttaaaactagtcaatttaagataagaaatatcacaaatgggtttttggcattataagataaaaagatcaattgattgaaagtctcgttccttaagattgaatttaattggtttgattgacatcatttatccacagtccataaaccaaagttatccatcatcattgatgaacggcatttgaaaactatcatcaaattagttgcttagaaatgccaagatgccaccttagacaaggaaggcctctggcaaaatatattcatgtgctgcctaatgacttttgtccaccatggactgcatatatgacagtagactcataagattataatactgtattttattgtatctcctctaagattagatatgtttagctacacaaatacttaccattgtgttacaatttcctacaatattcagtacagtaacatgctgtacttgtttgtagctcaggaacaataggctataccatatagcctaggcatgtaatagcctataccatccaggtgtgtgtaagttcactctatgatgttcacacaaagatgaaatcgcctaaggaaggacacaactctcagaacgtatctggactgtaggagaacaacaatctgattatcagatcttcaaaacgtgggcagccttacaagattcagagtttaactgataagcatgtaatttgcaatttcctaaccctggaatttgtcaagataatgttataatagtcccttatagaactaatagactcttccaataagtagatgctgctttgtgaattcagtcctatcgtgagacttctgaattgggatcttggaatctcattagcctcagaatcctaaatttataataaagatgcatagaggcatagtgagtagcatttggaagatgctcttaattctcagttctccagtttgtcttaatctttttatataaactcctctaatcctcaacctggcttctgcctgtgcaaaagtcaatatatgagttagttactactccccagtgaaagacgataacattttaggagtgatactttatgtatatttagcatttgtcatccctaaacttcagttatagaaattctcgcatgaatccccaaaatatgtcagtgaactaacagtctgtaaacatacaatcatggcatttaatatcgtattagctacacagaaaaataaggtattttatagcacatgctcaagagatttcactattgacattaaaatctccaatggaaatactccttggaattgaggatatattgcagtagtggtaaaaaatattaatatttgttgagaactcaccatagccctggcattctgctaaatattggatatccttttctcatttaaacctcactgctatcctaggaagtagaaactattattacccctattttaccagaagcaaattgaatcaagagagtaactgttttacccaaaatcatcagcaggaatgttgccaaacaatggcctcactgcctaaggtacacagaagtcagtactatggcaccagcttttgagaaaagaaagggctttattgcaagtcaactgccaaggagacaggagccaacactcaaatctgtcttcctgaacaagggtttgagagcaggttttccaggcaaacagcaacaatgcaagggacaggaaaatgaaacaaggcatgatctgattggatcatgcaaagaagtcacgccaggtctttggttaagtccatacggcagcaaaacagggcaccccttgcttcttaatttggcccttgctccttgatccaagcacttgggttccacacatcattgacttttttattccagctggctccagggtcctgaatcaggtacccttagttcatttgggcatgctcaggtaatgtgaccagcaacctgggggtcccttgcactgaaaaactcatcattttgttactgacaacgttgaattggttctgccattacagaatgacaaattaacaggaactgcagtgatctacatgaggtgttggtatcttgggctaggtcataacaatggaaatagaaatgagtggatctggggtcactttgcaggcaacagcagctgctgatagactgagtgtagcaggtggagaagcagcagcaatcggggtggctgctaggattctgcttgagtagttgccctgatggcatttatgtatatgagagagaagtaggttgatgcgtgttcccaagaggagaataaaacacattgtagtcatgatctacaaattaaacatacaattatacacacagacacatgtatctatacatatttaaaacatgatcctagagaaggatgttttttctcttgctgtttttcatactgtcctatcatgggagacccacaattaggactctgaagacagctgtttgcttggggttttgctaatgcttcggtgtatcaaagtaaggcacacactcctgaggagaaatctggcatggaaacatccttaaatgccaccctacccctcatggtttatataagccttagctacagcattgtctagaaatggctattctttgtcttttctttggaacacatttctcacttcaaatgcaactaccctttgccagcccaggattttcccaatactgaacgggtgcccatcttcaaggacaattccaaatgtgtgcccctgcctttggaacaatgaagagggtttcgctcattgtttttcttgtcttatctgcatccagaaatttctggcttgtgccattttaattttatatacttttactttatttcatttgaattttagaaaataatgagtatttaagagaataagtgtttgaatttaaacaactaggagtaggattactgcatgtagagcctgggattgccatttgaagtcattaaccagcctgagaccaacctttccagcatgcctgcagggatgtcttcccgggttctgatacatcgcacattgtgtgactcccaagcaagctcttggccactcaaagaaaaaccactgaatcaaaggagatggcatatgagtcatttcatcaattacttatttcacatagatttaaaactatgtcttgctgagctcaacttgactgcatgtttgaatagtgaaagacattgtgtgaaaaagaaaaggggcaaatctaatcacaggcacaaatacccttctagaaccacattttagataagagtgtcccgcagaggccgggtgcggtggcttacgcctgtaatcccagcactttgggaggccaaggcagccggatcacgaggtcaggagatcgagaccatcctggctaacatggtgaaaccccgtctctactaaaaaatacaaaaaattagcagggtgtggtggcgggcgcctgtagtcccagctactagggaggctaaggcaggagaatggagtgaacccaggaggttgcagtgagctgagatcgcgccactgcactccagcctgggtgacagagtgagactccgtctcaaaaaataaataaataaataaataagagtgtcccgcagaacaacagttccttgggatattaacaggtattctctcttttttttgcaaattttatttcttttaaaaaattattgtaggcacatagtaggtgtatatatttatggagtacatgagatgttttgaaacaggcatgcaatgtaaaataagcataccatggcaactgggttatccgtcccctcaagcgtttatccgttgagtgcaaacaattcagttacactccatacattattttaaaatgtacagttaagttattgactatattcacccgttgtcttattcattctttctattttgtgtacccattaaccatttccacccattcccagccccccacttaacagcgtactccaaaaggggaaaaatgatctgtggtcacgtgagtaatgctaggttaagtaaatttgaacaggtttctttactatagacttctctagatctttttgttgttgatgcttttttgttttgttttgttttgttttgtttgagatggagtcttgctctgttacccaggctggagtgcagtggtgcaatctcagctcactgcaacctccacctcccaggttcaagtgattctcctgcctcagcctctcaagtagtagttgagattacaggtccgcaccatcatgcctggctaatttttgtatttttagtagagatggggtttcaccatgttggccaagctgttctcaaactcctcaggtgatccacctgcctcagcctcccaaagtgctaggattacaggcatgagctaccgcgcccggccgacttctccagatctttaatgtgatgctaataggttctgtatctccaagaaaggagagagggcatttaactgtttcccaaacttatttaatcacagaaagctatttttgagaatgttttgtggcacatattttgagaatctcaattccaaaggaaagaaaaacataaataagggcttaattgaaaggacaacctcatttaaaagttgacatagaggccattatttgggtcacagaaaactaaggcctgagatttgtcatggagttcatgtccccatttggtcactaagatagagacttgtcattgtaatggctgctcagcactggtgaacacccgccatgaactgacccaaaccagtgtggccacacatgaggcgaggcatgcccgttatcacactaccaaatacggaaaccaagtcttaaaccaattttttgctccatatacagacatttactttacaattgcttattaacaattcatacaacacgtttggttagctcaaagaagtcccattttctgtccttttaggggctctcagcaccaccttgactgaaacattttctcaaggcagacatggcaacatgcccgaggcaggattctggaaggttcctaggccatgccgggcaacttggaattctccaactaagtgggtggacactgggccagttagcgatcaagtctcaggcactatccctaagaaaaaggctgcagtctttgctggagccttataccctcttcattaaaaacaggaagggctctaatattttagccaatcgaggtagcagtattagtttgtgagggaccacaggctggtaacaatagaaatttattttcccagagtgctggaggctggaatgctaagatccaggtgttggcaggcttggtttctcctgaggtctctccccttgttttgcagatggtcatcttctcactgagtcctcacatggccttttctctgtacatgcacatccctggtgtccctgagtgtccaaatcccctcatcttataaggacttcagtcagattggattagggccacaataatggcctcattttaatgtaatcacctcttcaaaaatcctatctttaaatatagtcacattctgaggtactggcgcttagggcttaaacatatgaattggtagcagggacacaattcagcccataccagtatcctaaatattgttttttttattataatgatatcccatatctaatgttcattttgctaattaatgtcactagtttccacagtgaaaactcctttcggatattcactatgctaattagcaaagtctcatacacttctcttcttttttaatataatttcaacttttcttttagatgtgggggttcacgtgcaggtttgttacctgggtatattgtgtgacgctgaggtttgaggtatgaatgaatccatcactgagatagggagcatagtacccaataggtcgtttttcagtcccttactcccctccttctcttcccccgctagtagtacccagtgcctattgttgccatctctatgtccatgtgtaccaaatatttagcccccacttataagtgagaatatgtggtatatggttttctgttcctgcattaattcactcagaatatcagcctccagctgcattcatgttgctgcaaaggacatgattttgttccttttcatggttgcatagtattctatggtatatgtgtaccacattttctttatccaatccaccattgatgggcacctagattggttccatgtctttgctattgtctcactcacttccttacatcactagctccataatcagtcaggtgcaagggcatctgattgactgagcctaatagcaagggaggctggtgaagtatgtttttggcttttatcctgggaggaaaggactcatataattgggctcttttttgcagtatctgtatttctttgcatatttcagcatagacaatgtgatatcatctgtatgccagcttcaatgctaagggcagccaattaccttaatagagaatgtacactggagggttgcttacgtagcaacactcaggagacttcaacaaatgctccgtttatacctataaactgagtagtgtcctcataggatcagcgttggatggggtttggccaaatgtcattatttcaactggttctctgtcttttggagattctgtgttacctcacagataattcttgtaataaatcccttttctgcttaaactagccagaattcatctttgcagccaagacacctgatacagttaccaatccttagattttcagaaagcatatgcaagatatgttatggtatagtgatctcctctctcataaaaccagggaatcacaggttgaccagctgacctgcctaatttagacatctctatacctatagcagggagaattagagagtcatatcatgttggaactagaagggactgtagcaatcatctaacacagatgaagaaatagtcctagagagaaaagattgctccaggccacatccatttttatccctacccccaaaaggatgttttaaaataacccctgtaacaatcctcagcctggagagaacaattttccatttctgtttaaacccatatcccaaggtggcggagacaacatcaggaaaaagctgcacagccaggtcttcattaaagacacgctggagcccaggtgggcttgcagagtgacctatcccccagactcggcagtgagtcactacagggtcagttcagcatgtttttctctgtttcagactacagttcagctaggctttaggtcggcatctttttaggttgctagggaggcctctctggtaggggtatggagaggaaaacaagatctcccagcctaaccagaccaggctagacaggagagaggcgctgctgtttggttgtgggtgtcatccagggtaattcacttttctgtgtttgccacccagtcatatctatggttgtaggtttgttgttgttattgttgttttcctttgagttttttttgtgtgttaaaacctaaactgttcaaagaaaatgcatgctgttctcatccctcaaccaagcatgttttctcaattagacgcattttcacagagaattagtcttaaaacccctgtgagcttaaaaatagattaagaactatttcttaagctccctttctttggaatttaaagtgtttttgagtggagtttttttggggggtggaggagaggaagtttagcgtaattaagtagatcaagaaaaaaaagaaaatcatttaactatttcttatatgatcctcaggctttgaggttcactcatgtaaataaagctcatcatggatattaattcattcattcctatactccttcattcacaacagactgtgtatctatcaggttcaaggcactgtgctaaaagaaatatacaggaagaagcccggagcatttaaaagcaggatgttgacaaacacacacattgaagatactatgatttgagcttctgacatctggactaattaaagctgaggaaattggcatctatttggcaaaatggccaacaaagaagacaccaggcagaacaacccacagaaaatttcatcagccaggaaattagaattcactctccccatccaaagagaaagttaattactggctttggtggattgcattcctggctctgcactattatcttaacacagaaggcaagagaaggcaagaaggggctgaaagagccatccttccaaaatatacttgggagaattaaaacaccgatgttcttctctggggcccttgtgactggtcagatcctcttgcccagatcataagagggcttagtggaaacaaaaatggtggttgtgaatgtgaacactattaaatggtctttcttctgtatccaaaggtctaagcctttctgaatggagtctttcaagactcagctcagacactaccttttcaaggaaaccttttgtgacctctctgccctcaaccccacacacacaaccatgccagctagaccatagatcttccttagcatttccacacatctgcattacccctcatggcccagcctcattatcagcatccctcatgaggctggtggacacttggggtgtctctggcacattgtaaacccttcataaatgatttctgaaggactgtaatacatagtttatacaattttcagcatacgaatttaagggaaagcataaaagaaaaatacccatggtgtacatttaaataataataatacataaaggaaatttcacatatttaaacagacaaagactgacttatactagaagagaaataatgacctatcccacagggtatatgtaacaccatacgttttccaaactgctaaaagagaggtagtttgcctaaagttaactcccaactctactcacttaaaggtggagggtccatttattcttaacagtgaggagcatttcagaatagaatgttctcacacacacacacactgaaggcacataatttgagctactgaaaccttgaactcgttaaagcttagttgttggaatgcatactcctaactttgcaagattattacacttagagaacatctgagattgcagttaaataaaacttaggtttgtctgaaaaattaattagtgtacataattattctgccacataaagcaaggtatcagatgtaagcaattcatgtatgttattttaataattagcaccactaagttatgttccttttccacctctggcttaatttattctctaatatgtgtacaagtgtctggtctactgtgttccccacaccattaatgccaaccacacacacgtaagcacaggcagcaaaagattaaaatcctgcgcaccctgtttcgcctgcctcttcacactcctgcctctactatggccccgggtggtgctccccagtactcccaagctctctgcctcctcattctctctcttttcccctacttccaggggaggattcacatcggatgggactgaaacgtatacaatttagggtttcttattttcaaaaaataatattaaattattaattctactgggtgcggtggctcacgcctgtaatcccagcactttgggaggccgaggcaggcggatcataaggtcggaagttctagatcagcctgaccaacatggtgaaaccctgtctctactaaaaatacaaaaaattagccaagtatggtggcacacacctgtaatcccagctactcaggcaggagaattccttgaacccgggaggcggaggttatagtgagctgagattgcaccactgcactccagcctgggagacaaagcgagactccatctcaaaaaaaattgttttaaaattaggtagaaataaatatttatttaaaaagagaagtttcatcaaactaaaacacaaagtaacaaatatcacaaaatctaagggaaaaaaatctcaaaataaatgtattagatagttctttgtgtagcactggtccacggactgccttctgactatgccatgtatatttcaaaccttgtctctcctgtatgacccacatgcatccaggggaagccactgtaggttgacatgaccatcatgataagacctctagcactacatcttcaggtcaggacagcaggtgggcgataggaagatgaatggaagccattccaacacaaggagggctagccgttacctcacacagtgactgcaaaccacacagatatatcttcacaacctgtcccctgagccagatccaaaaattgcctgtagtcactctaactctctaacagagaagtgtgactgaggcaagttaaaatggaaaagtcagaggatgtaagcagttgtagctaacatgtcttacttgtgcaaatgttgccaaacatgaccacatgaacgcatcactagggcctctctagggcctgggaaggaacccaggcatgtgagggaccctgacacctaagcctctacagcttcttggtaatcccacctctgccttcctcccacacatcttcccatggattccagtccccaagcttctgggtccagcaaggcaatgaggctcaaggcactgagcgccatgccttagggcaggatggacaaactggcaaaggaaacaggaagagtaaatcacacagatgccctctgccttcaagtcttgggacaaagagggatggagggagggattagagttctgagcaaagacaggactttgaactcaagcaagtggacactagctcattgaataaccatgagctaagtgcttcacacggattactgctttcatcctcactaccaccctaaggaaaaggagagagggaaggagaagagaaagaaaaagaggaaggagaaaggtaagagaaaggatgatgatgaaaaggaggaggaagaaggagaacatggagaagaagaatgtaaaaaagaagaaggaagacagaaagaagaggggtaggaggaggggaataagaagggggaggaagagacacagaggaagaagagaaagaagagaaagagatcaagtgaaagagaaaaagggaaggggagggaaaagagcaaagaagaaaacgtaagctgatagagagagataaaagaaaaaagagaaagtttactcgtgaactcctcttccctaggaagcagcagtgtttatctttgctgtcataataaaattaaaagctttttttcagactatacactcatcctcttaaattagaaagagtgacaatttcttttggctcagttctgcaaaatgcaagttgtcatgatctcacctcttaaaaaaaggaaaaagggaaaaaagcaacctcccaagagatggctatcacttcaagcgaatgcccagcgggccagccatttggttgctgtccatgttttccagtggcatgtgagcctttcacccagaccacaatcccatgccaagctccatgtcatgttcaatcttcaaaatcttttgtacaattccaacactttccagcaagagttgattttctttatgtttgcttgtcttttaactgactgacactcataattttcttccaaggaaaaaagaatagcagaaaacttgaaaatatcacctaatctgtactgcacatgttaagactgttcagaaaagttgaaaaattataattcgcaaatgggtggcttgaagtaccagttgaacctcagaaaaattaaattctttaggaggaatgcctttaattagaatcagaagtagactctgtcatggaagtcctggaaactccattatttcacagatttgcagactcatagactttcttatttattgtcagaaacttctggaagtctctcaatgaatctccaagttactgggtgagaccacacctagcccaggattccagatgaactgcctagtccatattattggtgaagacacccaggaaatatttcacaacctatctcagtaacattccaatgtgttacaatcctcgcttttaggaaatccttcattatttccaaagatactgctactgctctacatcctttgtgaaaataacaagatcaaaacctttataatctcaaaaaaaaaaaaaaaaaaaaaaacaggaaaagaattaaggaacattctctcttcttttttttttttttttttttttttggaaatggagtcccatcctgtagcccgggccagagtgcaatggcgtgagctcagctctctgcagcctccgccttccgggttcaagcgattctcatactcagcctcatgagtagctgggattacaggcacccgccaccatgcctggctagtttttgtatttttagcagagacagggtttcaccatgttggccagcctagtctcaaactcctgacttcaagtgatccacctgccttggccttccaaagtgctgggattacaggtgtgagccactgcgcccagcccacattctcttcttctgcaaactaacatgtctatacctttttcagtcctttaatgacctgtgtggaccctgtacataacaacgtgctctgtgggcccctccgttgtgggtcgaacaattaaacacctcactctggttggtgccagccagatgagttgatgaaacctgagaggccagattgcttccagttctgtaaaacctgtttgagaattaaaagagatgctccatcatgtcctaggctgagtaaatatgaaggaacagtgtaattctatggcaactgacaatcccaacagtaagccaacacagcaccacccccaggagcaacagcaagtgtttgagtgggttcaaaagagagttggggaactagggggattggggctgcacgtgacgaggagaaagggtgtgggataacatgggttggccttggttgataggctatgtccagtctctgctgcctctgtctctccttcctcctccttacctcactcttgagccccccacctttctctgtctccctatctgaaacacataccctgctcttaattgggaaactagtaaacatttctgctgattttaatcctgaaacatcattgagaccatatgaaatgagtcttaaggatcagaaccatatgaagggaaggactgtgggctggcagccggcgcacctgtgctgtcttctggacttccaccaccaacagtctccaggacctgtttcaagttgcttcacctctttgaaccgacttcatctattaactgagtggttgaactagatggctctttctggcttaaaaattctgtgatttcatttctggaggaatttcaagcatgggtagagagagaagaaactgagaggcaagaggtatggtttggactcatcaaattaaatcacaggtgactttccagtccccccaccaccccgatctgtaaggctgcctttgggtgcgtggccttcctgcaaaatggcaaacacttgaaaaagcttccacgctgaaacccaaaccagaccatatttaggatgccccataaggtggcattttttactaagatgataaaggataaacattggtggagccagagaggctgctcccaaatacagtcctccccatcagcaacactgcagtagcctgcacctatcgtccagagtatgaaaaagacttttgccaaagacggcttttggggatttatcattattacatgttaagagcctgttctccatgtcctcaccttcctaccttgctaatcttccccatttccatctttcggcccagtgtgagacctcaccatctccttttcccatcttctttcctccatacccttggtttcctagcaggtcaatgcccctgccccttcactggaatccatccatcctggttattcttttctttatgaacctgctggactacatctcaaagttacccaaaagagggatacaaagacacaataaaatcggaaataacgctcacccttaccagcctgcagttaagagtgtgtggaactagggtggctgcaggcaaagagatagggggaagggctgcctcatgccatgggcaggacagtaaatggtgcaaattttctggaaagcatcttagtaatataggtgaagagcctttacaatgtgtttatcctatgacctatccttacttctcttattctaaaggaataagaagaggtttaatcaaagcatgagtgaaaaggccatccaaacacagggaaaggggccgttatgatgtctacggttctaagaaatagaaaacaacaacttggcttaaataataagcacataaccaaagaaatctagaagtaggattcccttaagagttgagagatttagcagctcaaaaatgtgacctgacatacgagttctttctatgcttttgttcttcctcctccaacactggtttcacactaaacttggctccccagtggccaatagcaccaaacagcacttatcggcattcttgttggtatccaaaagagatggagaaagcctgatttcacatggctcttccttaaaagcaacaaaggacttttcccggaagccttcagcaaacctcgtcagatttgaatcacatgccaattcctaaatcagtcactggcagggaagtgggaaaaaggggaggaggtgtttacccttaaccaatatgcctacccctgcccactgagatcaattccataaaagtattgcttcagttctttgaagaggagtacaatgtttgtgagtcactcaccacatttacccaccaagagctaagggataactgagtaaaatggtagagctggtaggaaaatggtgagtagtcccgtccttctgtgccataattgacttgtacacaaagagatttggaaatttaaacataagaactctctcttcccaagcccagggctttgggcacttcaagtctggtccttgcctgggcacagtggctcacgcctgtaatctcagcaatttgggaagccaaggagggtggatcacctgaggtgatgagtttgagaccagcctggccaacatggcgaaaccccaactctactaaaaaatacaaaaattagttggatgtagtggcacacgcctggaatcccagctactcaggaggctgaggcaggaaaatcgcttgaatctgggaggcaaaagttgcagtgagctgagattgtaccactgcactccagcctgggagacagagcaagactccatcccaccccccaccaaaaaaaaattctggtctttacatgtgaaaaaataaaagctaatttttaaaaactaaataataaagagtgttaggtgataagttttatgatagagataatgtgtgctttaaaacacacagcataaaacagatggaaaacacctcatggagaagggagagcttgaattggtgtttgattgaaggacaagaaaaatctgttggtaacttcctcctggctctgacctctgatgcagttaaagtaaagcaacttagaattatgatctagggaacatattcagagagaaatgaatttatgatgtcttcaatttgaagatgctatgattttagactattctagaatacaatgatttttcattgcttcacacttgtaagaaatgttccactactgaaaatttgcaacacttaaaaaattcctacacaaaatcacagcccaccttgctgttctatgctaaataaacaaaatattttttctcaattatgttgctctccttaattacacgcaattttaaaactagctgtaactgacagccctttcctcacacttactgccaatgtatttaggtcaatcccacctccaattagagaaacttagaaaaaggaaatcctacggtgaaatgccatatgccttacaattttcagtaactaatcctcaaggatgacaacttggcaaaaaagagaactggaccagctccctgaaaggtccatcacttcggcccatgttaattgattgccttaaaatcacagtgcttccaggttgtagagacacactcaaaatggactattgccctcacattaaaggggataggttttcttttcccttttcccatccctgcttctctcaaagctgcacagaggtatatgaggtttggggaatatttgcagcacatgttggctggcaagaatgtgggtgaattcctgttaaggggcgcagacactccctcttctatgacctttcctttccacccagaacaactgaagtatcatgataagaggaagggctttgtgtttgagataagcagctcctatacctgtcagctttctctaataagaaagctctttcctgccaccgtataggtcaccttcttattggtaaagcatgatgaagtttggaaactgttgtccttgttttgttgaaagaagccaagttccaagaaatctgcagaggcattcctacaatccctcagccatggcagcatgaatcctgaaggggcagtgagtgctggtttctactctgtctgcacagctaagcctaggggagataatcttttcatacaagatgcattctgcttttgtgggcctcttgcagccctcaagcccccatctgatttgtacacaatgatccagtgggccagaggagcccagagccatgagcggcccatccctccaagaactatttctgactgtccagtatcatggagcaagtggaaagaagaaaaaaaaaacccaattacttttcgaagagcaagatgaatgctgtagaaggagaaggaaggggagggagatggatgggtgccgattccagaatcttcagatctgcttggatgaatcattacctatgatttgcgggacaagaatctgattttattcatcaaccagtagaaacttttctttctgcctcccaacatctgaaatccaacaaacatgtgccttaggaacataccggtcatcttttagaggcattttatatacatattgagtaactagaaaacactctttccgtaatacacacacacacacacacacacacacaccatcttgtcatacaacactcccacgcaagaaaagcgaaactgctgtttgatgaatgtaaacacttggctgtttgcagcagtcgggagtcctgccaggtttaagtgctaagatgggaggtgaaccccaggggtttccccctgcccgtgctgagatccttatttggtcaagcttctacctatgccctggcctcggagcgagcccgatagcgctggatcacagcagagggagcgaggcggctgacgtcccatcccgaagagatgaatggaattccaggaagctagagtcatgctggcttgggacagtggcttggagaccagacttcaatgacagaagcactaggcagcggcactcatggcaatgtgtgcacccacagaaatgtaacccacacctcgggttcaggagccgaaaaatgaaaagaacgtttagggaggaaaaagggaaatacaataataggcagagagtaatttattactctatgggtctgctctgtaaatagctgaagactctggagccagatggttctgcaaattctccaaacaggagtcacgttaagaagcacgagtgggcacaaaaactgtttttcaagacacaatttcaatttggcttgtggaaactggatacgagtaagtttccttaaaattcgagtagaaagcagctgtcctccccgggcccct

SEQ ID NO: 361 - DNA, 286356 bp, Homo sapiens
tggtgtggttcattctggaaaaggctctgcagaggcacgagattttctggcaagaagcagattgctgctttagatggctgtgtcctggcaggaccaccttaatgacttgtctcagcacatttagggtgtcaaaaatagcccttaaatctgggccccttcatagctcagaagaacctgggcataatgtagaaattattctctagtgagaacaagatctacagggtggaaaaatagaaaccttaaaagttaggaaataacaagaacagaaaaacagtataccttgtagattatttttaaatgaccaaattgaagaccatgggatttttttttttaaacaaacaagctaggagacagtggttagttttgacattgatgtagttgtagggaactctagtttgtggtcagcccaaggtactttccatgcacatgaatcaccacatgcacttaacttgagcagagctcaatttcagattctttaaaccaaagtgaaaagccccaagttaggttaactggcaggcacatactgtagacagcccagatctgggaattttaaaaaaagtgtgtggaaacaaacatattttggtggtttttgacataattattgtctctttctcacagtgatttgcataatgttgcagaggtgttgcctggcaagctccagttaaagttgcagattttgtgtgcacctgtttgcaggctagatagagaacagtcatatgcaagtaaaatcttggtaccctccattgctcgatttacttttttgagcaggcttattgctgtataaataacctacaaaaattccacatatttgaagtgtagatatgtttttgcatatgtatatatccatgaaaccatcataacaatcaatatagtaaatatttctatcactcccaaaagttgcttcatgtaatttataatttccctcccaagcctctcttcctcactactagtttgttttatatcaccaaagattttcattttctatagttttattaaaatggaataaagagtatatggtcttttttgactggtttgttttacttaatataattatttttgagatttatgcatgttgtgattatccattactattattttcttttttttcttttttactgagtaatagtccattgtatggatatatcacaatttgtttatccattcatctgttgatgaacttttgagttgtctccagtttggggctatttaccaataaatgtaccatgaacattggtgtacaaatctctgtatggatatctgctttcttttctggtagaactgagaggctgggacatgtggtaggtgcatgtttaacttttcacgaaactttaatctgttttccaaagtggtagtttgattttacattaccaatagcattgtatgagaatttcatttcctccatatcctcaccccatatggtcagtcttcttaattttagcaattctaaaatacatgtagtggtatcacatggtggttttaatttgaacttccctaatgatgctgacatcttctcatgtgcttattaccatccatatatcttctttggggaaatgtctgttgaaatcctttgcctattttatttttaatggggctattttcttattattgagttttaagaattcttcatatattctggatataagtgcattatcagatgtgtattcttggcaaacattttctcccaatctgtggcttattttttcaatctcttcagagtatctttcaaagaatgaaaattttaaattttgataaagtctaatttatcaatttattttttatggactgtgtgtttggtgtcatacctaaaaactctgcctaacccaaggtcatgaagattttcttttatgttttcttctaaaggtttatagttttagattttacattgagatctgcaatccatttgaatcacttctttttatataatgcacgtttgcatccaagttcattgtttttgtctgtttctgcatacaggaatctaactcttccagtactgtttgttgaaaaggctatcctttcttcattgaattgcttttgcaatattgtccaaaatcagttgtccatatttttgagtgtgtctatttctggactttctatttggttcattgatcttttcctctatcttgctgctagtactagaatattttgatcacttgtagctttataataaatcttgaaagcagatagttttagaacttcatcttttctcttttttaaagttatattggctcttttggttttgttcgcacttccatatgaatttcaaatctgcttttcaatttctacaaaaagcctgctagaaatttgattagcactgcattgggaagagttctcattttagcaatactgagacttctgacctttaaacaaagtatatctctccgattatttaggtcttctttaatttatttcagcaatgttttgtagtttttagtgtacaggtcttacacttattttgtcagatttacccataagtatttctttctttttttttgagacagagtctcagtttgttccccaggctggagtacagtggttcaatctcagctccctgcaacctctgcatcccaggttcaagtgattgttgtgtctcagcctcccaagtagctgggattataggtacaggccaccatgcccagctaattttttgtatttttagtagagacaaggttttgccctgttgctcaggatggtcttgaactcctggcctcaaaggtatccacccgcctcagccttccaaagcaatgggagtacaggcaagagccataacgcctggccagtatttcatatttttgatgccattctaagcaattgaattttaacatctgacagttcactactagtacatagaaatacagtgatattttacattttttctgtgttctgacatgttgctgatgtggtttggctctgtgtccccacccaaatctcatcttgtagctcccataattcccatgtggtatgggaggggccttgtgggagacaattgaatcatgggggtgggtctttcccatgctgttctcctgacagtgaatgggtgtcatgagatctggtggttttaaaaacaggagtttccctgcacaagctctctctttgcctgttgccatccacataagatgtgacttgcccctccttgcctgccgccatgattgtgaggcctccccagacatgtggaactataggtccaataaacctttcttttgtaaattgtccagtctcaggtatgtctttatcagcagcatgaaaacgaactaacacagttgctaaacttacttttaaattctagtatgtaaagtgtacattcctgaggattttatatatacataattgtgccaactatgaatctttccagtctatgccatttatttatttttctttatctgttttgctggctaatatttccagcactgttaaatagagtggtgagagcagacacttttccctgattcttgaatttagagtaagaaaactccatcttttatcatgaaatatgatattagctgtaggtttttcatagctacccttcaattgttcaattggttgagaaaatgcttttctattcctagttttctaatagtttttaatcaggaatgggtgttgggtttttttcagattttttttctacatctatttagatgatcatattgcttttattttgtagttaatagtgatttacattgattgggttttgaacatcaaaacccaatcaatgtattcccgggataaacccttcttgttcaccatgttttatcctttttacatattgttggattagatttgctaaatttctttagaaatgttgcatttatgttcatgagagttagttattcatctatagttttctttgtttcactttaaaatcagagcaataataggctcataaaataatttggaattattctcatctcttcaattttcagaaaacgtttgtaaggattgttatttttccttctcttaatgtttggtagagttcactagtgaagccatgtcaaccgggaattttcttcatgcatacattttaaactaaacattcaatttattccgtaaatagaggattgtctgggttctttctttctttttgagtgggctctggtagattgtgccttgccaggaatttatccattttatctaagttttaaaatttataggcataaaagtttacaatacttccttattatccttttaatatctgtagaatctgagtgatcccacctttataaatcctaatattgatgaatttgtgtcttaagtaattttttaaatcaatacacctagaggtttttaaattttattgatctattcaaagaactagcttttggttttattgattttttctatttttttctgtctgctattttattgatttttcattctgatctttattatttcccttttaatgcttactttggcttaatttgctcttcttttctaatttttaaagtggaagatgaggtcattggcttgagatgttttcttttttctaaagtagaaatccagtgctgtatatttccttctacatattgctgaagtggcattccactattgttgatatattgtgttctcatttgattatttttcaagatattttctaattttccttttgatttcttattttacccctggttattgacaaacacattactttgtttccaaacctttgggaattttccagatagatttctgctaaagaattctattttaattacagattgctccgaaaacatactttgtttgacttgaatccttttaaatgtattatgcattgtttatggctcagaatatagaatatatcttgaaaaatgtttcacgtgcccttgtaaacaatgtgtattctgctatttctgcatgacgtgttctataaatgccaagtaggtatattttattagtagtgttgttcaagtcatctatatccttggtgatctttttctttactcattctatcaattattgagagagaggtattaaaatatctaatttatatctgtatttgttaatttctccttatagttttattgatttctgttttatgtactttggagctctgttattaggtgcataaacatttaggattattatggtctcttgacaagttgatccctttaacatttttaaatgttcttctttatgcttgataatattctttgcttgaaatccacttttatattaatatagccactctagattctttgttagtctttacattgtatctttttcccatcctttttctttaacatagttatgtctttacatttaaagtgcctttttgtgttggtaaaaagcacatagttggattagcattttaaaaaatctaatttgacaaattgccttttactggtgttgtttaggccatttacatttaatgtaattattcatatagttaggtttaattcctgtcatctcactgtttttctcaatttatcccatatgtttttgctcttttttctgtttttccctgacttttttcaaattgattatttttatgatccaactttatctcttttgttgtcttatttgctgtaactctttgttattgtgttattttcatatttcttaggattaacagaacacatctttaacttattatagcctaccttcaaatgatattataccagttcgcgtatagcataagaaacttacaacaggatacttccatttctccccttctgacctttatattattgttgtcattcattttacttacatacatgttaacatcacgctacattgttattacttttgtttaaataattgattacattttatggtcatatccacttttctttctttcttcctgaggtcctgaagtcttttgttattatttcctttctgttctgagcacttgctttagtcattccttaagggcaagtcttctggtgacatattcttttagtatcctgtcatctgaaaatgactttacttccccttcatttctaaggaatagtttgacttctggtttgcaatccagtacgtaaggagcttggaagttgtcactacatcctaacaacaaataaaaggctgaacaaactgattaattaacaactcttagatccatcagagaagtgaggtttactgccccttaaattggaaagactgacaagaaaatacttagaatcacaaattactgcagcagaaacccttgagcagaaacctttgtgggaaccagtatggggtagaaaaacctgaactgtaattgatgaattgctgggcattcacagtaaataagtatgagagttaaacagtccagggggacccattcaaaggagggcctcccacttttgtgagttctggtttcaggagttcaactaggttctcacagtgaatatcagaaaaaaaaaaaaaagatcttgttcttctggtgaggagagggaggaggaactatttgaagtaagtcagatcattctcttctagtcaaaaaggcctggcctcaggagaaactattttatcagagcctaaactattgggattttatcagagcctaaccaacctggaagaaaggaaatagcatgctccagcatgccttagccttctacataggggaagagaaatactcaacttcagttcattctagccatcttgtcctgcctaaggggagtgttgggggggtcgagaagctctgtttgaagttcacagtttagagacacaggctcactaaaagactgagatataaaactatagaacacttttctccttcttgcactgttacaggatctttggggtattgattttctggccagaaacctctgtggctggtggcatctttgccttagttcctgtcttgcctctagaagaatgaggtatgcaaacaagtgaagggtgaacaagacaaagaaagctttactaagtgttagaacagctcagaggaaacccttagtgcatagctcctctctgtaggcagatcatcttctctgtaagcagatcttcccattgagtgctcagctctcaagcagagaggaggccctggagagggtagctcctctctgctattggtcatcatcctgacatctgctgctctcaccagaaaggaggccctcgagaaagttacttctctctgcagctggtagtccctatgtctctgcaggtctctgaagctctcagaagagagagtagttcctcactgcagcaggccatctgtcctccgtcatctgtcctctgccctgctctggctgagcctggggcttttttggaccttagagggaagaagtccctgttgatcagttcatggagggccatgggcagtccagaaaaggcaccacaagtccccactccattctgctggtctggcagcctggctcccagccttcaggccctccttggcctgaaggtggggtcttactggcaacccacccacttccacccaggagcctgcctgccttcttgcactgttacaggatctttggggtattgattttctggccagaaacctctgtggctggtggcatctttgccttagttcctgtcttgcctctagaagaatgaggtatgcaaacaagtgaagggtgaacaagacaaagaaagctttactaagtgttagaacagctcagaggaaacccttagtgcatagctcctctctgtaggcagatcatcttctctgtaagcagatcttcccattgagtgctcagctctcaagcagagaggaggccctggagagggtagctcctctctgctattggtcatcatcctgacatctgctgctctcaccagaaaggaggccctcgagaaagttacttctctctgcagctggtagtccctatgtctctgcaggtctctgaagctctcagaagagagagtagttcctcactgcagcaggccatctgtcctctgtcatctgtcctctgccctgctctggctgagcctggggcttttttggaccttagagggaagaagtccctgttgatcagttcatggagggccatgggcagtccagaaaaggcaccacaagtccccactccattctgctggtctggcagcctggctcccagccttcaggccctccttggcctgaaggtggggtcttactggcaacccacccacttccacccaggagcctgcctgccttctgctgtccctgtccccctggctgctggcaccaagaggcacctgcaggccagcactgagcaatcctcagagctcccctctgcttcccctcctactctcattggtacccaaattctggagggggctggggcagcagggcactggcttgccagcactgatccaagtgtgtgcagaccatgccaaactgtgatagcacccggccttggctccaaccctgctctgatatgggagcctgtgcccggagcagtgagaagccaggcaactggagaagacacccctgggcttatgggtaccggggtcggggggccttccctggcccctaagggtgtaggttgcagagacacctaggtcttgtacctgggaaggtggctgcagctgcacccagggagctcccaccctgccaactcagaaggggtggggttcctgcttgtccttggctcctgccggcttggtggagcagaggcccaggtctgcacttgtggatctggtggttgcacctgcaccagggagggcagagatcctccctgctcctggcacctgcaagagcacagggaggctctgatcggcagccacagcttgagcagctgcagccttactcaggaaggcaggactcctccctgctccatggagcaggaggcctgggtctgcagctgcagctgcacccaggagggcagggaccctgcctgctccataaagtgggaggcctgggttgccagctgtggtttgggtgggtgcattggcacctggggagctgctgccccaactcagaagggcaagtctccagcttgtcctggcttccagtctcctaggaatgtggagccccagctgtgcctccctgctgcagctggcatgatggcagcgctgctgccatcaacacctcactaccacattagtaaagaccaactttctgcagttccttttatccagtatctcatatctgactattaaaaaacaattacaaggcatgctaaaagacaaaaaaaaaatagtttgaagacacagaacaagcatcagaattaaactgatatacctagaatagtcttactaggtagagcattcagaattgccgatttttttaaatcactatttataaaatgctgtgccacttctttctggcttaagttttacaagtaatgtattgtttccccttaacctctcttaagacctttttccatctttaatttccagaaatttgaatatgatttgtcttggtatggatttctttggatttatcctatttggggtttgttctactttattctttttgaatcagtgggtttaatgtcttttgtcaaatttggggaaattttagccattatttattagattatttttttcagttgaacagtttttctccttacttctaggaccctgatgatacaaaagctagattttttgttatcatccatagatctctcaaaccatttattttttttctaggctattttctctatattgtttacactgagtaatttctaattatctgtcttcaagtttgcggattcattctttgttgtctccaaactacttttgaggctatctgttgagtatttcagttattgtatttttttaggtttataatttctagctcattacttattcaatatcttatattcctttacatagattcttttatttttaattttgtttcaaaagtgtttttaattgctcatttaataattttttacacttgatcttagccaaaaggccaagaggcaatcatttaataatttctgctaactttgtatgtgtttgaaacttcacaataaaaagggaaaacagatgcagtttttctgatctagggaagatgctgaccactttcttcatctgtaggaaaaaccaaaacaagaaggaaatgagactaaatgattatagaggagagtataaacagcttaattaagaagatatttcaccactaggaaaacttcccatgcaaagtgcatcctagtgcctggtcatctctcaaatttaatgtttactagttttaatcgcaagagtaataaataaaaactaatgattcattttgcagaataataggtatactgtaatcccagttctcatacattggagaaaaacaaaatttagaaaatgagattcctctatagtcacagcccttatatcaccgctctcaatggttttgtaaaccattcagatttctttatgtgtgattagaactgggattatattagacctattattctgcaatttctttttcttcttttttgcctaaatattctgctaagagagtttgtgaaacagaataaacagctgtttagacagaaaagctaaaaacagttgaaaacagctaaaagcagcttcttttctgttcagattccaagatcatgccaattttatccatattttaatatctggcatgatccaggatctttttaacctaaggacataattttccacaattattatcctttttacctaaggacaaaaaaattacagtagtgaaaataacccgaaaagcaagatcctgaagttccgtgcttgcagttggctggccctctgtgcctctgtgggcaggtggccgccgggctttgtgtctgaggggctgcatagtagaatgactcagcaaagcagtggcctggggagcatagaagaggctgactaagattatgagctttcaggggagcattctttttagctggcaaatttctcttttaaggtaatgaaagtgtttcaggttcctctttgtccatttgcaaataaactggtgagttaacgtcactcccagtgcaaatgagagtgtagtgcacacgtcatgaagatgaagtggtttccccttaattttgcatattttcttgtctgcttttaactctagaagatatttgccttcacctgatttacagtcaggttcgtttctcgcatcgtaaatggactcttctcggttgtcctcacaaattattcattgctctcatttcatgtatgatgcccctgattttgtagcattggccctaatagaatattagacaaaactcaaggaggagaaacttgtgtggggataggggaatagatgggtgccctttgtagaacagaactctgtcttgggcttcttttttttatcctgtaaggcttaactgtaagaagctcacagtatctccatataagccttctggttgattgacaaatattctcagcagggattatttaagaaaacggatctcaatatttctaagagctagctgcagtgactcatggtgaacagagaattatgattggacagtgttagagccattgagaccacgttattgcacctcaatgcttagcataacgcctcatgcatctacttgttcatccatccatttttcagctagcttttactacatgaaatcctgatatgaagctctatgccacgtgtttactccatatacctatcccagtgactctttcaactcaagcttgctctctgaggacaaaatcatgaacacatccacagacccacactctacctctctcccactagaagaccagaatccgttttccagttcccccaagcccaagcactgtgactctcacctgtccatggaagcctctaagccactccccccagcccccatcctgttccttggtctccttcctcctcagcaccttggagcctccagagttgatcttacttcttctcaggtccccctggcatcctcatgggccctgacagactcatttagagagccaaagagccctctatgaggtttccaaatttttcccaattaagattagcttgtctcttctggcggggcatggtggctcatgcctgtaattccagcactttgggaggccgaggtgggcagatcacctgaggtcaggagttcaagaccagcctgaccaacatggtgaaaccctgtctctactaaaaacacaaaaattagctgggtgtggtggtgggtgcctgtaatcccagctactcaggaggctgaggcaggagaatcacttgaacctgggaggcagagattgcagtgagccgtgatcgcaccactgcactccagcttgggtgacaagagcgaaactatttcaaaaaaaaattaacttgtctcttccatgctggggagtaaaagcctctctgcttccatgcccagcttctacccttgccctgtccaaaataaagcaaagtccaatcccagctggctcctccctgctacctggggagtattctcacttgcgctttacatctctgcttggcaccctcaagcctcaaaaagaggtttttattgtaatatcatattacactaaatttgaaaaagaaaaagtaacaccctctcacccccacacccaaatacagccacagttatcattttggtgggtttgactgggctcctctttcttgtgaatgttgtcatggttatatgcacacaatgttgtgccctgctcctgtcaaaagcatgcctccatgttgctacatgaacaatagtcaccatgtacatgcataacaacattaaaacatttataatgaactgtaattttagcactgcatacacctatcaaaatgacaattaacactcaagtgatactttgctccatattttggatttttttttttttttttgtagagagggttaagaacactcttgcaattcttaacacatcatgataaattgatctccatgggagactgtacaaatgcatactgtcaagagcaatctgagaagatagcagttttaccatatccctgtcagcactggaaattgcaatggaaatgttaattttcgttaatgtatcagggcaaaaggtagctcttcattgatatttatttcaatttgattactaatatggttgttgaatagtttttcatgggccagttataccagaacgggtctaagccagctaagtgctctgctgtctttccctttggtgtctatactgtggaaagttattgttcatagagcttttgcgagcttgccacctctgccattgataccaggcacgccatattttgtagagccagctttatttttattttgaagtggcttccccctttctgaaaagggacttggcaagagttccgttctgtcacagtgaattagacaccaacttcccttgtcaacagaagttggcctgttgggctagacttgggcaccaggtgccacctcctgcttggctgccctctcagtgacatcatctatacctggaatgcccagtgggtattgcactaggaaagaatctggcctgcttggactgtgtctggtcacaggtcagtggaatttgaggagcaacacagtggcaaagccccacaaggactggcagcctgactcaagaaggctctaaaccattcatccccttcaactgccacaccaccatatctggcccatcagtgctgagaaggtgagccaggtggggaccacagtgtcactaagtcaaacatgatgaggcagaaggaaaggtctcggcatagaaaatgtgccctctgtcttgaggcagagacatccattttatatgctcaatcaacatatatgtagcatttttatgctgttcaatcaccctcctgaaaatgttcatgacaaaacagaccctccccacaggcctaccttcccttgccctggcagcagcctccttgaacagagtcccagggagacagaataataaaaattacaacttcctctatcaggaggaaggctgcaccctcacactgattgcctttgcctgaaaagtttcttggccacaccgtggcttccttgggcttttggggctcactgtggggctgcctatctctctccacaccacacacacatttaagctcttcactgggacatcatgagctaagaagtctgagattttgcttttctctctatcaaaactttattgaatgtccatcatgtgctagactttgcaacaaagccaagtcagacttggcctgccctctgggaactcacaggcaacaaagttcatgatcaaagtaatgtcagctaagaattttgctagctaggcacagaacgcataggaaagatgaggtcaaggcaagtttcttagaagccatgaaggctgagctgaatttggggactccagaaaacagaagacgtaaaattgcaaaaggtccttgttctcaaaatgttgtcttaaaagctctgagcttcctgaaagatttcaggcaagccaggggagggagggcaggcatggctaactttgcatttaggacagatccccttggcagccatgttgggcatagatgggaagataggaaggccaggggaatggtcataccccagcgaagaagtgatgagtgcctgggttcaagcaggatccatggggtgtggggggacagtgcggttttcagaggcagtaaagaagaggggctccccagcttggatttggtggtggtgggaaagggaggatttaagatgatatccagtttcctggttcaagcagtggacacacatttgggggaaagaggacaagttctgttttgcagatggcgtattctggacatccgggagatacattcgggggaaacaggacgagttcagttttgccgatggcgtattctggacatccgggagatacattcgggggaaagaggacgagttcagttttgcagatggcatattctggacatccgggagatacattctggggaaagaggacgagttcagttttgccgatggcgtattctggacatccgggagatacattcgggggaaagaggacgagttcagttttgcagatggcgtattctggacatccgggagatacattcgggggaaagaggacgagttcagttttgcagatggcgtattctggacatccgggagatacattcgggagaaagaggacgagttcagttttgcagatggcgtattctggacatccgggagatacattctggggaaagaggacgagttcagttttgcagatggagtattctggacatccgggagatacattcgggggaaagaggacgagttcagttttgcagatggagtattctggacatccgggagatacattctggggaaagaggacgagttcagttttgcagatggcgtattctggacatccgggagatacattcgggggaaacaggacgagttcagttttgcagatggcgtattctggacatccgggagatacattcgggggaaagaggacgagttcagttttgcagatggcgtattctggacatccgggagatacattcgggggaaagaggacgagttcagttttgcagatggcgtattctggacatccgggagatacattctggggaaagaggacgagttcagttttgcagatggcgtattctggacatccgggagatacattcgggggaaagaggacgagttcagttttgcagatggcgtattctgtacatccgggagatacattcgggggaaagaggacgagttcagttttgcagatggcgtattctggacatccgggagatacattcgggggaaagaggatgagttcagttttgcagatggagtattctggacatccgggagatacattctggggaaagaggacgagttcagttttgcagatggcgtattctggacatccgggagatacattcgggggaaacaggacgagttcagttttgcagatggcgtattctggacatccgggagatacattcgggggaaagaggacgagttcagttttgcagatggcgtattctggacatccgggagatacattcgggggaaagaggacgagttcagttttgcagatggcgtattctggacatccgggagatacattcgggggaaagaggacgagttcagttttgcagatggtgtattctggacatccgggagatacattcgggggaaagaggacgagttcagttttgcagatggcgtattctggacatccgggagatacattctggggaaagaggacgagttcagttttgcagatggcgtattctggacatccgggagatacattcgggggaaagaggacgagttcagttttgcagatggcgtattctggacatccgcgagatacattctggggaaagaggatgagttcagttttgcagatggcgtattctggacatctgggagatgatacattcgggggaaagaggacgagttcagttttgcagatggcgtattctggacatctgggagatacattcgggggaaagaggacgagttcagttttgcagatggcgtattctcgacatccgggagatacattctggggaaagaggatgagttcagttttgcagatggcgtattctggacatctgggagatacattcgggggaaagaggacgagttcagttttgcagatggcgtattctggacatctgggagatgatacattcgggggaaagaggacgagttcagttttgcagatggcgtattctggacatccgggagatacattctggggaaagaggacgagttcagttttgcagatggcgtattctggacatccgggagatacattctggggaaagaggacgagttcagttttgcagatggcgtattctggacatctgggagatacattcgggggaaagaggacgagttcagttttgcagatggcgtattctggacatccgggagatattcgggtgtgtcctcagtggctcaagcccaggacaaggacccaagactccaaggcaacatgtggtgaaatccacggctgagtctatcgctgagtgggaccacgtaggtcctgctatagaagaggtgagtcccaaggccaaagctgggttccctgacctctaagatggtaacagcagagaaggacggtacaaagaagattgagaaatcctggccagagcaggtggacaacaaaagggtttctggaagaagtgtctactgtgtcaaacattaaaagaaggttaagtaagaaaaaggtcggaagtgtccactggttgggacaaagaagaggcagcgagtatcagtagctggttcaggaagattggttgtgaaaggaaggtgggatgagaggggaaaatgtggtcaagagagaggtttttgtcaggatgggggactttagcgcatgtaaagcatggaggattgctttaaattgcagtttacagaaatgcagcagacttttctgtctcaggggagtggcacagtttcttttgcaccttcttaagcttgcatggctctggaaagtgagctttctctatcaacatgtggaaatagagggtaggacagagtaagaggcgttgtacaagaaaacaacaggaggattgaaggggaaccagtgggagggaggaggagtgagcagaaaggaggtggagctcaaaagagagaggagaggagctgagtatgtgtggaagaagagaggtcatgcgaagaacttctcagggcagccaggcatggcttggcagactggggatgactaagattccacttgcagttacctgcttaaccaggtaacctcaaagcccagtaaacgtcactcatgcccaatcacttttgtgtcagtagagtttggaggtctttattagggacaaaggtttagatcaatatgtggaaaaaagaagaaaatagccataagaattagaatatgaatgagaaacataattctgcttgagtcagtgcaggggtagacaagtgtctatttccccctgactgtgaggagggtctgtccatttcattggttatatcaggagggaggctggcaggtttggggctgcaggttcctgattgttggtttacagaggttaaaaacccaggaaaaatggaaaggttgaagaaatgggtcagtttcttctgtctttgtgctgctccttccatctttcctcccacacatggaggacagcatcctccaccccacaactcaagttcctttccagctttcagatgctccccgtctgccctggaggcagcatcaaaccctgcaggtgactgggtgcaggtgatttggtaattttgccaaattaccaatcactatttcccaaaagtcaattaattgaaaaacaatttgctgaaaattaattttccaaacgatcaatttccatgagaagtgatctctggaattcacccaaaagttgctttggttaattacttttaaaattataacaatttgtgtgctctggtttctaaaacactgaggatttccccccagctttggttttctatttcacttatatttagcagtttagtttgcaagtgtcaggtatgtttttatcagccgttttgctgtggatttctcagtccctccctggtaaatgtcaatttcatgtgggtttccatatttcaggagtgggacacttctcaaacacacaatatttttttggtgtcaatagacgggttttccctcaaccacatttattgtcaattccaattttagacttgtgtctaaattggactacagttcccacttttggattttgtcattggggaagttgtcatggatatgtgaaaattaacatgcagaaaaaacttttatttggctgactgccaaaccactttgaaaaaaagaagatgacgaaaattggtgtaaaattgcacttgaagggcaagatcatcttttctgaaaaccaaaggttagaatataaaaagcctcatgaattgccaaaacctttatagtaactactgaggagtagtcagcttctgaaatatgaaccacatgcctataaatctgatagaaaacagtggtagagaaactaaaaatgcaacatctcaactaaatacaaccaaaggccaaaatgttgggaaaaaatcattaccagatttcgaaactttctgtgaaacacatatgattacacattttgtaaataattactacaaagaagtttttagtgatttgggaatctgtgaaactggtcgttttgcaaattgatttttaacatagtggcttttaggcaattggtgtgacttttggcaaatgttcttgaggtcaggagtttgagaccagcctggccaacatgatgaaaccccgtctctaccaaaaaatacaaaaagtagctgagcgtgatggtgcttgcttgtagtcccagttactggggaggctgaggcataagaatcgcttgaacccaggaggcggaggttgcagtgagccaagatcgtgccactgtactccagtctgggcaacagagtgagaccctttctcaaaaaaaaaaaaaaaaaaaaattgctaacacagaagcattaagccagcaccacacattccacacattccacacatttaattcctgtggcttcctcctgccttgagcagtctggggatgcaactggggccaacccagtgggcagtgcattgaatgcagtgacattactaacatctgtttctgacccgtacttctgctgtgacccatatgtggcctcctctgctctcaggctgaagtccaggcacctcgtgggaccttccaggcctcacggatctggctcctctaccccatgagcccagtgaacacctctcgtgtgcagggcctggcgtccgacctgcccttgagatgcaccccgccacactgcagtcggtgtcttgtgcactcctctctagtgtgccacctctgaaaggtgggcaccagccaaccctggtcaccattcacagtagcacagctaaacgggatcaattagtgatttttaaagttcagtgctttgagacttctgcttctggaaagatggagtagatatatttttccttattcttctcactaagtacaactaaggcattgtataaaacaaacataagaagactgaaagatacagagaagaaggcagcccgactagggacctcagcctcccaaccccagctccccaggtagtgtcaggaaggccaggtgcagagtctggacaggacttcctgcctggagataacgagctgctgaccctcctccatgcagtgtgaatggagaacacgcaggaagcttgggctgccccccgccaagaagaaggcacccaaaaggtgtgcagtaaaagccaacagaactgagaggaaaaatagacaaattcataattatcattgggcattttgctactgtttctctgcctttctctccaactgatataaaaccaagcagaaaatcagcaaggatgcagaagacctcaacaacatcttcaattaacagggtctaattgacatttctagaacgctgtacccaaaacctgcagaatacacattcttttcatgtgcccaaagaccatataccaggatacatgacatcttgggctgtaaaacaagccttggcaaatgtaaaataatcgaaattatacagagtgtgttcttggaccacaatcgaatcaaacaagaaatcagtaacagaaatatagcaggagaatctcaaataacttacaaattaaacaacacatttctaagtaacccatggtttaaagaggaaattcttcaaatcaataagctaagctctcgcctcaagatactagaaaaagaagagcaaaataaacccaatgcaagcagaaggaaaaaaaaagattgcccagaaaacagtaaaaatgaaaacaaagaaacaatagagaaaatccatgaaacaaaagctagtccttgaaaaggtcaatgaagttgactaacctgtagcaagactgacaaagaagaaaagaacacataaattgccaacatcaggaatcaggggatatcactaaagaccctgcaggcatcaaaaggttaataagaaaatactatgaataattccagatacataaatttgacaacttagatgaaatggaccaattgcttgaaaagcacaaacttccacaatttatctaaaatgaaatagatcatttgaatagccttataactattaaggaaaattaatttataatttttaaaagccataggaagaaatttataggcttgggggttttgctggagaattataccaaaagtttatagaacaattaacaccaattttatacagtgtcatccagaaaatagtagaggaaggaaaggtcatttcctaattcattttatgaggtcagtattaccctgatgctaaaactaggaaaggacagtataaaaaatgaaaattatagtccagtgtccctcatgaatatagacataaaaatctataagaaaaatactaacaaatagaattctttaatataaaagatcattatataacatgaccaagtggggtttatcccaggaatacaaggctggtttaatattctaaaatcaatcagtgtaataatccaccatattaacaggcctaaagaagaaaaatcacatgattatttcaattgctgcaaaaaggacaaatacaaaattcaatactcattcatgatgaaaactctaaaaaatctggagctgaaggaaacttcctcaacttgataaaaacatctacaacatcatacttagtgatgaaaaatgtaatgctttctccctaagatcataaggcaaggctgtttaacataatactgtaagttctaaccagtgcaataagacaagaaagggaaataaaagacccacaggacagaaaagaaataaaactattgctatctgcagattacataaaggtgtgtggaaaatcccaaggaatctatcaaaaatctcctagaattaataagctcagcaaagtcataagatcaacataaaattagttgtatttctatatgctagcgataaacatgtggaaacccaaattaaaaatgcaataccatttgcaatcacacagaaaaaaagaaaacaaatacttaggtgcaaatctagcaaaacatgtacttgaagggtttatatgcctaaactatgcaatgtcgatgaaagaaatcaaaggcaattgaaataaatagagacacccatcacattcatggattgaaagacaacaattctcctatattcatatacagttttaacaaaatttgcattaaaataccagcaatgttttctgtagataagattattcgaaaatttataagaaaggtcacaaaaactaaactagcctaagcaattctaaaaaagaagaataaatggacaagaaccagtctactcaaggctaaggctttctacttagcaacagtgatcaagacagtgtgatattggcagaggattagacacacagatcagtggaacagacaaagaatccaaaaagagacccagaaaaatatggccaaatgatttttgatgaagatccaaaatggataaagaatgggcttttcaacaaatagtgcttgagtaactagggaagtgtgggcttacagaaaaaggtactttgtacctaacacattataaaaaaaaaaaagagcaaaacaaaactcaaaatagatcacagccttaaatgtaaaatgtaaaactataaagctttcaggaaaaaacaggacaaaatttccaggagctcctagttggctagacttggcaccaaaacatgttgtataaactgaaaattgataaattggacttcataaaaattaaagacatttgccagtaaaatatcataagagaatgcaaagacaaggtgcagattaggagaaagtatttctaaataattctgatatctgatcgtcaataaaggactcatatctagaatttatttaaagaactgttaaatcttatcaataacaaataaacagtctaattagatattgggcaaaaggcatgaagagccattttaccaaagatggaaaataagcatatgaaaagatgctcaacaccactgcccactaacaaaatgtaaattaagactctcattttatatcaccacacacctatcagagcagcaaaaataaaatttaaaatagaatctatgtcaaatgttgacccagatgctaagaaattaggtctacattactggtgagaatgtaaaatggcacaaccactttgggaagtagttgggcagtttcttaagagtatcttactccatttgagctgctatgacaaaataccataaactgggtggcttaaaccagaaacaattatttctcacagttctgggggatagggagtctaagattagggcactggcagggttagtatctgatgagggctggcttcctggttcacagatggcaccttctcactgtatcctcacatggtgaaagaagaaaggcagctctctagcgcctctttcttcagggcactaatcccatttgtaaaggccctgcccctaagacctaattaactctcaagggcccaatctcctaacaccatcacattggcgattacgtttcaacatataaatttttgggggcgacacaaaatccacactctagcactaggatacgcttttcatacgatctagcaatgatattcttggacatttatttcagagaaatggaaatatgtgcacataaaaacttgtatatgattcttcacggcagctttatatgtaataactcaaacctagaaacaaccaaaatgtcctacaatagaagaatggtgaaacaaactgtggtatatccataccatggaatactactcaataataaagagaaacaaattattgatacatacaacttggatggatctcaagggcactacactgaaggggaaaaaaagccattctcaataggtcacatattgtataattccatttatgtaaaatgctcactattacaaaattgtagaactggagaccagagtaatggttgccaggggttagttatgggtggggtcatgggggagcagtggatgtgactttaaagggacagcatgagggagaactttgttgtgatggcacagttctgcatcttgattgtggctgaacgtgcatcagtctacatctgtgataaaaatggcacagaatgtcatacacatacacacacacacacattgtaccgatatggatttcctggttttgacattatactatagttaggtaagatgctaatcaccagggaaaatcagagaaagtgaacacgagacatgaatctttaattttttcaaaacaaggttttttgaaatgttgttcaattgcattctggcttctatgctctgtcgcccgggctggagtgcagtggtgtgatctcggctcactgcaacctctgcctcccaggttcaagcgattctcctgcctcagcctcctgagtagcggggactacagacacacaccactgcgtctggctaagtttcttattttttagttgagacagggttttgcccaggtttcgcccaggctggtcctgaactcctgacctcaagtgatctgcccacctcggcctcccaaagtgctgggattacagcgtgagccacagcgcccggcctggcctctatggtttctgatgagaaatctacaaccctttaaataattgtaattttataaataatgtcatttttcattgctgctttgaagataattcctttgttcctagttttcagtagtttccttatgatgtctctaagtgagaatctctttgagcttattctgtttgggattctctgagcttctcaaatctacaagtttatgtgttttgccaaattcagaaatatttttagccataattttttcaaatatttttcagctcctcactcattatactctcctcttgggactttaatgttacaaatattaagccatcattttctgtcattatgggtccttctgagcgacatgtttactttccaagaattgtcaactttttgtcaaatctgcattgttaatccccaacccggaggaacacctgtacacactcaccttctctgcattaattgttgggttcccaaacatggctagtaactggtcaaaatgggatttcctgggtgtgtagccagttatagttctgggcctctatcacttccagtattgatctcttgttgaaaaaatttcacattcccaacagtgactcctctattcaaggtctcacatccctctcatggagcaatgtgctcaccctgtgctggtagcaccctcagaaacgctccacacggagtggctagacaccttgccaccttttctttccctcctggtctcctaatgatcctccttttcccaactaaactcagggttactcgccttaggatcttgttgcttccttgagaatcttgctccaaattttatcctccccaccttctgctccagtggcttcttttcttccacttgtagacatcctcaggctcgtccaagacttaaacaacaagaacaagaacatcagcctccagaatcttccttaaccttgctctttcttcaagttggagctatcttgttgaaatttttctgtcaggacagaatttctcagtcacccaatccaagagtctctccacattggtccaccgtgtctctctgttactgaaatgctctcccctgcttccctcagcttctcatatacctccttctctttctgagccttggatcctcctccactgactcctcattgcctttatctatttttataaggtttttattgaggtgtaacatgccatattagtctgttttgttttctacacaggaatacctgagagtgggcaatttataaaggaaatatgtatatttggctcatggttctgcaggctgtacaaaaagcatggcaccagcatctgcatctggtaaagcctcaggaagcttccacttatggcagaaggtaaagggagagcaggcatgtcacgaggtgagagaggaggaggaggaagaagagcggtgggaggagtgccactctcttaaacaaccagctctagcatgaactaatagagtgaggactcactcattactgaggagagggcaccaagccattcctgaggggtccgcctccatgacccaaacacctcccactaggccccacctccaacactgggggtcacatttcagaatgagatttggagggggcaacatccaaactacatcacatgcatacagtaaagtgcataaatattaagagctgggtgaatttttgcacacatacataggtgtgactaccactgtgaatgagatacaggccactcccagaagtgcctctctttccctcccaggcaatccacattctcccttgctcttgctcttcaataaccactatcctatccacatggattatttctgcctgttctaaaacttcatataaatggaaccatgtagtatgtcttttgcgtctgctttttttttttttttttttttttttttttgagacagagtctcactctgtcacccaggctggagtgcagtggtgcaatcttggctcactgcaacctccacctcctgggttcaagcaattctcttcctcagcctcccaagcagctgggattacaggcacgcgccaccacgcccagctaatttgtgtatttttagtagagatggggtttcatcatcttggccaggctagtcttgaactcctgacctcaagtgatccacctgcctcagcctccccagcgtgctgagattacaggcgtgagccaccacgcctggccaagttggctttcttttacacaacatgatgcctagtggattcacccatgtttctgtgtgcatccgcagttcattcctttttattggtaggtagcattccattgtgtgaacacgccatgatttgtttactcattccactcctgagggacatttgagttttttccccttaggctttttgtaaattcagcacccttccatattttgtcttcatctttcttcaaggtatctctttttttttctcaaaatgatccagaacaataggcattcagccttccctggaaccggccttttcctgccgccagagcagtagccaacatagtttctggcatcaggaggttaagtcaaagttatcagtcaaaacacaccgggagagaaagtggaaattggtacacagcagcgtataattaagcaatcgcaagctttgggaggcataaaggggaatctcagggccagcctctcagctgtgaagttctgcaagtagagtccatggcaaggggggcggcaggcacagcggacaccccgtcactgcagctctctgagccctgcaagttctaggctggggctgggctccctggccttctgcctagagcccttaggcaaccaaaatgacagcccaggagagccaagagccacaaggttatttttctaagacgtaaagtgaattatgtcatccacccagacctctttgtccaagagaacaacctcgagtctcctccttcaggaccctcagatagatcttcccagaaacagagcaggggaaagagagaggaggagacgctggagccacagggctggagcagttggatgggcctctgacagcagagggagaggcgactgcatagggaaacagagagggacaaagtgagttatgcttgagagagcttgagggctacaaagctcaatgtttatgtgaatataatcaaaggaaaggggaaagatttgggagagagacacccgagaaaaccccaagaagccacaagacctagacaacaactgccaatctggtaatgactgggtgtgctgtggagttggtgtttatcccagacaaagccagtgctttcccgagatctggtgacaatttggggcacatatatttagggaggaggacaagccctgggaagaggttttgagtcaggagacctgtggttgggcctcagccatgtggtccgctgccctccagctctgacagcagagtcccttctgctggcagagtctctgcctgtgagtggcagcaggccagcccagctccattggcccttctggatctaagaggtctggcttctcaggcccaggcttgcaaagcctctggctgaacttcacagtgaccttgccagcgcacacctgagccacacctcattgcttttgagtatacctgaacctcaggcaaggtttggtttaattcctaacttcttactgcagaacagaggaagtcaatttggagtcaaatcctcatgaggcttctcttattccagggtatttatttgcttgatgattttgaaccatttatttggacacacaaagttctatctggcaaagaaccgttggctccaacatcctcaaacaacgctagttttagatgctgatagggtctctaataggaggcaaagaaacgtaacacccagccaggcaattgcaaagttgaatgtgagagtctagctttttgagaatccttctaaaagccatgtgataagggattgtcacagtgaggataacaaattcacatctaagggatgaaggtaaaacttactccaatgctctgcaaatggctgtggggggtggctcttcctgggaagcacccctcagacttggagtcactgcatcctacttgatttaactgaagcaaaggcaatgtattcatcaacaaactgtgacataattaaagagagatcttgtgtcgaccaagatgctggtgctgtaaaggaggtgagtaatgtgggaaaaagcaatgtttccaaactcatgtagcattttactttattttattttattttattttattttattttattattttattgtttgagacgaagtcttgctctatcacccaggctggagtgcagtggcgcaatctcggctcactgcaacctctgcctcccaggttgaagccattctctcctgcctcagcctcccaagtagcttggactacaggcatgcatcaccatacctggctaattttttgtatttagtatagatggggtttcaccatgtcggtcaggctggtcttgaactcctgacctcaggtggtctgcccgcctcagctgcccaaaatgctggaattacaggcgtgagccacggcacagggcctattttattttgttttattttttgagatgtagtcttgctctgtcacctaggctggagtgcagtgacacaatctcaggtcactgcaacctctgcctctcaggttcaggcaattcttgcacctcagcttcccaagtagccgggactacaggcacgcaccaccacacctggctacatttttgtatttttatagagtcagggtttcaccatgttgtccaaagtggtctcaaactgaactcaggcaatatgctcacctcggcctcccagagtgctaggattacaggcatgagccactgtgccaggccatactcatgtagtattttaaatatgcacgagtaactatgttgctagttaaacagatatttgactattctgtctacatgccaaaaattgtttagaacatcacttaaaatttttctcactgaaaaagtcacatacacagttatattaaaatcagcgtatgctatattctctaatctagaaatagaaaatgtccaagatatctgactagacctagcctgtgcagttctatggaatccctctgaatcagctgctactctgaagaagaccaccacacacaagatggacccagcccacccttggcccaggccctggtgcacctaactccagtgcagacccaccccttcatcaactgcactggagtggttcttcaatcatgtcccatggtccctgtggcagatgccatacaggttgcagtggaagatcttcagatgacttggtgacaggttcatgaccatctggtttcaaggtgggctgtcaggcaagtaccaaacaggctctgtgggaccagagtgtgcgtgtgagtgtgaagttggaggtggtggaaagaaggcagagtgactgtccccacggtgctggcaaaaaagagtggcaaacccgcattttgggtcttttctcttcttttatcttcctcactggctactgtcatctgtaaagagctccaagtcttcatgtatagaaagcattcaatgggcaaggaaggcccagtccctacactgggggatctgctggctctacacttcagagacccacagcttgaaggacaaagtttgccctcaagtgatttcttcaacatcagccagttttccctgaaatgtgactgactcatgttcaggggagctgatattctagttggaaagggggaaggggagacaggattgtgagaagggttgttctccattttcaaaataaagaacttcgactactgcacttccccaaatgaggctttctctccaggcacatcttctggttcacaagctgctcaagaagggcaggaagggtcaccgcaaatcccatcccattgttcctccagatccagcttcccagagattacagtcagctcatctggaaaggagcctgtgagatcggcgaagtcctagtgtaacacattccaaggaacacctctgattcattactctttggagactggctcccattagcaattactggaaataatggctgtccacagagcatggccgggagtgtggcatgcagggaggatatcataaggtgggccactgatgtgtggaaattaacccaggagcccacaaaggcaacagctatgggcctggtaggatctgaagatttcttctccagtggctcctggaggcctccctgcattggtttgtgcatctatatcctcaacattgagagtatccagctgggaatagtgtctacctcaagtcttgggtccttggtccctcaaaggtgcatggtacctccagctgcagaaaacatgggggaagagctacatgacaagtcataagaagctctctggaaatatctcccaggtgccctcttctaaacagaaatgcttctctgtcaaagcaggcctccctgtgggtgcctgggccttcctatctaggctaggctctggatgtctacaccagcctcgtaagcacaccccttcccagtgctgagaggctgtttacagcagggccgcgcatcctttctgaggccaaaactgaaacaacaacagaaacaacataaaaccccctttctgaaccacagctctggcttggcgtgtaatttttgagaatatacttctctattccttgaatggttacctttgtctttatggccctgctatttatatgctctgagaactctccagaaactccttttccaagaaatgagctagcccttcagtggccatgtttacagaatttcctgttttcatgatatctgaagaggacaaaactttggaaccttccaaaataaccagggtttctgacaaaccttgtggaccaatgttactgcattccaactacatgcaaactacctgtcacatccaaacctcaaagcctcccccaattccttactctttagttatttcctcccctttcccccagtcccatagctatggtgtgagaatggggtttccactcggcagctgagatctggagttagagtggaggaaagtgggtcaatttcccctctcccctatagacataagtatacatgtacacatacccgggcccatttgaggacaagccatccattatgcaatgaggtcataggtggcactccagtcctggtgagtgttgtggtacagtgggaaaaaaaagaggtctctggagccataaggacagaatcttggctccattagttgtgagaagtgatcacgtgctcactgagtctgtttcttcatctgtgaaatggattgttctgaggacagagatatgatcacatgttatgggatcaatagatggcagtagctattggtaatgatgatgtcattttcatcatcattattgtcatcattgtcatggctagtaagcctacagatctttaaaaaatagctcctgggctataaactaatttccagctaacattcttactgggccaaagtaatgttaggtctaaatttttcaggttctgggtctgagctacagagatttatacactgcatgctgttgtcagcaaagattataggctctcccccatgtgtgagtgcacatgtgtatgtacacaaggcctcctatagacaatgcactttccattgtgccacagagccagctaggccttctatggagaatgaagtcaatctcttcctgcaccttcatgggttaaagaaagcaggatgaaaacatttattctcttttttcaggatctcaccatcagattagccaccctttgactactgagacatttaagagtttgaaaacacacacacacacacacacacacacacacacacacacacacttgcacacaggacaactatttggaggcaaataaagcaggcagattctggagaagagtcaacacttacaaaaagagaatggcagatgacccaaatgttggaattagcaggtaaggattttaactatgttcagtcatgtaaaggaaaagatgctcctaatgaataaaaagttgtaaaatttcatcagaaaaatacaaactataaaaagcaaccaaataaaaattctagactaaaacataacatatctgaaataaaaattcatcctctagcagaatagagacaacatagggaagagtccatgaacttgaaaagggatcagatgaaaatgatccaatctaaagaaaagagagaaaaatggcagagaaaaaattgaacagtctcaaggactggttcaaaaatattaaaatgtctaacataggagtaattggagttctagttactctagtaattggtactcttacttctaggagggaagagagtaaatggagcagaaataaattcccaaatatgatgaaaggtataaaacttttgattcaagaagctcatgatactccaagcagagtaatacctagagatatcatagttatacgctgaattcataaataagggaaaaacgattgaaatcagctaaataaaaatggcacatcacacgaaacaaaaaagcaatatttgctgatttctgataaacaatggaggccaaaagagagtgaaacaacatctttaatgtgccacaaaaaattgtcaacccagaattccatatgtagcaaaattatccttcaagaatgaaggcaaaataaagacatttcagaaggctaagagaattcatcgccagtagatctgtattataagaaatactaaaggaaattcctttagtatttcctgaagggaaacgatcctgttggaaatagtgaatttctagataaatagaaaagactggtgctttttctctttatttatttaaaatacatatgattctttaaagcaaaatttatgtcttatggggtttgtcacttagatgtgatgcatatgaaaattgcagtataaagagtgattagggatgggtagttttatataactgcaaggtttctacttacataagtggcacaatcttttttcttttttttttttttttttttcctgagacggggtctcgctttgtcgcccaggctggggtgcagtggcgcaatctcagctcactgcaagctctgccttccgggttcacgccattctcctgcctcagcctccccagtagctgggactacaggcgcccaccaccatgcccggctaattttttgtatttttttttagtagaaacagggtttccctgtgtttaggctggtctttatctcctgaccttgcgatctgcccacctcagcctcccaaagtactgggattacaggcgtgagccaccgcccccagccaagtggcacaatctttaatagattgtgaaaagtaagggaaatgcattgtaatctctacacaatcaataaaaaaagcaaagaagtggctgggcatggtggcccacgcctgtaatcctagcactttgggaggccgaggcaggtagactgcctgagctcaggagtttgagaccagcctgggcaacacggtgaaactctgcctctactaaagtacaaaaaattagccgggcatggtggtgggcacctgtaatcccagctacttgggaggctgagacaggagaattgcttgaacccaggaggtggaggttgcagtgagctgagatcatgccattgcattccagcctgggtgacagagggagactctgtctcaaaaaaaaaaaagttaaataagtatagctagaaagccaataggtaaatcaagaaagaattctaaaatatgttacaataagtttaaaagaaagcagaaaaagaataaaggaacagaaatcagaggggatgtagtcagaaaacaaatggtaaaatgaaagatacatatccaaatgtgtcaataattactttaaatgctcatggactaaaaactccaattaaaaacaaagattgtcaaaatggataaaaaagctttctataagagatgcattttaaacagaaagaaacagatatattaagaagaaataaatagaaaaagaaataccatgaaaagagtataagaagaatataggactgttgaagtggctatattattatcagatgacattaaattcaaaataagactactgccagacatagagtgggatatgttataatgataagaattaagaattaattcatcagaagacattataatcataaacgtatataggcctagtaacagagcttcaaaataaatgaagcaaaaatgacagaattaaaagaagtagacaatcccacaatcatagttggaaattttaacatctctcaatgactgttgatagaaaaactaggcccaaaatcagttcagatatagatgatctatgtaataccaccatcaccttgacttgattgatatttatagaacactacacccaaccattgcaaaatatatcttcttttcaggtgcacatggagcttttgtcaaggtaaagcatacgttaatccataaaataagtcttgatgagttggaaataattgaaatctacagagcattttctctgaccacaatggagttaagttagaaatcggtaacaataagatatctaggaagactccacgtgtttagagtcaaacaactcacttattttaaaaaaacccatgaattaaagaagaaatcacaaagacaattagaaaagcttttgaacagatgaaaatgaaaatgttacatatgaaaatttatgagctctaattaaagcaatgtttagaaggaaatctagagttttacatacttacattggaaagagcaaaggtctaaaatccataacctaagtttgcaccttaagagtctaaaatgagagaagaaagaaagaagaaaaaaagtaagaaaggaaggaaaggagaaaggaggaaaggagggagaatggaagggaggggaaaaatacaagaaaaggaaagaaaaaaaaagaaaacccaaagtaagtagaaaggaaagaaattctatatataataacagaaataaatgagataacaacaaagaatagagaaaattaacaaagccaaaagtctgttctctgaaaagatcaactctagctatactaatcaagaaaaggagagagaatacgaatggtcaatatcagaatgaaagaggggttatcactgaaaatgctacaagcatttaaaaaaagtataaaagcattatgctaacaaaatagacaacttagatgaaatagacaaattccttgaaaaacacaatgtaccataactcatgtaggagaggaaattgaattgaattgaatttatttatttagtttttgagacaggatcttgctctgttgtccaagtgtaagtgctaaggtgttattccagtcactgcagcctcaacctcctgggctcaagtgattctcccacctcagcctcccaagtagctgggaggtgcatgccaccatgcccggctaatttctgcattttttgtagagacggggtttttattatgttgcgccaggctgatctcgaactcctgagctcaagagatctgcccacctcagcctcccaaagtgctgggaatacaggcatgagccactgtgtccagccaaaatgtattatttttaaaaatcttccacaaagaaaagtttggtcaagattgtctcattaatcctgtaaaacatttaaggaagaaatataatagtatcattatttcacaaactctttcaaaaacagaggaggcaagaacacttaccaatttattttaggtagtcttaactattgcaataatgtaagtaaaaaaaaaaggcataaagattttaaaaagaagaattgcaactcactccacacacgatgtgattgtttatgtggaaaatcttaagaaatgcaagaaacaactattacaactaatacatcaattgaacaaggtcacaggatacaaggttaatattaaaatatcaattatacttttatatatcagcagcaagaatttgggaaatgaaattagaaaaacaattttatttacagtatcttcaaaaagcataaaatactcatgaataaacaacaaaagatggacaagatctctatgttgaaaactaaacaattattgaaagaaattaaagaagacacacacacacacacacacacacacacacacacacacacacagtatcatgtttgcagattggaagactcaatgttgttgagatgtcagttctccacaaattgatctgtagagttattgcaatcccagtaataatgctagcaggaatctgttgtagaaatttacaaattgattctaaaatttatatagacatgcaaagaatctagcgtatctataacaatcttgaattaggaaaataaatctggagtgctcaaactacatgactttaaaacattataataccgacattgttggttttataattaagacagtatgttactggcatagggactgacaaatagatcagtggatctgagaagagagctggaaacaggcccatgattacatggtcatttgtttgccaaaggtaccaaagcaatcaatccatggggaaagaaaagtcttttcaaaaatggtgctgtattaactagatgttcagaagtaaacacacaaagaaaactttaacttatttctcacgtcacaaacaaaaattaattctaaattattgtagggctaaatataaaatcataaaacttttagagaaaatataggagagcatcttcataacctggagacaggcaaatgtttatagacaaacaggccacagaaagcaataaacgtaacagaaaatgaataaatgtgtccctgtcaaaattaaaagcttctgctgataagtgataccattaagaaaataggcaagccatagattaggagaaaatatttgcaaaacatctgaaaaaagattgaaatcctgggtttatgaagaactctttcaactcaataataaaaagataatcaatcagaaatggatgaaacagttgaagagacagttcacaaaaaagatacacaaatagccattcggtatatgaagagacacttatcattactcatttgggagataaaaattaaaaccacaacgagatgcctctacacttttaacttaaagaatagctatcaccaaatattagtaaggatgtggtaacttcttataaagctatacaaacacctacccccttgacccagcagtaccactcctagggtttttcccaagagaaatgaaaattatgtttacaagaagactcacggagaggagaactgcaaacatcagatgttcatcaacaggagaacggataagcaaactgagcttcatagaatggaatatcactcagcaataaaaaggagcagttcaagatattctcatgcctcagcctcccgagtagctgggagtacagggatgcatcaccacgcctggctaatttttgtatttttagtagagacagggttttgccatgttggccaggctggtctcaaactcctggcctgaagtggtccgcccacctcggcttcccaaagtgctggaatcacaggcgtgagccaccgtgtccggcctacaaataacttttttaaattaaaaatgtggttcccagatgcaaatacaatgcgtgtgctttgcccaaatcacctaaaaataataagacatttttagagtatcaggcatcctttgatttactaatatttattgattgcctaagatataaggcacagtgaagctggcagatacacatgtatctcctcgccttcaaggaacttaaaatgggcatgaaaagtggtccacaggaaattgaaaccatgaaagaggttttaaataatggacttgatgagtgtatatacatatgttatagacaaaaacccaaacagccttctttcttgctctctctctctctccttcctatcccattccctcccacctgccagcatcaaccagactctatactatttctctaactcatgatacagggaagtcaggtgtagtgagtgtggccagggtgagtgaacatttgaatggactcagcctgactctgggaacattttaggatctttgaggaacattctgagccttgcgtccgcatgcaaggttgcaactacagtgcagcctgtggctttcctgaccctgcctgcagctggtgtgaggaatggcccctggtaaacatgtttttcttggttccaggcatgcttttccccacagctgttctcttctggcatccaggttcaaaagcatgaccttggtcttctccctccctgggggccctaatgcagggctgtgtggttcttggaccctggggctgctttccaccagaggctcccttgctcttcccaccaggaagtatatatgttcacagggcctgcaagagtgcacgagccactgagggagcctcctcccagggttctgtggttgagggcagatgagaaagctgaaggccagcgatgagggatcctggcaggtcctctccatgagacatcatctactcatccttctcctcccatgatgtggggaggcccacgctcagatgcagtgattttgatactctgagattaagcttccactgcaagaaaatgggactcaaagcagaaattatgttgttactcaccaaaatgaaggctatggtcttataccagggagccaccaactcagatttctacaccctactcctacatgatggaagctccatttaaaaaaaaaaaaagtacacaaataaaaacaaacaaaatacccaaaacagaacagatagaaccaacaaaagaacagggataaaaacaaaaatcccttcgatttcctttttgactgttttttcttgtcctatgggagaccgacagccagttgtagtggaaagagcattggacagggagtgtggagagctcatgcctgtttcccattgtgggaccccaggcagatcacagcccttcctgggacctccatctcctcctcatctgctccagctcccttgagatgccatgattgatgaagctcccttggccatcacatggtacacatctgtggggttaaagaaggcatctcacaggaagggtgaagagtcacagcagctgagcactttctgcatatcaggccttggctaactgcctgtgtgagataggaaagccattttacagatgaggaaactgaggcttagaatgttaagtaccatgcctgagtgaatcaggatttgaatccacatggacatcgggctttcacatacattggcccaggcacagtttgagactgaaattaagaaattgcatttcacatcatttttgttggtttggtggtcatagttgctgtttctctgccataattagaatcctgctggaaccacacccaccgctcttgaaagatattactgtagtgcgcttcagtgtttgctcctggggaacgcattatacctctgggaggcaagatgctttaacaaagaagcacaactgaaaaaagaatgtctgttgctttctggataaagtatctgtcatttgattccagtttgctaatctcaaatgtagcttttaaaatacacttgtgatttattttctttttgagagtcaggtggagtcccgcatttgtgggacttcatttttgtttgcaaatacaataccttgaataaaaatgtgctgtggagcaggcacgatgccttcaccagtgtagccgaagacatgtgctatcctccctgggtctgctttctggcctgcctgtggaggaaggggtggaggtcaatgtagggatgagagccagggcctgggtatggggacagttgataaggtaggggtcccatggacccagatcctggaaaagaaacaggcaaaactagaaggaacttcttcttatcattcagtagaatgttcccggtgaggatgtggactttattcaattatccagaattgaatgaatcagttccctgccagggtgatcaactcacccttgcttacctgggactttcctggctttaaaacccaaagtttcctgggaaatttctctgttcaggaaaactgggatggttagtcaccttacctgggacccaggcttggccactgaatctcccactacacctattcacctattttacagcaaggcaattgagggagccttgtgttgacgttagagttgtgaacatggtgacttgagctgtaattttgtctctggggccatgggattgttttcagtccctggacttggaaccctcatggaccccatctctttctaaccctgtagatgctgtcagcccctgctgtaggcttgggcatgccctttctggttaaacagtgaggatggacagagcatagaatagcctcctggtcctggtagccagtgtgcagaagacggtcctgaacctcacggtgctcctgctttctgacctcaggcagaggccatcctacagacaggaatttggagccccagctggaatagtgttggtgccccacctctactccttggttctagaaaaatcaatccaagagttaggcatgttgtatagcacccattctccgtatagtcatataagtgtctgttttcagcacaagatagaccctttttccactctgccccatgagggccaattcccccattctccaagctcccctgagaaaggcagaggaccctgtgagaagctgagctttgagggtgtccctttcctgggagagccattttgtatcagtggaagcagaaaacaccaactgggggacaagacagatttaagtgggcctgcctaatacagcacattaatacatgcggatacaatggtaatctaaaagaggccctgttcatagatgactgtgcagcactaaaagcatctgaaattttagtcctaatttaactatttttttaagttttttttgttgttattattgttttgttttgagacagggtctagctctgttacccaggctggagtgcagtggtgtgatcccggctcactgcaacctctgcctcctgggctcaactgaccctccggcctcagcctcccaagcagccaggaccataggcgtgcaccactgcgcttggctaatttttgtgtacatatatattttagtagagactggttttgccatgttggccaggctgatcttgaactcctgggctcaagtaatccacccacattggcctcccaaagtgctgggattacaggtgtaagccactgcacccctcaatttaactcttgaaaagtgcaaaaatactctgttcaggaagaggcaggtagagaattgttgacatttaaatgagcttaaaaggtgaaaattgcatccatggcactagcaacaattgaaagcctattacaaagaacacaggcttcacttcccaaagtggaaagacaacactagcagggacttcatagcctccttgataaaacaaaatgaaaggcaatataatttaaaaccatcctatcagtattattggatatagttcagattatgaagtcatggtactgttgagaaaaaacagccaccagattctcttctttatgggcctgtggggccaggatggggagatacagtaaatcataacacaaggtcagttttgattttccactctcagactgaaaaaagtatatggagtttgatgtttgttttggctaaaccaaatgctttttcaataaaattaatgttgaatgaattataaataggctttaatattgagggcagttgcaaggaggtaaagggaagaagaaaagtcacattccaggcatccaggacaatttttggtgtgtggaacctaacatgcaataggtacttataacatgtttgctaattagatgaaagcagccttatgtttctaatttggagacaaaggtatagtgctaagcacacagtaggcattcaaataaatcctttttgtactgaactgcaagcttgactgaacgagccttgccagcttttgctcctctgaactccctttcctaatctatttttctctaattgatacctcagacatgagaatcaagttactttatgtcattagagtacaaggaatattcctgctgctagagcctaagaaatttggtctctctcccagactcacacacacaaaagaagtacaaactgcacactaacccatgtcctaacacaagtccaagtcctaacccaagtccaaggtcatacactcctgactcaagagcaaggttctcaggcacaaacaccaacctccaccatggggtgcagtgcactgtctcctgctgttttgctcaagaccctcagcaccatcactcaacactggcttaactcgtctgtaatcctctggcttccttggaggtttaaaccatctttcttctccctgatacaattccctttagggttgagtcactcagctctttcactgtctcactaaccacactcttagctcttagctgcatctcctgtccctcatccactgacccctcttttagattcactgtgtcacagtaataataatacatcctgggtatcagctgcaccttttcttctgcatcctgcatgcatggggtcagtctgtttttatcacatgccaaactcaacacagaactcaatccctcttgaagataaccaaaaaggtacacttttccaaaaccattagtgagaagcacagactttacagaagataatgtaaagagaccatgaaaggggttaacattgcacattccaaagacaaaaaattaattccccaatgaataatttttcttttttcccaaagttatttgtcttttgaggcctcatttctgaccctcttcccactagactctccatcctcacccaggaaaatcaactccctatcctctcttacttagagtagcttctctgtccctctgaagcttaggtgtctagccttggcttttactccaatcaagcttaattgaggtgagttctttcagagtaggttctaccctataggagtctcatacaatctcccttgagacatcaccttcactattatcatcaccaccaccactgcgatcatcgtcacctcatcaccaccatcaccatcaccgccaccaccaccatcaccaccaccactgccaccatcaccacctccaccatcaccatcaccaccaccaccatcaccattaccaccaccaccatcaattattgagttaacatcttgtgtcaggcaaagtactcagcatttacaaatggtattacaatgatcttatgagataggtagtataattatttccatttaaagggcgagaacaccagagtttggagaaccacttgtcaataggcagagttcattgcgattctctggcctcaactgggcccttattgcagctgccacgctgttggtttcttcccagtggactccttgctgcattctcaatagttgccctagaaaatcatcaagttcttaatcccaggccagatgacttctgtggtttctgtaaaatagtttcctcgatgggtcttctcttttataaacagctgttctgctccaccctctcattgctaaggccaagatttcttggacagcacctgttctaagcatgtttggtgcatgactgcattatttcatttaatcctctctacaaagtgctgaaagctgtgaagttggttctgataacatccagaacctccccagttgattctgcttctccagacttaaaaccccacagcatctttgactctgtcactttacacgaaccctatccaagtgaggagctcctggatttcctcctgtggagcctggtctgttctactgggaagagtgacctgccatgcctgcatgctactggcaccaatggtgtcagggctcagaaggaccatcactgtgaaatgcctggaaagcccactgagaaaactgcttaggtttatgtcctactaacttcataaccagagaatgagacagttgaagacccttcatgtagaagcaccaacaggaacaacagcagcaaggctgcagagaagagagatggacctaaggaacctccttgtaagtggctttttgtatgagaatctctaccataccaacaaacaaatgaacacacaaacaaaacaagctcaagatctcaattctataagagtttcaggagacaagcacaatattagcaaatgccacattgtaaccaacaccagcatgccatcctgctaacttggtttctggtgagaagtcagctgttgttcttattgaggattgcttctgtgggatgagtcacttctctcctactgctttcaagattctctttgtcttttacttctggtattttaataatgatgtgtccaggtgtggatatttttgaatgtatcttacttggagtctattggcttttttttatttttttttggaagtgcagtttaatgttttacatacaatttgttaagtttacagacattaattcttcacatatttttatcacctttctctttttctgctccttctgagactccccattatgtatatgttagtatgtttcatagagatctacaggtttctgaggttctgttcatttttcttcataattttttttctttctgtttctcagtctggaaaatctcaaatgaacaatgttcaagattgctgattatatcttccacctgatcaaatctgctgttgagctcctcttaaaattttccttttagttatctttttaactctagcattcctatttgattctttttttttttttatcatttctatctctttactgatattctgtgttagataaacaccattttcatcctttcctttagttatttagacatggttttctttaaccctttgaactaaatttaaagactttttctaataagttttatgtctgggcttcctctggaacagtttctattaattgattttgtcctgtgtatgagacatattttcttgtttccttacatgtcttgtaattttctgttaaaactggacattaaaaatgcaatgtggcaactttaaaaaatcagattctttctctactcctcaggttatgttgtttttacagtttgttggtgtttttgttttttagtaacttttctgatgtaattgtgttataagtctgtattctttgtcttgtgtagccactgacgtctctgctttgttagcttaatggtcatctaatgattggagagaaatttctttaaggatcaggaactagtaagtctctgtcaatgaaaaagagttatactatgtaaaatatttgaagagatttattctgagccaaatatgagtggccaatggcccatgacacagcatttaggagatcctgagaacatgggcccaaagtggttgggtaacaacttggtgtgacatattttagggagacataaggcatcaatcaatacatggaagatgtatattggttcagtccaggaaggtgggacaagtggaagtgggggtttccatatcataggcggattcaaaggttttctgattggtaattggttgaaagagttactatcaatagaaaggaatatctgggttatgataacaggttgtggaaaccaagattttgtcatgcaaatgaagcctccaggtagcaggcttcagacagactagattgtaaatgtttcttatcagatttagagtctgttctgttagtaactccaaaaaggaggagggtattaccaggtttgtccagctctgccttcccatcatggcctgaacttctttttcaggtaaactttggaatgcccttgacagagaggagggatccattcagatggttggggtaggacgaccttagatttttctttttggtttacatctccaagtttttgctgaggtgctctacatgcatgttggggaatgtcctccacactcatccaagcagttgacaattccaccttaaacttagattttgacaatatcttcttgtccagaactttaagggagccattgatgagggtttaggaccttctaagatcttttccaagcctgcacacagctctgtgcatgtgcaaagcctatcttactcctgctcatggccttccagatttcccagaatatgtcagagcttttcaaagcccctatgaacatccattctccagttttcactttaagctttttaattagcctattgtttgttgcaactattatccactatctcaagcatctgtgaagttaaacaattgcctctaaatgtttttaacaaatgcccctgaagaaatggcttttcacactgggcaaactccaagtcagattaaataaagacagccttgcaagtggggtctttcagagaaccactagacgggttttctctgtgactgggggctgctggttttcaaggctaccatgaagctggagaaagggtgatgcgaatggggcaagttaaaatgtcacaaacccactattctaggtgaaattcagttgttttgcttgagcaaacaatccttggatggctgcaacactttggtaaatttccagagttctaaaaagttgattctgattatttttgtcacttttctcattatttttatagaggagagaattttgctgagatcaccggattgcattatcttttccaatattgtctaaataaaattaatatgttaaattataaaggcacataacaaaccatcttactaaaacgattggtccatataaacaaattcctttggatttaagtagtcagtcgagtgactcacacaccttttctgaccaccattgtctgactgctttggcagactccaaagcctgggctgtggtggacctgtatccctactccctcctctgcgtgctcagcactggatggttttactcagcagttagcatgaaaccctctcaggtagtaaagtcttttgaagatataacgtgggagcgttcaccagacatcaagaaaattgcatgaacaggtcctctcattagagggacacgctcccaactgttagcagagttggaattttccacctactgtggctgcaacattgatcctgtagaagtatgggaatgaagaataatgatgctcactcttggggaaatgggtacccaggaggacttcaaggtccaccttctaactccttattcacatttcataatcctttcactactttgatgcacatgtgctgtaccaatctacaaagcattacttgagggcaactctgccgtggaactcatgctcccctgttaaaggtcccttcccagcctttgccatgggtcccttctttgataaaatgcaggctaccaaaagacttgcatggattaattattaattaattttgtttcacatcaattgtaatgaattcgtatggactatttcacctatacacatttttattgaactaaatcaaacctaatgaggtttccgaccaaagtaaagaggcctctcctcagctctaaagaaagaaacatggcagtaggatgtactgcattcttagggttagactcagattttctactggcattttgtaatgtagtatttcaaacatatataaaaatgaatctaccgtctacttctgtcacttgatgccaatcttctatatcacccttgtgtccacgtcacacacacttctcaccccattcctgctttaccttgaagccaatttcagttcttagataattttatttgtaagacattcagcatgtatctccagaagataagggtcgttcttctgtgacagttttattgaagtataatggccacataataaattgtacataatggaagtgtgtatttgagaagttttttatgtttatgtctctgaaactatcataacaattaaataatgaacatgtccatcacacccaagagtttccttgtgctattttgtagcccaaaatacatgctgaatattttaaaactaaaatgtgactttaacccttcccctgctgctgtccaactccttcccccaataggcaaatactgatctgcttgctgttactatagattagtacacttcctagaattttatgtaactaaaatcatatagtatgtgctctttctttgtccatgttcttttattcagcatcattctattggattcaataatgctgttataggtatcaattgttccttttttaaattattggttagcattccattatatgactacgtcacaattggtttatccattcacctgctggggtacaactgggtgattttcggtttttggcaattacaaataaagctattatgaacacttgtttaaaagcctttgtgtgaatatatgctttcattttttgtggggtgtaaataaccaagtgtggaatgactgagtcatatggtagatatatttttaacttttaaaaaaacaacaaaatgctcttcagcatggtcaaaccattttccattcccactagctgtgaatggagttcctgttggttccacatccttgcaaacacttgatatggtcagacttttcaatttcatccattctagtgtgtgttattatctcactgtggttgtagttttcatttctctaatgactaaaggtgttgggcctcttcttgtttacttatttgccagtcctacaaacgacttggtgagatgtctttttcagatcttttgtcaactaaaaaaaaagtatgttgcttttcttcttaacttctttatacattctggatacaaaacctttattatatatatgttttgcaaatattttacctcagtctggggctttccttttcattttcctaaatgtcttttgaagaacaaaagtttatgttttatttttatgaggttcagtcaataccttatttctaatttgtgttttatctattgaatttaacagatcactgccaaaaccaagatcaccaaggttttctctattttctcctgttttcttttaggagttttatagttttagttattacatttatgtctatgatctattctgagttaattttttatatggtatgaagtaatgacggaggtggaggttttcacttttttctttcttttctttcttttttgcatatagttactcaatttttccagcatcatttgatgaagattatactttctatgctaaatttctttggtgcctttgtcaaaaataaattgaccatgtaaatatgagtccatttctggattctcaattcttttctacccatctgtgtacccatcttgacaccaatcctactgattacagttgctttacgataagctacagtaatcacaaagtaaattgtaaagctttataatcagctttataataagaatacaggacttgagaggtttctagtgtgatctgagagaccaaaatagacacccctttaccaactaagacagatcttaaggttagggaaaaagttacctataagcccagggtttagggcttggctggcgtggcaactccctaaattcctatggttacaagaaaaaccacacccttgttaaactctcaacagtacagctaatcaggcaaattgtcagatgcctcctaactctggttggacagaggactggtcttacaaggattctttccagatgagcagctgtagccctcaagtccctttggagagcttgtgcacaaactgcctttgtgtctgatagctcaccttttgatgtaaagagccaaattccacctcattttaatgctaaaatcctgcccctaagtgaacatgggatgtgttacatgtatgtttatccattgcccatgtagttggctcccctcataaatatatatagcttttcccccaaacctactgaatatgcatgactctattatataataccgaccctgtaaggcacaaaatccaagctgcccttgccctctttgaagaaggagcatctttgctccacactggaggctatcttttcccagtttgcaaacatatcaccaataagactctcctttctactatttagccctcctggtgatcttctggacaaccccggcttgccccaaagttcctgtccccacatcctggagggcctcgtgcctctctgggaagtgagactgggatgcaagagccctttgaggtcttcccctgccttgacataaatgaaaagacagtaggggagcctggctcagaagaaagagttgcagagtgtggtctggatcacccagcaggaccagttatgctgcctgcctgccaggaagtgttgaaaagtgacaaatgagaggtaccaaggaggtgggtgtctttgattctacacaaagatgactaggaggacaggaaatagcagcttatgcacactgggtcacctataggttcagtcaagattgtgatcttaaaatatagaagacctgaatggcctcctttctatttgtctccctactgaaaaaataatcccataccatgtttttgggtattggagaagggaacacatttgaattatactgaggataaaacttctaagaattctcacagggctcagaggagaggccatgactggcttgtggggcaggtaagcagtagggaaaggaaggtgggtgagtgtaaaggcacagtggtgaccttcagcaaggcctcataggaaagagaggaggtggggaatgtaggtaattcttgttaggggcaacaaatgagtattagtgagaatgaatagatggtgggggaggggggacagaaactaacctgtaaattattctcttttgaattttaatgagcctgagagacagacattatcttgtgaaaaggtccatccaggtacgagatttcagggaacagatggaaagcaattgctgtccttggtgggtccaatctttatacagataaccaaaagccttttccagcatctgcttgtctccaagggcctttaattcaaaatattcatcatgccagggtgccatatcttggggtaaaattattattattattattattatcttaatgtacaaaagtggagagttcagattccctttctttgagcaaaatttgcagaagtaatgacctaaggacattcaccaaactcacatttccagcacaggctggtttccagccaatgtttcccagctttcgggtacgggcttgcattccaggagctgcttttgcaagtttggctccatggtccaacgcatttaggaactgctgccgactgtgtccccttttgaagatttgtgaaaaaatcaacatatcaaaggccctgaacccatgaaaaatgctcaaaacaattagtcattagggaaacaaaaatcaaaatcacaatcacaattaggtactacttcatacccactgggatggctataataaaaaaggacagacaataataagtgttggtgagaatgtagggaaactggaactcgtgtacactgctggtgggaatgcaaaatagtgcacctgctttggaaaagagtctgggagttcctctaaaagctcaatgtagaattaccatatgacccagcaattccactcctctgtatagacccaagagaactgaaaacatatggtcaaatacaacttgctcatgaatgtttataatgacgttatttatgatagccaaaaagtggaaacaacccaaatgtccatcagtgcatacatgcaacaatgtggatgaaccttgaaaacattaagttaaatgaaagaagctggtcgcaaaagatcacacagtaaatgagtccatctgtatgaaatgtccagaataggcaaatctatagaggcagaaggtaaattagtggttgtcaggggctaggaaggaagtggatgggaaatggctgcaaacagcatgaggtgttttgggtggtgatggaaacattctgcagtgacattgtggtgatggatacacaactctatactaaaagccaatgagttgtttacttaaagtgggtgaactttatgctatacaaattatatctcaatacagatttctttaagtcttcaggaagccctctggtaaagaagtcagcctaacccagccctgcactcatctgaccaccaaagcttttcctcacattggcactctgagaaactggtattctgaagaatatgttttaggaaaaactgctttagacaacaggaatttggcaagaggaactttgtttctgtgaacacatatttggcatgtcagggtacatccttttgtattttatttatatttgatgtgtctatgtcctgtcttcttggtggctttataaacattttggggagggaaagtatgatttattctccttgagttcctccttctcacccatacgatccataatgtagtgcacacataaatatctctaaatatgcagttgggactttgcatcactaatgagttaaactattcaacaaagccaaaaatatgtattatgggcccttaagtgccaggcacagttttgggcatggggatacaagaatgagggagcttatgatccaatctgagaccaggccaggggccatacagtagaggcatctctccctggagggttaagttctgaagtcattcccaaggcacatttttcatgtagttgaaattattgaacaccttaatggaggcaccatatttgagacttacccccttgctgttgaaaagcagacacaaccaatttcttcttcactgttggaaaagattgctttccctttggttgggcaccagttgaacacttgtacttaacagctatcttggccaaaaccgtgtctcctcaaaggtgagtccaggtcaggcatggcggctcatgcctgtaatcccagcactttgggaggccgaggtgggtggatcacgaggtcaggagttcgagaccagcctgaccaacatggtgaaaccccgtctctactaaaaatacaaaaattagctgggcgtggtgatgcacgcctgtaatctcagctactcagggggctgagccaggagaattgcttgaacccgggaggtggaggttgcagtgagccaagatcgcaccactgcactccagcctgggtgacagagtgagactccatctcaaataaaaataaaaataaaaataaaaataaataaaaaggtgagtcccactggggcaaatctaggtgctcctggcctcagcagtatgcaggaaggacaagcacagataagagtgagggatgcactcctctaccctccactctgcatccaccctgggttgtagctaggatggcacacagactgactggcacagtctaaataactttttctttattttaaaaaatttgctgccttgcttacacacttatatgagcttgttctgtgactccacaatcctgaaggtcagcctaaagtccaaacactgggcactgaaggaagaaaatgaccctggagatgaaaaggacagctggctcacaggaaagctgctcatggcaggcaaaactggaggacagagaaacgcactgaccttggatgatacagtttggatgttcattccccccaaatctcatattgaaatgggatctccagtgggccctggaggtgggccctagtgggaggtgtttgggtcatggaggaggatccctcatgaggggcctggtgccgtccccacggtacggagtcttgctctacttatttctgcaagattggattttttaaatctggcacctccatccttctctctgttgctctctctctcacatgtaacatgcctgctcccctttgaccatgactggtcatgactgaaatcttcctgagtccttaccagaagcagatgccggtggccatgcttcttcttcttcttctttttttttttttttttttttttttttatggagtctcgctctgttgcccaggctggagtgcagtggcacgatcctggctcactgcaagctccaccttctgggttcaagcaattctctgcctcagcctcccgagtagctgggattacaggtgcctgctgccaagcccagctaattttttgtatttttagtagagatggcgtttcgtcatcttggccaggttggtcttgaactactgacctcgttatccacccaccttagcttcccaaagtgctgggattacaagcatgagccactgtgcccagcaccatgcttcttctatagcctacagaactatgagccaaataaacctcttttctttaagaattacacagactcaaattagcctggcgtggtggcgggcacctgtagtcccagctactcaggaggctgaggcaggagaatggtgtgagcccgggagttggcgcttgcagtgagccaagatggcaccactgcactccagcctgggcgacagagcgagactccgtctaaaaaaaaaaaaaaaaaaaaaaaaaaagaattacccagattcaggtattcccagcaacacaaacagactaacacatggggtctcccaagataacacactgcaaatgtgggaaaggagcctggaaagaaccatgggaaagaagttgatgtgatcagaacacccccaccgagggcaggcgcttagcagatcccctgtctctgagttagcagcagcaggaagcctcccctgggagacgctggctgcaggatgaggctgccagcctctaccagggacatctggaagccacacttgctggcttctgtggaggcagagggcagcctttccagcaggccactggctctctggaggctcttggggcccatcctaccctcagggaacctggggaggaagtgtcagctgactgtgctcctgggtcactcacggaagccccttttcctgccccaaaatgaatctgaagagaagaaatcctagcgtctgccaagtgctatcacccagccttgcagcatgaacatatccaaggggcctgatgagcagcacctggtctcccactggctcagacacttgaagctactgaatttacatgtaattaaagactcgagtgcagaccgcatttcaaaacagacacttggttagagataggaggccttccccatcagatggttttgttttgcttttcctctgcatatgggccttacaatttgccaaggaaaggttacaggggccaccgttgtttagtttgaagatgagaaagctcaagaatgacctaactactgtcttcaaatatgcagaggcatttattacaaggagggaacggctggctgtttttttcttaaactgcaagaaaaggcagctcagctaaaatcctaaagacctgcacacatggcctccacactcagcccttccccacagcaccttgcacataggaagcacacttcttgccgtaaaacccaggactgcctgcctttgataaggaagcttagaccttgactatgattgaggaaggaggccacggtatctattttagagaagtctagtaggttctgcctggtggctggcagtcaggtcactgagtttatggcagaggggtacaggatcctcagtgacggaggccttattcatggcagggcccttagtgtggctgacaggtgggtcatcaaagctctggcgcagacgtgactgagctgaactcctctgaataatagagttgagaacatggaagcctacagctatgaggaagtccaggaggagacgggagaagctggggaggctggtgctactgctggaagacaggccaaagaggaagaatgaaaaaaaattccagcaggccattgagaaagaactttgaacaacaaatgtttaatagggattgcagcagtgtgatgcagtccccaactttgatttcctgctccacacgagatcctagtgaactgtctctagttattactccttagctccatgtagttccagatcctttcctgtgagtggatttggcttggacagaagagggaagacttatgtggaggtgggcgcttggctgccgccaccattgtggccatctggaaagggtgaatcttcgagaggagagcccagtgactgtcgtgcattgcctgggacagcccagacacctaattctgatcagacagaagtccctgatcagatgaaaagaaaaagcaaagattctgtctgtcctgaccgccctgcaggttaagctgccctgcagccagcagagtgcctggcatacgggaggcaccctgtgcagcagccagggctactcgcccaactgggaggaggcggatggtgggtaaaagtgagcactgggccttcctgatgtgaggcgaggatgtggatctgggaggaaagacaaatgaagaagcaggtggacagccccagctgggctccaggtggggcctggggtaaagtgacccttctgcattgctttcctgctctgggtacccgtaactgctaacagaccagggctgagtccccagacagccttcttgtctggggttcagtctgtgccaccctctccaactcacctactctctattttccatctgcactgagaccttgtgaaccaccgtgaaaaatgcttctcacttccagtcccaagagaggtggagagccgcagtagaacgttgcagaaggagaggcggcttctagctggggatatgggggctggcccttgagcaggactttgcaggatggggtggacatccattgctatatattctcctggtgctgtgctataggaccccctactgtttcaggaataaagcccagcccctgccaggtgcttgcagtccagggggcacccgggtgagtggcagtcagggccaacactgtgtggtggcagggctgggctgggagcctcacatacattttcctcatgatcttcccctgtgaccttggtgatttcctgagatttttgtcagtccttcccgttctgcaagttgatcagtttggccctttggttttcagatttttatggaaagaacttctctcatccctgcttcatatcctttcagttctgtccaaaggcaaatctctgacgcattcccactccggccatctgacgtgtgctgggtcacgagggcaggctgcagcctcccttgcagtcccttgccttagacgcccgcgccagcccattcaaccatcacaaatgcgcagacagagcagaaggttcccaacaggctgcgcctgtgctggaccaccccctttcctccttccttcagctgcccctctttctggatgggtaaaagcacttccatgttttcagaggcgtggagggagcccgagaagagcagatgttgacaccaccatcactgcctgcagcagtgagaccaggggcacagtttttgttgaaagggtcgaccaggaagcacttccttgactctgtcctaaagcctctggagagcccttaaatttgtggtccttgaagctattgtaaaggtaagatttttttttctcctcaagtcctacccatcctgacttttcaagtttgtggtgtctctgataatctctgctcctgttctttgagaccatcccccacactctccactctccaacgtgacacctgtaaagtctcttccagggatctggggctgcattccagggtctctttgctctgagctctctgaggcttcagactgttgtaataaatcaaatggcagggatcttctccaacatcatccttcttccttctgctttcctatgagggctgaaattcaatgtgtttgcagaggactccgtgtgagggtctcaagggaatttccaatttggcgcaagggaaggaagggagagagagactaaaaattgcttgatggccaccatgtgccgggtgctcccaatatagtctcaaactcatgacatctcccagccaatggattcaccccctttaccagttccacctggagctccctctcccagacaagcaaaggccgtgttgggggactctgaagtcagctgcctgccattccatctcaggtgttaccgtgggaaagttgtttaacctctccgagcctcagttccttcacatgtaaaatggacctacaagtttctcacgtagggttgccctggggccaggatttccagataaaatataggatgcctggtataaaagttgtatgggacatacttatactaaaatattatttgttgcttatctgagattcaaatctaactggatatcctaaattattatttattattatttttgctaaatctgacaaactacctgaagtttaagtgacacgtgaatgccaaggcctggcacagggcctaacgcataggagggtctcagtgagtgacagccattgttgtttctgggagtttctgggaaagttatcgagaagacttcaaggggagatggagaagtttatggtttggttggaaatattgctgatcccttgcaatgtgcaggtattattcaggaacaagatgggcaaaacatgaataggacaagctttctgctctccagggactcccttgaagatgtgtcacaaccccaagccagtatggtaagtgttataaatgcagtacatacctgtaccaaatgctacacaggacagagaagtcactcacctgccagggcactggaggccagaactgccaaggaagtgggcaggcctctcgggcaagccttttgaatgtggggcttggtgggggtgggcaagaggagagtttgaggttctccaggtggtaagatgtgcatggtcggctcagggctcacggccagaacgaaggcagaggggaaggtgtgaggtgaggcgtgttggttgtcagcggggctgggcccatttttcatagacagtgggaactcagtgttctaattattttttcttttttccagtttttaaatatataaaaatgtcactagaatgcttttttctctggacctctttgctttaaattggactcttctgggaagtccagtagttcaatcaagtcctaggtgatggtttctctgtgttttccatgccagcagccctgatggagagtgcagaggctccgagaatccactcttgcataaaacgttgtcctctcccgccccacgcttgacttgccgtctggcagctctttctcatctgggccatgtcccggtggagggatggggcagaagaggccagacagcaggctgtgcccttgctccctgctagcagacgcggccttggcctattctgagctcagcagttctgtttctcctggttgctggacgcgggccatggcatttgctgtgcactctgttatctggaactctcggctcccttggctcacccgtctcccgccctgcggcattctgcatggcctgcatttgacaggcccaccccctcattgcctggggaacctgcccacgtggcatttaatactcataatactcttggtgtggggaatggaggacaggggagggtacatagtgacacagagcagacattatgagggaaactttgatatataagtaagtggacaagggagtgtgcaaatatgatcatacacatgtgagccatatttatgtaatcccatatacacatacataagcatgcatgcacactcacaaggtggatggattactgtgattaccactcaagaaccattttggaaaaacctctcaaatcatgtttttcctctgctctcacactgcaacagcaatcaacaacagaagaaggcttctgtgaccaaatgtgtggggattttccccacacaccaagcagtggacaccagctgggtgtcctccaattcccttccatcactgcctaccaggagatagcatcagatcccacaacttaagagctcagtcccacaagactgcctcccactttccaccagtctcaagtccaggtctttggaacttctgactgacccacttcaagctggggttcccaagaccccctctttgggttccatttgctagagtagctcacagaacttgggtaaacacttaacaattataggtttgttagaaagatattttaaaggatacaaataaacagccagatgaagagatacacagggcaaggtctggaagagtccggtcctcgtggagctggggcagccacccactcggcacatggatgactactccaccttcctgtctgtctccacgtgctcagctctctgaacactgtcctcttgggttttctctcccttccttcctgccttccttccttccttcctctttccttcttctttccttttcccttcctttcgtttccttttcttttttcttttcctttctctttctttctttttcttttctttccttctttccttccttcctcctttcttttcctgtcctttccttccttttattttcctttccttttctttctctttctctttctctctttctttctttatttctctctctctctcttgctctgtcactcaggctggagtgcagtggcacaatctcagctcactgcaacccccacctcccaggttcaagcgatcctcctgagcagctgggaccacaggcacaagccatcatgcccagctaatttttgtatttcttttggtggagatggggttttgccatgttgcccaggttggtcttgaactcctgggctaaagtgatccacccaccttggcctcccaaagtgccgggattactggtgtgagccaacatacctggcccgtcttgggtttttatggagccttcattacatggcatgactgacaaccatgtagaaatgtgattgggcaaaaagaacacaatctaaacccagcaagacctgcccgttcagacttttcctagcctctctgtgcagcatttcttcctttaggggctggggcaggacctgctctgaaatgaaggtcttttgacccacaatcggattagagtcccgccttgggcaggagaaaggagaacaggaaaaactcagagagagggacgttgtctcctgaggcctaacgctcccaacattataacaaggactatgagagtgatgagccaggaaccatgaatgaaaacctatgcatatgtatcataacaccacaggcacataagcagagagaaaaatgcctagaaagatattgaaaatatatccaataaggtataaatgtaaatagcagtggttagattatgagtgactttaattttcccttccaatttagctgtattttctagtttttctgaaatgaatatgtattatacaataaaaagtaatacaaaaagaaaaaacaagttattttctacagtatctcatagaaatcagagcactgcttttgtgagcataattttgtcagtgagcccaagggggtggcatgagagtgtgaagtggggtctgcagcaggcagcatggccacttgctggctggtctccaccagcccttcatctctcttggcagctggtctggagtctaaactaggccctgcattgaactctgtggccctcagtctcctccacgtaaaatgagaggattcagctaacatcccagggatggcaaatcagagatggtatgtgagctgaaacttctcactgattccttgggaaagatccaggttcctcatgaaagacggccgtaattgattatgatatctgctatggcaacccagggcaaggggtgccaccaaccctcccagctcagcaggcagcagcagccccgccctcctgggctcccctgaccttccttcagtgcctcaattatagctgtcattgtgtttagcaattatacagtgggagttctgttgtgtttatttttaaattgccaataccagacataggaataaatgaatgatgaatggattactcagaaaacaattactaaatgtgaacgcaattgctaaacaaaggtgtgcagttttccaaggtactggaggtctttgtttagacacatcaattctgctttattactttaccatctaaagcatgccaggttgtaaatgacagtgtaaatctccatgacaatgtcaatgtcaatgtcaatgtaaatctccatgacaatgtcaatgtcaatgtcaatgtcaatgtaaatctccatgacagtgctgtcatggagacagcactggctgccagtctgccattcatctttaccatgtttggactctccttttatggtgtagtgggtagagcaccatgaagtgtgtggatccaggctgcgcccccttttggctgggttatcttcagcacatcactttaacttccttgggcctcaggctttcttgtttatcaaggtcccttctggcttcagaaactccatgcccttgagttggctctcagcctctgcagaactcagattggggctattctgatgggaggtcatttgtacctgaaaattcgagcagactttggagaccctcacgtcctactcttcctcccacatcttgcactcatcttttccaaggagacttctgccatgccagatctggaggtgtccgcctcccttctcctcccctcccttccctctcactctccccagtatctgtccttttctcctctttccttttacctatggccctactccaccctgccaagggcccccatgtgccttcctctcctccagtcccagtggggagttattcttgtccttctacctgttccagcagggtcctccagaatcctatccccataccacctcatctcctcaggccccccaacaaaggtgctctgagctgactccttatcatggtagccggttgtggcacctctccctctgctgagggacaggcacctggatactgtctggttgagaaaaaacagccctgtccagcagctccaactactgtcttccagtgtctgatgcacgatgatgggaactgagccatgtgcagtggccaagagcttctcatattcacaggctgtacccgaactatccacccaggactgcagaggcctcctcagaggctgccacctggcccccaccccagcttagctggcctcatgtttgttagaggtgtttccacatgacagtggcattctttttttaagattttctttttcttgagatggagtcttgctctgttgcccgggctggagtgcaacggcgcaatctcggctcacgctcactgcaacctctgcctcccaggttcaagcaattctcctgcctcagcctcttgagtagctgggattataggcatgctccaacatgcctggctagttttgtatttttagtagagttgggtttcaccattttggccaggctagtctcgaactcctgatctcaggtgatccacccgtctcggcctcccaaatttctgggattacaggtgcccagcataaaatagattttcaagaccctcaaggatgctggggcaggttcagcagctgggcgaccaatatcctttctaggctcctcctgagaagtggctaagcctccagcctgcagggtggtgtgagtaaatgggagctggcaggtgggcacagggctcccaatccccctaaatcctgagcaggaggggatcccagagacagagggaacacaatgagcacccacctggcccgggacacagaagcttctagaagagcagaaaatatggcccagcacatggcattgtttggaggcaatgagaaagccctgtcatgtgcccacctccacctactgtcttggaccttcctgagacatggagactggaaagccttgtgggcacggtacggatttttaagtggcttgagcgggcaggaggcccagggttgttggggaggcctcttccccattggcgctgggcccttcatcagcgattctgctccccagcagaaaatgaccaggggctccctccccacactggtggcgtctgtggctgtgctggagacaagttgaaggagccacgccttgcatccctggagcctgactgtgcccaaaggtcctcccagccttgctctgaactggctcaccactcaaacctgcattactcacaggccgtgccatcccctctgcctgggacaggaagcagagcctccctgccatcatcagctgattgccaagcgccagacctgagcctgacccaagtgttgccataacacaggggctgtggctgtgcccttgtcccagaggaagaagatgaggccttgacaggcaggcgatgggtccaaggccacaccactggtgggttgcagggcaaggctggaacccaggtcttgctgattcagatcagaagttaacgcctacactgaccagagtcaaacacagagctggtatgtctcatagaaaaggcacagattccttgtcattacaaacactctggttaatgctcagatttttgatatatcctgcatgaaccatttcagctcaaggaaccatgagtccagtgttaaaaattatgcaggaataagagtgacagattctagaccaaagacctggattttagttgactgatttgcctttaggtgtgggccctttggtgttattaatgggggtgtctcacattgggactagaagggtgggctttggagtctgcccagactcttctaggcctctgtcttcttctgggagagaggaaaaagtagcatcagtgctctcatcgggtgaggaggaaatgagcaaatgtgtgtgagatgctcaggcctgcccaggatggactatggctgttaatattattagtagtattaaatgcaatggcctgaggccaatcacttaacctccataagcttccatttcctcatctgcaaaatagggaaagaaaaattgctgctgcacttgattgctgtgaggttcaaaaggaaaacctctgtatgctgtaaataattacaccagcccttgcaaccaattaaaatcttctccctgctttaaatggcttgattagacactcactgttttccaaggctgagcattattgggcattggcgtgtagtttttaaaggaagtgtctggacaattgtgtctgagaatgcagtctcctctcactctcagctcctcggagttggtctccttctcatgggctacatagtgcattgtgaccaatggagaatacacacctttgggagaatttgcgggcagggccattttcagccagtacgatgtctttgtgcaaatacagaagggacctccttccctgggacatacagagaacatgggcatgcatgcaagctggatttcagcgccctcctaccccactgaccatctccctcctgtgaatggcagccctgtgtgcacataatctgcacctaggttgcaaacttcagtgtccttggggacaggcagacggtgtcagtggacgtgagtgaagtcacctgggtgtgaggcagtaggaagggtggggactacagccaactgaagcgcccagtccaggagttgtgggagcagctgtgaccagctccaggtggcactgccaggtgcaggtccaggaaggccaggcctttccatttatctagagaaacctagatatctatataaagttttcctgcttttgaaaattactgtgcacgtcagaaaaacacatcttcgggtggaatatcgtgtgtgggtcacagctgcccacctgctctatgcaaagcccagtcacaatctgaatcctgacaccagtgagagggggggtgcctccctcttcccctcctttctccttgtcttctcgccttcctttccctccttgaccacctcctctgacccaaccccaaggcctgtgggcttccctctccctgcctcagttctctctgttcatggcctcccctcggacaaccacaccacctatcgaaaaactctttgcccacatcctccctctttccgccagatgctctcaacccccacccagcattagatcgctccctcctgactgccagctccttgaagccaagagaccttgcctgacgtggaatctgttagtttaagatatttctctatgagcagatccaaactcctcagcctgctctctgtgacccacctcccactgtctcccaggaccctggagcacctgctcactgctctcattgaagttattctctgagcaaagcctgaccgtcttgcttctgtgccttcattttagttgtgctcattacctatgattcccttcttctcttgtcgaccagccctgcaaaacttaacatttaattgccttaattcttccactgaatgtccatgaacaacctggcttccctttcccagaatcctgctgttgagagaaggattcaggattggaccccaggaatttcttacagtggcagttattacctctccagggacatagccttttaccaactggaagttgctgggtgcagcagacagatttgcattctttgtagtactttgtagtactatttgtcctgcatacagccagtggtcaccaagaacttaattctcacctagtgatttccatcattttttctttcaagtatctagagggcccaaagtagcagctatgtttcctaaattcaggaagcaccactcctctctgttgtctcttatcccatatcctccggtgctgtgtttccacgggatctttcctgggtgtgcaggaggagccacggacttacccttggggggtgagtgtggccttgtgttttgctgttgtttttgagtatgcaagttcctgttcaagaaaagacctttccaaaacaaccaggtgtgccaagaccgtgctggacacaccagctagctgcttgcacacccatcaggccactgctgcagctactgccccggggatacccgggcaaccaataccaactgcccaaaagaggccagcaggcaagtggatccccccacccccaagtatgtccatagccagggccatgttttgggaccccagagagaatctcttccctggtcttacccttcatttctccactctctgttttcatctttccataatcaagtgagggagtgatgagattggctcccagtccctcaggcttctgcacaagacaggcctgttcccaggtggctgttctgcagaaaattcgcatcttaagattgtaaaaggtgttactggaataaaaggattctgtgatcaaagaagtttggaaaacattaacttaaacaaaagttcatcaggtttctttactgcaggacttctcagagcctttaatgcactgtggttccccaagggggtgccaggtcacagagcatttttcagccttttgcaactgtgaaattcatttgttcaaggggcatctggagtggatggtgacgaatgcactctgggagatgtggttgtgcaggacacacagccagcactcagacccgggcctgcccacagcactggctcctcatgtggccaggccctctgcccctcactgagccttgccggctttgctgtaattgtattcccatatgtgtcccgtctggcttgatacaactctggccaccgacttccggaatattccaaggcctagcccaggcctgtgtgtcctgagattacctctcgttgctggcagccatctctatgaattcaggaacgaaaatcacaaagccagtggcagggctggcaggcctgacaagtcggtagggaccatgctttgccctttgtctgccccatgctcctggctcggccaggaggcctcagggatctaggaatccagtctctctgggttcacaccaccagacattcaaagcagaacaaaacacagtttcacaatgacttcgagaagtctgacacgggtggaccttaaattgccaccccatgattttaactattattttctttgattctaagatgtcatcaattgtacgacacaccattgttttaagaacagcttgtagggggtgaacaaaaatgaaagaaaaaagaaacaccacatgtagtgtaccgactaattgtaagacacatcctgatttcagaataattaaaatttgaacaattgtgtgccttggaattgaggaaatacactatttctacaggtcggggttggcttcctttttcattgctgctgaggaagctgagatgcaggctccaagcaagaagtcaggagactggggtgctgggcaggtgtttgatctcaaaaagaagtcattgaagtagcatgtggtcaagcctgtgccaggttaggaggtgctggggtgaagcttgccctgcctttaccctctagtgtgtggctgtttatcctgtcaagaggtaacgtgtctcctacagcttcccagaaggcaaggtggtgtgtgcgcctgtgttttgtagctgtcagaaatagctggaccattcaagtgtatgtgaaaccagctctgtaagctgtgaaatggagcatcattctttttttttctgcaatggcataaacatcgccactaattcctaaagatacaatgaaaacagaaatgtattaagagtattttggaatgactctgagctgatgacaacccttcactagctcacatcatagggggactcactcacctcttcttcatccaaggaatcccacctcctgcttcctgggtggagtttcctgggtgaaccccaggaggagggaatctccaccgaggtggtgatgtttgagctggttcttagaaaacaggggcaatgatggggcagaagatattcaacagaggaactggggctggagataaattgaggagcaatgagaagtttgctgcgagggcacgtgagctgggaggtgggaggtgaagcccgagcaggattggagttaggctgatggtctataccaccttctcactgagtgatttttacatcttgttttcaacaaatcagcaaagacactttaaatgctgtcatgagctggctgcaagtgttcaagtggtgccaccaatgctcttggttgtgcccggatcgcgtgctccagagcagagctcctgtgcagcctgttaccatgccccatgccctccacctcaggaggctgggctcggtgttcctcctgctggcacctgcttcccccgggcacaggcatggctaatttcactcaggtctgggccggcttccttcccgaacctcttactgttaaacatgctctcctcattctgtctcccctatcatgcctgttaccccgtgtgacacttgtcattcatttgtttcatttttataatgtgaactctgtggtggctttgctcagtcctgtctccgctgtgctcagaatgtggcctgacacttagcagaggctctgtgttgattgttgctatagaatgacactgttctctgagttcttccacatgtattactttgtttgattctcattccttttctgatttgtggatgtaaaaattatctaaaagacgataaaagaattacccacgatagttattgcacaaggagggagagggacacgcaaccccacgctctccccgctacagcgttaaccttcaggatgacaccaccctcgacactcacttcatgatggcctgcacatctgaccttgtgcaggagcccgcagcgtgggattgagcagcctcctgctccaaccagctgactgcccctcagaggggactgaggtgacaaaacaggatcccatcatttggtaaacaggactcaagcatgaagtctgaggggtgtggggaggtgcagggtgggtagcaaatggctgtgaaaagcaagagactttccacgggcaaagctaagtctagatgtacccagattagcgacttttccttaaaaggtttttccagccaggagcaagggactgggtgaatcatccctaagacgggtgacaggaggcaggaataaagcatgaataaagcatcaggaagggactaggatttaaaactggcccctcaatgcttctacactgctggtgagaatgtaagttagttcagccactgtggaaagctgtctggagagttctcaaataacttaaactagaactaccatttgacctagcaatcccatttactgggtatatgcccaaaggaatacaaaatattctaccataaagacacacacaggcatatattcatcacagcactgttcacaatagcaaagacctagatgcccatcgatggtggattggataaagaaaatgtggtgcatatacaccatggaatactgtgcagccacagaaacgaatgaaatcatgtccattacagcaacatggatagagctggaggccattatcctaaacaaattaatgcaggaacagaaaactaaatactgcatgttcttacttataagtgggggctcaacattgagtagacatggacataaagatgggagcagaggacactggggactcctggtggggggaggatgggaggagggtgaagacagaaaaactacctattgggtattacgctgattacctgggtgacaaaattatttgtataccaaaaccccatgatatgcaatttactcatgtaacaaacctgcacacctaccccttgaacctaaaataaaagttggaaataaaaaaaaaactggctcctctatctgggctcctctcccttcttaagtcctaggagagttggccaacgaggccctgagtccagacacgccccaccttggcccagtgtccacctgcacctgctcacattcccatgtgccaccattccttgatgcagctcactctctagaccagtggctcccagccactggggtgcatgagagtctcctgaggagccgaggtacatgtgtgctcaagtcagcatccagacccactgggtccagtctccaggctggcccagtttgagaggtgggtttagagagtttctctgcaatagcactgggaatacctactgctgatggagcacctagatggatgcttagactcagaggtgactcggagggcttcacagacataatcataaagatcctttgaacactgaggctcatgaaggtcaagtcactctcccaaagtcactcagctgagaatagcactaggataagaaccccttattttattttattttttgagacggagtctcgttctgtcatccaggctggagtgcagtagcgcaatcggctcactgcaacctccacctcccaagttcaagcaattctcctgcctcagcctcccgagtagctgggattacaggcatgtgccaccatgcctggctactttttttgtatttttagtagagacggggtttcactatgttggccaggctggtctcgaacttctgacctcgtgatccacccgccttggcctcccagagtgctgggattacaggtgcatgccaccatgcccggctacttttttgtatttttggtagagatggggtttcaccatactggccaggctggtctcgaactcctgacctcatgatcggcccacctcagcctcccaaagtgctaggattacaggcatgagccaccgcgccaggcaagaaccccttattgaccccttagaccttctctcaaccatcacaccagcttgccatggagcccaggcttaatttaccttggtatcccagcacccccaagcccagagaagcacggggcttggtatatggtgggtgtttgctatagaccaaatgtttgtcttcaagttcaggtgttgaagcctgatccccagtgggatgatacctggaggtgggacctttgggaggtgctcgggtcatgacagtggagccctcacaaataagattagtactatcataaaagagacactaaagagctgccttgccccttccttcaggtgaggacacagcgaggagtaggctgtctatgaaccaggaagtgggccctcaccagacacagaatctgccagcacctcaatttggacttcccagactccagaactgcaagaaattaatttctattgctcacaagccacccagtctatggtattctgttacagcagctggagcaaactgagacagtacttgacagtgattttcatgaaggttctcccttgctcatttttaagcccactggttcagacagaagcctctgggagagccctccagagtccaccttgaaggcttcattccttctacccagagcatctccgtggagaggaagaaaaagcatcaatgaaatgaggtgccccagcggttctggggagcaattcctctcttcatatgaccatttgggaaacccccagtgagatggagtgtgcttttaagccatgaaaaccatgcacatcagccccaccacagaggtgagcagaaatgtagaatatggtgtctctttctcctccttttattttcagagaaataattagggattctgtggtaggcagcctctaagatgggccccaatgacccccactctccctgtatcctcaccctcatgtcatcctttccctgtcggtgtggaccagtctaagtaacttgcttctatgactagaatagggcagaagtaatgagatgtcacatcttcataggttataaaaagcactgtggcttccattttgggtcctctgtcctactctctccagagtcacacgaccccagggtaaccagccacatgtcacaaggcagcctgtggagacgcctaggtggggagggacagaaccacatgagtgagcttggaaacagatgcccccatgccagtcaaccttcagataagaccaaagcctcaggtgacagcttgactgcagcctcatgagcagccttgagttacaagcattcagctaagccgtgtccatattcctgactcacagaaagtgtgagataacacacatttgttttaagctgccacgttttagggtgacatgttacacagcaatagataactaatacagcttcttagcctggcaagaagcaggaagagttaaggaattaagacagggtgattctggtgaagatgagaaagatgcagatgtcatgggtgaatgtctaatacctgagaaattcagaaaaggatttctagggcaacacagagttagagcagagaaactgaaggccaggccaggcatggtgtctcatgcctgtattcccagtgctttgggaggctgaggcaggaggatcattttaggccaggagttcgaggttacagtgagctatgatcacagcactgtacttcagcctggaaacaaagaaggccacttctttgtttccagactcaaagcaatttattaataccaactgctttgtcctctgacattcctgtgattcccactgagtcacacctctgtattcacggtgtttcagaaattccccagaatttacactggcagaggtgagggcagagtgagggcctcattgctctggacgttggcggggctgtccctcttgggtttatctgatgtccaccttttaatcaataatgactagcctatgacagggacaaggctcaggtctaatgtctgggcttattggaaggctcctgttccttttgttgtctcttccttcctcattcccagagctgctctgaatgcagtggggcacctgccttatccagatgtgctgctcacaaaatggacagaattcactgctctctgtgtgctttacaacaaaaaatgttgataagttgctgttgggaccccttaaatacacttcgggtgagcagcggtttcccctgcccatcccaggctggatggaagtcatccctgcggagggtaaagctcagcctcaggggtcaatctggatttctgtgggggcatctgaggaggctatcaggttccccaaatgtgaattgagtcctggttcacatcttgggtgcttcacgtcgtccccttctcaccgaaggggagagacagctggctgtggctggcttcatgtcctaattcaacaaaaacaacgcacctaagaaaatgcatctaaatacttcacaacatttcctcctctatctgcagaggttggagatgagcatagacattactgatttttgaccctatcaagtgacgcctgcttgaggcaccctgcagtacctgccagtgccttcagacctggagcccccatggaaaatttctgtcttatttcctgctaccaccacgatccttttcttacttctcaaacccatctaagccatattgataatattttgtaccatcaaatactttttgtagaaaagcactttttataaacaaagcacaactaaactcagggcaagagatggctgaactcatcacctgataacccttcttttccacctcctgcctcctcctgcctctaccatgttgccttttccacctctgtggctcatgaccacacaggatgccaggcgaggtcaaatacaaggttgctaggaaaaatcagacaagaaaattaagcaatggccaattcttgccagaaaacactgtgatacccctttgggttttcattgcaggggtcttgagggccacccacacaggtgacttaaatctttcactctcttatcagtctcttgggagagaatgtggatccactggagtggatgtaggccaaccctcttctagagaaaagtacagccacactggatggtcattatcatggtccccaaagcctccatagctggtctccctgcaccgatcgtgtgttttacacccggtctccaccactcaatgtaccacataggggttcattgcatctgtcaccccctgtgttttgtccttccttgtcatcctggggctcctgtggtgctggttggtgtagattgtcactagcaagcaagaaggcccccccaccctacttctgtcctggggtcacagcctggctggcatttagggcacttaactcttccaatgaatcatattctccactcctgcacataacttcctagcatgtctcaggagacatgctgaactctcagtaaactgctttcggagaattatttaaacacatgaataaggatagagagaaatataacaaatgtcatacgcccacatggctttatcagatcttaatattttgccatatttgtttcaagcctttagaaaaaaacacataaaacattacagacacagatgaaggcctccttgatctcattccctttccctactcctcagagatgccacaaccttaaatttactgtgtattaatctcaagcctgttttttagattttcctacagtattcattcctaagtaatataaagtattggtttgtaagttttccattttatggaaatctgtcctgttgtatctatcttcctgaaactcatgattgtttttagatttatccatgcagatacctgttgctctaactcctttaactgctgtataatactcagtcatatgaaccttatcagaattaatttgtctattttctgctgattgtttttcagttccttttcaatttttcactacagataatgatgcagtgaatatttgtgcacatgtgtgagaggttctccagtctggatccatgctctacatcctcaccagcccagtatgagtttcttatgtttgccttttgtgtcaacacttggtagtggcagacaaatgttttggccagtctgatgtgttggaggttctgtagttgattttgagtgtcaacttggccggaatgtttctgtgagggtgtttctgatggggatttacattgaaattggtgggctttcagtaaagcagattgccttccagagcctgggcaggcttcgtccagtcagttgaaggcctgaatagagtaaaaggctgagctccctgaacaagaggaaattctccagcaaactgttcttgggacttcacctgcaacatcagctcttcctggggtcttcagcctgatggccttttgacttgagctgtagcattgtcttctctccgggtctccagcctgccagcccagcatgcagattttggacttaccagcttccataatcatggaagagatattaactctcataatcatggaagttaatttcttaaaataaatctctttctatatacatgtaaatcctatttgttttatttcactggagaaccctaatacacaggtggcatacttttttgtttgcttatttctctgattactaagaggtaatcatctagtcaaatgctcatttgccctttgagctgccttcatccataacttgttcatgtcttttggtcattttttccattgacttgccagtgttcatgtattctggattctggcctttgtcaattatatgactgcattgcaaatactggtttctggcttgacatttaacattttttatgaataatttaaaaattttaaaatacaatcctgcttactaaaccaaatagtctgttaatttttgcattaagggtctttttgtatatagtttaagaaaataatttcttactctgagttcgtaaagatagtcttctacatcttcttctaaattatttgaagttgttgctttttacacttaggtatgtaatcaaccaaggatttgtttttacatgtgtgttgatataaggatctaattttattattcttgtatggataacctatttttcctaagttatttcttgaacgagcccaccccttctttttactaatctgtaatgactcttccgttatatatgaaatttccacagatgcataggtcagtttctgagttctctaattttctattgatctattcactatctatatatcgatattgtactatgttaagtattataaatgtataattagtcttgatgattatcagcttgtcaaatttcacacacaaaaaaatccccttcaagattttggatagaattgtagtgaatttaaagaataattaggagatgatattgacatctttccttcctttttttttttttttttttttttgagatggagtctcacactgtcacccaggctggagtgcaatggcgcaatcttggctcactgcaaactccgcctcccaggttcaagcgattctcctgcctcagcctcccgagtagctgggattacaggtgccggccaccaagccaagctaatttttttatttttaatagagacggggtttcaatatgttggccaggctggtcttgaactcctgatcttgtgatacgcctgcctcggcctcccaaagtgctgggattacaggcgtgagccaccgcgcccggcctgacatctttcttaaatcaacactagtttttccatttaagaatgtggtgaatcactccactcactaatattttctttcatgtccctcagctgtatttccaagtttcctctaaaaccagccaaatgaaccaagaaaaatcaaaaccaagcaacgtgcacatattttgtttaatgtatgcagaaagatcttatagctttagttgaaatataagactcattctcctgttatattttctaattggttataattaatacatataaattgtacccaattttgtgtatatatattcgttggactgtattttcatttgaatagtttattagaaaattctcttgaattttctatatagattatcatatttcctgcagataaaaatattcttgcttcattctaaattcttattctcctatttcttttgcttgtttcattgccctcagtacggcttccaggatactgatgaatagacatattgacaatggacatcctcgtcttgttactgatattgatgggcatgcttccaaagtttcaccattaattataatgtttactatacacttttgatagataacctttatcacattaaggaagttccttgcaattgctattttgagcactcagctcgcttaaacctctcatgattttgaaataaattcatgtcaggctataaatttacctctagatattctttcttttttcaacaaggtctcactctgtggcccaggctggagtgtaatggcatgataatggctcactgcaacctccacctcctgggatcaagcagtcctcccaactcagtctcccaagtagctgggaccacaggcacccaccaccacacctggctaattttttgtagaaacagggttttgcattgttgcccaggctggtctcaaactcctcaaatttctgttgtaatttcttcttcagcctattagttactagggagtgaattttttagttcccacatatatgagtttgagactgtattttagtattgacttctaatttaattgggttgtgtttagagaatatgatctgtgttatttgatgattctagatatttgttgagttctttgtgacctagtatgtggtcaaatttttaaataatctgtatatcaccaactgtttttaaatgatctatgatgaccatttatgtttggccgcaaagttttacacacacacacccattagataatgcttgttacttttgtttttcaaatcttttataacctagtactttttaaattgcttgatttatcaacttttgataaagttaaatgggttgtaatcttagacttgtagttctgtcaatttgcttactatattttgaggtgcgtgtatgttagacacatacatatacatttgggcctgtgacagcttctgagtcggttggtgccttgattattatatagtctctctcctattataatctgtctgctattgctagcatttaaatagtgtatatttttccattcctttattttcagcctgtgtgatttcatcttagatggtatcttggaagcaagacctacctggactttttagaaatctaatctaatcattttctgtcttggagtaggtaagttcccatttgctgtcattacagacatacttcaatttgttattattttgctaccatgtgttttgggtttttggggggggggggtttgggtttttttgagacagagtcttgctctgtcacccaggctggaatgcagtggtgcaatctcagctcaccgcaacctccacctcccgggtttaagtgattgtctgggctcagcctccctagtagctgggattacaagtgcccaccaccacgcccagctaatttttgtatttttagtagagatagggtttcttcatgttggccagactggtctcgaactcctgacctcagatgacctgcctgcctcagcctcccaaagtgctgggattacgggtgtgagccaccacacctggacgtgttttgtttttaaattctcttttttcatctttcctgcctttttctattattctgtgacctaatgagtaatggagggagccccatgaagagtggagtctgccttcaggagcagactctgcctggcatcccagaggagtctgtgtcttgaagcagtcagtgctcccagggctgagccgctggccctgaacaaccattccttgaataaagaaataaagagtgaggctaactcaagacccatcctggctccataactctatttccaaagtcttttttttttttttttttttttgcttaacattgcagggcacctgctctatgctcactgctgggatcacacaggggaatgagtagagctctccctggcctcagacacccccacttagtgagaaggttacctgtggggacaactcccttgccaggtgataatagctatgatggaagcacccacagaatgtttgaaaagatttggcaaaagtggggccacagtgttgcctttggcaacagctaggtgaagctgatcagcagccatccctttgggtaggtccatgctccatttctccactgtcctcaccaaggccagactaggtcaggcaaacaaggcccaagaagccaactttaaggaggcactcatctcccattgctagccttgtacttgcaaagccccaagagtgagtgcttccttaaaacatgcatcctgggcaccttcctagccttgccctagccctagtcctgaccctggtctccaacactccctactgcctccccaacagtgaggccatgtataaatggtcacatcctgcttgctctgttgtttgtctactgctagagttaagaggaatgtgaattttctggtatgcttgtctccatcaaaactgagtaaacaaaatataaaccaaaaagagtcctggacttcacctgcctgattcacctattacattccccatggtcttgagtttgagaacctgaggttctcagcctgattgcaaggtccttgagtgccaagggcaaatgtcccatagtaggaactttagtcagaggagcaatgggaacaaatgtcttttagaaaaataacccttgctttggtggtctgagagctgatgtggactgagaaattgagagtctcctgcaaaggtgagggcatagagaggggagggtgagggcagctgtgctcactgcaggagtcaaaacaaggttggatgaggtaggacttaagaattactagatggctctatcaagacttcctggtcagtggtgaggctttaaacaagaaaggagtacggaagaaagtggacatttgctttgggtaagctgagtttgaagtcaggacatcagagtacaccggcatcacaaggaccattgctgagaggactcccaccaccatacagacccctccctccactctgggctctctccagggcaggagtcccacatggcttctcaagtgtgcctctgctggagcccagcataaaatatcccccagccgggcagccaggttaacttattgttagcaggctgaaaaggaggctgttatttcacagcagagataaaagttaatcacagattaggactgcccagaaaatattgatgacttcatccacctgagtactagcctgggggaagtgttcaccactccttagttgtcagaccagtccagccagttccctgactccctctttaaaatgcaggcccagactttaacaaaagcctggacccatgaatagacagcattcatacgcgggttctgagtcatcctgcagacctactgcgtgccctgccttctagacttctgattggagaaggtctccgcttaccttccgccctgccttgccactggaccctccctcccaccctccctctctcattacaacttttatctggcggcaccatcaccctgggagactccaaaacagaaaaccagacagacagtggttacagaataaaagacctgtgtttgcaggtaaggggatttctccattctgaccatccagattgaggactagagaatctatctctttgggtaagatgaaaatggatgaaattcaagctgtgtttgaaataaagatttcataagttattattgttggttccaaagtattaggcaaaaactgcaggggtacctggggagcccacagagcaggacacaggaagcagaaacctctcttaggatggtacaggcaagggcaccaactctgtcctcctgaactggaggatcaccttcacacattaaagttgtgagctcagctgggtaaaatgcacactacacagatacccctgaagcatgcgacattccccaacacccccagctttggctgtaacagaactagtgtggatgccaaaacaagatgccccacatggttaaagaatctgacgactctttttgtagaggagtagtcgactatgtcgttgttattcccaaagatggaagacagaatcatcagaaattacagtgacaggggtttctgctcggtagtatgccgaaaaggtaaggtccaaaccctcagtctcgctttcaaggccctccatgacccgcaactcccctcctcctcctccttttcttttctaagctttttcttattattgccctgcccagggcctgcacccaccaactgttcctagtatcattggttgatgataccatgaacgatgaaccgtggggctggccttctctccagctcagaacacacttgctttagctcaagactgtccaacccaagcccgcaggatgcacgtggcccaggacagctttgaatgtgggccaacataaattcataaattttcttaaagcattatgagactttttgctattatttttgttgttcttcatcagctaacattagtgttagtgtattttacgtgtggctcaagacacttcttcttccaatgtggcccagtgaaaccaaaaggttggacatccctgcagtctttatgctcgtctaaatgtccacttccttcaggccccaatgtgtcccagctcctctaagaagccttccttgggttcccactcccttggaacttttctcttctgacccctcccctagcctacgttggtcccccactcactcatcctctgggccagtcatttggcacacagtacacgttgtgtttctgtggaagccctatggggagagaatgggttgtgggggccaggatctggaagcttccagtggatgaagaggatgtcagtgctactaccaggtaggaaggctccggattactaagaaccaaagaggtggtgttccaggggtcaaggagagagagagcccagagtgtgcaggccactcagaatacgcaggggaagagcaggatttgattcaggagccggtgggaccccaggagaagacagggagactaaactgtcaccctccaccacagggagttgaaaggcacaagtgcggacaagaggatcaatcaaagctccgttctgttcccaatccttccagtcccgatgctccagagagcaggggaggcacctgtacacaggtactgggcatgattgatgaggcagtgcccaggagcccaacttcctcgaagcgagagaaaggacagagatgctaagatctgcacacttccacattttagagaatttgggagacccatgttggatgtggaccgtggttcttatttgtattattttctgagtggtagatgtgcttaatcccagcacctgcctaaactgatgacaacagcggctttcctactggaaggacattgccacttgatagcatatgctgtacctcgcttgcatgtccctgcttccaagctttggggatttctaggattgttttctcctagtttccttgtgtcacgtgggctcctttataaaatatccccatataatagtgcatgatgtgctctattacaaaacacagatgtgtctgtccaagacagcctgggggcagcgagctggggcgtggcaaggagacgaactggaatgacgggagagccctagtggatgcacagtgcaccgctcttacaccacaagcctcccgccccagcatgatttaacccgtgaagaaagcagagcatttaatatgttctacagatgttttaaaaaaagaataacggcgcttgtcccaagtgtgggatggaggcacacactcttctgagatgtgaagcaaatttcatatctcaaaagagaaaaaggacaacagttcctgctcagtcaccaagtctgattctcaaccctggaacgcctcagcctgcctgagcccagaaatgaggctccttgtgaacactatggaaatgcaatggctgttttgattttccataacggacagcacactggtccgggaggcatatccaatctaaatgaactagcatctgtgaaacttcctagcacagtcccagcacatcgcaggagctgaactaatgttcttttcccttcccaaggaaccctgaagcctttgaaggaaccgtgattgggaaggcatcaacatttgcttttcgctggtataaatttggaccactggtctgcccggggtgtcccctgccagtggtcgtggactgctagggaagcacagcacaccccccaacacccccccgcaaggaagacccttcattgcccaccaatgtcctctttctggcgtccctcacattcctggccgagaccctcccttcagtcacgccatgaggtcagggccacggttgccattgtctgctggaagccagtgcagcacttggagcttagaagatgcacacaactctttgttaaagaacaaagaaatgggagaaattttttaaaagaaaataaacagagagaaagagggtgagacgaagactgtggctgaggctttgttttcaggccgaaagcaggacactcagctcattctcaatgaaacttcaacatcgataattcaaatgtcttagaaattgtacattggaaggggaaataaaatgatttttcagctcttttaggcttacagatacctaaatgaagcatagattgtagaatgttgttcagaagggaattaaatttggatttcatccttcccagggactgggggcactgcttgtcactttgactcaaatggagagtccctgccactgcttgcttgccttcatctgaccacaatgtgctaagcgcccagccccagggtatagctgagccctgcaccagctgcagtgaaccgcttggccgggtgccctcttagatcctccctgccctgttccctggctctctgtcccctgcggtcctcttctctaggactgttgaaacttctccgcatctggtcagcttcacacaaaagggctcctattttacaggctgagagccccttcctgtgtgttggcaaaactgacacatcgcattgcttgggtttaatcttcaggtactttttctgtttttttacctataaaattagtataagcatatgctcccgtaatcaacacaatttagataaagcaagagttcctctgggccctcccacttccatttgcattttcttttctgtggactaactggtcatcttctttatccacttgtctatgaggttgttgatcttggtcttttttcttattaacagataggagttcttcatagagcctagataacaatccagaattcatgtgtatacgcacgcatttatctatatgtatatgtataagcacattacacacatacatttgcacacatacaaatgttagaaatatcttctccaactctgttgcttgtcttttatctcagcttatagaggtttccgattttgaatcagaagtttcacatttcgttgaaggtagacatcactctttctctatttgcttttgtgatttgtgtcttgctcaaggccttccctgtcctacccccatgtcataagcatgttctccactattttctttcagtccttaatctttcttccgtaggtagccaatgtccagcacgtttggtaatgacacctcctcggtgaagcgcaaggccaccttgaccccagctcccatgggtctgtcttcaggggaattttgaggttgtttttgctgcagggtgtcaggaactccttcctctctgattcttggaaaagtttactgtttgctgctggctttgtggtctctcctccctgcgcaggtagggtgtggagggtaatcagagtcagtccagaggttgctcaaagtttcagtttatctccagccactatttgctaactcatctgagaattctgccaagataaacatcagacagaccctcctatggttcaatcagtctgctcctgggaaaattaggacatgtgtctgcccggctctgctggtgttcctgagagtgactggtctctgtgtgacctttcattggccaggctcccccaagggaaacgtccaccagcagaaaaagtaggaaaaaaagccctttatgcagagaaaatacactgcagaaacaaacatagtctaaccctgccttttaaaacatagcttttagactgaaagagttcacccttcctctctccacctggtcactcttgggatgacaatttcaaatcccacataacattcacagtgtgttattcccatgcaattaccttgttaggtttcatacatttagaacacggagcgggacaggggatgcttctccacagtctcttcgttattgggacatactccaacgctcagacagctccacaatgcacctttctcccactcttcattccttttctggcaaccctctttctctctcagaggattttaaaaacatgtcttgctacaaaaagcaaagaatgacagttgcttcagaaaaatacccaactgaaagatccactccctgaccatggagagctcactacagatctagaaacgcgaggcagagacttgaagatgctgcacacatcctgtgtgggagtgggagaaaagctgctgcttccttagcattaaaacagacagggtcatttcagccttgcaggggatgaccagccctcactggaattatgtgatggcatcacatttgctcctcatgtaaacattccagcgggagaacgactgctccctgaagacactcatggtgtgataaacagcagtcagtggaatcaaggcaggggcgaggtcctcttccttctgcctccttctcaccatggcaccttgagagaggccctttgtccctcgggtttttccattttctcatttgcaaaatgaagaggatcccatctacaccgtcgtgtttagaaatgacacaagatcacaaaaacctctgccgcctcgaagatacagaattgctggtgaggctcgttgtctgagagccgggctctgctcccctcggggccaagtctaccaattgttctttggaaaacaaaagttggaggcattaaaactgggctgttccaagtgttctttacgttttataaattttataaggtgaaactcaatatttagatgattggtagaaacgtctcttgggggctttatggttttctaacctggagtggggggacatgttacctcggcaggagcatgtgggctgagaggagggaaccacatcagggaggccggtgactggagagggaagtcctcctcctgtggagggcctggccctcatggattccccacttccaggcaactttgtgacctcagagaagctaacctgatgtgcatgctactgacgttgcccatgccgctcctgctggctgatggaactatctgtctggagtctgtggatggcggacctcctgattgtgtggagcgtgagtttttcgaaagagatctctcactttcatccaggctggagtgcagtggcacacaccaccacaccaggataattcttttattttttgtagagacacggtctcactatgttgcccaggctggtcttgaactcctgggctcaggaggtcctcctgcctcgacctcccaaagtgctgggattacaggcgtgagccactgtgcccggccttggaacatgatttgttaaggtacctctgaggtgaattagaaaaccagttcaggaagttggaaaggagaaattcctagaatcctgtgtaactgctgggttcacttagtatttccagtgccaagagggacccgaagtaaagaggagcagatgacatgggagtcttgccaaatagagagacagggccagggtgcaggggaggtaaggctctgtgcccaggtgcgggggagggaggaagcttctggaagtcctctgggattgtggtgcccatttcttttgctaaagccagtgttaacaagggtttcagtcccaaccatgccccataccctggctccccgatcctgccccagcccaagcttccctgcagtgggtttcaccccgtttcttctcttgcacttgcctctcccctgctaccccgtcaatgatatcatcaaagaaattagacccggattggtcactgcagtacatgactgcatgcagtacatggcgaattccacttcactagcccgatagggtcatctcttgtagttgcctcagctgcaaagtagggttaataatgccagcctggcagactatgtgataatacttagtaagaggactcaggttaagaacattcctaaggtgctctccaaagaatcccagggactgtgaatgaaatgttaaaataacctttctcccttccctgtccctgcatctcatttatccttgagagaaggtcaatgaggtgtttccccgaggccaacttccaggtaacacaaacttcaagggggtacctctaagcacttaaataaatcacgttattcttctagcattttatgtgactgtaattctagaactgtacacatttcctgcctttagaagtagtgtacagggaattggggtgaagggttttcttcaggactcaggagggcaggtgacaggactctccctggtgttgtggtatgcaaatgagcccccgcccatcagtcctgggcccttcaccatgcagaccaagactgggcatcattttgtgtgaattctctccctcttttttttttttcagtttacttgaaggcaatttattaatagaaaacattttgaggagtcctgttcacagatggtgaccatggcaacccccttcctgcaggtgcttttggaggggatggcagtgacatcctcaatccacctgatcttcatacctgagcaggccccaggtccagggatctcagtcctatttccatctgtggcctggagtttgatgtaggccagtggtgtctggctccttgcacctctaggccacatcctgggtggccagcgtggcagcatgtggagaggattcatctggccaccctttaccttcatcccaccagtcacacagcacattttttttttttttttttttttgccagaaagatcagtgacatggacaaatgtgtcattgaaggatgcaaagatatggtagatgccaaatacattctctccttcagccacctgaagtccggggctgatgatgtgttcttccttcttttccttcccctttcaaggtgtcatttctgtgcattatctccagactctgcaccaaaaagccctgtgagttcttagatctgcctttgaagtcccttttctttctgtgtcctgttgccggctgccatctctggctctccctgcctcctcttggctccctaccctaccttagctctcaactgctctttgaggaaaactgagggtagtcagaatggcctttaatagggaggggttgatgagtttgcagcagctcagaggctctcagtgtctgagtcctgcattcttagccctgagcaaacacaagctgttgctgtgggtctaaatgccagatccagaggccctggttgcatttgtataatacacctcccactttgtggctgggtgtgtcctcggatttattttagaatagtcattatctatttccgtggggaattgtgctactagcatggccactttattggaagatccaataaagaaagcagtgggtggtctcttgaacttgggttataatataatcgtattacaataggaggcagcatagtttagcggctcaaagcttaagctgctgcttggtcgtgccattactagctctatgcagtttttgtcctcattaaattactatatgcaaagagatgagcagagcagagcagaggcctgcatctctgctgaatcctgtcaagtcctcatatgtgggcctggcacagattatgggactgagaggatgcccacccctcccaggagaagtggggaggtgcattgcccctggaaagcagggtgagaggggcagggaaggggtggaaagctgtcaggacaggggggcctagcttcatggtggctttgtcacatcccatatttagcccaagatggggctattttggagccgattcagttcctggggatatttttttctttttataagattcagaactactctgagctaaaaccaatctttatctgtaaaacagaaataataatactagctgcctaatagggctattgtggaagttaaatggagaaatgtacatcaaaggctaaaaacagggcccaggcaggacaagcactcaacaacagctagcactcaacaacaagcactcaacaacagctagcactcaacaacagctagcactcaacaacagctagcactcaacaacaatcactcaacaacagctagcactcaacaacaagcactcaacaacagctagcactcaacaacaagcactcaacaacagctagcactcagcagctagcactcaacaacaagcactcaacaatagctagcactcaacaacagccagcactcaacagcactacacagtgttatatgttattgagtgcttatcctgtcctgggcactgttctctgaggactctgttctttgctatctttgacagcatttcttgaatcatttttgaaaattatttttgcctttctttttttatgaaatactatccctatagccaccagacacagagcaatgggataagggtctttttcttctgtttttaacagcacagacttcttagcaaacctttcctggcctttagagtggcctcagaaggacactgtgttgcattcgagggttgtatatcaggcaggcctttaatactggttgacactttttggggtttcatggcactagagagaccactttgtgttcctcctgaggagtagactgaatcaggctgttgggtggaggtgacacttctctgtagtcccctataataccccaagaacccatgcattgttcccccacagaggtcttcacatggcaatgagaggaggcaaactcttgtgagaccttggaagaaatatcaatagtgttcaacaatcctgagtcaagatgagaattctttttaatttcacaggaaccctgagttgaaggaagccctgctcatcctgttaacatggtggtggctgctgggatcagagtcaaacagcatactgaataggctctggctctcttctgactcaaaaatcccagagtagtcttggaccaggtctgaagaagatgctttatatgctgcagaacaggatgtattgggcttttggatcttttcattaagaatgtgtaactattacctcactgtagggtgaacctatgcaactaaaacttgaggcaggatgcattcttctgtctcttaggacaaacctctccagaaagtctccttggaagtgagccatggggcatggtgttgtagttggagagccagccacgctgtgagggaagagagcgctgccatggtctgaatgtttgtgtccccccagaattcatatggagaaacctagcccccagtgagggcattaggaggtgggggctctggaaggtgattaggtcataaaggcagagctgtcattaatgggatcagtgcccttataaaagaggccccagagagtttgtttgccccttccaccgtgtaatgatacagcaagaaggcaccatctataaaccaggaaataggttctcattagaaaccaaatctgccagtgccttggtcttggactttccagcctccagaactgggagaaataatttctcttgtttataagtcacccagcttatggcattttgttacaggagctcaaatgtgttaagacggtagcacttagaatcagaggcttgggggcatgctccttgaagttaaacttggcttgtgactcactttggccaatgaaacgtgagttgcggtaatgacgtctcttctgggaacagacctgcaagcccaaggcttgatacaccatgtcccctttcccctgccacagagactgatggcactactttgggggattcttccaaccaacactcctaagtaaaggtgacagagaatagaaccctgctgagtcaagatggccatatagcatgcacaagagataaatgtgtgctgggcgcagacattgagtttgggtttattttttaccagagcataaccagcctgtcctggcggatatagttaacagccaacagtatcccctaaatgccacattttacacacggccagtggagccttataaatttgagagctaggaatcttcccattttacagatgagaaaactgagactctgagcagtaacaactcacacttgatgctgaaactggaaccttaaccacctaccaccacctgccaagcctgatctgtagcaggcaaccagcacattcacactgaatctcacagacattcactctgggctgagcagacattggcagacactgaccccttcgtttgtttctgaggcaagaagaggcatttctcatgggaaaagggttgaggacaggaaagagggctcctaggaaacacacccatccatctaagtccacaggaggccaagtcaaaggtgtagggtcactctatacccattgcttggccctactgtgcctggaatcccccaagaagccaccagaaacaaaaacttctgggaaaagagacagtgggaatttcctcagacagtaatgagttattctggatcaaatgcccactgggccaagaaggtgagtcacctagtcagtttggactgccatagtggaataccattgatgggatgacttgtaaacaactgaaaattacttctcacagttctcaaaagtccaagatcaggtcccagcatggccggattctggcagggaccctcttccaggttgaagactttaacatctcattttcttgcatggtggaaagagagtgagagagctctctggggtctctttcataagggcgctaatcccattcatgagggctccaccctcgtgacctcatcacttcccaaaggcctcatctcctaatatgatcaccttgggggttaggatttcaacatatgaatttggcaggacacaagcagtcagtccataactgtgacacacaggagaaaactgcaggccagccagggagagtggcaaggaagggaacaggtgcttcctctccacagggcagctgccattctgctgagcatctgcaggtgggaagatggccaagtgtttccagagcatcccattttccaagacaagttggaaaatatagattttctttttaacatgaaaggtcagctcctgatctttaaatcttgataggtcattaaacaacttaaaatgcatgtgtgccaagcaaaacacattccagactgtagcccccaagccttcagtctgtgacctctggaaagatctagcatcattttgctgcttgaaggaatgttactgggggcagaatctcctcatctaaacaaggaatatgtccggaaatgctgtcgcccgcctgacatgtgggtggagttggctgccatctggatccgggtgtttcagaaccaccacctgctgcgaggtgtctgacattccataactagggactcagttcttgtttgggggcactgtctcctggttaaaaataaatgaaccttgactgccttctcaataacttttcccttagaaaaaagcagtaagtatgaagacaagaccctgaagtttggccagtgggtgagatgctgcaaagagggttccctgggatagggcagaagaggaaggaaaaagtagctgggtgtgtgtaccaggaggacttgccccagttcatggtttccactcatggtacccaatgttggcctccaacacacaatcctgaattcccagcaatggctgagaaaggtgcatgggccttcagggagagagacttcagctgggctgaggaagctgttgaggtagagcctctcaaactcagttttctcaaaggcacgcagaatttccatctgtggctatttgtactaatgatgatgtgccctccacacacgcgtctgttcaaactctcattaattttaagcaggctgggagaagacagcctgtacacactgagagagtcaatatacagacaatgtcaagaccatatagaaagacaggactctgacccgcaatctgtagcaatcagcccagaagccaaacaacagctcctatagcaatcagccccaaaattctaggactcgattaataactgaccgattccttaggtttttttgttttgttttgtttttgttttgagatggagtcttgctctgtcccccaggctggagtgcagcagcatgatctcagctcactgcaacctccgcctcctgggttcgagcgattctgccacctcagtatcctgagtagctgggattacaggtgcacaccaccatgcccagctaattttttgtatatttagtagagacggggtttcaacatgttggccaggctggtctcaaactcctgacctcaagtgatctgcccacttcagcctcccaaagtgctgggattacacgcatgagccaccatgcccagcctgattccctaggtttttgtccccacttccaacttaggaccaatgaaagaaagccaaacatgctccctaaccaatcacatgggagtctcatttcttatagccaccttcattttccccaggccaacaccctccactcagggcaacccgaaggcttcctttctttcttctttgaggctttcccactcccctacctgcctctgagtttctgccaaaacacaagggatggtggctgactccctcgctagcacaagctctgaataaatagcctttgctcctcatttggctggcttttgttcatttccacagctcacagtttagttgggggttggggtcactccaggtaggcagcattggccaacgtggttgattaaaatgcacccccacacactaactctgcagaatgcacttggaggaggcaggtttgaagggattgatgtactcatctgttccagatggagggcagagaggctcaagagatgtttgaaatcattgtgttttgaccagaaacttcattagcctgaagacaatggggcaattgtcctggggcagacaaagcagagtgctggggacttggataagctgccacctgagctgtctgggcacagatttccacaggccgatgcccggcggtgaagaaggcagttctcttcctgtgaaaggcagccactgggggtggtggccactcagtcccactggagggggccaacatggacaagtggccctgtcacctccttgctggggcaagtcaccaatgtttttagcaggcaagaggcatctcaaattaaacccaactaaaagagatgtgccttgggaagggaatggcattttctagtataagaacaaaatgttgtcatggacggagagctttaaagacatgatacctttattttgcagggagaagcagttggaaatgaaagaagttgaaatgtacaatactaattgaaaagaattgggatagccctgaaatgtattcccggccccctctctcaccagtttctgatattttgaaaacttcaggagataaattcgagtttttctccagacatggctctacaaagaatcacatttagaggcactgcttggagcttggccagttaggaagaagggtgaggaagactccgcaccagagccctgttggtcctggcacaggcccccataaataggaagagaaggtgctaaaatacctttgttctttttaaagaagggctgccaattacttcaaccaaggtcctgattccactcctgctaattaggctgacatcacagaatttaccagaagaaaagtggcctggaaagccactctccccgtctctaggtttctgtgtgatcatgtgacacagcagttactatggcgattatcagtcttgagtggattgtccacaagttaaacttacatctgacaagtcaaatttgtcagtttggggaaaaagtaaagtgggttactttttttatttttccttgaagagattttcttggctcctggagataccttctccccctttctagctgacaggtttttttccacactgtagttttgaggttgttttattctctcttgtggtctatattgtgcataagaaatagacatagctggcagctgtggccctccatcatgatgtggggataaaataaaacacttcctgtgattcagtgaggcaccaatcataggctctgcctcttccgtgatgggaatagtatgccagcgactgggttttctctccaacaagtgttttcaatttccttcatgggcacgaactgcaccaccaccaacataccatgatcctgcatgtgggcatgtgtgcacatatgtgtgatgggattcctaggctataatgttattttcccgaatgctgccagacacatgtctctggaaatccagtgctctatctctcttatgccttcttgtgcatacaaatgcagaccaggagccagagccagaaaatacatacataaaaccagaaacctcttatgctgatgccgcggaaaaataacagatatggacctcatggaggagcaggctctccataaaccagccagaacccacctaccccaaccccagatgcagacagactggtgcaggtggcccagctggggctgtaggaagagtgtgcagaagctgcaggaagagtgggtcctgctcactgccttctcttttttttgttgttatcttgcactccccatgccaggggacatgggaggtggagaatcctcgtgaagtgcgtggggacagttgaccatcttccactcctcccagtctacccccagagcctctctctctacaggtttgcctggctcttaatttgaggacctgtctctgcagaggccccttggtgataaactcagggtcacgagtcagttctcatagggatgttcactctccagactcacacccactggctgcccttgcagacctgctgggtgccacagaaccagggcacactgcaaccagagcttccagaaactgggaatgctggaagtatccaggcaagaagccaatagctccagggaccctgtggctctgggatgcaggtggcctctgctcaccaagttcatgctggtaggtatgtggatgctgcactccgtcctctgaacaagatggccactttccttactggcagatagtgaaaaagaatccttttagcactgtctaagcaagaggctggcctgcctacttgccagaactttccgtgaacttgccagaacactcctggcctcaaccaagcctcccgcctcagcctcccaagttgcacaatctcatggtgcaaaaggtatccctctggcctgcaccctgccaggagctgacaggcgtccagggtaagccaagatgggtttatcgtgaagctcccagagtgagagggtagtcccagcataatggtgccaggtaggaaggtgcccgaggagttagggctaatgagagccatcatttatcatgaggtgcccacatagtgggcagggccacctgcccttttccagttactcctacaacctggcagggcctcacattcccaccaggagatgtttgcttcctcccaggatccagacaaggttctgggtgaagacagacaggagtggtggagacaatgactaggatccctgctggcactgcaggagagccctcagcggattacaggagggcccatctgctgagaatctgctcatgccaggcaccatgctaggaacattctcattctaactttattctcatccttcagagaaagcctccaatttagaccctgtgattccattttacagaagagaaatctggggtccagtacttcaacaatgcctgtgtgtcccagtgccagtagggaaagcagaatttggacccagaattacagacagaccctgaatcagtgctgtttcttgcattccagtgctccccaaatttcagcaactcatgtgtcaccatgcaccccatttacttgatatttttcttctgatcaacttgaaatcactcacttttaaacttcagcttgtcttaagccatgatattcataaaataatggatttaatgtgcaagtaacactttttccagatctcattaaaagtttcctggccacagagcccctcttgagggaggtgagggagaactggaaggaggaaatatgtagatggaaaggagaggagttagcagaaagcaccagtaaaatagaagtaggctgtatatgagtgagtggacagctcatttgtttcccaggactgcagtaacaaatgcccaccaactgagtggctaacaacaacagcaatttactctgtctcagctatggaggctccaagtgcaagatcgaggtgggggcagggtcatggtcccactgaaacttgcaggggcgggtccttccttgcctcctcctgaatctggtggttgcctgcaattcctggcactctttggaggggctgagtcactccaatctctgcctctgtctccataccacattccctcgtgtgtgtgtgtgtgtgtgtgtgtgtgtgtgtgtgtgtgtgtgagagagagagagagagagagagagaagagagagaccctggctctctttttaaaacatttatttatttatttatttatagagacgtggtcttgctctgtggcccaggctagagggcagcagtgtgatcacgactcactgcagctccagctgggctccagcaatcctcctgcctcagcctccccagtagctgggattatacgcatgtgccaccagctaattttttaatttttaaaattgttttagagatggagtcttgctatgtttcccaggctggtctcacattcttgacctcaagcaagcctcccacctcagcctcccaagttgctggggttgcaggtatgagctacctggccctgctgttttctcctttcataagaacaacaggcattgatgtactatgaccatccaacatgaagagtatgacctcatcttaatgagttacacccgcaaagaccctatttccaagtagggtcacactctgaggtcctggatggatgtggatacagggtcactcttcgacccagcacagatggagcgagtgtgggtgtgagcgtgtgacacacagcagccctgggaagggacgtgtgattgagctgtgcagttagtgagaggcagcctgtgggggagaaataccctggtaaggaggctcaggccttctcactgcgggcctgcctgtgcctctctggaactttctacctctatcaagggagaagctcagacatcgccagagtgagagatgaaatgtatcacaaattaaaaagagaactaccatatgatccagcaaccccatttctgggtatttatccaaaacagtcagcatccttatgctcctagaagcctatttacaatagccaagaagtggaagcaacctaaatgtccaccgacagatgaatggataaagaaaatgtgttgtattcacgcaatggaataatggaatattattcagcctcaaaaaaaaggaaggaaactctgacacatgctgcaacattgatcaatctggagaacatgatgctaagtgaagaaggcagacacaaaatactgtttgattccactaacatgccgtatataaaatagtgaaactcgcagaaacagacaggagcatggtcctgccaggggctgggggaggggactgaagagctgctgctcaaagagcctcaagtttcagtgcagtgagatgaataagccctggggaccggccatgaagcatggcacctgcctagagttaacaagactgtattgtgcccctagaaaccagctaagaggggagattgcatggtaagtgttcttagcacaataaaatcaaattttttgaaaaagaattaagcagaaagaaataaacctttatttggaaaacaaaaacaaacttattatatcgctggccttgaaagtgggtaggggccgaggggctccctggggactgggaagaggccctggctgttgctgctttggtcttttcctgcctcactcttgtgtcttatttccccactagctcagaggtggatgggagaagtgccattgattggggcctctcatacctgggccgccagggccatctccacttacagagaaggaggctgattctaaggcaggagcacatggtggagagcccatggtcaactgggggaggctgtgcccagcacagtggctccaagcacatagcccagtctagaaacttccctgaaggaggggctctgtccacgtcaccaagtttccccagactgccttgtgctggcattcaagagcttatgggggtgacccctcagccatggggtggctgatgggcagggcctgaggtccaaagtctcccttcccacttgcccccctcatacacatgaccccactgggggtgaaggcaaatcctagcattttctgagctggcctttgggatgggctgtcatcacatatctgggatgcaggcccttcccatgagcgctagtcactggggctcgggttcctgcagctaggtgtgctgctcctggagtgaagtggccactgtaggcctctgtgggtgtctgccccactcatgatgttcccttgtctgggaactgcctctcccatccacagaggtgagcctcaaggagtcacctgtgttctgtgggaccttggattagtcagggtcccccagagaaacggagccgagagaagagtaggatgtgcattaattggctcatgtgattacagaggctgacaagttctaaggcctgcagccagcgagctggagacccaggagaactgaccagttcttgacatcatttctcacacaggcctttgttggagtccaaaggcctgagcccagaaggcccaatggtgtagctcctgttccaaggccagcaggctcccaacccaggaagaaccagtgtccctgttcaaaggtactcaggcagggggagagttccctcttgccctcagaaggtcagcctttttgttctacccaagactctactgattggatgaggcccaccacagtagcaatctgcttgacccagtctattgatctaaatggtaaactcatccagaaaacccctattaattaattaattaattaattaattattgagatggagtcttgctctgtcacccaggctggagtgcagtggcacaatctcggctcactgcaatctctgcctcccgagttcaagcaattctcctgcctcagcctccctagtagctgggattacaggcacccgccaccatatccagctaatttttgtatttttagtagagacagggtttcatcatgttggccaggctggtctcaaactcttgaccttgtggtctgcccatctcggcctcccaaagtcctgggatgacaggcgtgagccaccgtacccagcctcctatttagaataatgtttaaccaaatatctggggactttgtggcccagttaagttgacacataaaattaatcacagatctcaagccaatcagattctctctccagaggaattttctactgggacagagagaccagctggtctctgccttggtaggacctggggacctgatgggcagacaactttgctcctggcctccttctcaggcccttgagaattgtaggacaccacccctccctgcccctgtatcttgatcagacgcataccttccaccttagatgagcttgggctgagtttcttgcctgcatccccaccgggacccctgtgaaggctggctcccctcagtcaggctctccctcctctgtggggtcttcacccatccctcgcatgttttcttacggctgggctgggtcatacttagagaactgactaaatacagagtctcacatcctcagtgattattacaataattcgagtgaacacggaagactagatttttatttgtgggagtgtgtgtgtgtatgtgtgtgtgtgtgtgtgtgtttctaacaccagccacttgcttccagagacacatttccatctgtgtggtcactagcctgcaaagttgtggcacttcttggtgcctccttcagggcaagtctgaaatattttaatagacgacttaaacgtcctttaggtagaggtttccagaaaagccagtggagttggatatatggttttaataacaattctagttactgaggcttctcctcccatccttggcttgggtacatacagtatagttaaaactaaactgtcgaaggggaatgatttaaagcaaagttctggccgtgagtgggccttgggaaacctgctttgaggtgctttgttttgtttctggaagagagctggggaggacagccaatgctatgtcggcgtggctgcatttttgcagcatggaagtcggcgggattattttattatcacgctgactggactatcaccctggtcacaggctgcagcaaggaagactgaatgtttgcaactgtaggtgatgaagatgccacagagatggcctaattaatcttctcatctgttagctggggacacagggagcccgacttgctccaagtctcccagccaggctgtaggagagctggattgcaccaaatcagacacaaattccagatggctcaaggacctaagtggaaacgtgaaactttccagtcacgagagaacacctttatgacctcatggtgagaaggagggacttcttggggaagactcaaaaagcacaaaccaagcgacaaaaggctgacacacttgaccacattacaattaagaatttctctctatcttaaaacaagaagaaaagccagtgtgtaaagtctaggtttcccctggaagcataggatggtatgcatgggaagagtggcagtgttggctccctcccagcaccagccccttgcaataatatatgccccacaacagtgctgtgaagcatgcgtccccaagtcacatggaggaagctgagcctggggaggccagttgcttgccacagtcactgatctggtgagtgacagggcaccacaagccaccaccccctgcaatcatcacccatagactcaccaatgcccctctcctcccctcccacctttgcaggaaccaaggtgttctttaaaaaatgaaaatcagactgtgatatcctcaccatcaggtccttctcctcctcacctcttaccacatttccctttccccagctcctgcagtgcgggcctccccagggcctttgcacaagctgctccctcacctgagaccctcttctcacttctccacgtggtcaatgtcactcatcctgaaatgccaccacctgggagaaccctgccctggcctggatgccattcctcttagcactgtacataatttggcttctatgtatttgtttaacatctgtctggagtacactgaatgctcttttgttcctgactgtactcttagctcctaatgcagtggcgggcacataatacatgctcaaccaaaatttgttgactgaatggtgagtccctactgaaatgtttcgagcactgtccctaatgagccatgtgaccttgactatgaaagcccacagtgcctcccagctctgacctacattcacccagctactcagagacaataaccctactgtgtgccaggcaacagggatgcagtgctccaggcagcccagggtcaggcagcatctaccaagagtctaaattcacacagttctcttggtctccaacttgcctggagatggctggcctccccagatgttggcttgcgtttcctgggtggccccctggctatggaggtgatgccgggggcgggggatgagttccagcctccaggaaggatgcacctgagccaaaaggccatagtagtgcaggagccagggccagcagccagtcagaggagggcggagccttcgggacagcagcacgtctctgatgccaatgggacagcagcagccctgcccgccctgagcaggctcccttcaggctgtaactcctgtctattattcaaaaaagggaacctttttcctcctctcaagctttgtacaaaaccatgacgaaataattaagttgttgactcttctttcttcctggggcagaaaacacagccccacagaggatcacatttcacctgtgtgctgcccatctgtgctccaagctcagaagtctacagaaggagccctccaccagccctgcagcagggtccccgtgcttcctcaccagcggggctctctccacgggcttctctgcacagcgcagcatttttttaaaccaaggttctaaaatttaccttgcttctttagaggcacctaggaagccttcgttgcttcagtgagcttctcatggtaaacaaccagaaacaaatcgtaatcatacggggaagggttgcgctggcagggtcgtgtggaggaaagggccagctatgtggattccatctccgctgggataggacttctgaggacgggggagtgccctgagaggccactgggtgaggggccagtgggggtcttgggaatgagggagacactggacaatttttgcggctttctgagaggtgaagttacttgacaggggtaagtggggagagaaaggcagaggggaggagaaaggagcctgcacctactgagtgctcacaaagtgccctgtgctctgcccatgggttacctcaattttctcatttaagtcccttgctgaccctgagaaacagagattatcatcctcatttgatgcttcaagaaactgaggctcagacaggctgagcaacttccccaagatcacacagtgatttgcacccaggcccatctaaagcattcataccgcgctgccttgcatggaggaagggaatagcgtggcctgagaaagtctgaccaatagcccctatcctctcccacctgagctgggatcctcgtgacagatctgcagacatgcagtggagctattccagccacaaggccctcaagcatttgccaaaccaagcatttgctgcaaccaacaaatgaatctgtgcaccccttccaatagcccacacacaatggtttggttcaatgtgtctatgtttgagacaagcacttccaaaaggaaagcacgtgtctggccagtgggacccatagcaggttcagagtccgaagggccatgaggcatccttggcaccgactgccccggccagctgtgcaaggttggaggtggtaggtggggtgtgcattcaccaaggcttttcctcggcattaatctgcttacaagaagactgcgcagactcttgtgaaaagttcaccaaggttacatgcagggggaaaggcaaggccaaggtaggaacggggacctccatggagcggatgacctgagaaagctgcagatggaagatggtggaaagatgacgtgaaggttagggcacaagagtaacaagtgtcctgggctcagggggaagttaatcctagtcagagaaagcagggagggaagaaccatctatgccacccatgagggatggagttgagaaggccccggctctgtaactccaaagctcaggctcttactgggccatcacacagccccctgtgtgctaaagtgataagtgccctacatcagaaagcactcatacctctctaaacagactcaagatggagctggattccaaacccggaagcaaggctctctgcaactcattttttttttcactttccatattgtgctgaacaagtggggagggttgaaggcagtgggatgttcagaatgttggcaagtgacagtgaccagaggcaatggaaagcaggacaggatgtgacttgagcatgttgtggagggtaggagagacagtgccggggcagattcaggtcctccccatgctccgccgggctggctggccctggggaaacggcaaacgagagttagccaaggcaaaagagcttcttaaaagtgattttgattgtgaagtataccactcatattataaaatgcatcacacatacagaagactgtataaaatgtacctgaacgatttaaagaataatcataagatgaacatttgagtatccacacccaatgctaaacaaaacaaaacaaaacaacaaaacaaaaaagcagcatcttacaaaacggtcctgtgtttctctcacatggtgtcttcctccctccctcaccagggctagcaaacctcctgatttttatgtcggtcatccacttgtttttctttataatttaccatttatgtgtgatctctaaacaatggattcttcagtttaaaaaaaaattagtagcaagcacaaagccagctgtgcaaagaaagggcaatgtagccccaataaacagaggccccaagagcacgtaacatgccgcagaacatcagaggctggcctccgctgccccgatgatgacctaattacttggtattccaggaactgggccaagggacagcccggtctgccagaacatcaactccagcagggagaatgggggccatgaggcccaagggggcagagcaaggcagctcatgtcctgagaagcctgccacctcattcccacactggccttgtctccatcctccccatctcctgggaccaggggtattaggagaggggtgatcccgcacagagaccccccaccgcttttgggggtggaagactgagatgcactgaaggcatcgactgctgtgggcagggctggaaggtccctgaccgggggattaatggaggcatcatgagagtggactagggccgctctgtgttgctccctcggggagggagggcaatgatgcaagatcaagcagtcgggggaagatcctcagggaccgggcgggagctgaagacttccaagaacaaagactccggactctaatgctcagtatgaagtcctgtgactaattccccccatacttattcattcaatagcaggcaccccctcacccaccattcattaaagtctgttccatgcaaaaatgtcttctgagactgagttgtgaggtatcagtgaggggctagagttcatctctaggtttgatgtcacccaagatagagaacccagctaatgcagaggaccatgtatccgtggaactaatccagtgagagcagaagcttggaactgggctgtagagagctatggaaccccacagcaatttgaggtgatcttaaccagatgtgtaagagactatttaacccatgcactagcatctgtgctcctctgatgtgctcccatctctctcctacccgtctctctagactagaggccttcccgtgtgattgctggcaactccagtgcaggcactggctggcatttctttgtccctccagcaccacctcctgcctagtgcaatttatggtcatgatggttcagaaagaactttttgaagggatagcccatgccagattttatcatgacgcaactttgcttcaactggatgttagtgtagaatcaatctccttagttatttagaggaagcaggatgttcaagaaggtagacagcaaatagtggacacatttattttagggaaaagaatcattagagtgtgtattcttccagtcgtgcagtcattaatttaactatcataatgcaaatatttaaaaaggaagaaaattaacatttagtgagtgcctactgcatgtttcatatctttgattcttcctgggtttacaaaaagtatctctgaagtcttgtagtgtgtccactgagtttctctagtttcactaaacctccggacagaagagctccaggcagcacagcagtcaccttctgctccctgtcctggccgctcctgtcgggagagaaggctggggcgctgtggggcactgactacaggtctgtgccggagttccccgatgatgctggctgtaagtaatgagcgtggtctgctgggccttccatgcaaagttggctcagaaccagcaccctctccctgccctcaccggtgtggctcctatggggaaacagagtcagagctgaatggaggaaaagctctcagtgagggcagaaaatgaagttcacctggccagcccagacacccaacaaacaaaccaaaaacaaaatataaacaaataaacaataaataaatgccaagcaccatgtgaaacatttgcatctgctgcttcacaaacctacgagtgccaagtgtggtatatgaagatgagcaattctcacatctctctttagacaacagaatttaccaaactgcaagaaaaactgacctccagatgttaccgccacctgatgcatattgaatgagctcaaaacaagcttctgaatttggaatcatccttctcaaattgatggagaaagtgacaaaagtggaggcatttctgtgggtgtggagggtgccgagagccagatgtggcttcttgcagggacacagacctgcctccaagacaaagtattcatttggtggccccgggggccccttctcaggaatagttaataatattaacaactccaacacttcgtgaaattatttaggtaattagcaaataaagattacacctctaatttcttctttaaattctgatttggggccctagactcaaaaaaaaattgaggcattcgtaagtcgaagttttaccactacgagagttagcatttcctagtgtggagaaaaaaaatcagataaagaaattgcactggaaagtgaaattggattttttaaaaaatcaatgaagtaaccaggctattaaaatggaaaataagtctgatgtcattctgaaaaataagggagtgagtcacctgcagagccacttaattaagcacaggaagtaacaggagagcttgagtaattttccccgttaatgtcagtatttcaaaatgagtgaggcgttaggccactctcttttaatctgagagctaaatcagctcttttgccctcaggacatcttgagacatttgaagttgatgaagagcaaaaaggaatgtattaaaaattatcccaactgcactcaaacaaggagaaaactaagctttctactttaggtccctggggcatggagtgatggaggccggggagcaggcgctgggagcaggcactgggagcctggggctggaacgctctctgtacggagtgggggaggcagcccaaggcggcaccgtcacagtggtcatagggaatgtcagcagaggtcttccctggctcctggggattgcagtaattttcatttctggcctgtagcagctgagaggggtggcttctgtgtttgggttttcacagaagtgatgtgggacatttgagcaccttgaaagaaagtgtccgttctccttcctgtcaatgcggggtcatgcggggcctggctggcctcccctcctgcctctaccagccagagcgccctggcttcatctgccccagccaggacactaggtctggggcgctctcccaaacagcagtatagaaatgccccaggcctgccccagacccaccctagggaagcgtggggaccgtcccaaggtgtgcttgggggctctgagtctcagtcctctccaccaaagtgaaggaggctcctgaggttcctgctggatcccaaactagagcaggctctgacaaggaggaccggggctgtcccctgaggcctcgtgtttagagcattccattgtcctccatccatcagggccatcatcatcaaaggcctgttcctctccactgctgggattagcatagtttgcacctatgtcttttggtgttggttggttgttttgtgtctactattattatttaactttgctgaaattcgggaactttaatccctacatctggcctggtttccataagggcttgtttggagaaccgagcccacgggggcgtgagtgcctgcgaaacacagaaagaagccgagacccaggactgaagactcgagactgctttgggcgtgtggagtttgcatccctgatgagtaagtcagtctgttctgaatgatccaagcttaattcgtggttaaaaacaaaaactggccacaaccaggcagctctaggttttagacagcaccctaaaccccaaggaccaccagacactttcccaatattaaccaccaagagtgaaaaatgcataatgctcagtttgcaaagttaacttcatcagaaatgcttctccctcccaggtagttctttattacttcatcttgaaattggcaatgtagcgctgggtttttactctaacttttaaaatgtttctcgttctcccccatcccaccccaaatagaatcgcttgataaaaacaaaagcaaattaatatttggtgttcacgtttttaaccaatcagccaactgagaaccaggtgggctaatcctaatccctttttgaggattgtcctgaaggccagaggccaggtgtggcctccagcctcaggcacccacagactttcaagaggcctcttcctgaggtcctctctccctactttaacaaattctcctcccacatgagatgacacatctgacagtcacccagctgcttgatgtatgcaggtcaagctgtgaactggctttgagttccaatcaccattagaaggtaaattcactgacttgaaagcttactgatgtcatggagtcataatcaaagatctctttgaagtggaagttggtcagtcattgcaggaggaggtaagaaggggtgagataaaaactcaggcagctgaaaccattaccccctggggaagcaaaccccagccctcaattctgaatccccagtaaggcctctccccagtgcaagcaagcccacctttccttagccatccccattcatagcctcatctgcttctgcctcaccaagggtgactgctgttcaaatcctggctcagctgctcaccggccttatgcccctgccctggggaaggccaatgcttggctgcttgctcacctactaaacaagaaccctctgagtgctggtgcatttccctcggtgaagggtttggcttggagtcagggtcttctctccctcttctgattgcgagcctggccggacccttgcctgggtaaatacacatgctctaccctcacctgcccccgacatcccacccacctgcccttctctgccccctgggcctgccccatcccttggcttcctgccctgcctttgacctggcaccagcacaatgtgcgggttgctgagaccaggaacaggttcatgccaggagagtcgtttcctgacccaacgatcagctgcatgagaaggggtgacatcatcgaacttccacggtcactctgccccagagcccctgcatgcatctgccctggggaagcacggcccccaacaactgatataccacgccccagcagtctcccggcctcaggaggacctgcggtcaaagccgccaaaactgtgagagtagcacagcagagctgcctcgatttgtgggaatgcaaagggagcctgggctgctctgccaaagccaaaaccgcactgattttctaccaggcaccagctactccgaatgcacaaacacaccctccacttcccggagaggagacatctatgaagcctgtgtgggccctgcccgctgatgcccagggcagtgggatttggttttttgtccaggaaaggcatggatataaatcatggctgatggggtcggtggctgtgtgttggtttttgggctgccccacatccacccctgcctattggccccagtttccttttggggatgagttttcccccactgtgtttggtgtgggtgggagaataatcttaggtgcctggcctccaccgtggaagtctaggaagtgaaatcctgtctctccctgcctgtggtcacacagggtagggtaggtgacctaaccctagctcacaggccctcaccgaagaggtggcatctgcaatgagtgagacagggacagaggatcagcaggtccagctgggaccctggactgatggcctctgccataagacagggttgtgcttcctgccttcccaggacaaattccctgagcccctcattaccttccagtttgctccgttgagcgggctggagcctctttctcatgatgatagaatcctaactgatactgcaaggggatactgtctagccttcagtaagccactgtaagccccccagggtccctgacagtggcctgggtatagtgtcatggggacaacaaagagaagcacaggccttcaagcaggtgaaatcgtgtgtttttttttttcttttcgttttctctttctttttttaaaaaagagatggggtcttgctttgttgccccggctggagtgtagtggtaggatcatagctcactgcagcctccatctcctgggctcaagagatcctcctgcctagcctctggaatatctgggactacaggtgtgtgtcaccacactgatcttttgtttgtttgtttgtttgtttcattttttgtagagatggagtctgccatgttgcccaggctagtctcaaactcctggtctgaagccatcctaccgcctggcctccgaaagtgctgggattacaggtgtgagtgccgttcctggctggtgtgtttcttctggagaggagtcatttgctaatatctgtatctgctgcctctctcttttggcagagcctctgtctgtgtatgcatgacagagtttttcctctcttaccagtaaattagcagaatatagtttcctttgctgttgtcattcctctaaatgggtgagtattttatgtctgagggaccttccccgcctgggagacaactgattctccaaagcacactagtggccagcagctctgagtgtgccacaaatgcacgtgcctgttccatttgtacaaggaggatttgcaatcactgcatctgctggcctgcccaggacagagccctgtggaacctgggtgctcaccctcaccctgctcacagggatcccccggatgccctggtggctcaggcaagagccctctagtccagaatcctgtcattcatcctggtgaggaatgaagctctggggcagtcggggcctataaaggcagtggctcctcctcccaccatgttcttagtgacctacaatgagaggaaaatccataaatgcccctaacccagttattttaagtatacaatgcagtggcattaagtacattcacaatgttgtacaaccagcaccactatttccaaaacgtttttcatcacctcaaactgaaactccgtacctgttaaccaataactccccattctcccctctccccagcccctggcaacctcgattctagtttctgtctcaatcagtttgactaatctaggtaccttatatacgtgtttttatacaatattcgtccttttgtacctggcttatttcacttagcatgttttcaaggttcatccacgttgtagcatatataagaacttgattcctttttatggctgaatagtattccattgtgtgtacataccacattttgtttatctgccaacagaaacttgggttgtttacactttttttaagctattgtgaataatgctgcaataaatattggtatactagtctctattggagtccttgctttcaattctttggggtacaaacataaaaatggaattgctgggtcatatgctaattctctattcaactttttaaggaaacattaaactgttttccaaaacagctgtatcattttccattctcaacggcaatgtctgaagtttccaacttttccacatcctcatccacactgattaccttcttttttgtttgtttgtttgtattgtcgccatcctaatgggagtcaagtagagtctcattgtggttttgatttgcctgtccctaatgaccaatgatgctgagcatcttttcatgtgtttattagccagctgtttatctctaactgctcctgatactcctgcgtgtgtattcaaagataagctgtgcctgaatgtcctttctcacactcaacttctaattgcaacaaagctcaaactcctgctgctcgcagccctgctttgagatgcacctgggatgacttaaccctttggctgctttcaaagtgggtgaaaggtatcctagtagagcagggttatggaaagtcctgagaacaggcactaacattcagttagtttcttggcagagacttccttttttgcactatcacaaataacgagggtgcttgtggcagaaggaacttcagactcatgcctggtgccacgcagcacctgcatggagaagggtctcctgtgggcagaggaaagccccagacagggcacaggtgctggccagtggctcaagagggtgcagctgcctcggccttttccagaccagccttgacccctgcccgcccagagaaacaactgttcccattttgaccaacttgcttggagacacctgaccagcagcctaccaccaaaatcacacaataaccatggcatcgtgtttctcgcggacagatgctgagacgcagccagccaccctttggtttttagtgctcttccctgatagcatctgttggcctgctgagtcacactgcaggtgaagtgcactcatccctctgtgtgagctctggccatttgctgcctgtggttcccccatgagtcagtggcattgggccttactctgaggagatgtaatggagggacatggaggtcacagggcatgtgctgagaggagagtttgcaattcttgaagagtttattttgaataagctgagtcatgattacttcaaggactaggctcagctgtagacaccaactgcaaagccaaagcctggggcattttgtctggtgaaactctgaaagtttccataagatattattttgagtagaactagataacttttttcctgatgaaacatgcaattttctataaaacctttaaaaatcaaaacgtaaaagaattaatgccttactcattccaaagtaacaaagagtgtctcatatatttaaacattcaaatcaacttccaaattcagtctgctataaattcagtacagaaatggggaggatgtagaagaatgaggaagacccagggagagggaattcacaattcactcaaaatgcaatcaaggtggctattcttttaaacatttacaacagctttgacacttcttctttggtttttggatagagcgtcttcttgaaatctctgagtcaaagttgatatcttttaagacgctcttctgttccccaaagtgtctttgctttttcagggataggctggtggttcctcttgggtgtcctcagccatgccaagtcctcctgggacccgggaggctgggttgtcctgtcctggtgggagtgaaggaccgtggttgggtgaagtcttggtggaggcagctgcctagctctcctgtgctctcctctggtggagtggggagacttgctgctctgtagatatgagctcggggaggaatgagggctgagctccctccacagccacccagtgtctcagcaggagggccccacttggagatgccaagaccctcccagtgggttctctcctagcacagcaagggagagctgcaccagcaggtggagaagttggggaacagataagcagcagcctctcagccaggtggacacctcagcgtgggagcctcaagcagccttgagggcagtggcggagaggaaggacctcctcccctcactgtccacagcatggccctccaccctctgtctcccttggtctgttgatatctctcttttctcctccctgcaagctcttatgactatgttacatgtgtggttggtttgttggaaggacaagagaaggagcaggagttagaatcatctgtggcacccaccagtctcacctccacccaggtctatcttcccagcaaaacactacatggtcccctgtatggaaaacttccccaatactctctcacctccctgcactctgccaatctgtcatcttaactttgaacagccctagacggccatcgtcatgaaactcagctcccaagccttgccacttgaacagctttccacatctccccacagagtcctctaagataaaaaccaatagccctgggaggtatcattttttattttacagggccccatgcaatggcatgaagccagacagcagaataaaagcggaattcctcctcacagccttggccttgcctcctttaccttctgccttgccctctgtcctcccagctttccatgtctttcttcctccatttccctttcctcctttccttccttcctacctgtccattctcccttcccattttttttctttcctccatgcaccagttttccagccttgttccaccctaggaccctgggcctgaagaggctggagctgcagtcctgacgcttcttcctcccagagccccagggatgtgttcctacctttggtggacccctcaccacctatgccaagcattaaaatctccctccttcagccagtctaggccggagagcgcgcctgaatcttcctgcctcccctcttcacgtgtgtccctaaggataggcttgtgccctgtctatgaggcggacatagttgacaatgaactgacagtggtagtccccagcctccacttgtaatacctggggacatctccccaactccccccatcattctcccgtcatatccccccagaggatgcgcaacatcctctggccaaggatacagctcattctacctggagccccttggaccagcacagctgcctgggcccctcccctgcatcactggaatgcccgaggccgccagacgaggtggcctccttcctaacgcaaggatgttcccctggggtgttctgtcacataaattcttccaagaatttatttccagaaaaaattaaattccccaaagaattggtatattttcttttattagacaataagagctgcacaccacagcgcttgccttttctttttgcttttctttccagggctgtgttagtgctgattatggatgtattcatcagctctcttttctgttctttctctttctgctgccatttgtccagtttattcttgggtgtgtgtgcatgtgtacttatggagagctcagttcaagtaactttgtgggaaggctggccgggccggcttctgtggtcttgatgcaccgcccttgtccttcctcccacctctcctggcattcacacctgcttcagagtcccctccacacattcaatttggggtcctctacccctacttcggcccatgtgatcaccaagtggtccagagcagtccttggacctgtccaccccatgaaatgggagctttccaaaaagaaagaaatcaccttacatggtagatcaggcctgaatgcctgcagagcctcctggctaaaggaccaagtttctacctccttcccatcagctcccatctctcaagggactgagtttctactctcctttccctcagtccccatctttccccactctgtcacaaaggagggaagagaagaagatggaattttggtttcacaggtgaaggaaggggatcttggtaatgagggaggttggaaattgtcaaatcagcatccatgagcacagccaccccagaggaagttcttggtctatccttgcacaggtcttcagcccagtgggtggaggtgtagtttgcaatgaatgatgacagattccccttgccagaccctggaaccaaaggtttggagggccttctcaacaggccctccataaacaagacagaaacttgcagttagcggggaattatttctttgagtggcagctcagctttttgcaaagtcccaccacagatcaaagggctctttttgcctgggggagaaaagctgctttctataagcttttaatattcagcagggcttcatagagttacaatcgaagcttcatcttaaatgacaacttgtgtctggacatcaaaattaccccatcttggccgggcgacgtggctcacgcctgtaatcccagcactttgggaggccgaggcaggtggatcacctgaggtcaggagttcaggaccagcctggccaacacagtgaaaccccatctctactaaaaatgcaaaaaatagccaggtgtggtggcacgcccctgtaatcctggctacttcggaggctgaggtgggagaattgcttgaacccgggaggcggaagttgcagtgaactgagatcgcaccactgcactctagcctgggtgacagagcaagaccccttctcaaaaaaaaaaaaaaaattcaccccatcttttcttatctgtgcgcatactttaaggaaaatagagatgtataagtcattttgaagtaagcttaagtatggtgttggagtcactaacagagccagaaaagtgtttcaaataaagtacaaagtttatgatgtgagcctgtgacctccactaccttactcaaatacaagagtggacagatatcaagcacgggtcctccagacctcaagctgttctcattggtttgttgggtaagagggtcagttgggtgaagagtcatccttgaattctagacttggcaccgactccactcatgggattaaagcctgcattgtctatagccctgagcgcctgccatgcacctgccaactagcccactgttggctacgtggaaggacaaggattggtgtctggtcaccaactgggccagcatttgtaatggccttataaacatgggtgtgaggtttgtgcacaccccctgagtactggctacctttgccaggctccagtggtgtaccccctcagtgacaggagaggtttaaaaggtggggagggcagtccaatcaagtgtgggtccctgtatgacatcacccaacccaagagaggacttgaagcacaagaggtgtggtgagaattggctcatgctccttcctttgttgatctgcctttccagggacacttccaccccaaatcaagaacagagtttaggatgaggctcacctcttttggcacagcctctgccctgacacccttaccctttggcccctgctctgaggttctttcagatctttgcagagaccaggctctctcttgctccagcccttcgctcaaactgggactcaatgccctctaccctggcctgtctgctcctttcatccttccaatcccagcctgggaggcttctgtcatcccttcaagagtgggttagggcctccaagcctcccctaccatccatgccatccctgcattgggtactggtcttgtgggtcttcccctaggcaggaaccaagtcagcctgaaccactgatacatcctgagtgcccctcactgaactgggcaaatagcagactcttaaaaatgctcaaagcatgaaaaaccccctggactcgctgaatgtgagcgtccaactgaatagaatcagtaggagctcacttcggagcagctagcaggaagagagccacacccgatgcattgtggttccttcaaacccagcaagctggtcagtgctaacccttgggacacttttgggagctgcggagagatctgattctgtggagcagttgaggtttcaggtaaactataaccacatgaatagaatgtgatgggcttgttcatttttcagggttagagttgcctaggccagaatatccaggagcctcctgtctctgcactgtgcacaatgcaagaacatccgggcagccctactctggaatctccacaagggcagagacccataggatttattcccactggttcccagcccccagtacagtgcctgacctacaggagttgctcagcaattgttggttgaatgattgaagggagaaaaaaatgagtgatagggtttggatttgcgtccccaccaaatctcttgtcaaaccgtagtccctagtgttggaggtggggcctggtgggaggtggttggatcatgggggtggatttctcatgaatagtttagcactaccctcttggtgttgttctcatggtactgagttctctcaagatctggtctttaaaagtgtgaagcatctcccctctcactctctcttgctcctgctcctgctatgtaagacacctgttcccccttgctttctgccatgattggaagctttctgaggcctccccagaagcagaatccactacgcttgctctacagcctgcagaaccgtgagccaagtaaacctcttttctttgtaaatgacccagtctcaggtatttctttatagcagtgcaagaatggactaatacaatgagtttatggacagaaaaattctttcttagagaaacagataatgtagctccagctgagtctggagactttcccagttaaattggaaaaccctgtctttaatatatttacaggtgatgttccactttcaggacttactctcccacatgagcacatggaaatcctgaagacgatcttcacttaaatgctcatgatgatgagaaagggaccataagatagataccacccagcaatgagaacgagttacgtccacaggtagcaacaggatagagctcaataacatggagagaagaaagcaaattgcagaacaactccttttacatcagcatataaaacccaacacatgataccctatattgcttttagataaatgtatagaattctaaacacctggacaggaaattctatacccaactcagggtggtgagatgaggctgaggacccacgatgggtggggatgagagaggactgtgggaatcaagctgcagtcaaaacaagatctgaagccaatagagtaaaatgttctctactgaatgttaaaggttgtccctattaagtgcatttgttatattactctctagagttttttgcatatttgaaagttctataatattttcaaagaaataattttctcagattatcgtaataatttagaaaccagcggttactttacttagcatttgctatagaacctaccagagttattttatttaaatagtataaaaattgaccttgcgaacaagaattcttctttgaattgaattctcccagtttcctaattattcaattcagcctcttttgcaccagtctgcccattaaccaatgcaaatccttaagggaccatctcaggctcccctgccgtgaataccccattgctccctcccttttcctcagctcaccttatcctcctgctcagccttcctcagatatctgggggccgccatgcccctctccaaagaggtcaagcgagttttcaatgatagcaagcaaaacgtctacgcactagaagcagtggtgctcaaacttccacatgcatcagagtcttctggggcttgtgaaaacagatttctggaccccacccccagtgtttctgattcagttggtctgggatggagcctgagaatttgtgtttctaataagtctcaggtgatgctgatactaccagtccaggggacacactgataaacggtgggttggagaaggttggaatgtcatgcctctgcatattgtgtgctgcatgtgctgtgaaagaatggcacgcttctgtgagcctggtctgtccttcctggtgccctctgccctgacatttcatcatcacgacaatatctggcattgatctttgttttagtccctctccgcagagaacagatttaatcacatatatttccatttggtctggaccaagtcaacttttggccagaagagaacatccaaaattaaataaacattattgtgtgaagaatgaagagggagatgaagagaaagtcaaagggcccaagaaattagaaatgaaagcaggaagaaagatgcaaggcaagagggaacatggagaaataagaaagttgatactttccattcccactgacgcaagaggcccccaggaccagcagacaaagaacagagggactgtctgtcattcctgtgtggaataatcgtctctagccagaaaacaaacaaacaaaatcagtgtctgagaaggataattgacaggcaggagttctccatcctggaaactctttaacacagagttttgttgtcatcatctcttgtgggggctttggatgtcttcaagtcctgtccacacaactctggaggcacacggtccctatgggaggggacttccctggcagagtctgtgtccagacacatgtgggagctggtacagaagggaaatagacagcttcccatttttaggggcttggggcttaaacacatttgttcttgagtcaggcgagaaatcagcagcaaacaagacaagggtgggaaggagaggtggtggtggtaaagagagcgcttcggctttcatagatggaatttaaggcagaaaccatatgcctgaatttccaacccttccagtgcttgggaatcgcctgggcctcactcccacagatcgtgatgtattggtctggactggagcctactcggcaaaactgttcctgactgatgccacagggcaggtttgagtctcactgatctagaatagagcccagccatcatcctgcagctacaagagaggaaactgagtctcagagggattaagcaacttgcctaaggtcacatacaagggaagagcagaaggaaggtgagaactcagatctcctgacaactatctcaagtggagagaaaataagttttggatgagtttaaggttaaaactagttggccattttccccacatcagcatccagagggaggatttcccctgatgagcatccagtggaaggaaccccaggacaagacaggaatagactccaggtctcatgcttgcatttctcagtggggttctgtccacacactgctgaaatgagtctgaaatggtcctgtcctgcctgctatctcctgggaggcctgatgcctgcaggctgtccctgcaggcagtgacacctgtgtttggcctgtgtggttgtccccatgacatgggcttcctctctcttggtatctactcctaggaaagaacttgccccttcagagggtggcacagcaagtttggaatatggtatccacagatgaggaaatgaatcagcaacaggaaaatatttcagggcaactgcagcttactaagtgttcactctgccaggcattgagcctctggcgtagtaggatcccaggacatgtcatgaaactcccaggtaggtggcagcccatctgacagttttgagaacgagtcagtacctgcaccgcgtggggagggaatgcagcagagcagggagacaggagctagcaggccaggcctctcttgcatctgatatgttgagaaaatgaagccagaactggaccagagcagcctgggataacatccaagatgtcagggatgaggcagaaattccagggcaggaggccccatgacctccattttgcaggataacctcaccctccagaaaaaagaaaaatgagatgacctgctaccttgccaggctgatgcccagtggcatcctacagcccactgtgagctgtccccaacactggaaaggaaaggaggctgtgacggatgagtggccagctggctcaggccttagttttctcatctatacaaggggctgtgtgttgcaaggattcaacgagatagcccaggtcaagctcttggcagggggcacagtcttttctaagtgctgcagagacattagctattgccattgttgctagtattcttatgagagtctaaaaattgctttttcttcttagtctcttaaaatagaatcacactaaattctagaagcaaaagcagaaatagagctgatgtcatccaattataagcctgaaaagtcactttcattaaaatgcagcattaacatcaaccctagaagggcttctcctccacaaccagaaggaattgatttgcccaatccttgcctttcaggtacttcactggttccacaagaggcttcacagaagagccctcaagatctcctactaagaaaaccatctactctgttttatcaggactaagtgaccgacatccactaacgtgtgtccctccaacacttcctacatgttagtgtagagagtgacaggaggagctttcctgcccattcatttatctgctcatttattcattgattcattcatcagttggctactgaatacccaccccatggcaggcacagtttcaggtgcaacgttgagacagagcacggagttggcagggcagagacagaggcaggctatggaccagaagccatcagaagcactcctaacaaaaattaagcagggtgaagaacaaagagcacctgagtggtctaggatgatcatgacctttgggaatgtggcagctgagacctgagcgtcggagggtccaggctctcaggacctctagtcaaacactccaggcagagacaaatgctctgaggcaggtacctgtgccccttgctagttaactctgggtctaagtggttaaccaggcttaaccttggcagcctgaataagactcctcccctcccacctctcctggtgggcagacccttcctatagccacaaggagcctttgtcttcagtgacccctccccacctgcgacacaaagcagaggtgagactggaggtactcggaccagacacccccatctcccaaggatgactgttctgcattctggaaccatgggcagggcatgggcactctgtttcctcatctggaaaatgggcatgatccctgctttacaggattgctcagaggttcacaggagatggcagaaaagtcattgtgcaaaatgtaagcaaatatccaagcatggcacatttgaaattggagtcctccaggtgactgagtgatttctgtaaattgtgttgtcattgtaacttccttttacatccacatccttaagttttctgccttctttaaaacctgcttgcatgcagctcccagaattagcaatcactaagcctaattagtcttctcctcccagagggctctgccttttatttttccttttatttttagttgacacaaaataattgcgcatatttatggtgcacagagtgatatttcagtacatgcatataatgatcaaatcaggataattaggaaatacgtcacctaaagatatatcattttttcatgctgagaatattcaaaatcttctcttccagctttgtgaacatatgcaatatattcttgttaactataggcatacctctgagatattgccagtttggttccacaccactgcaataaagtgaatattgcaataaagtgagtcacataaattttttggtttcctagtgactataaaagttatgcttataccatactgtagcccataagcatgtaatagcattatgtctaaaaaatatatacacctgatttaaaaatagattattgctaaaaaaaaaaaatgctggtggttttggtatgttgcagctctattttcacttgttttgagaacttttttgacctccttcttaatttcttcattcacccattgaccattcaggagcacgttgtttaatttccatggatttgtacagttttcaaagttccttttgtcatcgatttctggttttattcgattgtggtctgagaacatatttgatatgatttcaattattaaaaatttgttgaggcttgttttgtggcctaacatatggtctatcttagagaatgtttcatgtactgaagagggaagcatgtgattctgcagctactggatgaaatgttctgtaaatgtctattagcttcatttagtctctagtgcagtataagtctaatgtttccttgttgattttctgtctagatgatctctccaaagctgaaaattgagttttaaagtcccaaactatgattgtataagcatctatctctctttagctctaattatattttctttttatatctgggtgctccagtgttgagtatatgtatatttataattgttttatcctcttactcaaatgatccctttatcattatataattacctctttttctctatgttttatgacttaaaatctattttgtctgctgtaagtattgctactcctgcacacttttgggttttttttttttttgcatgcaatatcttttttcatcccttcagtttctgtctatgtgtgtctccacaggtgaaattagtttcttgtaggtagcatagagttaggtcacttttaaaatccattcagccagtctatatcttttaactgggaaatttaagccatttaaaaaagttgttattgataggtgaggtcttattcctgtcattttaattgttttctgataattttaaataatcctttttcttccttcctttcttccttcctttctttctttctttcctttgtttatctttgcagtttggtggttttctgtaatgataacatgtggttccattctctttcttatttgtgtgtctgctttaccaatgagttttatacttttgggttttcatgatggtgaatatagcccttttgcttccagatgtaggactctcttaagcatttattgtagggtcagtctagtgatgataaattccatcagtttttgcttatctaggaaagactttatttctccttcatttctcaaggatatctgtgctgggtacagtattgttgactggctaacagaggaccaattaataagccaaagaaatggctctttaacaatgaacatttctgccatcaactgacagatcccaggaataaatgttttccagtgaggagacttctctggttttcagaacacctctggctgcccctgcccaccccatagaagggctatccctccaggtcaggttagcatcatcacctagagccaacaagtcaaggaggtgatggtttgcctttgacatctctacccagaccagactccactgagaagactctccctttttcatcactgccctacctagttagttggtcctgccctggggccagagtttcactaatagtatactgttagctcaggcaacagatgaactctgcctccatgcgcaaatacaaaaagctatctctgcttctttttcactcacttaagattttggaagaatggctcctaaagcgggtgatcctcacgacttacagtgcctcagcatcacatgctattcattttgcacagcaaaaccaggaagtgaatatgactgttatccctacttcacaagtagaggacactgaggccctgagaggttaagaggtgcaggtaagatttgaacctacgggctgtgtgcggtggcttatgcctgtaatccctgcactctgggaggccgaggcgggcagatcacgaggtcaggagattgagaccgtcctggctaacacagtgaaatcccgtctctactaaaaaatacaaaaaattagccgggcgtagtggcgctgtagtcccagctacttgggaggttgaggcaggagaatggcatgaacctgggaggcggagcttatagtgagccaaggtcgtgccactgcactccagcctgggcgacaaagccagactccatttaaaaaaaaaaaaagaaaaaaaaaagattcgaacctatgagttgtgcctccagaactcaagatctttactctttgccacatccttctgcaagcccaatcaaggacttgggtgttttcaaggtttgccctttccacacagctgcctctctcctccagtccatcccaaatgaggacttcctgtggccaatttgctactgggaggaggcagagactgcctcttgccgcctcctagggaagtttctagaacctgactttgatagtaggaagtaaagaagaggaaccaagggaacaacaagaccttactttgttttcaaatccctgttgtggggtcactgccagctgtcctgtgggatctgtgttattactgctcaacttgcaagttcttttcccctccctggcctcaatgtcatccaaacaagagggttacagtgggtattctagaagtccccacctgactttaacataatttcagcaacctactactgggactacgcagagaggttttgtaaaaaatgtacagctcattgttacctctcactcggttcattgatagaattaagggactggaaagccctggacatctcataatgaaataaactagccctttgtctttaagggctctttccttcagtatatctaccttccatgttagagcccctttgctcatttaaaaaaatgtcagggttattttaacaaagtaactcagcaaaggctatttatacgttttcagaatgagagagaggaaatccctaaataattctgtctttagttctccatgtcagggtacatcggcatggaattaaaaaaaaaaaaaaaaaaaacaaccaagtcaccaggtgagttgtacagtgacaaggaagagctgaatgtggcctagcctctctagtctccagacagggtcatggcatcagaatagagcagctgggaggatcagtacaagagctgagaggcctagagtcagggtaaccaagctctgtaaggtccatgaggtaggtgggcaggcaggtgaacagaatgctctgctgaaaggaagactgacctctctttcaaaagaagatatcagggtacttaacatagaccatctttaaacaagtagcccacttactttcttactaatctgtaatctgtaatcagctcagaatgaaagaacagcattttagcttctaaagtttttaaacatcatgtaaaatagtctttgtgaggcaatgaagatgttgcgggtgttttcaactctgcaaacccaagtatgttcttttcagtaaactctttactgaagtaaaagatacatagagaaaagcacacaaataataaccagaacacactgatgaattttcacaaaggaggcaaaccagagaaatcactgactaggtcaagaagtaggacattgccaacaccacagaagtctcacttgtacccctaccagtcacatacccaaaataactatcacctttgactcctgaccccattgattagctttgtctgttcttgaacttcatgtaaatggagtcatcagggtaccctcttggttttctggcttctttcactgaacatgatgtttattacattcatccatgttactgtctgttgcattaggtcctttaatttcattgctcagtacatcttatccattccactgttgatggaaatttggattgtttccagtctttggttactataactagagagtcatgaacatttttgtagaatttctgggtcataagatacacaaatgctcagctgtagtagatcctgccagttttccaatgtggttatactaatttacactcacaccagccagaggatggcagctgtagttgttgtatattctctctggcacttagtattattagtctgtcattttggacaaccctggtggctctgtagaggttatctccttatgacttgaatttgcacttccttgctagcatttattagaaaattacaaagcctcttttgtgaagtgcttgttcaaatcttttgcccatgttttctattgggttattaatgactcatggaaattctttaaatattctagatacaaaccctgtattgggtttatgatttgcaaatatcttctcttactcaagggcttgcttcttcactctcttaatggtgtcttttgataaacagaagttcttaggttttaaaattttatgtattttatttttattatttttggagtgcagttgtgcaaacagggctcactgcagcctcaaactcctggactcaagcaattcttgcacctcagcctcttgagtagctgggaccacaagggtatgccaccacacctggctaattttttaaatattttgtagggatcttcccttcctggcctccccaagcgcttggaatacaggtgtgagccatcgcacccgggcagaagttcttagttttaatgaagtccaattcatcaatcagtcttttcctttgtgcttagtatattttgtattacatttgaaaagattttactccaaggtcataaattattctcttatgttatcttttagaagttttattattttgcctttcacttttagatctacattctatctgattgatttgtgtgtgtggtgtgaggtagagtcaagattcattttttttaagtatgaagatccaactgaccctgcaacatttatgcaaacattatctgtcctattccaattgcatggcagtattgcttttgtcataaatcaactgactgaatatgcgtggtctgttttctagtactctcttttctgttccattggtctatttgtctatgcttgtgtgtatctcacactgtcttatttgctaaagcttcagaataagtcttaacaaatgttcttgctcaagattgtttcagtcctttaaatttccaaataaaatataaactttattcctcaaataaaataaacaaaattccactaaaatttgttgtaaaattgtactgactctataggtcaatttggacagaactgactataaaaatattgtcttttattccatgaatatatattttggattcttttaatgcctcttcacaataattttatagtttttaattacattttattagatttatttctctgtatgttgatgttattatacatgacatcatttaactttttaattttccaattatttgtcactcacctaaaactatttgttctcttaagttgatttagcaactcctcttccacgtggttaatactactagtttgtgatcaaagttatcattcaaggtagagcttttcagtctattttctctctgttattcagactgggggatttatattgttctttcctcaatttcactgattctatcctctgtcatatccattctactattgagtagaatccagtgattttttttaaatttctattgttatattttttaattctataatttccacttggttcttctttcacaatttctatttcctcactgagatttttctattccttcatttgtttcaagagaatttgtaattgctttctgaaacatttttataatggctgttttaaagtctgtcagacagttccactatctgattcatctcagtgttggtgtcacttgtcttttctcatttaggtagttttcctagtccttggtataatgtgtgttttttcattgtatttgcacatcctgttttttatgttaaaagactctgggtcttttttttttttttttcaggctatcacctaaggtcctagcctagtttagtgggctgtaggtccagtggcaacttcatttcagagccttcatactattatagcctactggagctcccactggtcctttctggtgcccctttctggggctgagggaatttccatgggctgggccacctggtgcctctagatgggcaaaaggagtctcaggcctacggagaccaagagtgcttcccaaactaggctgcctgttatgatgtggttcctattgttgataccacccagtcaccctacatgtctgtcagtggaagtggaggagaataccaggctcaccaggaagcaggaggaatgagtctatgttggctgtcttttggtgccaagttgggatcaggtaataccaggcctaggtcaccttctcttgttggatgcggtgatggtaagacatcctacctctattgttcctccagtcttagggtccctaactaattcctctttctgtttccatctttcagagttctcctttggttacctcttgcattatttctagactttataattgcatttaactgagaggagagaagacagaaatggatctatgctattttgtctggaccagaagtcctttcaaaattattttgaatgaaataattcatggaatacatcactacaaagtcagccttgaatacaatttattgacttaaatatagctaaattattttaaaaattggtagactcttagactcccgtccacccttggtctcaaaagagataccttttcatagacatagaataccctgacatatggagagcccaccacttccacagtaccatggaatcaggggaattatccaaatagtggtttccttgttgtaccctaggcagggacagtcaagaaaacttcatggatctgtagtgtaaagctagggagaaagaggaagagttgcctgtttgaatttctgtaactagcgtatctccagataatgcatgaacagccagtaaagatgaacgcagattattgatggaaagaacacacatggagaagagaaaaagcaagtccacagagctttttaacatacactccctcacccctacccccagcttagaagggcaggaacctgctgtccaaaacaggaaatataggaaataccagctgagaaactgtccacttgacgtccatgagcccagctgcccctctcacctcactcctattttaagtcagtgacacacagtcatgctttccttttctgcacctgaaggagtgatgtcactccagactgagtccttattagaggtgatgatggagttatttttagacctgggaatggtctaaaacattttgcctcagcctaatcattggatccttcaaggaaatggatattctgatgcacatcccacccggtgtcctatcaaatggaaccttagctctcaggcaacttgttagtttgaaggcagtgacaatgaggccaagaatgactcctggctcctccactctgccatcacaggctgcacccagagcctcccacatcagattgtacccaccgtgccagtggaagtgatctctaagtcaagctattcctgccctctctagcctactttctctgggaggcattagaacacagtcagatcccgagagtccagacctggattctattgctttgtaagctaggtctttgggcaaattacttctctaggcttttgtttcccggtctacataaatgagacgaattcatggttatgtggactaagtaaaaagttgtaggtacaaagttcccctggtgctggcagtggggagtgctccataatctctagccattgctattgttattctcagcgtgctgaaagcactttcatgtatgctgtttcacttgatcttttttaaaaggactgtacatgttttaattaatttaatcttctgtatagttttatgaagaacacactcttttgacctcatttaacagctagccatataactaataagtgatagaggtaagatttaaagagagtctggtttcagagaacattctcttgatcactgtatacaaatattattccaaccatagtgtaggctcttctggtcttacccttcctatgagagaggggttattgtctccatttcataaatgaaagcagtaagagtcagagcaattcactgagctgacaagtcataggatcactgaacaagggctccagtggcagtgcctgggagtggcagaacaaatagcacagtatcacatacaactgcagcaacagcagcagtacccgcagcaagtacaatgacacatttactacacacttgctctcatttaatactcacaagaattatggcctctgggttctatcatcaacaccattgcagatgaggggaccaaagttcagctggatcaaggaaggtgttcaggggcatagagctagggagtaatggagttgggtgtccccctggtctaccatgcccaagctgtgcctcagcttctgtgctgccatctcctgcagcacttaaacagaacccctaagaacaactagcagcacttgcctgatcaatgtagccaacagaaggaggacaacctatttttcatagattttttgggggattttctatttaaataatcatgctgcctaaaaaaggagacagtttcatttcttattttccaatgagcatgacctttattcccttttcctgccttattgcagtggctagaacttctagtactgtgtttaataagactgatgaaagtagaaatctttgccttgttttggattgtataaggcaatgtattctgtctttatcatgaaatacaatgtctgatgtagttttttaatagatgttctttatgaggttgaggaagtctccctctattcctagtgtatttgagaggattttctattttcatcattaatgggtgttgaattttgttaaataattttttgttgccaactgctatgattatatggtttctcttctttagcctgttgctatgataaattttattaatttcttttcaaatattgaatcagctttgtctacctggcataaatttcacttggtcatggtgctttagtctttttatacattgttggattttgattaattacatttgattggtggtttttacatccaaagttcatgagagatattgatctgtagctttctttttgcatactttctttagctggtttgggtatcagagtaatgacggcttcataaagagaattgggaacttcctaattttctcttctctcctattttctggaagatacacatagaattggcattaatttttatttgaatgtttggtaaaattcttggatgaaaccctctggacctggagatttctttttggggagtatttttattataaatccaattcttagaaatatctacacagctattcagattatctgtttcaccttggctaagttttagtactttgtggtttttgaggaattagcccatttcttcaaacttgttgaatatatgagcataaagttgattacagtttttaaattatctttttatagctaaagacatctattgtggtgtcccctatttcatttctgatgttggtgattcatgtcttctctctttttatatttgccattcttgctaaaagttattaatcttattaattcttttaaagagacaactttctgtttcattttttctttttccagttttcaagttcattagtttctgctcttttttatttcctcctttctgctttctttgagtttattttgctcaacttttctaatttcttgaagtagaaacttagattagtaatttgagatcattcctcttttctaatgtaagcatttactcctatcaattttattctcagcactgctttagctaatcttacaaattttaacatgtcatattttcatgttcattcttttcttgtctttttaaaatttcctttgagattaccactttgacgcatggattatttaaatgttttttgtttagtttccaagggtttggagatttgcctattgactttctgccttgatttctactttgattttattatggccaggtaacatagtctgtataatttcaattctcttgaactttttaatgtttgttttatgatctaggatatgctctatcttggtaaatgtctcatgggacctttaaaaaaatgtgtattctgctgttgttggacagattgtgctatgaatgccaattagatcctgtcagttgatggtgtggttgagtttttctatattcttgctgattttcttgctagtagtcctagaagtcctgagtgcagggagacagcagggattgatgcctcaaccacaattgtggatttcttctttcagctgtcttagtttttgcttcagacatgtgaaagtctgttgtttggttcataggtatgtagagaaaatgctcactaactgtgtttttcttttactgtcacaccacaatcatcaacacagaagaaaggcccagtgactcatgggaaactactgtattaaaaacttgcagctaatgttttaaattaaccagaaaaaacacaaaagtcagaacactgcaccaacagatagagccctgtgcctttataaaagaaaaaaaatattgccttctatacactctccctcaccataaagataatcctctggttttctcctaagtaaccagagagtggataccccacaccgcaaaaaaataaaattctatttgttgaatatcttttgtcttaaagataacagctcaggaaaaatagactgcacttaacatgatttatgtcattccttttttgtgcccttatacgatatgaagaaaggcttctgtgttgatgttgtcatggtgtgacagcagaagaaaaacacagctagggagagttttctctacatacctatgaaccacacaacagactttcacatatctgaagcaaaaactaagacagctgaaagaagaaatccacaattgtggttggggcatcaatcccccactgtctccccacactcaagactactaggactactagggagaaaatcagctagaatatagcagcggacaccagctgggtgtcctccaatgcagttctgacactatctacccagagatagagtcagatcccacaggttgaaggttcagcccccaagactgcccccatacacacaccagttgtaagtctgggcctccacaacttctgactagccagcttcaaggtggggttcccatgaccccctctttgggtttgattaatttgctggagcagctctcagaactcagagaaatgcttacctatgtttacgggtttataattaaaaaatattgcaaaggagacagatgaagagatgcctagggtgaggtatggagaaagggtcacggagcttccatgccctccctgggtgcaccacgctccaggaacctccacatgttcagctatctggaagcttaacaaccctgtcctcttggctttttatggaagcttcatgatgtcagcattccttcccccaggatatagggtgggactgtctcatgggagggtcttaagatccacaatgagaaaggcagaaaggtgggagaacattagagtgaaaggaaggcaggagaaggtcagaggcctgtccctgaggcctaacacccccaacaatataacaaaagactctaacacgggatgtgggagttatgagccaggacccatggatgaaagccgacatatatcataacatcacaacaggagagctacatcttcttggtgaattaattctttttgttattatgtaatttccctctttgcctatagtaactttctttgctctgaagtctgctttttctgatgttaacatagccacttgtgcttccttctgactaatgtttacacgttatatctttttccatcaatttgctgtcagtctacctatatcattgaatttgaagtgagtttcttgtaaacaacacatagctgggtcatgttttgtaatacactctgccaatctctgcattttaatggatgcatttagaacatttacatttaagataattattgatatattaggactaagtctgatattttattattatttgttctctgattgatccttttgtttattacacttttgtttcttttttcttgccttcctgtggtttacttggacattttttgatgtttcattttgatttaattgtgattttttttttcggcatatcatgttatgttgtttccttagtgcttattatgtttggaaactctgtagatggacagccttccatgatggggaggaagctgcagggcctgggtctccttatgccactggatggagtctggggagacacagggcttcacagtggctgcttctgtgggtgaattaggccatgtgctgtgtctaagttgtggactgggggccaggactgtccagggctttgctgctgctactattgctgctgatgccactgctggcagatcaatctctctgcaaggaccctgggttgtacaaaacaggggctagagcttcctactgggtctctgttggggctcccctttcctgaactttggccaaagacaacaggatattcttgggggttttgttgttgttttgttgtcattttttctgtgcctgttggtgattccagcacagcccagcgtatatgggagacaaaaagaaaacttagaaaacttaccatgttgctgttactcaagtcctgaggtttcttgcaagtacaccttttcttctagctttcagagccctttatcattgtctgctgaatagtttccaaggtacttagttgtatttagaggagcagagcagggaaaaatgagtttaaccatcttgttccagaactggaagtcggcagagcctgttttaaaaataatgtttaaaacaaattttatttcgtgggtgattttccagaaagcagaaaaagtactatcgatggcacttcctataataaaaactacaccctatgctttcttggaaggaatcaattgcattattcaacagtcgtcttcctctgaacctgctctgcatttagtcaacaggatattgaattccttttaaaaatctaaacagattatcacttctttcctgaaccaaaagttgattagtaatgtaaatacttgtctgtaacacagaaaactgtgttttctttgagctcttcctattccgtatcccttgtcttgaatgaggagtttttcctttggcaccaaaaggttacaactacatttatctacaaataaactaccatagaagaactggaactttcctaattatcaatgtttagctgcactaataaagctttcttatatctgtgttctccttgtttcttgtcttggacccttgcctgacacagataggatgggctttcagcccagtgactcacgggaaactactacattaaaaacttggagctaatgttttaaattaaccagaaaaaaacacaaaaggcagaacactgcaccaatggatagagccctggccctttataacagaaaaaaaaatactgccttctatacactttccttcaccacgaagataatcctctggttttctcttaagtaaccagagagtggaccctcccacaaaaaacaagttcaatttgttaaatatcttttgtcttaaagatatagctcaggaaaaagtagactgcacttaacatgatttatgtcattctttttttgtgtgccttatatgatatctcatgacttggaaaactcctataaatatgtaaaatattagaatgtatagcaaaaaattgtcagtttacgttatttttggcttatctcagtacaaagattaatgtggtaaaattgaatatttatatccttaagataaaattgaatgttccaatgtgaagtaacatattttcaactacattttttttttctgaaatccctttatcaccacaaactctatctttaaaaaaaaaaaaaagttcacaacatataccattttctggctctacatgaaaagtttattgtttgtgtgcagggttaaagagaagccaataagttaacatgttatatttgacatgggagctgttcactccaaattttaagaaaagccagaaaaatcacgtacaggcaaccaaccagagcgttaaaatggccttttgttaattgttaaaaatctgtatagaagtacatttttttttaatttgtaaaagtggaagcaatttgagtcactttaatttacagcatgaatggaagattctcggagtcatctataacctcagcagaaaatgtgattataaaagtttataaaaaccccagttccccagagagctatgaaatgagcagagtgcagaacatattctatcagtctcttgaaatattatttgccctcttaactgataaggcaatggaggaagaaagtaagaatgtaatacaaatatgaaaaagtgactacctttgcctgccttcaacaaacctaactttaaataaaataagaataatgaacaaatcagctaaaaaagaaaacagcttttcccctagtttcttttgaagtgaatctccctttactttttttaaatttcttggaatcctacaaattaaggcttccttggaaatgaatgaattttttagaatttcaagactcaaaagataaacaaagaagtctgtttttcttctctcacccaccccaaccctgtgaataaccccaggttacagcctgggtttccctctgttctttatgtctatcaggggttttagagctggggaggtcagtgggggaaggatggggaagagggggaggtggggaaaggagggagaaggggagaataagtggggtgggctcatctcagagtgaacctcggctgtagctgggtacaggatgtcacacgcatgcctgcacacacaaaatgtacacagtgaaaccgggcaatagaactattaaaaaaaaaaaaaagaaagaaagaaagaaagaaaatgtactgctacatcagctaaaaacagtcgtgttctttcctggtttgatgtcagctcccagtactggcttggaattgcccacagcgatcttgggcccctgcccactcagcaggcagacggctttccctgccagcaacaggcttttaataaaacaggatgctgtcccactactaaggcccagcctgagaatggatcccagtccgtgtgaactccctctccaagaaacagcagttctgtgttccttatcaggaaaccccactttggcgttcctggcctgggagaaaggcccctctcccagggacttgctcagcaagtgtttgcaggcagccgctggcccctggagctgtctgctctgcaaggttctcaccacagtgagcttgctcccgcagggacttctcattctgtgcgtgtgtttcagcttttaggaaggctctgtctgactttgatagtcaagcaggatgggatttaaaataaggagctggcttctacaggcaggatgaggacatttcgcccctatcttcctgcagcaaaccccagtgagtcacgccaggactgcacttgaactgacttctcatcttaagtgtgaagagttttatcattttggggaggctcacccgtctatttgtttacttctcatttggaatgaaatggagtatgttccatttggagcagcaatttctaatttttttccagctgcagtttgacaaaagtccaaactaaggagtaagattccacggcaccttccaaaccctggagctccatggctgcagagcccaggaccacctttccttggctgtataccaccctcttgtcctagggtagaagaactgtgattctgaaagttgtcccagagtattagccccagccccacaggcaccagcaggatccctttcgtgccacactgtcctgtacagaggtggccgagtatagcatgacatcacagactgggagacacacatgctgtcaggaagtggacttagatgacatcctatgacagtgaattccaatgggaaagagaagtcattgttgttgatagagaaggctggacaacctggattctacccccaaatctgccctgacttcctgtgtggccttagacagcttgatagatgtgtgactcagtttccccattttgtaaaacacagagcagattgttaaaggacgggcaaataactagctcatatgctgtcactcccccttccctcatccactcagacattgggaatcactcccagcacttttcttcctgtgtccagatgtgacaacccagtcagccacaaccaaacgatcagagacagccctgggagcaaaggcttgtgatggtttctaaggcttcttccaactctgaccatccataagtcccagtctaagcccaatacatttctgtttactttgaagttctggggaggaaattggaggaattggtgttacaggtggtgttttcattccttctctcactggaaggttgtgagtttggaaaagaaaaggagaaagaggaagtacatggagggaacatctgggcatgtagatggtgtcacagtggagaattttgtctcctggactgcagcccagatccacctcagaacagcgggggcctggcaggaagcaggaagtgctggcccaaagctgggaagagcagagcatgctgcaggaggccagcccatgagaccagaaaaagtgcaattggtaacttcagagggaggagtgaaaagagcccaagtaaatctataaagccagggaagatagagcacagcacaggaatatgagctaggactcttgaaagcagaaggaacgacccttgctgactcaagcagggaggggaatgaattggaagctatgaaggagcttgtgaggtcaacaggggtgctggattctgagctggagaaccaggttcaactgggacaagagcgctccaccatcaagcgcctctacagggaacaaacagcctgctgtccctccccctgggaccactcagctcagctcagctcaggaccaccctggggcaagggaggagacactgtggacaactttccacttccacgcagggggaaaagcacctggatttaccatgaagacggcgcccagtgagagagtagtgccacaaaaggacatcgaattggggaaagaagaggcagtggattccaggctgctgaaaaagcaatgcccggcactgtgtataacacagaggtgtcacacacaaccacagcaagtgaccagaccaggtcaagagtcagagaagttagcaagcaaacattaaatccaatccagcaggcctgtgggacaaagttaggagtaactccaaggtcatttgccaggtgtggaaacccatctgggaggctcagtggggtcagagggtaaagacaaggccgattaattaccagctctcaggagcgagctgagtggagcatgtggaggagtgcagaggatgtcgcaggcaagagtcaaggtcaggaatgttcagaccgagatgaatgagggaataaaagcaggcacctgtgcacagggctcggggttacccatctcaattctggtggggtctcccttgctagaaaagagctgcattgaaaggcccagctgccccttagctacagagtggaggaagtgtccagtttgtgtcagcaatatcactcgcagtcaggaaggctcatgtgctctcttctctgggaaagcaagtcttccaaattcagtttggcagagcaccagtttgctgagataggagccaaacctaagcgctggggtcctgctccccaccatggctatgccaagctggaggctgctgctgcgccacctcctccttccacacagagcgtcagaggaaccagatggacacaactgagtcctgaggacattaccagggctgtgaacccagctgtgccgaaagccaggtctacctttggatgttgcttgatggtaattcctaggggaaacttctctgagcaacagattctcttttcgtgtttaagccagtttgaggtagttttctgtcacttataaccacaaagtgtgtcaggaataggtagataataatattaatactaaccacaactaagcactatttccttcaatcctcataacaactccaggaggtaaattctgttatcatacacaattatatcaaattgaagaaactgaggctaatgtcctagtgccacacaatattaacctggagggctggggctagggagtctgaacacacacagatcccaagtgagaaaagagattaggagaaaaccccaaattctgcatatgtatcgtcaataatcctgaataagcccagtgaggaccaaaaagaggaaatagttagaaaaatccagtgtgggccacacagggtaccactggtgatctcagactttcagaaaggcatacccagaagataagaagttgacatggagtcaataccggggttgggggggcctgaacctgtgagaaccacactgggaaaccaaaagcccacaccaagcagaggctgaaaataggcccgtgatctcagaagggttttcaaagctatttgaagagtgggacaagaaagggattacacaggaaagatgctaaaatgtagaaacttgagaaaaaaaaaaaaaaggaggcagagccaagtaatttcaacttcacgtctctctcttctagttagaaagatgctcttccaaaaggtggacccctggcctggtgagaagacagcaaggtggtgcttggatgccctacacaagtttaacaatgaaaactcttcgatgacctggcagcaacacagaaactcaacacagggaagccctctcctgggcaaacggtccatttctaacatttataaaaatggtcaattgtcgatggcaatccctgagggaatattctagaactactgaccatctagattgaaaatatttcagaaaaaacatagggtacaacatgggttcagtaccccccaaacaaccataaatctttcatgatggggtgattaatgctgaccaggtgactctggtaagtactgtataccaaaaataacctcagcaagcagctgacagtttttcaggatagtcttgtttttgaaacggaggaatatggaccagatgaaaataagataagagggattcctagcaaattgtaaaatgatgcccaaatgaaatgatgaactttgaagtcttatgaagggggacagtgccaggggtcatattccttccactggcccagccttaacagtgtccttgaaggtgaacttggagatgtcctttcagacgctactgatggggcaggaatcagagcagtggggggttgtggtcaggattgagtgagctgggtgtgtgacatacataccattgttaggctgttgctctggtactggccacctctacgctgcctggtgccctgtctttgggggcacaagacttggatccccatctcatctccccattatagttttgcaatattcgtcaaatcactccaccattctgggattcagtttcctcatctgtagatttgaaaaaagatgccaaaggcacttgtgtctactgtgtgggtaaccagaagctgagaaggacaatgaatgcaataaataaccaaatcatgaatgattcaaattcatttcaataggaccgaatatgaggtcaaaccaacaacacccagaagaatttagttggaatatatgtcaagaaaaacacagtattaaaaatgcagcctggcacagtggcttacatctgtaatcccagcactttgggaggccaagctgggtggatcccctgaggtcagcagttcgagaccagcctggccaacatggtgaaaccccatctctactaaaaatacaaaaattagccaggcatagtggctggtgcctgtaatcccagctactcaggaggctgaggcaggagaatcatttgaacttgggactcggaggttacagtaagtcaagatctgttgcagtaagccaagatcatgccactgtactccagcctgggcaacagagtgaaactcttgtctccaagaaaaataaaataaaataataaaaataaaatgcaatcttaaagaacatgccaggcagggccatggctatcttgacttgacagctgcctacgtgaaaacaagatttgggaataacccagatgtccaacaacagcatgtgaaagcgcttaaaaaccaaagtgacctgggaagtagcagatagctctgaaagctgagaattaggggtcagtttgaatattttcacacctggaaatataaaagaaaattatgctacaagatgaaacagcagacggtaaatactgcctactcggtagataaagttatgtagaagtgttagatgcaaatttagagtgattggcagtcttagggagagatactttctctaaaagttgtaccctcacccccagaataaaaaaaaaaaaacaacgagattttagttgccatgggtttaatgtcagtcaataatatgagtactaaaagtcaatgtggctttattttgtctcggtggaagtgtaatgtctctgctggtatgttccccacagggctcatgccggtaccaggtgtggcagatctggtacctggataaggatataggagctcatccaggtaacaggtgtgttagaacaggaaaggagtgtagccatcccacacaagcttgttccagtacatctggactgcattttttttttttttttgagtcagggtcttgctctgtcaccgaggctggagtgcaggggtgcaatcatggctcactgcagcctcaacttcctaggccccagcaatcctcccactttatcctcctgagtagctaagaacacaggcatgtgccaccactcccagctaatttttgtatttttgatagagacacagttttgccatgttgctcaggctggttcttgaactcctggactcaggccttccaaagtgctgggattacaggtgtgagtcaccacacccagcctggactgactttttcagaaggaaactaatgataacatccagatagattaattaattcaatgccaaaaatgaacccactgcacaattaaaataaaatagtagaactgaacatttatctatacttgataggaatgaaaactttctaagcataaaaataatgggaatagtcacacagtaaaatactgataggcatacaagatttaaaactttctagtcctaaatgaccataacaacattaaaaggcaagaagaaaactggggaatttacctgacagatagtgaactaataatatacatgtgtgtatacataggacaaggctaacagaaaaatgggcaaaagccatcaacaggcattttgtaggaaaacaaatgcaaatggtctataagaaatggaaagatgctcaaactcaaaagcaacgaaataaatgcaaataaaaacagtaagctaacatttctctttcaagatgaataagaaaatcatgtatgcaagggtccaagtatatgagcaacagtgcaggggagcacagattacatgcactgggcttgactgtccatgctggtctcactagctagttgtctttgggtagtttatttatccttccacaccatcatgtcccttgtccattaactgaagattatcataactctggtctcacagtgctattaggaggattggctgagattactctaacccagtggtgacacttagaaaaattgttttttctagttagaagcaagcaatcagggaatacttaaataaatcatgatatatttgttagatgaaatattacacagacatcaagcatattgttaaatgcatattgttgaaggccatttcctaataaaaaatgtgatagatgtcatggtcccaatattgttatgaaaaattccacacacactttttttatatacagaaaaacatggctaaaatgttggtttctttctagtggttttgtctggtgatgggattataggtgatttttttttttttaagaaaaacaaaatatgtaaggacaaaagaatttggaaaatggtatggataccgtacaaagccaaaacaaagcaaaaaatcctccaacgggtcctgagaatggcatttgacttgttttgattgctagaaactttgtaatgtctgacacagttggaggaaatagctatgtgtggcctagaagagataagctttttcgggggctgtgacacctatctgtatatatttgatggatgtcatatcaggacatgtcccaattttgttttctgaaacagcacatcacctgcctctcaatggcaagaccctctagggaaaaaaagactagtgagtcctacggaacttggagccacaatcaggccttcggggagactctcacagctactggtgggcatcttcatccaccaggagagcagcaagaacctatctattctaggggtcccatggaaacgtctcctgctctgcacagagcttgggtttgataacttccttccctctcttcttccctccctctctcgctttccttccttccttccttccttccttccttccttccttccttccttccttcctccctccctccctcccttccttcgttccctccttcctttctcttcctctttaagatgggaacctgtgaaatgatggggcaaagaggagaagccagtgtaatcatcagcagactcaacagtatggaagggagtttgacaccatccccaggaatgttctgctttaactaaaaaaaaaccattggatccacttctgagatctgccaccttgccattccatgacaccttgtagcaggacaaaattcacccagaagttgctttatcacagttcagtagatttaacacattgctcgagggactagctctgtgaacagtcatccccatggcctcaggcatcttatggaggtgcctcccaccttcttagttgctcttcctgcctgtctttcacctgccattttttctgtgctgggtcacacctgcagctacagagggggaggtctttctgtcctgcaacactgggatcagaacctttttacctggttgaacaagtaagcggtgagttgctgaatgcaagtgccagatattcttgtattattacggttaatcctcacaacagccctgtgcagaaggttctttcaatatcctcgtatgagactcagagaagttgtcacttgaacagggttgtaggttcagcaagggtagcactgcaacttgtacctctgaaggcgtagaaggtccagagcagagcagtcttggacccaggcacgtggagggggacacctgcggttcccaccatccaggatccaatcccctttctcctggcccagaatgctcccatgcctagcccgacactgtgtagatggagctgccagatccagagatggacaagtggcccagaaccactaaccagcccactccacatctgagtcacaatgaccagcccaggatgagcagctggtctcatcattgccactcccaagacacctgccacctgggctgctgagaggacaggctgtgcaccaaactgctggcagccacttcccagccccatgtctaatgagtttaatgatgccattaaactcagctggtcttgagcttttcagaagtaaaccaatatctttctttcttaagctactctgaggtaggcatttcccctcacagcccaactgtctggacttttatacagatagggccagcagtgtgaccagtcgtcatcaaaccatgcaggtctgcctgcgagggaatgggcagtgtggtgtggaggaaggtttaagaggttatttgaatgggaagttgctggcaactcttaggtattctggaggtgttaattgatggtgaagcatttatgaccaggacacatttcacagctctgggccacctaatgttacttctcctcaaagcaggtttgaaataaaacccaaccattggcctttctcaccccactgcaattaaatacaaacacccacagacactgggccctctcaggcccggattgcggctgccagggacacaagtgcacggtggctgtgtgctgtgtcacagcaccaccacacttgaatttccagcctcagagcctgtcttttggatcagcgagaagttgtgggtgacagcctcgtgccaagctcttggtgggctcagcttggctctctgcttcttggcttttacagcaggaccccagagtggagaacaggctcattctggtttcatggagcatgctccctgctgtcaccatgaagaaggtggcatcttggctctcaggggcctggccaactgcccgcagacattaccagtgagttgccttgtccctgggcacaggcactggaggctgccctggccactcaggaagggttttcatctcccctcttggccctccctctggattctaacgtgaggcaggcagtcaggcagtcctagcagagggccggtcctgtcctccctgcgggggcctgggctgtcacacaggcagtggtggttattcttacaaacggctaagcagacttttttagaaaagtgagctattaatagcaaagtgctgagtgagaggcttggagctactcccgtgcatgaacttgtgtgagcatgtgttcacgagtgtgtgtaagtctgggggagcgcgtgcacaggtgtgcacatgaacacacggacaccaggcagacagacgcatccccttgcagttgttcacatgcactcctagtctcctggtctgcctggaatcccattctggaactggcctgcccctctgacttttgggacaagaaaaggccgggagaaagtggctgcctgccacgcaagaccagacatctgggtgcccagtgtagtaagcgcgctgcttcctggggcagagatgctgcccagcgagatgtgtgtggatccgttggtaggcatggagacagttgcttcctttgcctgtgatgctgtggaccctgagaggcccagcctggacattgctttttgtgctttcttccctggcttgggaggaaaggaccctgttggctaatgcatggcagaaagcacagcttacagattttctagttatgcccaagatgaaagaggactttctgaaaagaaggaaaaagatggagagagagagagaatgaaagcgagagagagagagaaagagagagattaagggttgggggaactggaaggagccctgagtaatgtatggaaagtaaaagcacagaacactcagctcaagcaattgtttttctcctggaggctaaaattcatgggcaggtagccaacagccacattaggataagaaatataatctgtttataataagtttgcaaaataccgctcgttggcacagtgaatgtgcaggaccccctaaactgccgtgacactagccttggcctgctgtctgaggcaaacacaccggagctagtaggtcactgctggtaaagcctaagtcccctggttgcctcctttctcaatcatctatttccctctggggcagataagcacattcccaaaaatgacagctggagtgtccaagagccagtggaagccccttttccctcccttgctggagctaccatcgctaccattgcagagacttgaaatgacctctccaggtcggaaggcactccagagatcactcgaccccactgatgcaggaagttgggtgtctgcaaaaatcctcctgcaaggccctggcctctgccagatcactcccacttctgggcagggtgccagcctgggcagctctgggctgcctggccctaaaacacattgttgtctttccactctctgcactttgtatgtctgtagtgcctgccatttttcaaaacaatagcgaataaaaacaacagccagcatttattaggcatttactgtgagcctggtattgtctaagtactttatttgcatcatctcattgtacctacccagcaaccctctagggagataccattattatcccgttttacagacatggaaatggaagcttagagggcttcaacaatttgtccaaatgtcctccattcgtgggatttgtggtacagtgtggatttgaacacaggatttttcaattccagaacccatgctcctcccatcataccctgctatgctctccctcctacatggtggtccacagaaggcttccctcccagctacacatcccagaactggcacaggcatatcactacctccatttctgtcctgtaaactagagaacagctttattctagaacctccctctgacctctgcaaattctgtccgtctgttcagaattgaacagatgctaaaacattgtggctaaaagcaagagcatcagaatcaaacagatctggtttagaattctactttagcctcttgccaacctcgggcaaattactcaacctcactcagtctccagatttccatctgtaaaaacagagagagcactttactacctaacaactccatgggattgttataagaattaaaattagataaaacataaagagctcccaggctgtatttgcagatgaaaggcagctgtgctaaatacatggtgacaaacgtggtaagtctcaaaggacatgtgagcagatgtcctaccatcaagatttcactccttccccaacttcaggggtaagaatcctccaacatcaggggaggacttgctcaaagtcacacaaaccagaaatcctcaagaggccatactatggatgtggctttctaacactattctaccagttcccatggggaagcacctgaagaagtggggacggagtgggcagggaatcggggaagtgcagggccatgacaggactgaagccgcacttaggaagcaaaggacgagttctgtccaccaatagctgaatgctgagtacagacctctaatctcggccttgccactgaagactcatcatgcaactctagggccagttgctccctctctgggccttgggtcttcactaccatcaacagctgacttggaagttgcctctaaagtgtgctgaattatcaggaatgaagatgatttaaagacataagcttttttctttgtaccttcttccaaccttaccttctccaagaactctcctatgacttcctcctaaaaggtccctgtattagtccactctcacattgctgtaaagaaatgcctgagactgagtaatttgtaaagaaaagagatttaattggctcacagttctacaggctatacaagaagcatggctagggaggcctcaggaaacttactcatgacagaagacaaagccagagcaggtatcttcacatagccagagcaggaggaagagagagagggggaaggtgctacacacttttaaacaaccagatcttgtgataacttactcttactatggcaataccaagggggctggtgttaagccataagaaaccacccccatgatccaatcacctcccaccaggtcccacctccaacactagggattacagttcaacataagatttgggtggggacacatatccaaaccatatcattctgaccctggctcctccccaaatctcatgtccttctcacattgcaaaatacaatcatgccttccctacagtccctcaaagtcttttaactcatttcagcattaactcaaaagtttaaagtccaaagtctcatctgagacaaagcaagtcctttctacctatgagcctgtaaaataaaaaagaagttagttacttccaagacacaatggcggtataagcattgggtaaatataccctttccaaaagggagaaatcagccaaaagaaaggggctacaggccccatgcaagtccaaaacccagcagggtagtcattaaaccttaaagctccaaaatattatcctttggctccatgtcccacatccagaatatgctggtgcaaggggtgggctcccaaagccatgggcagcttggccactgtgactttgcaaggttcaacccccacagctgctctcatggactggcattgagtgcctacggctcttccaggcacagggtgcaagctgcttgtggctctaccattctggggtctggagaatggtggccctcttctcacagcactactacgtagtgccctaaagaggactctgtgtggggggtccaaccctacatttcccctctgcactgctctagtagaggatctccatgagggctccaaccctgtagcatgcttctgcctggacatccaggtttttccatacattctctgaaatctaggtggaggcttctaagcctcaacttttaaactatgtgcacccacaggcttaacacctcgtgaaagtcatcaaggcttatggcttgcacccactggaacagcatccagagctgtaccttgggccctcttggccacagctggagctgtagcagctgggatgcaggaaacagtgtcccaaagctgtgcaggggagtagagaccctggttctggcccctgaaactattcttccctcctgggcctctgggcctatgatgggacgggctgccatgaagctctctgaaatgacttcagggcctttttcccattgtcttggctattagtacttgccttctttttagttatgtaaatttctgcaacctgcatgaattcctccccctgaaaatgggtttttcttttctaccacatggccaggctgcaagtttccaaacttctatgctctgcttcccttttaaatgtaagttccaatttcagatcatttctttgttcatgcaaataagcataggttattagaaacagccaggctacatcttgaatgctttgctgcttagaaatttcttctgccagataccctaaatcatgactctcaagttcaaagttccacagatccctaaagcaggggcacaatgcagccaacctcttgctaatgcgtaacaaaagtgaccttgctccagtttccaataagtccctcatttccaactgagacttcatcagcctagactttactcttcatatcactaccagcattttggtcataacaatttaacaagtctctagaaagttccaaattttccttcatcttcccttcttcttctgagtcctccaaactcctccaacctctgcccattacccagttctaaagctgcttccacattttcagtatcattatggtaataccccactcttggtacctattttctgtattagtttattctcacattgctataaggaaatgcctgagactgggtaatttataaagaacataggtttaattggctcacagttttacaggctgtacaggaagcatggctggggagtcctcaggaaacttttactcatggcagaatgcaaagccagagcaggcatcttcacatgaccagagcaggaggaagagagacagagggacatgctacacgcttttaaacaaccagatcttgtgataacttactgtcactgtgacaacaccaagggggatgttgttaaagcataagaaactgcccccatgatccaatcacctcccaccaggccccacctccagcattggggattataatttggtgtgagatttgagtggggacacagatccaaatcatataagtccctcccctgaccatctccctaagttcctctccctacttccagagctaaaatgacaccctgcctacctctggaccaactgtaatgccctacccacttacctggcttcttttccgtcataacaggtattcactaactgatgtttttgtcttttccctcactagcatgtcaactgcaccaggccgacttacatttgttctcttccccactgagccttgaatgattcctggcacagggaataggcccactaaataagggttgagtgaacaaatgaatggatgaagaaatgacttcttatatcatttacgaaaattacaaactcggcacgtcagagctggaggtgatattttcaaaaattattaccacggaaccctgtgttcagatgaaagtttattcacaccattttttaaatgccccagattaaaatggctctctttggctttattcatactagccaaaacctggaaacagctcagatatccatcaatagaagaatggatcaacaagctgtggtatatgcacacaacggaatactactcagcaacagaaacgaatgacttataaaacttgctaaatatgaaaaacattaggctgaaacaaagaagccagacagaaaagagtgcatgatatcccttctattcatactgcattctagaaaagatgaaactaatctaggaggtgtaaaaaaacaaaacaaaacaatgtttgtccccgcgaggtggctggggaagggattagactgtgaaggaggaagaaggaacttgtggggtgatggatgagttctgtatcttgacagaggggtgggtggtactcatcaaatggtgcacgtaagaattgtatatttcaatgtacctagaattttctttttattttttgaaatttgttttcttttattttacttttagttctggggtacatgtgtagtatttgtaggtttgttacataggtaaacgtgtgccatggcagtttgctgcacctatcagccaatcacctacttattaagcctgacatgcattagctattttcctgatgctctccctcccctgaacccccacctgcagtggcaggcctcagtgtgtgttgttcctctccctggttccatgtgttctcagtcttcagctcccacttatgagtgagaacatgtggtgtttgcttttctgttcctgggttagttttctgaggataatggcttccagctccatccatgtccctgcaacggacatgatctcgtttctttctacggctgcatagtattccatggtgtatatgtaccacattttctttatccagtctatcactgatggccattttggttgattctatgtctttgaacatttgattttttaaaaagccttaccacatccattacaattgtaaggttgctctctaatatgaatactctgatgtttccattttgatgttcaggtaaaagccttagcatgcacattacatttctgtggttcctctcaaagatgtatattctgctgtctagtgagttctgatgcctgggcaaagcctgacggcaatgtatgtatagttttcatctcacacaagaaaaagaaaaatataaactaatgttgagctgtagttaatgatatgcatactgaaatgtgtagggtcatatatttgcaacttcttttgaaatgtatccaaaaaaagaaatgaggagcttctcttccagaaagctgcagtagacatacttgtcccattgcttctgctaagcgccactaaaaagtgtagatgttatataaaaaacatgcacaagaagactctgaaagatggagagaagacagactgtctagagatcttgagactggaggaacaacatggtggagagtgccctggtttctttctgtcttgtatatcccagatatatagttgaagaaactgaactcagaaattccaaatgagaccaagaaggccccaacaaaagcctgctctctccagcctaaggagctggacagtggcagcccagcaagacagaaaagctttgggcaataaccgctccactctagccaaacaccacttaaaataccacagccccaccccaatcacaggtccttcaggaataaaatggaaataaaggcattctcaggagagggaaaactaaaagtgtctgtcaccagcagacatactataaatgaacagctaaaaaaaagttttctaaacaaaaagcaaacagtaaaggaaggaatattggagcatcagtaaggaagaaagaacatattaacatattaacataatagtaagcaaaaatattggtatgtataatagactttccttcttcactggacttttctaaattatgttgacagttgaagtaaaaattataactatctaatgtgatcctaaatatatgcagagaaaatatttaagcaattatattataaacagagaggatagtaggacgtaaagaaaggtaagtgccctacacttcacttgagcttgtaaaatgacggcactagaagattgcatgtctcaatagatgcagaaaaaaatttgataaaactcaacaaacgttcctgataaaaagtctagcaaactaagaatagatggaaacttcttcaacctgctaagggaacatctatgaaaagcctataggtaacatcattcttaacggtgaaagactgagtgttttcctcttaagatcagaaactctcacaaattcaacattgtactgaaggtgctatccagtgcaacagcaagaaatggaaacaaaagagattgagattggaaataaagaagaaaagccatctttatttgtagatgacatgagtgtgtatgcagaaaatcctatgaaaaaaagactactagaactaaaaatgtgactttagcaaaaatatagaatataaggctaatgtacagaaatcaattatgtttctatatacttgcaatgaacaaccggaaattgaaattttaaaaataccatttatagtgggtcaaaacgtataaaatagggcaaatgtgataaaagatagaaagatctatacattgagaattataatgtaattgctaaaataaattaaagaaaacctaagtaggttcataggtcaaaagactcaatatttttaaggtgtaaattttcaccaaattgatcttaaaataatttgaattgtaagttctcattaaattgatccataaattcaattcaatcttgatcaaaatttcataagggctttctttttggtagaaattgacaaactgattctaaaattcaaatgtaaatggaagggacctagcacagtcaaaacaactttgtaaaggaagaacaaagttgaaggactaacattgcttgattttgagacttgttataaagctacattaatcaggacagtggagccttctattattggcattgcttatacagaagcaaccaacaatccttccctctccgtaataatgctcctgaaatcgagaggtagagtctcatacccttctccttcaacctggtctggccatagcaacttgctttccttacagaatatggcaaaagaaactataggatgtgtaagctaggtcacaggaaactttgcagcttctgcctgggtctcttgaaacatgtgcttttggaaaagccattctagggtaagccactactaagaagtctgactttcctgagaatgccgtactgtgaagaagtgaaaactagacacatagataggaggtagggagagaattagaagctcaatcattccccagctgttccagcctactccactgaggtgctagatatggaaatgaaggagtcatatggggccttcagcctccttgagcctccagattgctgctccagccatcatccaactgcaaatgcatgagagaacccaagtaagaattgcccagctgaacctggccaacctccaatatcatgagagatgataataaattgttgtttcaaggccaaaaaataaatcaagacaaacatcaatggaactaacaatcaagagtccaaacatacactgattttcgacaaagacataaaacaatgcagtggagaaatgtcttttcaacaaatgttgagggaacaattgggtaaacacatgtaaaaaagtaaactttgctccatgcctcacaccatatttaaaaataagttctgggtcgggcatggtggctcacgcctgcaatcctagcaccttgggaggccgaggcgggtggatggcctgagctcaggaattcgagaccagcctgggcaacatggtggaactccgtctctactaaaatacaaaaaattagccaggcgtgatggcacacacctgtaatcccagctactcaggaagctgagacaggagaatcgcttgaacctgggaagtggaagttgcagtgagccaagatagtgccattgcactccagcctgggcgacagagtgagactccatctcaaagaataaataaataaataaataaatataaaaacgagttcaaaattgatcattacagattgaaatttctacagcttctaggagaatattgttgtgacttaggttaggcaaagatttcttacatcaaaagcataatctgtaaaagaaaatattgacaaattggatttctttgaaattaaaaacaaaagacattgttaagaaaatgaaagaacaagctacaggcttgaagaaaatatttgcaaatcatatacctaataaggaacttgtatccacaatacataaagaactcccaaaactcaataataagaaatcaaacaatccaaataaaaaaaatggacaaaatatctaaacagacatttcaccaaggaagagttatgaatgacaaacaagtatatgaaaagcgtcccatcattattagtcactagggagatgcacattaaaatcacaacgagatacggctatgcacccattaaaatgaatacaatagaaaagactgaccttaggaagcactgtcgaggatgcagcgcaaaggaatctctcatacagtgataatgggttttagaaatgacagggctgtcattaaccaaatcttttccaatcctagtaaaggtattactgtctaaatttcagtcttcctcttcatagggccacggtaaaaccagctttccagtgtctcacaagggtacccccaacagcagtgagctttgcactttaagcaatctggggtggctctagcttagaaacaatctttctggtgttttctttgaggcaccagacaacgaaagccacgagacacagcctactgtgtgttcaatggtctgtccagctctcttggatttggttgttggttcctttaaggcgtcttgaaaggcagcgtggtgcccaattaaatgaaaaccaggaaggcataatgcaccacgactatcagcaatcagctctagacagttcgttgaggacagaacaaaactttgtgtttcagcaagtgcttttctgtctgcctctctgcctgcagttagaggaaggggccaggttaaggccagaaaagattctgctttagctgataaagggaaagctctgtgccaggaagcctgtggttttctgtctttggaagttctcccctccggggcttaggagggagagacaccttcctcctaaagcatcgtatcgcctattgcccaggggaagcaagtctcacacatccgggccgggagaccctgatcaccccgggctgcgtactcgatttcaggccagcaagacactaggttttctctcttaaatgttttaactgtcgagttccatgctccgcctcctcgggcttcttatcctgcaggcataggcggagggaggcagcttccaggctggggtgggagaagcaccggcggcgcgcgctgcggtcggtgcgggtccgggagcgcagcgcaggcagcgcggggcctcgcggtgaacttggccgccggcgaggctgggcttctcgggcgcgggagccccagatcctgacagagccaggctgccggctcagcgttgtgttgtgacagaaaaggctgccttttacctttcctgaaaacaattcccgggatctgttagaggggaggttcagtcactctgaaatgaccagcgacatctcttagagccaaaatcagtcaacgcggaaaagacactccaatttttaaaaccaataggtagttgataaatggagctgtcagtctagaagcccctgggcccagcgtgcttctgcagagccgggtagtttcagagtcggcgctctctgagattccagctggtccacccggcggggctcctgttggcctcacagagcacgtggctttgcgggatgtgatgcgaccccagcgtgggcttaactgatgctaggcaccaggctgtggatccagggaccccgggacacacagaagtccagctctcatccctcatccaatttcacttttttttttttttaaccctcaaaagacccagatgccgttttagggggacaggatgtattgaagatttataaatggagcaatctcctaatcaaaataaacatcatccaatcatgctcacagggtggtggcaaattagtggcagcatattttgttttctttagcggtgatccatgattgatttatggattaaattgtgccctgtgaagtacatatatatctgtgaactgtctccctaagcatttcctgttcacctctgtgccacatgcctggctgaaggagagaattgtttctcctctaggcaggagctgtctgcatagctccttgggctgggatagtgtctgcttagggctgcattcggctttgtcttctgctctgtcctctgagctcagcaaaaggcctataaaaaggaaggccgactctcctacacatccacagggcccccaagctcttcatctgtgaagtgggacaataatgcttgtcttaccagtctgatagtgttcttttgaggatacagttcattaaggttggaaaagatgctggtgactgcagcctttgctgatccactttgcttgtctgtgagataaaggagatgatacatctttatcagtaatgcttcagttactttatttttaaaaaataaattgcagtaagcattataaaatattacagttgttactcccagaatgtggctacacaggtatttatgttattctctgtgtttttctgtgtctttcaaagtcttctcatccaataaaaagaaaagaagaggcaagaagaaagaggagttatgcaaaatctggtacccttaacttagactttctctggttctatggacaggaaaatgctcacaaaacctgagtcctgtaggaatgagaggtatgacaattattcatgatatttctgttccttccattgctctgggaatttactaaaatcctgcagcaggtttcacccctacactcaaccccatttgtctaaggcagctgtttgctcaccgggctgatttgctggtgggataggaattttctagctgaagaagggtaagcccaggatgatgtcatttataagattttgcttccatctcctcctccctccccaacaatcccaacctgtaccaaataggaacatacacctgtaggaagagaaactatgatctctagtcattaaaaatgtgctttgtatgatgcaatcccaaatgctcttgggcttaacaaaaacacattgcaagactcacattgacattgacatttccactcctctaacttaaaaacagccaaactaaattaagtaacaacaacaacaaaagttgtttcccacacagtttgaccagatcttaccaccagtcttcagccttaaaacaattttcatgcttgagttattaacttatgaaaataggcacaaaagggggaaaatgtgcacagatcctcgctactttattagtcattgctacagctgaatgcgttctggtacaaaggcatgttattctgcctgccagtatctcggttttgaacaaaatgcagctcactaatgggttctgcctcatatacctttctgtaatcattactttgccattctctgtaatttatcctgtttttcatgaggagtgtgtccattagtcaggcgtgtgcacacacatgcacacacagcttttaagtcccctttcatttgtagctgaaaagaaaggtcagagagctgccagtctttcggggggaagcactactgcgctgattgtgataatatttggaaaacagagtggtggatgtggtggatggatataaatagatcctgaaaatctagtgaatggagggcagcaacatgagtacatgaaggggatctagaagcagactggcaaaggtggagacagaatgggagagactgacctgtcccgtgttgatctctttatctgggaggggcagtgtggggctgacatcttcctggaccagacagagacatcttgctcacttgctcagtaatctcaagtttgggggatgagctccaagattccgacaggaacccccttttggcaatttctggcttgggctcagaggtgctgccccaagccagtctgagccaagtgaataaaggaatggagttttgagcctattgatttttgcttctgtaaactccagaattagttatagaaatgaaggcttttgagtgtttacttttgaaaaaaaaaagagcaggcaggaaaataattgggaaaaaatacggatgagatttttttaaaagcttgatgaagatcaaggttttcacaaacaagtgtgaatcactagaaccagctcctcacagatcagaggtctgcagggggctggggatctggcaaacaggccctccgtgggcagggagctccccaacaattctcagccagcaagagaagcctttggcatcgtcctcttgaattaggataacaggattctccatcatacacttgcctggttagggaggcagtaattgtgaaccgaacatgttcttttatcctctttgaagtgttaacgaatgctttgattttgctcttttctcctcattaagacaaatatggctcctttttgcccccaggaagctaatctcacctcccaagccaaacaggcatcctgctgctcagctgagtccaatcccaaggaggtcctctcctgtccttgccaaagacccctctaccaggattctgacccaggcccaggtgcagggcatctcagtgcttcacattgttctgggagcccagggtgcatcaccatggagccccagctcacgtgacaacataacagtgttcgcagtaattctcaaccctagatatcctgttcactacgaaacacaggcatgttaagtttccctgatactctcctgcagaggctagcaggctgcacagaatttaggaagacagagcccctcaaagatctggaatctttggcaattacaaagcccaatcctgcccacagccttcttttaccagagacaaagcaaaatggtttgcccagagcctcactgccagacagtggcagaactgagtctggaagtggccttgcttctcccagctgacattgaacccctgaggctcatctgccatcaaactcctacctgcagccctcacttcccccctcccagtgccagggcaaagtcagtgagatggaaatctgcagactggagcaggtgggttactcggaggccactgaaggtggaataggtcccttttgcactgtcttccaaccagagaggaacacaggccagtgggtcagagtgctaggccccagagtcacagacacagggcatggcccaaagggcccagtgaggacattcctgcagatggctataggctggtagagagctaggaggcctggtgaactctgtcgtgtgggcaatgggaaggtggacagaggagtgttcttgagaaagaaattcaaagctgagaaaacctaacccctcctatctcattcctcttaggcataatccccacgggcaacaggctcagtgtctggctgaatgtgcacctctcttttgaatccctcccccatcgatgaggttggtgtcacaaattagaccctctcccctattttcttcttttcaacaatcttaaccattttaagtgtacagttcagtagtgttatgtacattcacattgttatgtgaccaatctccaaaactcatttcatcccccaaaactgaaattcttaggcattaaacaactctccattccccagtcctggaagccaccattcttttttgagacagagtctctatcacccaggctggagtgcagtggtgcgatctcagctcaccaccacttctgcctcctgggttcaaccgattcttatacctcagccccccgagtagctgggattacaggtgcacaccaccacacctggctaatttttgtatttttagtagagaggggtttcactatgttggccaggctggtctcgaactcttgacctcaagtgatctgcctgcctcggcctcccaaagggctaggattataggcgtgagccaccgtgcctagcacaccattctgctttccatctctatgcagtggactactctaggtacctcatataagtggaactatagtgtatttgtccttttttgtctggcttcagtcgcttagcataaagccttccaggttcttccatactgtagcatatagcactgtttcttttccttttaaggctgaataatattccactgtatgtatagaccacattttgtttattcatccatctgtaaacactcgggttgtttctaccttttggatatggcaaacaatgctgctatattggaataaggatgtgcaaatatttatttgagatcttgctttcaattttttttaatacacacctagaagtggaacttctgggtcatatggttgttctatttgtaattttttgaagaactgccatcctgttttccacagtggctgtagcatttcatattctcaccaaaagtgcagaagggttccaatttccccacaaccttgccaacacttgatattttccgttttattgctattagccattctaacggtgtgggggtgatgtctcattttagtttttatttgcttttctctaatcattagtgatgccagtcatcttttcacatgctttttggccatttattaatatatatcatctttgtagaaatatctatctaagtcctttgcccattttctaatcaggttgttgttgctgagttataggagttctttatcttcccactccctggaccttttttttttgtttgcaactgaaaaactaaaggctcaaagaggcagacggcctgctgaagcctttgcccaggggctgcttagcagcagcagcagggaaaaactaaccctggctgaccctagcttaggtagcaactacagagctctcagcccattctcccagccacacagcctcagagcaaatactgtccatcaaatgcacactctgtgttcacagcctcatgtgccaaattgctgttggaaaaccaatggcaaacactggttgcagagaacacagaagcatgtaatatccactttaatggtggttccactttcatattttttctcccctctaaggaaagggagagagaaaaacctgttcgtggaaaaaatatatttaaatggatcagtgccagggaaccattggcacatctgttcttaacaggtttcagctgaaactactgaaaatatacatagatctgtttatgtggaaccagttaaatatgataagattacaacttggagggtaactatggatttggtggtggaaaaaaaaaatcccctccacacttggtctccgcaagcactcataacattttaccacagatgtgttgagggaatcagatttgctgcaaatggaaaagacctgaattatttgagattagctacaaacaaactcaagatgtccccaccgcctttctgcagcacataattcctgcctcgtctctaatctgggcccagtcctttgttatcagagaggagactgcagccagggaatcacccatttctgagtgagtctgtcttcactcctccaactagccatttaggaggaagacagtgtgcacactgcttacacagagaatgcacagttgtcttccttaaagttttcagcatcccaaaggactccatgttctcttgaggttgtgcaggcagcaaggagggagtgttggctgaggggctcccaatggaggccctgtgctccttctggagtctttttctatgtagtactcacaaccaccctatgaggttgcattgtcaccccccttacagagatgagcaaattgaggctccaggctctaggataatttgtccagggccatgccgataattagatgctctaaaggaagaaagatgtttcctcccatctaaatatgccttaacaggagcatcacttgagcccaggagttcaaggctgcagtgagttatgattgtgccactgcactccagcctgggcaacagagcaagacccttcctatattaacaataaataaataatacgtgaataagccttgaggcaaggtcatgactcaaatatccacagagtctagcaggagcaggagtgaggggccctaggcagctaatatggggccatagcagactgatactggggaaaatgcagaccttgtggcccagatcttctggtttttgtatagagaatgagaaatcactagatttttgtatgatggctcaaatattgaaaacaaacacaaagcacagcccctgctatagtttgcaatctccactgtgggtcctttgctgcccccagcggtgggaggaaggggctgcactggctttgaaccccctcttgttggggactgagcatctgaccatcaggatccttgcctcctggtgcaggaggtgtctgtcacaggccacaggcaccgcagctcagcaccctcatcccagtgtcccttctaaacttcattagactcctcaactctggcacactgtgaaatgtatattcatctataaacatttctctaataatttatctcaaaaaagtgacatcagtctctaaaatgcaccacgggacacaggaatggcagtctcatggcctcaaaaacaatcagccaaaattgacatctgacaacacctcctcccgcacccccaggggccgggctgtgatccgtaaggttttcattcttgctggaccccacgctgtgaaaatgcacctatttttattcatcaaaatcatttttttaaaataagcagcccagcggaaaacaattgtgaatggcagcttcattacatttggagttttggaacaaagacaatattgctcacactctatgacctgttcaatgatactgaagtttaattaaaaaaatgttaacgtactaaactgacaacaaggaaggtgcaacattagggtttctttgaaaaatcaggaaagcaaaatatgcttgacggattgtctcagttatcaattcaatgtgatttaacatttgtcttttggtttttatttgaaactttcagttttgaactagtagggcaataatccaagctgtatggaaccaaagtggggaggttggtgggactcggagggaaagttgaatagagggacccctattggccctttagagggctcaaatatcatcctgggcaaagttgtttcttaaaggtcccactagaattggctactgttccggctcccctagaaaagcccttgaaagggtattttctgagcaagaaacatggtgatgcttccaccacgtgactggtttaagacagtcattctagtagacctgataagtgaaagccaattattttgaagcaatagagtaagtggtgtgtgggcagccactgcatatttaacccagcctgagattcattaattatgaaagacttttcttctgagatgatgcgataatagaatacgaaaatttaagtgctgaaagtatgtcaatgcattgattttaaagaaggtgatctaaagcagcaaaaagtgatccacatgctctctggatagtctctaggacatgtcatgtcagttcatgtcttaaagccccataaaagagagccattttcccccaaccacagagccctgagatctggccagaggtcccatggtggaagactcgctcccactgtagcctgtgaaagaggaaagccactggccctcatcttggggacccgtgaagacccacctcccacttggagcaagtgagggaactgcagggtattgggtgaggcctgctatacttcctacaggctttgggtcttggaggtaatggtaccagcctcatagtgtgggagttggagcgtctgcttccaccctgagaaaataggtatgggagcaggtcacaagctaggacagtgcctcgacctccctgaggaaaagaccagaatgtattcagagtccagggtccaaaccagggttctggagtggcaaatttaaggccttgaggctggactggaccagtgcagagtcagggagccacagctgtgacctcagggaggtgcttgtcatgcacagggaggaggctgcattctgttctcagagtgacaggaagccactgttgagttccaagggggagaaggacatggctcaatgtgcctttcccaaagatcttgccgggtctctctggagtaggagtctggacaggtaagagtctggactgtgggccaagtgggagacatgggatgggagacaacaggatggactcttgagacatttcacagatagagtcagcaaggcacagggaggcactgggtgaggaaggtgagggcagggtccatggataaatttcacagatagagccagcaaggcacaggggggcactgggtgagggaggtgagggcagggtccatggataaggcacctaaaacccctggtttcccatttagagaaagaatccaataattcctacccgtctgagctgttgtgaggacagagaatggtgcatgccatgagtggctcacaacagggctccaaggagtgagggtctggctgtgctcctgttacctccttttgtcatcacaagcacagatgatggacatctgtctctagctatgttacttctgaccccccagccccagcaaagcaggaagtggggcctgggtggagaggggtgacaaggcgggtttgaattgatctttctgagaaatcatgtgcaacttcacaagcaaaacagttacgcaataaacttccaggttcttaaaaccatgctgagggttacaaaaagaaagttaacgggatgctgatgtggactgtgcaaatcgttaacatactgaaaacctctgtgtccatggtgacgtatgtacaagtgagctggatgagtgactgccccctaaggccaggatccctgtgtccactctctgccgtgcctgtccccatcatcactcctggtgaagcagggacgatagcagagttcccactggaggaccaaacatgcatccagccctggaaaacagtgccacactaggcacactggaccttcccagccctgggcagtgggacatgctagagaagttgattcacaggggaaactgggtcctatctgtggggtcttcccactggctggaagggttcctggaggaggagtttcagggctctgtgaggatgggtaggagggcctatggggcaaggttcatagcatcctgcttggagaaggacacataccctgtttcctcagagccaacacattttccattctaaatatagcctaagatgacccaagacatcttgagtcccttgcagggagaccgcagttttgtaattttcggcacttctatgattctgaggaaatgaacagtaaagcccgaagccctttcacttgcatcccctgagcctggggactggcagacaacactccaccctttgaaagaagagcccaggcaagctggccctggtgagaagctccctttagcaaccaattttaggagattccacaatagtttgtcagcctactgtctccctccggcaaagtgaagtgaggcttctgttcacccagcatgggtcactgtcaccccaggcccacaatgagtagctctttccatgacccttgggatggttcacctcctgagagaggcccagctctgacaggctttcagttggacaatagatttcagtctcccctgaaatcgttgctgcatcaccagctttcgtagcatttctgcaaagtctaagatacaagactttcaaagagggagcgcccactacatgcctggggcacagcggtgactcttggcttggaggcgcttctctgcttgtttgtaagccaggggatatttttactatctgagtggggccctgttaattgcttcacaagcacttctggggaagttcactttccaggggccagtcgttaactccaacagtgccagcgcttcccagccaggggcctacataaagaggtgcattagttatccctaaagggttaatgactggagatgcgaggacagtcatgttgagttatatatagcaaacagtgagcaaagcaggcaagcacaaaaaaaggaagacaggaaaaaaactgcatggatatactcccctcccccaaccttccctggtctacccccaccctcccacaacactatatatacagaccacagttaaatttggcacagagactatagccaagaaggaaaacagatcgagttacacaaagtcctattcagatttgggcctgggcctcatggggacaatgctctgctgaggagaacaaggccatggtctgttgtcaaaaaacgcacacccgtgcgctttgctttccttccaagcattcgctggcctggccctgggcagcaggttaattccctgctccgcaggtggagacagataaaacaaactgaaatggtgtaatgggctacaggaaacctttctttcagaacttgattcatctccagaaaggaaacacacgaggactttgctctggacggtaatctgttttcttagggcagctgagagaggcctggcagccagggtaaatacggcaactggtagaggggcttttggcagatggagctgcaagagaagtttgaaacgatcacttcctacactctgttccctaccaagagtgagctgtcaatcttgcaggatggaggtgctctggaaaacagcagtggggagagagcgggccacaagggagaaacctgagccacaggtgcgtgcctgggataccccctactcctgcgggctggctcacctggcagaactcgcagaaaggctgctcccaagctcactgctcgaagctaaccatgtggagaaagcaggccaggacttctggaatgcaacctgggtgcaagtcaacctctgctttgagcagacaagcaggcccgcagcgggcaggctgccatcgagtgtggcctgagcctctactggatgtaaagctgggcatggagaaggccaggtaccttttagtcattggaatcatccccatcagcaggcacgcaggacacctcgaggagatgagacagccagctagcacgtaacagtcagggctgcatagaacatgatagtcataaagacaatccctcatgccaccttcgtgtgtgggtctttcaaaagacattctatcttattatcccatttgatcttcacctgaccctagatgggtcgggcagggcagagcatcaccctcgttttactgtggaggaagtggaggcccagcaaagccactcttgcctgagtgggaacagctggttcaaagatagccctttgcccagccctctgggaagataacacctccgggccagtctctgtggtgcaggcagtagtttgtacatttgagtgtgcacccaaatcaagggggccatcctcggcctggtatagcctgctcccctcaggttgggcctgggacttctgtgtgggccccggcccccagcaccaaggtgggcatccagtgatcttagttcacactgggcttttccatggacacaagcttagtctgcattggcaaagtggggacaatagctcagcatgtgtctagggctgcctcaaacagtgacggacccagaggatttcatctcctttccctgcatgatttgatgggctctctaacttgaactccctgtgtagaaagaatgtggttatgggctgagttgcgtctcctcccccacattcatgtgtttaagtctgaaccttcagttcctcaggatgtgaccttatctggaactagtaccattgccggtataattagttaagatgagattatactagagtagggtgggcccctaatccaacatgactggtgtccttataaaagggggaaattcagacacacacacagacagggagaatgccctgtgaagatgcagagacaggttggggtggtgcttctgccagccaaggaacaccagcggctgccagcaaacaccagaagcacgaatgattctccctcatggcacccggaagaaacctacgctgcccaagctgaccttgaactttcatcctccagaacttccaggcaatcaatttcagttgttaagatcctcagattgtggagctttgttatggccttcctggaagatgaacccagatgctaaaaaggctgaggagtggaaaactgatgtctgtggttagtttaccttgaaaaccaaccatgaggccccttccagctctgttctacagacatcgattctgctttattgtttttaccaagagtagtactccacaattgtaaacacagtccacaagttttctactccagaccatctctttagcagagagaaggaaatatctgtcttccttctccaaatcctaaccctactttgttctcaatagaaattatattgtgtctaagtctcccaaaatgtctcaaaagcaagacaaacacccacttcctcttttggaaactgatgggaccctctacaaattacatgtggagacatcactctttcccaaccaacatagaaactcaaactcttgtcaactttcctagtatcccaacttgctttcaagagaaaactaaaaactcattcacatgaataaagtataaatgacagtcaagagcttaaagtgttagctgtcctaggtggggaataagctcacaaggaacatcggtaaagaggaacatgtcaggagtgggagcccactttgccttataccctgaccaggtatgtagtcctcaatgtaaaactctcccactgggtgggaattcctcccaccccaacaacgccagcctccctgtggctttgcatcaggctccatctcctcatcgcagcgtggaactctattcctgtctctccaatgtcctcacaccccagtgactccaacgtcctctaggactagggaagtctgcacggaacctaccaaaatccctggcactctgacagccccttctagtgacaggagcttaaagtgtagcttaaagaagcagctttggacctggtagtacctagggctaaattctgcagtactcaggtggaccataaaataaggccatattattagacttgatgtgtgaatgccactctccttttctttgattgtcctgttcctgaaatctacctgctctagaattgcctcccagataatgtctcttctagccttgctcttcccccagagtttcctattgtttatacaagtcctgggttattgttcctccacccagcattacttaatacatcaattaattagactataggctttccagagagagaatcgtacttttatccatttccccttcccagattttggtgacttacatgtagaagttactcaataaatatctgttgaaggttaattcaacctgaatttcttgtgttcgtctactcttgttacctgttttggtccccaaatccttcccacttcagacattcggtcagcccatcaacagaggttgtctcctaacatagaccaaatctataaggagctgatttcctattaattcagtgacaagatgtcacagatcttcagagttggaagattctttagaaagtatttcatccatttctttaataagaggccatgttactcatccaaggccacacagctggggaagcagcagcagggcctggcaggaagatgttctggtggaagtgaggccattcatcatgtccaagaagctgtcatctgggtggccagcgttgggtgagaggccaactcatacacttgttggaaggttccctctattggaccctgggcatttctatttaacccaaacacgcctctgcataagtccaggtatctccatcagatcttctccgcaggttatcctcataggcaactggacgaggggcccatccccaatacaaccaggctgcacagactcctgctcccaccgctgggtagcagagacacagcctcctgccctatctcacaaatccatggatgtgacccatgggagtgacttccatttaaagttttgggcaaatctcggagattgctgttttcaaccactggggaagcttaaagccaaacagtcctactggcatagaagtaagcctcatttgttttctatctgaacacatgttttacatcaagagaagggctgtggttggggtagggagagctgaagggagattcaaaggttcttcagctctcacagatctcaacctcttcaaagtttcaaccctcagagcacttaagatgtttcatcccactcagcagaagtgcctctgcccacactctcgtgtgccacagtgcgtgcgtgggaactcagctgtggtccagagccagtaaaggaaacgggacagtcacctcactgtacttttcctagaggatgtaatttctcctttgggatttgataagcttcctaaggcacattcacatgcacagggcagatgagacctgcttgttagtgaggtcacatcaagcctcacatggtgatgtgtatgaatgaactcatacttaaaggaatgggcaactcctacctgggaccttgagcaggtgggtatgggtcagagcccagagtcagggtggataggcaatgggaaagagagaaaaggtttgcttttagtggtaaccactctctagcctcagcattctcaactgcagactggagataataataatgtccttctgtgatatttggggggttgaccaaataagatttcttgtaaaagtgctgtgcacagggcagatgagcatcaattctgtgaccaggaagggattccagtgccattgccagctcctggttgcgttcttttgagatgatgtattttttttcaagggaaaggagcaacaagagggtacctgcagtctgtaggacaatacaagtcaaattctggagtaaaattgtagcacttacactgtgtgctgagtcatttgtgatcagagggaaactgaaaagtggcataacagggtgacggacaggcccaggagaattcactatgagtcttgggagtgctgctagcacctctgctacctcctaggtgggtcatttcacctccctggcccaactgtgaattcaagaataccacatccagcactgcactgtggcaagggctcctgcagaataatgcaagggaagagagctggaaacgacaacgtactggtcacatgtgtgatgccatttgatgtggtttggctctgtgtcccccctcaaatctcatgttgaattacaattcccagtgttggaggaggggcctagtgggaggtaagtgaatcacgggtgtggacttccgccttgctgtgctcttgatagagttcacgagatctggctgtttgaaagtgtgtagcacttcccccttatctctctctctctccggcgtgaagatgtgttagcttccccttcgtcttccgccatgattgcaagtttcctgagacctcccagccatgcatcctgtaaagcctgtggaactgcaagtcaattaaacctctttccttcataaattacccagttgcaggtagttctttatcacagtgtgagaatggactacacattattgttattgttaaaggaaaagaggagggggcaggaggaagaggaggaaggaaaagggagaaatgaggaaagagagggaaaggagaaagagggaggagaaaggggattgccttcctttttaaaaaaataaactttttattttagaatagttttaaatttccagaaaagttgagaatagtccagagagtttccctagatatcacacccagtttctctcattgttactatcttacattaatgaggtacctttgtcacaattaatggccaatgttgatgcatattaactaaagtcacccttcattcagatatccttagttgacccagctgtccttcttccaccatagaacatcatgttacactgagttgtcccatctccttaggcttctcttggctgtgacaatttcttagactttccttgtttttgatgaccttgacagttttgaggaacactagtcaggtatttcgtagaatgtcccaacattgggatttgcctggtgttttctcctatgattattgggagaagaccacagaagtaaagtgctactttcatcacattctatcaggagcacatcctatcaacatgacgtcactcgtgatgttgaccatgatcatctggctgaggcagtgtttgttgtacgtctccactgtgaagtttctcccctgccccctttccacactgtacactttgaaaggaagtcactgtgtgcagcccatatttaaggagggggaattatgctccacctccttgggggtgcagtattacataaattacctgaaattccaccactctggagatgtgcctattctctgccatttacttattcatatgtatgtgattaaataaatatataaatgtaaatcagtatggaatcatgcatatttattttatacttgggttatttataatccaatactactttattgctcaaattgttccagcttaggccattgaaagctttttcaagtggtcactgtgtctccttgacctgtgtgttattgtttgttcttctgaacacgttcttactttctggccctgtaaaatgctcctccaggctcattttgtacattccccgcctgtcctagaatcagccatttctccaggaaggcttacttccttttattaaatggtattaagaacagtgggggcggtggtgggggcagtggcagtggtggcacagtgacgtcagggcgttggggcagctcctgtgacagacagagctggagcggcggggtggtggcagaatccagcggccgggagagtggaatgaatcttacttgttgaatatcttctggttactagttggattcatttgtaaaagaatcattttccgctgagtggaagacacttagtgtcatatttatattatacgtccacggatcaaaaagctttttgatttcccaaaggagggacataccactatatgagataagcttgacattacagccaagatggtgctgtcccagagacaatgagatgaactaaatcaagctaaagcagattatcttcgttcaaatggctacgaagaggcatattcagtttttaaaaaggaagctgaattagatatgaatgaagaaataaagtaggctggtgttttgggggaaaaaatggacatctgttattagattacaaaagaagtttatggaattagaatcaacactaaatgaagcaaaagaagaatttacgtcaggtggacctcttggtcagaaacaagacccaaaagaatgggtattttctgccagaaaaatacacattgagtggtcacaggagtccaatcattcgagtcattttccatcctgtgttcagtgttatggtctctgcttcagaggatgctacaattaaggtgtgggattatgagactggagattttgaaagaactcttaaaggaaggacacacagactctgtacaggacatttcatttgaccacagtggcaagtttctggcttcctgttctgcagctatgaccattaaaccatgggattttcaggactttgaatgcatcagaaccatgcatagtcatggttccccatgaccataatgtttcctcagtagtcatcatggccagtggagatcatatagtgtccgcctcaagggataaaactataaaaatgtgggaagtgcaaactggctactgtgtgaagatgttcacaggacagagagaatgggtacatattgtacaaccaaatcaagatggcactctgatagccagctgttccaatgaccagactgtgcgtgtatgggttgtagcaacaatgcaatgcaaggctgagctccgagaacatgagcatgtggtagaatgcatttcctgggctccagaaagctcatattcttccatctctgaagcaacaggctctgagactaaaaaaaagtggtaaatctgggccattcttgctgtctggatccagggacaagactattaagatgtgggatgtcagtaccggcatgtgcctcatgaccctcgtgggtcatggtaactgggtatgtgaagttctgttcagttctggggggaaatttattctgagttgtgctgatgacaagaccctacacgtatgggattacaagaacaggcaatgcatgaagaccctcaatgcgtatgaacactttgttacctcattggatttccacaagacagcaccctatgtggtcactggcagcgtggctcaaacagtaaaagtgtgggagtgccgttgattgtgtcttcttcggcccttcctccctcttttcctctggatgcactctgatgataccatggctaccccactgagctctgtttaaataaatattgtcctttcatgtaaattattctggatgtagattgagcttattaaatgttacaaagaaaaaaaaaagaacagcatcaaaaactaagacgtaaacagtaggtgtgctcattgctactgggatgacacttattcaggccctgtcaggagacagaacaaggaaatatataccaacccatatctgtaagtgtattgtacatatccgtctgcatctattttgagctgaactcgattccacgttgatgtccccaacactaaccactgccatatgaatcactgcaacctttcctgcttgcttgttggtagcctcccctccaacaaagagaaacctggctcccaccatcctccatccagtgacttcacatttcagagcgtgtgactagtggcttcagaatttatatccttttgggaaagagctttatctactagaatacagggttgtggacagttccttatgccttaatcttacagtctccactcacttccaatgccacttggtcagtacgctttcctcccaccccttcagtggaattattttatacatttgtaatacagttagtcttctgtcatactcagcaccccatcttggaatcccccaacatctttaattatttttttaatttgcatatgttaaggttcactctttgtgatgtaaaattccatgggtttcgaaaaatgcagtgtcatgtattcaccaccacagtatcatacacaataattttaccattctaaaaaaaaatctcttgtgctttgctgactctactcttccatctctacaggcccctggaaaccactgatccgttgaccatctcgataattctaccttttctagaacataatataaatggataagcttttttcagtaaacaatatccatttaagttttatctatgtttttacatagcctgatagttcatttatttatatctctgaatagtattcctttatatgcatgtactacagtttattaatctattcacctactgaaagacatcctggttttccagatattggtggttatgaataacgttgctacacacatttgcatgcaggtattttgtggacgtagttttcaatcagttgggtaaacatctaggagtatgcttgctggttcatacagtaaaataatatttaactttttaagaaacttccaaacatcttttaaagtagctgtactattttgccttcccaccagaaacgcatgtgggttcttattcttctaaattctcatagcaattggtattgttggttttttgtatactagccattctaataggtgtgtggtgaaagctcattgttgtattcatttgcatttctttaatgacagatgatgtttcacatgcttatttcccatttgtaagatatatatatatacatatatgtacatatgtatatgtcatatgtatacacacacacaaatatcatctttggtggtgatttggaggtgtctgttcagatttattcattttttcaattggattacttatggtctttttgttgacttttaagatttcttaaaatattttggatacaagtttcttatcaggttcatgttttgcaaatatttcttttcagtctgcagcttgtgttttcattatcttaacagaatcgttcatagagcagaagtttttaattttaataaagtccaacttctctattttttttttctttcatggttcatgcttttggtcgtgtatctaaaaattcctcaccaaacccaaggtcacataaatttttttcttatgttttcttctaaaagttttataaatttgcattttaaatttaggtttatgatccatttagagttattttttgtgtaagttgcaagttctgtgtccagattcatttagcctatgaacatccaattgttccagcaccacttggtgaaaagacttcacttgctccattgagttgcctttgcgcctctgtcaaaagtcaggttattatattgtgtgggggggtctatttctggcatctccatttgttgatttatgtgtcctttttttgccaataccacaccatcttgattattatagctttatagtaattcttgaaatgaaggactctgagtactccaactttgatcttctttagtattgtgttagctattctaggccttctgcttgtttatattaattttagaatcagtttatcaatatctaaaaaataacctgctgggattttgaattggactgctctgatcaagttataaatacttcacatcttaacaataccaagtcttccaacagataagcagggactatcttgccatttatttggattattttattttgccagtattttctagctttttgcctacagtttccatagattgtgtcaaatttataactaaatactgatttggggggatgctattgtaaatggtaatgtaaatttcatttcaaattctaattgttcattgtatatgggaaagcaattgactttggtatattttctttgtatgctgtgtccttgttatactcaccttttccaatgaggttttcacctttttttgtgtgcacagattatttggcatttcctacatagacagtgtatctactaataaagaccatttttgtttctttttgtccagtctgtatatctttcttttaattctttttcttattgctgtagctgggacttccagtatgatgttcgataggagtggtgagagaggacatccttgccttattcttgattttagggggaaaatgcccagcctctcaccaataagtatgacatttagtgcaggctttttgtgcatgttctttatcaagttgaagaaataccctctgtttctagtttgccgagagattttattgtagataggtattgatttttttgaaatactttctctagcagttgatatagtcatgtgatttatcttctttagcccattgatatggtaaattacgttgatttttgaatgtcaaaccagctttgtacacatggaatgaatcccacttggttatgttatataatattactgaatatgattcaataattttttcaaagatttttttgtatctatgattatgagagatattggtctgtagtttttcctttcttaaaatgtcattagcaggttttagtgttagggtaatatactgtgctatggtctgaatgtttgtgttcccccaaattcatatgttggaattctaacttccaaggtgattgtattaagaagtggggcctttgggaagtaattagatcatgagggcggagccctcatgaatgggtgatcccttgtagaagagacctaaatgcccttatagtagaggcctaagggagactcctcatcccctctaccatgtgaggacacagctagaaggaaccatttatgaagcagagagcaggccctcactggataccaaatctgccagtgccttgctcagggacttcccaaccttcagaattgtgaaaaataaatttctattgtttatgagccacccagtttgtgtggtgttctgttacagcagcctaaacagactaagataactggcctcataaaatgagtttggaagcaatgcctctgcctctattttttggaagatattgtggagaattgttattatttcctctttaagtattctgttgaaagtaccagtgaaactatctgagcctagtgctctcttttctggaaggttttaaattattcaatctcttcgaatataagactactctctttggggggttttaatagtttgtgtctttcaaggaattgttgcacttcaccttaattatatttatgagcataaagttgtttgttgtattacttaattaaccttttaatgtctatgggatcagttgtgatgacctctcttttgtttctaatgttaataatttgtgtcttttctctcttcattggcctgactaaatgtttatcaattttattgatcttttccaagaaccagcttttgttttatgatttttctctactgttttcctgtttacaattttattaatttctgttctaatttttaattacttatcttattttccttgcttcaggcttaaattaaattaggcctctttctttagtttcctaagatggaaacctgaatgattgactgtagatctttttttttctaataaacatatgtgtttaacattataaattcccattgttctgctttttgtcactataggttagtttgcatttttaaaaattttatgtaaatgaaatcatgctgcttgtatgttttttcctctgctttctttcgctcagcaaaattgttctcagattcatccatatccttgcacgtatcaatagtctttcttttctttcttttttagacagagtctcactctgtcacccaagctgtagtgcagcaatgtaatcacaactcactgcagccttgacctcctgtgctcaagtaatcctcccaccttggcctcatgagtagctgggactacaggtgtgcacctccacaccctgctaattttcttttcttttcttttcttttctttctttctttctttttttttttttttttttttttttttgagacacagtctctctctgtcgcctgcccaggctggagagcagtggcgtgatctcggctcactgaaacctccacctcctgggttcaagcaattttcctgcctcagccttcccagtagctgggattacaagtgtgcgccaccacacctgggtaattttttgtatttttagtagagatggggtttcaccatgttgcccagactggtctcaaactcctgagctcaagtgatctgcctcaatctcccaaagtgctggtattacagatgtgagccactgcccagctgtctgtttcttcttattgcttgatagtactccattatatggatatgccacagtccatttatctgttgctatacctttggatcattttcagtttcaagtgattgaaaataaagctgttattaacaatcatgtaagaatgtttgtgtggacaaatgctttcatttctcttgagtaaatacttaggagtggaatggctgagtaatatagtaaatgtatgtttaacttttaagaaactgcctatctgttctccaaagtggaggtaccatgttgcattcttaccagcaacatataagagttccagttcctccacatccacaccaacacttggtgtggtcagtatgtttaactttagacattgtaattcagactgaacacatgaatgtggtatgttatttaagttttatttaattcctctcaggaatactttgtagttttcagtatacaggtcttccccatcctttgtcaggtttattctaagtattttatatttctgatactattataaatgacactctctatttcactttctgattgttcattgttaatcatataaatgaaattgactttttaaatattgatataacagcttgtatcctttctaaattcacttaagagttctagtatcttttcgtagattcacatatttttgccattttttgtttgtttcatgaaagaggatatatttggtctctactactccttttggccttaattgaaaattgggaggatatgcattttaaaagtatatctttctaaggtcagttagctcatggatggagtggttatttgaaatcagggcatggtggcagcaagagccagcaggcatggaaacagtgagtctggtctgctctggtggtggcccataagaggaaaattcttagaacactctgccctagtaatgagagcaagatatgtgaggactggcttgggagtcccttctgtggatgagagtattaaaccccatgatgatttagtgtccatccttaagggatgcttgccaaggtgtgagacaaccatgtaatgggatactctgcagtcactaaaccagatggcaaaaaggtcattggcatggaaaacgcttgtgggttatgactgcattagttttctaatgttgcattaaatacgtagtcatgaatatgattgctctttttaagcataggctctgaggcgtaggcacagaatgttggggatgatatttaaagttctgcctttatataattgccaaataaaaattggcatgattcaaaacactatgtgcaatagagtaacatttttataagaaaaaaaagtgtatacagtaaaaaattatgggcagtgtttgttctttaccctccaagattttttaccataaacatgtatcactaggatactgtgaacagcttacatgaaacctaaactgttacaaatccatttgtaagatggaactcaaggtgcattttcccatagacacaatgtttttggggtgattggagccctgtgactttccacaaaagattttaataataagactctatgccccaggccttatttctagtgggcagtaatttcaagtttaattcaagatgccaggaataaatggctgtgtctccctcactcaccgacccatgaagaggcatcagtggtcaagggggctggtgaccaggagttgttcacattacatcgacataagaaaatgccactctctatgttcacaagaacgtatgttccattctaggagaggaggggcagagccccctcacagctgctgtacactggggttggcctcttcacaggcatgtctgtgtgtgtgtgtgtgtgtgtatgcatgtgcaaaaatgtgtacacatgagcacacgaggggacatatcagtatgcacatgtgtatgtggcaggtgatctgcgtccatttatgttgcctcttttcccagaagaagaaaagagtccaccaagaaagtttttgtttgagagtataggttttactgcagatatcgtgagacatctctgagagggttttctttccctgtcccgacccctcccctctctcatctgccattctctccagcctcactctgtgtggtcggtgactgattaaataaactgtggagcattcactccatagagtcctactcagcaagaaaagggggcattggataatgatgtgcccaacagtgtggacaaatctccagagaattgtgctgagcaaaaaagacatgcacaccacgagtctattattcctgaaatgacaacattataaaaatgaagaacagattattggttgccaggggttaaggagaagaggatggaaggaggtatggctataaaaaggcagcaagaggaaccctgtggtgatggatacacagaccctacatgtgggataagattgcatggaaataaatacacatgcatgtgtgcacatacacacaatgaggacaagtaaaagtatatcaatgccaatattctggctgtgctattatactatcatataagatgttatctttaggggaaactggataaagggcacacagtatattatctgatttatttcctaaaactgcagaataatttacaatgatctccagataaaaaagcttaattttggcctgggcgtggtggctcacgcctgtaatcccagcactttgggaggccaaggcaggaggatcgcttgagcccaggagtttgagacaagcctgggcaacatagcaagacattacctctacaaaagtaaaaaaaaaaaaaaaaaatagcatgatgtattggcgtgtgcctctggttccagcaacttgagaggctgagttgggaggattgcttaagcccagatggttgaggctgcagtgagccatgtttgagccactgaacttcagcctgggtgggagagtcaaaccgtatctcaaaacaaacaaacaaacaaaaagataattatagtaaaacaaaacaaaacaaagcttaatttttaaaaagtgagacagaaataaatatttttctcaaacaaaaactgagggaattcctagcgagtagatctgtcctaaggacagctttgcagaagctcttcaggcagaaggaaaaccttattagtcagaaactggggtcagcatcaggcagagatgcagggcagagaaagcataaatgaaggcaaaataagatcgtttgttttgcttatttttttaatttaattctttttttattgaggtaaaatatacatatatgatttaccatctttaccattttaagtgtattgttcaatggtaataaatacatcgtgttcctttttttccctacttcccctactctcttctttatagtccttattctttattgatctaaattactaattatggttttgcagctttcttcttatgttttggagccaatttttgttcaagtgtcaagcatgtttttttgaaaccttgcagagctggggtaggccttatgcccatgggtgggtggctggaagggcctggaaagaaccctgatgacacatggttctcccagggtacccctgcctctcccagccatggactccagtctctctgagaagccataacagcttttgttagaggggaccactgacgcctttagcatgtgggtgttgactagggctatgggcacgagtgacagatgcaagggcattggagtcaggccgacgtgagtccaaaccccagctctgcctcttagtagctatgtgatcttgggcaatttacttaacctctctggtctccagtctcatatgcaataatacttttcagggcggctgttgtcagttacaggacctaacacatgggatagacgccatcacataatggatgctgttcatttccttccctattatgatatgtatcactgttccttccagtgagtagacagttgccacactcacattggagactcccttccttatcaactttcataggtaagagctgcagtgctccatcctctcctgagagtttattctctgcagggaggcaaacataactatcacttctcagttgtcctccaaacttaggtgaggatccagttttgtaggagatcttgcagcttaagaaaacaggtctaaatccaagcagcctgatgaaacaataaccccaccttcttccattccccaaatccctttgagagtaggcgcattgtgttgccttcctggtggttccaaaaactggacctctggactttaatgcaattccatagtccattctttgtccagcagtcaaaatggtgtctttagacatttaaagtaagttagcaaggattaaaaatctcccatgcctgacccagcctcctgtctctccactctccccatggcttacactgtcccagccacgctcatcttgacaagtttctcaacttgacaaactcattccacctcagggcctttgcacttgttggtcctgctgcctggaaggctctgcccctgatctgagtatgcaagcccctcatcatcctgtcccagctccaggatcgccccagcaggcagccttccctgaacattgttgaaatgagaactcctccctcctcctcccttggcagccctcttaatttctccgtttgccccccagcattcaccacaatctaaaaccacctcactcgtttacaagctttcttgagttttctccatttcctccttcaggaacatcagctccacgggactaagaatgagaaatccctggtgccctgatctaggcccagcactcaatttgggtgagtcccaacatctgtttataagtgaatgactgtcccttccctccctggcaaggggactcacaccctgcaacagcaactctggtccgtgacccccctggagagctatctgtggatcccaagccattcccagaccacatagctggtagctggcacagggggaagcatgccagggtccagtgaccccagacagtcacttaggatgtgatatggtttggctgtgtccccatccaaatctcaacttgaattgtatctcccagaattcccacgtgttgtgggagggacccaggggtgaggcaattgaatcacgggggccagtctttcctgtgttattctcgtgatagtttataagtctcacgagatctgatgggtttatcaggggtttccacttttgctttttcctcattatattcttgccactgccatgtaagaagtgcccttcatctcctgccatgattctgaggcctccacagccatgtggaactgtaagtccaattaaacctctttttgttcccagtttcaggtatgtctttatcagcagcgagaaaatgaactaatacagaatgttagccccaaggataacatttttgcaagctcagctggcagacctgggcaggaaattcttttcttttcttctcttttttttttttttttaatttttatattatatagagaagggtctcactatgttgcccaggctggtctcgaactcctgggctcaagcgatctgctacttggcctcccaaagtgatgggattacaggcatgagccaacgtgcctggccatgaaggttctgaataaggagtaacggggcatgtctccgctcatatgcagccatgtagcttgatggcttgggattagggagcagtgctaattcagcagacaccaaggcaaagaaattacacctagggaagatttacttcttatcctctgcatcccacgtcacccccaccccccccagctgagctgcaccccacgctcccagcagccctcacgctgaggaataagcagctcagctgcctctcccgcatcctgccgagctgcagccaagaccagagggactttccccacccccaccacacatgtgtgtctatccacagaggaacatctatcaggggctcctggagagaaatgactattccataaagatttcatttttgttggagtctatccacagctctatatagtcataaaaatttaataggaaacttccataaaaaaagaggcataattaaaaagaaatagggacagctccagcagaggttgaagattaaagaccaagaggcccagcacagataggggaattttatgagctaccaaagaaagaaaaacataccacacagaaaatgcatgcagtagagacggtcctgccactttgagtgaggtgagccaaccagacccgggtgccattctctgaagatgggggcaggcactcaggccgtgtgtgacacagtagtgctcaagaaacactgcagctgcaagtattgggagccagtgagatgtcaagtctccactgccggacagcccttcccttgttggatccacagaagtctgaggctcaggacaaagataaccctctgaaatttcatggcctgaggagttgagttgttacccccgtggtcatagggctggaggaaaagcttttaactaacctctgggggactggatccttagccaacattcaaccaaaacactcaacttcaaggcaccaacttgcttttcattagactattttctctttttttttttttttttttttttttgagacggagtctcgctctgtcgtccaggctggagtgcagtggcgcgatctcagctcactgcaagctctgcctccagggttcatgccattctcctgcctcagcctcccgagtagctgggactacaggcgcccaccaccacgcctggctaatttttttgtatttttagtagaggcggggtttcaccgtgttagccaggatggtctcaatctcctgacctcgtgatccgccccctcggcctcccaaagtgctgtgattacaggtgtgagccaccgcgcccagcctcattagactatttttcttattacaaatacaatagatgttccttgtagaaattttggaaatacagaaaagcaaaatgaggattaaaactgactgtcatctttttacctatctatatgcatctatcaccttgacatttttgcttcccaatctttggaaaaatacaggtcataaagaagaaaataagaaaataacgggcttggatactggaaatctgggcaggataaggggaaaactgccatccaaagcaaaccagagacacaaaatggctgagttgtggacagagcttagcgcttacagagcaatcctgcccatcagaatcccaggtagctcaaaggagaaactgaggcttaaacaatgggggtgggaagggaagaaatgcagagagatcctcagggttttacaaccaaaaagaaacagtagatttgatggcctctctgcaaagcccatgggtatgtgtacatttctgtccccatttccaaattcgacacagtcggtgatgatggcggcttctggagtcagcactctttgccccatctaagctatgactgtggtggtggtacccacgtttctgctttacctgcagtactgggggctgggagccatgagccctcaggggtcattcctaaagagaacagtgagccccagatatccataaacataatttcacaactgggaggaggcagctcttgttattgctactatcttgttatatcatcatcatcatcatcattatcatcatcacgatgatgctgaagatggcaatcagagtaagtgagcagtgccttagaccacggctgaaccacttctttgggcataagagagatttagaaaaccataaaaagtgctttccagtgacttattttccagtaaaactgaacatagctatgttgagtcctaacggggaagatttgactcatcttatgacttaagagctcctaatttttggatagaggatcatctatggggaatctggcatagcttttataatgtgacccttggctcatgcctgagaaataaccccaggtagccttctggtccctcctgcaagcaggcacagcctaccactgagtaggtcacccacggggttcctggggcacttgctactgggagtaagggaagcataaccaggtgcaaagcaggtgagggacaggccagaggtgccttgccccgggctgctgtgtgttccactcctgcggaacgtgagctccgtggggcagggtggactcttgcttacccatgtccccacttccaccatggccatgggctcaccagtgcaaataaatatttttaaaaacatgtttagctagatggactctgagtaatagaaagaactctggagaaggttcaggtgagcctgctctttccctgcttttgaaattaaaagaccaaagcctggagcagatggggaagcccaaggacacgtggtggccacctgcagaggccacagatgacccagccctaggtgcctcgtggctcacatcaaaggagcctgtccaggatgaaggccactctgtgcattttcttattccataaaaagctaagaacttgctaggaagaagggagaaaaaacccttcctaggtttgtagaaaggaaatttcagggaaagtggttctaagatgctcataaattagtcctgatggagttttctagattccaagagtgtggactctggaactagatatccttggagcagatggaagtcccctatctgttagttaggccttagaaggacacttccgttctctgggcctccacctgggcatctccatcccaggtcgcagcagtagccgcctcgatagctcatcacaaagatcacgagatccctcaggcaaagctcctggaagggtgcctggcagacaattcctgctcaataaaggttgaccaccattgctattatttcattgccacccactctccaagaaacaatcttctcctggaactgtttgggattgccaagacaagtaggaggaatcaaactcacccagtcacttgacactcattggtttcaagccttatgtcaaaattggcaagcagtggcgtcggccctcaggggagggagactagccatcagacaagggatggggagggggtttcacttgaaattgtttacaatgtgcatatattcattttcaaaaaagcagttataacaaaggaatgtggtggctagtaatgaaaaataattatacagatattttataagttaaaagacaacacaggggcccaaaccacagtctggtaaatacatctgccctgaatcccaacaccccttcccaggcacagggacgagaattgtgtgtctttgggtccagcaagcaaagcaaaggtctgggggctgtgaggggcagagctgggaagagggggaaggtaaattcaggctttcctctcaccttaataataaagacattggaatctcttttagaaatttaagtgtgcaatgaacaaaaagaaaggaagcaaaataatcattacaaaagcaacgatggctgtcacttacatagtactttctacatgccaggaactctttaagaattatataatggctaacataattccaagaacaatactatgagataggtactatcactgttttttttcatttttattttaagttcacgggtacatgtgcaggtttgttacataggtaaacttatgtcatggggatttgttgtacagattattttatcacccaggtattaagactagcacccattagttatttttcctgatcttctccctctttccatcccctactcacccaacagaccccaatgtgtgttgttccccctaagtatccatatgttgtcatcattttgttcccacttgtaagtgagaacatgtgatacttggttttctgttcctgcattagtttgctaaggacaatggcctctagcgccatccatgtgcctgcaaaggaaatgatctcattctttttatggcttcatagtattccatggtgtatatgtaccacattttctttgtccagtctatcattgatgggcatttaagttgattccatgtctttgctattatataactgtcttttttttcttttctttttttttttttgagatggagtcttgctctgtcgcccaggcttgggtgcagtggcggcaatctcagctcactgcaacctccgcctcccacctcagcctccagagtatctgggattacaggcaccagccaccacgccgggctaatttttgtatttttagtagagacggggttttgccatgttggccaggctggtctcaaactcctgacctcaagtgatctgccctcctcagcctcccaaagtgctgggattacaggcgtgagccaccgcacctggctgtatcactgtcttttttaacagacgagaaaactgagacccagataatttatgcccaagtcatacttctaatatgtgttgaagttaggactaaaccagaaagtttggcttcagagtccacacatgtttctgtatacctctagaatacatggtcaatgtattcagattatcaactgtttttatttggagagctcaaagaaaagtagagaaaatacaactcatatccacagagccaaatggacaagcctaaagtctaaggggctccatggtgctgtcctcaccatacatagaatttcttcatttgtcacaaatggcaatgaggacaaagtagaggccaaaatcaagcatctttcagttcaagcttcaggagaagggagaagggacaagaaagaggataagatgaagtggtgggatctaaagccctgcaaggcctgaatgtgtccccttgaaatgtatatgttgagacaactacaagtgtaatagtattaagaggtgggcctttaggagatgattaagtcatgagggtggaggcctcctagatgggattagtgcccttataaaacagctgcagcagagcttgcttgccccttccaccttgtgaggacacagcaaggggcaccatctatgaagtacagagtgggccctcaccagacgccaaatctgcctgtgccttgatcttggacttccagcctccaaaactgagaaataaatgtctattacctacaaattacccagtctaaggtgttttgttacagtgtctctagtaaactaaggcaagccccagctggaaacatccatctctgctaaaagtgccacaggacctggaatgagtaacagactcttttcacatcttatctgcaagaagctgggttctgtgtttgtctcagcctggccctgctctcaaggttagcattgcacaactggaggaggttttggtgacttctgttgcccaccttgttctctcagtagaagagccagaccccagagaagggaagaacaccaggttcacagtggagagagaacaaccccccattctcctgctgaggctgcactaggggtgaaccccaccccaccctgtcctctgggaagcccctcctgactcctccctctgcagtcaggctgtttccattcacagcatgtagtcacagcaccattcccagtatatttttggacactagtcctggctgcattgccaggatacggggcccttgggttttccctctgctacagtgctggcctggctggatggaaaaacaggtaggcaagggttcgcccctgaggataaaacggatataagcctgtggccatcctgggggttataagcctctccacttctgtctttttctgtggcatataacagagcactcgaaaccaggcatttattattttcttctggaggccaagaaatccaaggtggaggggccacatctagtagggctgtcttgctggtggggactctctatagagtcctgaggcagcacagagcatcaaatggcaagggggctgagcatgctcacctgctagctcaggtctcgcttccttttttatgaagacatcagtcccactcctatgataaccctgtgattcataagggaagaaccttcatgactcagttacctgttaaaggcactgtctctcaatactgacataccgagaattaaatttcaacacatgttttggaggggacaaatattcaaactctagcaacttcccagaaattgactcatttctgtttcctatgcagcagcttctttacctttcaaaggatctggtcatcctaactccaggctgctgagacgggtctgagcaaatctaaactgtgtcctggattcctggagacaagcttcatgcaaaccccagcatgaatgtctcagactcgccagaccctgcttagctggctggttgtctgagagcacaattagaaaagaaatggctctgaggagacagaggagatgcgtagctaactctcacacacaatctcacatacacccacctcacaccctcacacacttctcagacactcacacactcaatctccgacacacacacacacacacacattcagtctcacacacacagcgcattgcaccaagcatctccaggtagaggtaattaaaagttgatttatgtccttctgaggcactaagactgtaatgaatttctccatgtttctgtgattgcttctgtaaatggggatgctggcttttctggggaaaaatatggtgaaataaatctaaattttgctgcagtaaatatatattaaggaatatgtaacattggcctggatattacaggagttataaagaaaaagccacctatgtgcttgccctataccatacatttcctccatgattacagaaggtggggaagcacttgcctttgtaagtgtagtggatggagttgatgtgaatccagatgcatcagcattggagacaaataaaggacaaacctggcaagatatgatgaatctgtgctcaatcaaaattcattcgcctgaattccaattggtttattcttgccggggtaagaaatggaacagaaatcacaggcatttcaaaaggtcatgtccatccaatcatcaacattctctctggatgcctctctaaagtgctcttctctaagtttacccttttatattttgtctctgaaacatggtaggtatcagaattagtccttcacagttataaatgctgctgtgttcagaacaaagtctgatcttagtttctgatctctgaacccacaaggggtgtcagtctgtgtcactccaggcaagtgctttcatgtcttggggcctcagcaaataatgaagctaaagctatagcagctcttataaacaaagatagatccaatgattaaatctaaattcatcaaccagaaacactcattactattcaaagtgcccagggccaccaagaattcttctaataaactttctttctgaggttcctatgtcctaaaagccacatgtcacttatcaataataataatacaccttgccatttgaggttgaccaaaaatgtacttaactataaagcagtgcttctgatgagcaagagaaaacctatgtctgcaggaaaactatgatgtaattccaaccaaaagtaatgacatttaagatttgtgttatgaataactgtatattttatgcttggaaaaatacatagtgcttataacttatagaagctgccatttgaccctgtgctaccctcataaacgcttttgggattcaggagccttgagctgggaagtactgggtctggtgttttctaaggttctggcattctatgcaatttggtctaagaaattctggctgccaaggggaaaggatatcagggactctcatttcttgccagtgagaatgtctaatctttgtgaaggtcaattttggaatacattttaagaaccataaagtgggtatagaagaagttctagttttaatgatgatggagtatcctccactggcccaatcctcctgcagataagatttataaactctgaacaaaatatttttaaaaaattgaaagcactggcagagagaaactggagtttgacctttgaaagaaggaactgcacccgtgcttcctatgcttaccctgtttttatctaagggctctctctagtccgccaggcagaaagctgtgatcttattgcttgaggtgtcagaggacagagtttggggctgccagagtgactggaaattgagggggataaatcctggaaagagctaaagtttttaaagctgaataatgatttcaaccaattgcccattgctcaatgattgggagacagattttggagtttaaatcctatcaatttttccaaaagagctgtttggaaacatcttgggcatttcactaaaatcctaggaaggggtcatacctaagagtaataactatgcccccaggattaaagatcctccctaagactaacgaaaaatctaaataggcctaccctaaagagtataaaaccaaggttctgcaactttaaggtgacattccataattaactgattgatgttgccaaaggaaaacaatagaatccagaatctctaaatctattatccacaaaacacagtatataataaaaacttataaacatgcaaagaaacagaaaaaagtgactcatactcgaaagaaaaaaaaagttaatagcaacaaactccaaggtactctaggtgttggaattagtagacaagaatttttgagtagctattataaatatgttcaaggacataaaggaaaatattttaataatgaaggaacagatagaaaatcagagaagaaaatagcaacaacttggggtaaaacaaaaaacaaaaacaaatagagcttctagaactcagaaatgaaaatttcagtggataagcctaacattagattggaggcaacagaagaaaaggtcagtgaactggcagagagctcaatatacgctatccaatcttaagaacatatagaaaatattttttaataaaagagtatcagcgacatctggcataatatcacatagtttaacatatgtgtaattataatttcagaagaggaatagagagaaaatgtaattgaaaatgtcttatatttgatgaaaagcactaacttataaacccaaggatctcaaaacactccgaagaagatgaacacacacacacacagggcacacacacactcacacacacatgcacaacacagtcaaactgttgaaaaattaagagaaagagaaaaatcttgagcagccagaggcacattacctgtgtggggccaatgatataaatcatatcggtttttttatcagaagcaatgaggtcagagatgacaaaattttgtggtaacgaaataataaatgctgaaattctatgtccagtaaaatatatcattcaaaaaatgaaggtaatatagacattttcagttaagtgaagctgagagaattcatcaccaggatatatgaaagaaagttcttcaggttgaagagaaatgacatcagatggaaacttgggtattgagaatggaaagcagataccaagatgttaacaaccatggataggtaaaatatgtctgtaaccataaaagactactctctttgtctttctctaatttctttaaaaaataattgcccattgcttatccctgttgtctatgtcatgttatgcaaagtgtattctctaactaagtgggtattagaaatcaacaaccatataatatcttaaaaattttcatgcaaaaattaagtaacacacttttaggtttatcaatatagacttaaaaataaaagcctaaaactataaaacttgtggaagaaagcataaacgatctctgctaccttgggttaggcaaagatttcttaggatacaaaaaacactactcatacattaattatacatttattttagtaataaatttattttcatgaaattcttctctttgaaagaaagaaaatgaaaaagagataagccaaagactaggagaaaatattcacaatatatttatttggcaaaggacttatatcaagtatacatgaagaatttctataaatccataataaaaaatacatggccaaatataaaaataggcctggaacagcctagagataggtctaagaaaaggcctaaaacagacactttgcaaatggtcaataagcacttgcaaaggtagtcaacataatgagtaattggggaaatgcaaattaaaaccagaactaaatgccgtttcccatgtactagaacagctcaaattatagagattaaagacacaaaatgttggtgaggacatgaagcaattctcatactttgttagtgggaacatacgccactttggaaaattatttagtagttacttatacattaaacatccacttatgtatggtttagcaatacttctactttccaaagagaagtaaaaacacttgtccacaaaatgacctgtacttgttcttaccagctttattcatgatacagtagtccctgcttttccacagttttgttttccatggtttttgctacctgtggttaatcatggtccaaaattattaaatggaaaattccagaagtaaacaattcataagttttaaattgtgccttcttctcagtatcatgatgaaatctcgtgatgtcctgttttattccaccagggacagtgatactccctctgtccagtgtctccacgccatatacacttcccacccatttgtcacttagtagccctctcagttatcaaatccacggatagtgtcaatactatccacagtcagtgtatataggggtcagtactgtccacagttttaggcatctactggggagtcttggaacctatcctgtggataggagggggactactgtactacaaaattggaaatagcccaaatggccatcagcaggtgaatgactaaacaaactgtgctataatcatacaatgaattacttctcagccaatctggggacacatacaagtcacctcggaccttaatgctgtgcctgtggtgagaacaggtcatgagcaaccccagccatagacacctaggcagggaccccatgagggtggcacctgaagaccaggagggagaagctctgcttccttgggaggccagccccttctccccagatgccacagggcacacacacccacttctcctggcacctgggctgcattttgggaaaggaggggagtggggaatccttgagtggcatcagaaacttagaaccttaatgaacgtaagttttaatacagtagagattactaatctttagttagtaaaatgaaatattttgttgccaccaatagaaaggggctgatatggtttggttctgtgtccccacccaaatctcaccttgaattgtgataatccccatgtgtcataggagggacccagtgggaggtaactgaatcttgggggcaggttttcaccatggcattcttgtagtagtgaataagtctcatgagatctgatggttttatgaaggggagttcccctgtacatgcctcttgcctgctgccatgtaagaagtccctttgctcttccttcgtcttctgccatgattgtgaggcctccccagccatgtggaactgtgagtccaataaacccctatcctttataaattacccattctcaggtatgtctttattagcagtgtgaaaacagactaatacagggaccttaagtgtaagacaagtttagacatatacataaaaaaattaaagttaaatatttttgcacttctgacatgcagctgagctacgcttgtgtttctagaggatctaaatgtcagcgatgggctctgagaggaggtgaaaggaggtaagaggagagacctgagtgtccagagaccgcaagcactccacgtctagattttcaggttcctattattattattataatacttttaagttctagggtacatgtgcacaattgcacatgtaataaaaatgctacagcaggtctcattgagctgtcttagcttaaggtaagcaatgctccctttgtaattcaagttaatcagtgcaattttgcctccagagaaaggctgttttccacactgacttagtatgggctctgagaaacaatatgtctgcattttctcaaatattacaatttatggttaaaataaaatcttgttattctcacgaaatcctgaaggtctttaagtgttttccttccatgtcagagtccaaaatcctggaaaggccctggtctcttctccaggaaggaatggcaggaggaacctccccttcaccctcccctcaccctacccaccccgcccccttaccatcaagaataaccagtggatgagaggggcatgccagtgaccttagattcaagataaaagcacgtgacattctttcaaagccagataattctatagacaagttggagcttgggtgagcaaccatcctagtttccccagggctatttgggtgttaacactgaaagtcccacatctccggaaatgtctcagacccagcaagcaaaccaggaatggttctcctgccagtaggtcaggacttgtgggtcagaggtcctccctgcccccagggcagctgcctcctctcctgaccgttggaaagggctctgatgcactgatctacaccctggttctccgggctgtgtgttatctctgacggcagcccctgtgccgccagcctaccaccgccacaccgtgttaaatttcaaccacaatctgctgccttggctcttcttggtatctctagcccaacgacagcaggctacttcccaagaacaccgagagtttagaaagttttttgtttttttgttttaacatctttgagtgatctgtaaatttactaacctatcaattctgatgatggagtctcttttctttgttgttgctgttgtctaaattagagctatataattccaaaatgcttgaacatgatatggcaccaacattcacttcactaccccaagcttttaccctcaagtaaaagatgaattcaggaacatgagtttttttgtttagtttctggtcagtgggcatcctggtggggtaaaacatagtaacaagaaaaggaagaacatgtagatggtcattgcttttcaggtgcattgcagaggcttctctctgaagggtgactacagttctatacggccatgtcagtccaccggcattcattcattcatttattcattcattcattcaacacatatacattgcttggcaaagtgcttctgagatgcaaccaaaataaaaaccctgccaggattcattatggctgtggtctccctgtactaaacctcacatccatttttgtatttgatgtgtcctgcaaactgctgtgtaaatgggagttttatgagcaaatagaaggacctggcaataatgctgccgtcttaaggaatagaagagcctgttgttgcacaatagagagccaggaacagaaatcggtgaaatcggctccaacactgcccctcccccaatacaccccaggcacacttctgcttgacagatgccaaggccttgatgccaggactgggtttccaaggcaccaacccatttgtaaggtggcactacaaggattcctcaagttctgaattaattccacatagcagacaatcctgcatcacagatttggagtgcaagcaacagaatttgcatctgtgaactccagcagagggcctaggtgctaacagttctggcagttctctgagccatgcaaaagactgggtcatcgagtttgggaatgagattgctaggggcctgagaataggaatggcaaaatgtggtcagagttcattgctgaggtgaacaagtaagctcccaagtctcagagagcagcatcccagccacagaccgtgctggcatgtaccaagaaaggagaagaagcactggtcctcttgctcctgcgtaggctggcatgtggatccaccccttctcaaggtatcacacaagtgcaggggccagaggaaaccaggggctgcagaggtaagggtcaatgtggggtggccccaaaaacagctctcctgacaaagttttgtggctttttttgttgctaggctgcttcaagtatcactcagggatgtagaagactgtctcataggtcttaactataactatctgagtctgaataatggctcccaaagacatccacaaatccctggaacctgagaatgttaccttacacggcaaaagggactttgcagatgtgattaagttgaagatcttgagatagagaggtagtcctggattatctgagtgggcccttaacgtaaccactggggtccttatatgaaggaggcaagaaggttaaagaagggatagccatgtgacgatggggcagacactggagtgatggactttaagtggaggaagggtccacaagccaaggaacgttggccatgtctaaaagccggaacagacaaggaagctgatctccccaaagccctgccgaaaccttgactttagcccattgaaacagatttcaggcttctggcctttgggaactgtgagagaatacatttgtgttttgtgttaagctaccaaggatgttagagcagccatgggaaaggggtgctgtttgcatgagaaaagcaggaagacagagagaggaactgtgtcagcctcctggtctgtggggagccacatcccaggaaccccaacctctgccttttgctgggaaacattctcccagtctcccagtctgaaacacctccctcaaatcccaaaaagacaatggtgggaatcctccaaggtccagcagagccttgggacaagatgcaatctttcgctagccccaagtgggtgggttcacccaccctcagctccagcaggtaggcccttctgaatctcaggctggctgaataggttccagacgcaggagggagcccccccaccccctctggcagctggagtgtgtgctggagatctgggcatgggcttgcccaggcaaagagtggagaagcttttataggaaagctgtaaaagcaagcagggttgacctgggcactcccccagttcccatgagtctggggcccacgactggctcatcgattgcttgaacaagcacacatcagagacatccagatcagaatggaagctgctcaaggctcagatgatccctgagccaccaacgttatcctggaggttcttatcacagagtatgggaaatgccatactgggctgtgggtttgcagaaatcctccaaaagatgcagaaacaagtccagctgaaaatggaatgcttcctgatggctcattttgttccagcctcaacccaaaggtatctatcacaatatttcttgtacaatgggttgtgcagcggggggaagggagatgctttacaggcatagtgtggggtgaggtacatttcgtaacagctcttgtttactgagatggctttctactgacaaagaaaaaagtcccgaaaagaagggggcctgttaattgtttgcttccttttgcttttttggttacaacagtaaaaactgtccttcaaatttagtcccagaagacatcagagtttgacaatgacaagtggggaatagaagttcctgggctatcagcttcgcggctccctcctctacatgtgggctcggggacacagagctggtccctgcccagtctcggaggccagagaatcaagttctgggtgtgtgagactgatgggacaggcttcctctgaccgagttgggcaacttggggcttttaactgccttgggaatgagggtgggtgccttaaatgaggaactaagacaggccctcatttcccagcagggatgccgctcagcctgcagagttccccgttcccaaggcttgtgaagcaggagacaaaagaggggccttcctcaggacactgttgtggggtggggtgctcactcgctctcctgtgcccatgtactcctctccccctctacttccctctctttgggaatccctatggggcaagtacagggagatgggaagaagtgggtgggatggatctgggctaatgacgagggcagcctcttcccccctcgggtctccctccaccctcttcagtccctagtacctgctgggacctgcctccttaataggtaacccctacagctctcctcggccagtctctgcacactgcgcccatgggttcccgatgccactgccctcagaacatgcagtcagaggctctggggagctagaggttcaggtgggtgtagagaacaccacacatatcctcccagggcagccaggacatcccacggggaggcaaagagggtcctgtcctgggcttcctccacactcagaccacttcctcacctgcccaccaagcagcagtgtgcatggttaatggaaattggcatctcttctatccatgtgaggaaccaccaagacctactagctaggtttacgatccaggttctagataccaggggttaggagggaaggacccccaagacctactagctaggtctacaatccaggttgtagatactatgagttaggagggaaggcccaggagtgccattccccaggttcaaattccagctccaagactcaccctgtgtgtgccctggcataactcaaggtgccctcagcttccccatccttaaatggcaaggtttcgtacttgcctttagagctgcttgtggggattaaatgatacctagttgccaagggctttgcaccggccctagtatgcggtagtgccagttacagaggaggaaacagaggctcagggagattgagcacctcgactaaagagaggagtggaatttcagtccaggaggtcaggctgtctttccgagagccgacacccaccagcctttggtgggcttgagaacacgtggggcctgccatccacgctgctggcatgcatcaggtggtgtcaggtgggtcctcgcacagtgaatcctgagcagagggcagggggacgagggggcggctggagcccagttcgcttttgcgaagcacttcctgaactgcacattcggttaccacaaaatgagtcaaggtcccttttaagtggcttgctgagcttccctctgatctggcactgtctccctgggatggccggcagcaggcttccctgacgagctgtcaggcctggcaccggagccccttccctgggcaccagctctgcacgagcaccccttcactcttcctcatgacaattccatgaggcaggggctggtcttgtttccactttaagtggggaaactgaggctcagagaggttgggtgagttgccttgggtcacacagcttagtcaggttcagagctgcaacctgaactctggcctgtctggttcttagctgttttgcttgctcttctgcctggctcatggcagtgaggagacccacgctcaccttcgctgcctgggtcaagtagctgcctgggacctctctatggacccatttgcaaatcaaggatggggaagtgaggttgtggggatgaaccattagaagcaacttctcatgtcccagaaggaaacaggggactgtgctttccaggatgaaaatacaagggccccctgatggactagtgtcctccctatggattgagtccctctaagaaatgggttgctctccccacaaacaggcttagcttaaagaccttgtgtttcctgggcaagagaggcacccacaaaaggccttcactaaaacctggcttcaggcccagggccctggtccggatgcagaggaggcctcagctgggaagggtccgtcctcctggggcttggggggtgggggtcatgctctcctggaaatgggctgccccaagacccacatgagtcttaccccagtgtctcctttagagtcctggagcaagaaggagggattcccagtgatatctggtgagtaagagagaaaaggaagcgggtacatccagaaacacaagcacagtctgtgaacaccgtcagacaagagggcctgaatggcgcctgtggtgattgggtctttttgtttgcttttgtttttgtcattgttgttttgagtcagtttaggagttttttttagtaatgactactgggaaactcagagggaaacacatacacacacacacacacacacacacacaaacacatgaaagaacaacaatgcggggtgatgaccacggctcaaccaaacgacattttcatcatcctgacacatcttgttgaaacggaaacagatctgggcctaaggtcctcacatcatttttcctgattctctttgtctgtttttaaaagtaacgttcaattagagaaataacgcatagccctccttgtaaaatactacaacgtgataaataaggctcaagaactccttggctgctgtctggaccgagggtccctccccaagccagccactgtgctctattttctgtgggtctttgcagtctgggtcgaactttttaagcatttcattgctactacttagcttttgagagtgggttcagcgctcgtgactgaagcatatgcttagagaacagtgtccctgaagtcaaatctcaaactttgcctcaatgcctcttgcctcagaagggcccagaaaggtctgaattgccctgagagttttcctccagacaatagctcagccttctgtgcccagccatgtttgcaaaactttctcacacacccctcagctagtccttcacagtctaagcctaggctgctgggatacacatttctattttgcagataatgaacagaagtctccacagagttaagagtcttatacaaaactacctaccctggctggtttttccactatagcagggactcctttcctccaagtcccgcctccacaccgaggtctcaggtggcgagggccttccaggcatgaatgtcccacacccgtgctcctgtcagagtcctcacactccctgaccaagctgcctaagttccaggaagctctaggcctgtgttctcccagggaggggggcttcccatctagtccctcaaaccaggagcccgggggtatttgtgaggttctgggagactctaggagaccataaataccagacctttaagcaagcatggtcagcagctggtgataaaattgaaggaaagagacacagcagcctgcatttcaaccctgccctctccacaccctccaaactgagtacctggggttgcagggaggcagggccaccaaagtccccagtgggaccgcagtgtggctctgaggacggagctggatattgtaaggttggcagcaactcaggccagtactctcaagtgggaacagttgggaaaacaggtagaaagaaaagacagcatgagaatctctaggacgggagccagcgcagtcttcccaaagaatatcgtgcagacatgctctgcacacaaaccttcccttcctagagatccagaatatctaggaagattcatgttcatcagcattatgaaagccctgagaagtcctgcagtcatggaataatataataataacgataataatagcccaaggttttctaaacttactagtccagagaactcttttctagcgaaatgcctattgctgtctccccatggagcacatgttgtgactgctggcctggcccatctggggtaaggagcgatgttggtcacagtgcttcttaagcagctgtgaacttccacagcctcactgcaatggccctggcccccaatcttacttctgataggttagacagatgcaatgtctaaaaccctcaattactgataacacttttagtgatgacttagatctcaaactatggggtctcaaactatggcccgtaggccaaatctggccctctgcctgtttttaaaaataaagttgtattaaaacacaccttgggccattcctctatgtattaccggtggctgcttcatgctacaatggcagagttgagccgttgtgatagagaccatgcagcccagcaaagcctaaaatgtttactctctggcctttagaaaaaatgtttgctgaaccctggcttaaacagaaaatcaaaactcacctgaaggactggttctgtaaagtctcaatagcatgggaaatttagatttaaaatctctgcaatttggaccaatccacgttctgccgtggttgtgttgttgatgtaacgggcccagactacagctcaagtgtagacaagggtgtgtgtgtgtgtgtgtgtgtgtgtgtgtgtgtgtgttcatggagagactgggaataggaacaggatggggaggaaagagaaatgctttatggcttaggaatattgaattcggagccagagcaggggaagttgtgccaccctataagcctcagctttggttgtatgagaaacctggagataatgtagctgatggcacagggttgttgtgggcagaaaatgagctcctgtgagcagagcacctctgctgtctctaggagactcagcaagtcctggggactcctccgcatttcttcttcagtgcccagggtgcattaagtgctcaacaaacgggctcctattcgggaattactcaagcgacacacaatcttatttggggaacagacaatatctgggcaagataaaacttccctctttcctttcaaggttggacattacgtgctaatttgggtcatctcctgagtgtgaccttcagccagccattggtcaccttacgtgcaagtagggcatgagtggcattccatgtataaaccacgtgacagctcggaaagcagacggtcctgtaagtgtaacccacagactgaaaatgacccatggcaaagggcaatgcgtgcatgatttttatgctggaattcatgatggaacattctggattcctcccagcaaacctgagctggcctgctctgttgggcagcgaggtctgctcagagagacgctggtgtttatctgccacatcctttagtttttattgcactcagtcgccttgtatatttaatgaggaaatttgctgaaatggttactaagccacagggggaaaaaaaggaaggaggtggggagccactctccgaccctgaagttggcaaagttgcctcattaatcagacctgtgctgggatacgacgttattcatgtttagggcattaaaacttgaagctaaaattgtagcaggcggtaatttgagtacaggcagcctgtctctctgcgatagatttatgatgtttactcaacaatggatgggaactttcagggaaagactgaccgcccccaacccccgccttttcaaaacacattgtcaggccacagtgatcaagttcccgatttttgtgtgagtatgcagagcctttttaaaagtcttcagggtgataagagcagactgtattcgatcttctccattctgagctcagcggaagtaggaaaatatgcaaggcagatggaatgagctgtctaccaggcgaatggtggttgccatgctctctgactacactgctcttcctgaagtgaccggtgcagtgccacccccaccggccttgatgttgaatctggaacatctggtcactgtgtcacctcatcaggacctcaaagaattcccgacaaaagctttcatgttcccggctgagggtcttgctttcctgtgcttcaaggttacaattcttggaactgattgctgggaatttcaggaaagtgagggttcccattttccaagttttcccacctcctttctgtcatgacacacagacagacggaggccacatccatctctgtcagtccaggcagactttgccttcaggtctcacatagcaaaggaagaggcatcagcctagccttgggtcttgccactcagatgggaagccctttctgtaagaggattcctttaagatgtggcacaaagaacatttatactgcacttggacaggaaggcccccaagtgcatgaaagcactttacagtgttcatctcctctccctggcacaggtgtagcagaggtgagacccagttctggtcactctggctgttagctttgcttttagctttgccctgggcctggtgtgttggtgatgaattgcagataataccaccaaccacatagggctgttttgcaaactaagttgacattttaagcagtttggttaaacaaaccaactttgagtatgggctctgccacctcctaagggagtcattttgggtaagttactggctccctctgatctttatttcaccattgtgagatgggatgaagctattatctgcctcactgggccattgctgagtatgtggaagtgcttttttttttttttttaagacaaaatatgctagtagattttcaataaatgttaggttctattctcaatattatggaaagatgcacttcttgaatttggggaagaaacaaaggagattgtattttatgccaaagtcataagcgctgacgcatatcaaaccacaaatatttctatcatccaggctgtggggggatcaacatgtcaccccatcatgtgacagttagataaaggatatgaaagtcctgcctagagtggacactataattttgtaagcttttctttaagagggtctctgacttttcagtcttctgtgtttgttttgtcatttaagttcatgtgctgcaacggatttaaagtagacactacttccctctgccctgcccggcagttacacatgagaatttttcagtttgaactaaatacaaggaatattaagttagacttaaagaaatagcccccaacttgcaacaagtggggcagtaaataaagggagcccttttctacaggggctgaatgggagaggagagctaaaggagtttgggaggtgaaagcaactgtaatgatttatcatcagggaagacttatttacccatggaaggaatactttaaaatctacctttctcataataaggtatgctcatatgcacagcacaacttaaatacaagtatttatgtagttttgcaaggagcttgcaaggttagaaacacacacacacacacacatttgaactatgttcagtaacactacctatgcagtctttgaaaaactactatagatcatctggctagggaactgtgagtctcatctgtacccacatgatcccaaagaggaggggccctgtagaaacaagaaccaaccaacaaaaagcagtgacaacaggcaccatgacaacaaaaggagttttaaagtgcatcttcaaatagcacacaattttccaatttaaatagtttggaatgaatcaaagggaaaaaagcattaattagatacaactgaatttctcaaaagtatattaacacagcctacaaataaatcctcaaatgtaccactctcaacaaatcttgtattgactgacattctctgtcaactagagaggatgcaggcaggaaaatgaatgaaatttccattcttcagtgtttacctgatgtctcaggttgtttgctttgggggagtggctgtttgcagggctatgggaatttgtgaaacactttgctagtgaagccagctgaggccttcgggaccaaatcgccaaatgaatgacagaggatccttgcagtagctttgtctgtctgcagagcggactcctgtgagtgttcatcacatttaaagaagtaacatgccgggagaacggaaaagggtgctaatgatttacaagcgaagataagatattattaggagtacgaggtcaatcagataaagataccatacacacaacttggacttgggcccattctttaatttattctgaaaggaagaggaggaggaaaggatggggcctgagagtgttagcaattggcttcccgcaagctgcctgttttaacactccttgtgatttatttcaatctcatcttttacaaaggtacggcaatttgttccattttcctgcttccttctcctcttcctccttcttctaagatggcagagagaaactttcttacaggtcccagcaacactgccgtatagcttagaagactggagatatttattctcaatgtcctcagtttactttgcaactggagcattatttgaaagacggcctgccagcattcaactgaacagacacaaatgcaggtatgaatagtgaggggagagagtggtttgaaggctggggttgctgtcaggtctgatgaaccctccagcactcgccatcatcggctacaatgttgaggagactccatcacaacctcagatcaaaagtgtttctttgttcctccaaaccttccaaagcactttatggaccttgtatttggacaacacctccatgaagcttggaagccaataagtcacatcttcattgaacaattcatgaaattacagggcagacgtgaaatatgaccttcgagggaaaagctggcggtggagcccagaacttcattttgctgggatggttccctgccgttattctcctttctcacgaaaggatcctgcagtcaatttacggcatttgtaaataaaggcggctgtgtcagcctcctgcctggagaaaggaaggcagcaccttgaatgctgagagtgtatctcaggcttactctatacttccattacaatatctcagaagttataacagatgaagatggggcgaggtggtcaaggtaagaccggggtcagcagggcaatggcgtgtgaggagtttctcattagaaaacacaaatggggatttggattggttgtttttcttgtctcagaaatcttcttcagaatgacctccccacccctgctttgtctttgaaagttttgccatgtttgaattggcatacttacacattgtaatgatttttcttccatcaattaaaaacaaagctattttttggccaagtgtctcctgaagcaaagttaagaaacagaataagaaggttttgagtcacgcacaagactgaaaattagctaataaaaacccttttccccccatttcctcaaaactcagttctcagaaaaacaattctggatgcaccctgtttaccagcaaggttaaaagttcaagaaaagaaagacatcacaatatttacactcaggcaaatcactgttcatctaccgcgtctgaccctgcagatttgggagcgggccgctgtcctgcctgtcaaagggagaggaagcagtgtctgtctggctggccctatatttgctcctgttgtctcactctctgccaccagttttgttttttgttgtttgtttgtttttgtttatttgttttttctaagactgccggcatcccttctttctagatcgtcttgtctttcttttgatattttattttcatggataagatcgctaggaccccatcagagtatttttctgatggcacgatgctactactttctgatatatttatttcattctcaatatttgaatctatgaaataaaataatagtgataatagccaccatttattgggtttgtgctttgtgccacgcatcatgctgagtgggtttgcacattattgcaaagatccctctgtgctgctggggtaggtgtcattctcccagtttatgggtttggaaaccaaggctcaaagagctccaacaactagcaggaggctaagcagaccagacctgggcacttctccacttccttggccttccaagaggggccccagcactggtcttcagtcttcagacctaggtcattcttgcctcagggagagacagatcaaggaaagtcaggtggttgttagctaacaagagcaacgttcttccagaagggcaacaggtgagggccagggctgagggccatgcgggcagtgggcagggagctcctgcttctggaggccaggtgggccacccctccacccatcagcatcttgcagccaggcagatccctgtggaggcccgacagtgacagaaggaaaagcccccagcagcctggaattggcctcactgagagtgtctccagggagaaacatactggggatgccagcagcccagaaggctgaagagggagctcatcacttctccatcatagtcactgcacacaaaagttggagccagaagcatccacaagtgcccctatccaagcagggcaggaggaaggaaatccattcagtgattcctccctcccaaggcctgactatgcagtaggagctagctgggctagagagacacagccagggcccatcctcaacagtcagggtgctgggtggatctggtctatgcttgctgcctgtgggcctgaggccccgtcccacacagcaacaccattgcacccagtggcttcccagtgcagccatagtggatgcccagggacagacaagggtgagaccctcctccccaccagctcccaaggcacagacataccgcaaacatacatactgcatacacacagaggcttatcctgtggtggtgccatgtggagccatgcttgagtctgcagtgggtctgggaacaaccacaaacaagctcaggaagcacacatggcatcacatgtcacctatagccactccacacaccaacacacatgcacacaggtaccagcatatacccaccgcacacacccacacacatcacaaacacctcactccatatgcaacatatgcaacccacccccagccacacacaatgcacatgtaccacaaacatacatactgcatacacacacgtgctacagaaccctactctcatactgcacacgtcatacccacatccagccacatcacatactacatccatgcacacatccactaagacacccacacttatatccgcccatgcattcccgcacaccataccacaccacacatgcaaacacacaggcatgtatgcacaagcatacacacataccatagatgtgcactcacagatgcacgcaaccaccccacgtgcatacaggcacccatgcaccagacaccccgtgtcctcttctgcacccacacctgtgtcacacatgcaggtacacagaacccatatgaccatgtctcacacccatacccacacaccccgaacacacacatgcttgagtgcacacttttgttctcacccccccatggctgactctgcttctagtaaggcagcctttccagaactgtcgaggaactgccaaacaccctttcttttagagatgaccgtgtgttgaggagtcagtgtttgtaaagcaacttcttggggaaatataatagcagatataaggtaatataagtgagggtatccaagccagataggaatcatcaagcaagggcacgctcgagagtgaaaggcggagctgaaaggaattatgaactcatttctaataggcatggacaggaccaccttgagtgaacttgggtacatggtcacctcgcctacagggactagggacaatgcttacagaatcagtgtgtctgctgcctatcaaccctctcggatataaaataatgggataggagttggtggcgagggctggaggtagaagagtcgtagtttttgatggtatattttcctgatttgtgcattcccttctcagattcccttctggcaggtggaactcatttctcactaatgtccttgctgcatgttggtgattctcaaatgttccatcccccgctccatccccctggagtcctgcctgggggcccaggagtccctgtctgatgtttccaccctctgaccagtgcctctgaagaataaagaccgaattcactcctctagcaggtactcggcacctagctgaggcgagcataaagagcagagctagcaactgtgacagccccctgggatcttgctgaaatgcagattctggtgctagggggtcagcgtggggcctctccctttttgacccagcaacatctatttatttatttatttatttatttaaatttttttgagatggagtctcccctgtcacccaggctggagtgcaatggcataatctcggctcactgcaacctccacctcctgggttcaagtgattctcctgccttagcctcccaagtagctgggattacaggcacacgccaccaagcctggctaattttttgtatctttagtagagacagggtttcaccatgttggccaggctggtcttgaactcctgacctcgtgatccaccggcctcagcctcccaaagtgctgggattatagttgtgagccaccgtgcccagccacaacatcacttttgagtagtggacagttttcagagaacaacatccaccctcatcccagcccatgtggatcctcacacagccctggcgggaggcagggccaatggaagccaccagtgtccccttctgaggagactccagtggggtctgcagcaggaacggatgccaagcgctcagcacccatcagtcaacttccagtcgccctgttttcagccattgtctggtgtcacccttcccaactgttgcttaccattcacagtcctttttaaggaagaatgacatttgattttacacacctacaaaatacaaaatggcagcataatagagggatagggagaagctcactgctctggacttaaatatgggatgcagcatcacatgaccagttttgtgatatgggaaaaattgattgtcctcactaaaactcagttttcttaactgaaacaaagaggtgatcaccttgcctctggggcctgctatgcgcactggaaaataacattgtaaaccaccaaaaatgtctccagagaaagctagaaccttagatggtagctgggatgattataaaggtgcatatgtattaatccatctatgtagacaatcatcactgaacacactaagtaccctagacctgagtagagtgaggctgaggttcatgcgggagtgagggagagggaactgaaatctaccccattccagcatgggcactcaggacagctttcaaggtcctgctaagtcacgtaaagcatgaaacagaccatgattccagcaacaagagcatcatgaggggtaggtggatctctaaacggtaatccaggtcttgcattggagacagcagtcctccctaaacacctgtgaggcaaagccagctattccttcccatggactctcttctacttgcttctactacataaaagcaaatatgactcaaaagtactttagttttaataaaacagacatttaaatctggaaatttcaagtagagccatttgtcagaaaacctcagcaaaaataagcatgatgcagcttgtctagatctgaaacccttgccgctttgataactaagttaaagaactcaacacgggggtaggcttaggtgaagccagatagggctgtctcagccacagtgcatttctgagccaagtgctcacacacggagcaggggaggaaagcggagtgttcccactaagtttcatctccaccaggttagttttctcttcctgccgtttttgataccgtgagaacatgtggatccaacagcttctcaggggaaggagctgcctaaagcccatgccagagagcccacatgcggccctgtcagcctggtcgtgggcacagagcatgtgggtcaatcccattcttgctgtagttcaagtatgtgcagatctcacttcagacaaacttgcaaacatcttagagatactggagaaaaagggagagagtctggaaggctgggaataagcaaacaccaccaccattttccagaggaatggattctaaaaactacagaagaacagacttcctccaagttccaagaaaacccaaaagagacacgaaataaggctcacaagcttttgggaagaaattggtggtctcaaggaagcaacataagttctctaagagaaagtcattccatgctaacctcatttcctgttttgacgagcttcaccagaacagtcgattaggggaatgccccagaaagtgtgtcttgatttcagtaaagcctttgaaaacctctcaccctatccgatctaagatacaaaagatgggccagatgatggtgtgaccaggaggacttgcaattggcaggacactcatctccaaagaaggccacctcctaactcatggaagtcctgcttgcctttgctccctttgcagctgctgcagacagccaggctgctcctgagtccccagttggacagacaattccgtgctttctgcccacaggcaagtgtggtttgaaatgactctctgcagctctacccatgagaaggttggggacccaaaagtgaggatgtcagcctagcgtggttggttctgcacaggggacatcctttgaagtgacacaggactttcttcatggagagccatgggactctgtcctgtgttctgtcccattcaccatttaaaaaacaccttggaggttgggtgcggtggctcacgcctataatcctagcactttgggaggctgaggtgggtggatcacgaggtcaagagatcaagaccatcctggccaacatggtgaaacccaccttggaaagagacatggtaaatgaaggcatatttaccaaatttgcagaacacacaaagctctgaggaagaaagggcccccaaaaatttaggcacaaggttagaaacctgggatggaaccaaagagaacaaatgtgaagctctagtgtctattaaaaacacagtccactgtaggattaaacatctatgtcaatttgcttcaagttgtgccactaagtacttgagtgtggccagggatgagagaacaaaacctatacttttcaatgccttcagcaatattaagctctgtcttagggtgttagacaggctctaaaaagccctcccttccttatcttatggccttgttaggaggacaaaataagtcagaggtggtaaagtgctttgaaaaagggaaagctctgaaattcaaaatagtattattatttgttgtaaggtgctttccctccaacaaaaaaagaaaatctggcagtctatgagtgataagcagaaagtgattcagctttggttctaattctccatctctaaccccaacgagttgagtttgctgggtcacctgactaaatccgtgacctccgaaaggtggcacttctagcgctctgcttttccaaaagtctcataaattcttggattacactaattaaacaataatttagaaagctcctttctaggactgggtcttcaacggtgcaaactgagtaaaccagcagaatgaacaccaaaagactgaggtctgggccttagatttttacagatacaatcatgcattgctaatgagagggatacagtctgagaaatgcatcgttaggcaatttctttgtgatgcgaacatcacagagtatacttacacaatcctagatggcatagcctactacctgcctaggctatatggtatggcctattgcttctaggctacgcactcgtacggcatttcagtgcactaaatactgtaggcaattgtaacacaacggtaagaatatgtgcatctaaacatgtcttcacacagaaaagataatgcattgtgctacaacattatgacagttgcaacatcactaggtgataggaatttttcagctccattataatcttatgggaccactattgtatatgcagtccattgttgactgagacattagtgagtgcataactgtattttcaatgcttttcaatcctacagtgcagtgctttgaaagtttgtcacccttgctgctgcacaagccctggcttgaaacatagatgaaaaatatacaacaaacccaagacaggagggcttgttagtgaagttaacagacagaattaccttaaagtcccttcaggatcagcaggatttcactcggcagttataggactccaggttcccctggaccacactagccagtagaacttcctgtgaccgtagacatgttctgtacctgcacagtccaatatggcagccacaagtcacatgtggatatttaaatttaaaataaaaaggaatttaaaaattcagtcccttggttgtacaagccacattttaaaggttccatagatatctgtggctaacagctactacattggatggtacgttgagagaccaatgtttctcagtcttggctatgcattgaaattacctgcagagttgtaaaaaatacggatgtctacaccccctcaatccccagattctgatgtgattggtccaagtggatcctgggtgtctggattttttataacatctgggtaattctaatgtctggccagggtcagaactattgctttaaccatctagaattgtgtggtcacttctcttttgctctttctcctaatatccttgtgaactaactatcctgcaggcatcatatgggttacgtctggtcctccctgcacctgtgactttcatctttttgaggtcataaataatcctgggggtaagactgcgaaatgggtagagaatgtggtttcatcctgctcaaaaacgcagaggaagagtgatcacttgggtggagatgttcttcccagtggagccccttgcacctgggcaagggtgtgtccagaggggccggagttaggtgagtgtgagcaacccctggggcaggctgccagcccacagttgggcctggctcctcacatcctcaggaggactgtccctgatgcccatgttacccttgtacactgcccttgcacatgttacccttgtatacttccttctcttctgctagaacctagccaggtagaaccagcagaaactcagggcagggtggaatctttgtattcatctcatctgatcttcttagtgttctgctggagaaagtagcatccagagacgcccagctgaggctatttccctccacaacacagtggtctttatcttccaggatgggggcaaattacgtaaactttaggaagttcatcagcagggcaaagcttggtttctgatgagaacctgactgtccagacagtagagagttcacaatcacccttttctgctgggtgatgtcccagaggaaagcctgggtcctcaccctagtgaggccattcaccagactcagatcagtttccttatccaccaaacatggtcagagcactgggctgctcagcatctcggtgtgcctgagaagtaataagaggatgaacccagtcagcacatagttgttgatgaggctcggatctcaaacgccggggacagaccgggaaataagacagaccacagtctgccttttgggagtggagtgagagacagacagatgataattgaacattcaggataagtgctgataatgataagtctatgaataaaataaaataaaatcacaagatagagagaaatggtggggaggaaggagggttctctcacgacatggtgctcagggaattctcctcgagaaggggacattgggttgagacctggatatgcattgcaatgaacactgtgcatgtacatagggggttttgtgatcaccatcatggcctattggtaaacgaattccaacaagtacaaaagagtaaacatggtcatttaaaatcattcttagatgtttgctaagcttaaaagtgaagattgccagaaagttctggaaggcttctactaatggcctgtctggccatgtcctcaggagggggtcaaattgtcctgcttgaggttagggaagagagtgggattacacagcaggaatgcttcgacatttcaccgttttatagactgttcaggtgccagtcccagagtgtcagagttcaagaaagcatttaggaaatcggggcatctaagtgaaatgggacggaggcatcgaccatgatgaactgtgcactgcacccaacacttcttcagcagagcccactcagacttggctagaggtgctgggtggggaccggggctgagttggtcccatccactgttttgtctccagaaccagcacacagcaggcccctaagaaatccttatgggatgaataagtgaagcagtaaaggatgtgtgaggggagggaggcagcagagatggcagatgtctctagtggaaagcccaaggttaatggagatcttggggtcacagtttacaggccacgatcagggtgggtgtggaaagaggcttccagatgaagcctgacgtttctctcaaatgtcagtctgcccacactgactctacagcaatctggagaggtatgagaagcagcaagacaagcgtggctgagttatgagagagtcaagcccaacacacatttaaacatgtcagatgagctgtgtggacgtgccagggttccctcaaacactattcgatatcctttcaatcagcgtttaaagatagctaataagcaaacaattctgttttctttagttttgcttttaatgaaggacaagggattaagacacacagagactggccagacaaatgggaaaccgaccagaccagcccatgaccaaaatatcacaggcagaccacccgcaaatgcagaggcctcagagtccacagtgggcagttggaaccaggccccagggaatctttcagctgcattccggctgtgatcggcgggcaacaggtagaggtgctggagggggatgagtcgtgattttcagtgtctgtcatattcgatcaagtgtgtcatagagcttcctgtttcatctcccagttattctgaaacaaaaacatgcatgaaaaacacaggtcactgccaaccacactgacagtcgctctagtacatggaaactgaaaagggaaagacatatcatgaatgccacaataagccagagaatcaaatttatcagcatctattcaaatattggcaagcaacaaacattgctggcggcaatggtggtgcgggacatggggtgtccacataaacagaattcagaagagactgaaaaggcagatgttcccaaaagcctgctgctttgtttggggccagcctgtgtgtttattgaaaagttgattcagttctgacttcctggtcagggtctgactcctgatgggccctgaggctcttcccctacatgcccctgttgacttggatgaagagtcacacaaggacttacaggatggcacaggtgttcgcccaggtggtgccctgcactcccctctccaaaggcccaaagagacccaatgagagatccccgtggaattccagcccaatgaggtcctgagactccccgggagacatggcctcccaggtgcatcaaataatcacaatacacctgggcctagcagcctcggtgaggtagagggaagggtggataagaagtggggcccctgaccaagcaaaggccctgaggacagcacaggactgacagcagctccagaaagactgtgattctgttaataactgctctgccgcttgagaccagcatggtctggctcactgtttgcagaaaatcattctcagtctcccaaacaagtgaaaggatacttccaaagacagacagagggacggtagaatcagaaatacagatggcaccatcttcccaaagtccatactgtagccccacaaaaccaacttcatgcttaaatctgctgctcagacacactttggggagaaagcagtttttccaggagtgagctggagacagcacttccatgggagggaggtcaaatccaagactacccgctatttccagccatattcactatggatgaagaagggatggctctacccatgaccgtgcaaagcttccttgggaaccctgctgtcccttccacatgcaacctgtccaagatgcaaccctcagttcaccatgaaaacccactggccctgccgctccccatttcctttggttaatattaggcacaaatttttctgtaaaatgagatgaaggcatgtgattttggaaaagcttcatccttcctcttgagattcattcacaagatacagtagcacacaaaatacccagagaagttaagaaataagaaagctgtttaaattattgtgcacttcccaaacatatatagggcataacattttttgcacactggcctttgctggcagggctctgctgagtggtgttaggaaatgtggccgaaggcaggctgcccagcctgcagggcctggcggagctctcctcctcctagggtctcttgcagtgctgcaggccagggaataaagcttctcctgaccccgtagccctggctgccaggacatgtggtgattatgacagtctctatttatcttttgaaactctgtattgtttccccccacccccagtatctttcccaatgtcttgtacaagtgagttaacggatccatataaactcctacagtcttatctgttttttccttaaaggcctcattggctagtgacagtgaaataccgagcttcctgagccttggcgaacctggccccatgattcctacacattctgggaagaacactgcccagatgaatctgttgggaaagccagcttcccgttttgagtcctatgagctagcattttctaatgtggcttaaagtccagcatctgggcccaggatttcatacgcagtgtcttcctgggtgggcaaagagaaacaggaactaagtaatgcatcagtggcctgtaggggtggaaggggaaacctggtttctttagtttcatcactgaaatagagaggtggtttaccaacccgtgcccctcaccagttacccccacttttgagtgcaatgaaaaaccaaaatgtaatagcccaggagggctacagtatggaacacccaaccatgtggaccttgggccaaagtcacagagtgagaggtggccggcccttacggatcatccaaccaacccttcaccttgcaggtgaagaaagcaaggctcaccgaaaaaggaagttggcaaccttcccaaggtcactctggatgggacacagctgggaccaggacctgggtctctcctacctctcctacctttggcttctggccaaagctgagaagaccctgaattccagttctccactgaaaggccttgtctgggaagttttgcatggatgaatcaactccatgttggcctggctgtctagttatcactgaataaacccacgacagttcatctgagaactaaaagttttgcccctaattcagggccgatcacacacatggcttcctagatgccagtgtacactgggagtgggtggagaccaccagcgccactccggtgttgaggcaaccctgaagaagcatctagtcacagacagggccactcttactctttggcttggctgacctgctgttcctgcaggtgtctaatattgatgagccgccaggtaggtctccccactgtgggtacaaaacctcacttccccccagatctgagagatggcctcagggtcacacacatcaccctgaatagaagccctcatcaggggccccaaatgcagctcaggcaaccttcaggaagctccccagctagctcccaaatcatgctctttctcttcccgataacagacagaaggctgctggcatggtaaactgacaaagggagagaagcagtggcacagatgcatacccccagtcccacccccaaggcaggctgttttgcccctgaagttgaaccatccaagcctctactttctgtgcagtaagtctcaaggtaggaggaagtgaagaccacaagcttcgatttgctgtgacatccaaggaactgccagtacctcactgctgagagcccaagccagagcttccagccagcctcatgcaaaaacacacttgagcttcctctgccccattggcagcaccgaggtcttcctcaatgcatagaaaagggacgagtgaggaactcacaccctgtccattcttgactcacaccagattctaacagtataggaagccaactttttgagatttcaaaagaattgccaaggaggatggagcctgctcagtaactaccaaactgttcagctctcaagagaccactgtttttatttttcagaatattaaaacctagaccgcacactcaggaaatgtatattgcttatcacagactaattttagggagatatgagatgggttctttgtataaatcagactcgtgtgctgctagagctgtcagggcaggggagccaggcagcagcacttgagtccccctgcccttgtctctgacagaggctcccgcgtctagagcttcagccacgtatctctgagcagacttagcaccttttcaaggggacccccgctgagaagcagtttctgcaaagtgctccacacgtcattacagacctacacttggtcaggaagattctgtgtctttgagtggggactttcaataccctcgtcagcagagtgtgacagtgccaggacacacacccgggtctcctggccaccatttaccaaggatgtaccacaggccagctacagctccccagccaagctttccttcaaacatctccccagccctctcaggttggtgctattgggatcatctctctcacttaggaaggaccggagctcaagggagttcaacaaatagcagggaaatagaggcacacagccttccatgcagcaaactgatggtgaggctctgctgcctgccaggatactcagcagctccttcaaacatctgaccccctgaggtcttccaggctctctcacttttggttacagagagtgtcctgagcagcacaaagtcagacatagccgggtccacgcacatttgtgtctttccacagggtcagacttttactgatgctatttcaatcacaaaagccacaagttacatggagttcccaaggaagtgattctccttagtacgtcctgttcaactggtagtcagagctgtgagcactcaggctcaagccactctgcaagtcagtcaatattgcaaaccatacacagcagtgtccttaacttaatcaatatataaatgctatattaaacattccacatggaacagtaacatttaacatcgagagaaaggggataacagagcataagtgtggctttgaaaaaaaaaagagtgagaaggggatagaagaaagggttaatgagccaatccaatgagagcaacgtggatgagagtgtcctggcctgttccggacagacatcaagagtctttgatgtgggcagagtctttggcagcagatgccgggtgctgatcacgagcaacaacagagcaaggctctgttaagatgaccatctcaagctggtgaaatcctgctcttcttatagccctgagacctctggcaaggactgatagtagaagagggctggtgatgtccctgtctggttgggtgtggtctttattgattaggtggccatctgttccctgttggcatgatgccttttgacatgtaagatggagtctttttctaagatggtgtcacttatgtcaagagtgctctatatagggaagaacctatgacagctcccttagtttataataaaggcggaaattgtcaaggggcagcaacccaagggttggcccttggtagattgtttcctagtctagtgataccatacactacagcttgaccctttcactatctgtaaaatacaacccatttttcagagaaccaaacctcaaaaacattttagccactttatagtctgatggacatggtaaaaggccaagatgacaggtaaccttgctgtgcagttactgagaaatgcaaaaggccttctgagaggctggtgtggattttaagtctgtggtaggacacacaaagggacattaggaaaaaagtggagacaacttgcagactccagtagacacggtttttaggcatttcaagcaccctggctctaggctgcggttctcaatgggagtctcagcactggcagcatctcattacctgagagttgttagaaatgcaaattctccggcctcacctcacatattctaagaaggaaaccctggggctggggcctaggaatgtgtgtttcacagtgcccaggtgattcagatacacacaaccaccagtggcaagtgatatctgctcctagtgacactcttgtatgcagggccatgggtgactgcaggttggctatgcggctggctactgatgttcacacttagtcaactgtacccaagctacttgccggacgctctctcctgagatcccgactgggggcggaaagagcaagcagctcagaagccatccagaattttcaactcatttttggggtgacctggggagaaatgttggcatgcttcatcccttaatcttcttttccagatgttgctcatctgcacagcgtgggactgagcactgtgggatattcaatctgcaccagtgttctctccctaaacatcaaatgtctcttctagccatgctccacccctgctcctatcccccttgccttccatccttcagctcattttgcctgcacagaacacgacaaccatgaattctgctgcatctctctcaaataggagaacagaagtgttttcaccagctcaaccctcctcactgcaaccctgtgcaaaacaccacatcccccactcccactttcaggctctgctcacaccgacctctgtgcccaggtagagagcaccagcaaaaggctcacaacaacacaggtaggaggcactagacaaccaggcctcccaaaaaagttgaaaaaaaaaaattgtttgtttatcattttaaaaaaactaacctcatacaggaagtatgagaagcagaagaagaagaagaaaaaaacccaggctaaaatactggaaatgtccacatttgttacagataaaatatgtgtttctcagtttccatattcaactttgcagggacggtgggaacaggtagggtagggcactgcgggggggtggggacttaggatggatggggatcaaataaaaaaggtgactgtgagtacatgaggcacaggcttgccagatgtggggcaggaccacgaccccaatcagggccctctctgcaggtgtggctgtcccacccagacttggagaaggggatgcctaaaacagaaactgttatccgagatcctcctactcacctgcctctctggccccaggtcctgccctcgtgtgtgtttcaggtgaagaagccagagttacaaaatcatgatcacctccctccaatagcccttccagacctgcagccccagcagcagtcagctatggagacaccgccacccaggccttccttggaagcctgaggccgtgcagaccttcaggacagcaagcccaaacgggcggacttgctttggtgtgatggacacagacacgaggccactggaggcagacaggagtcagatctgatgcctgacatggagccaggtgccctcggggaaatgtggctcaactggatttttttaaatggggctggaggactcacaacctccacatgaggattagagtggagaaaaacagtgagaataaagagtatgtcctctttcatagaaccaatcagtaggagagaaggaaataggaattctcccttctcataataaaaaaataaatgcaaacactgtataacgtgcacacattaaaaagatatcaactgaaggattttaagtcattgcgattggtgtcaaagaaagcaattggtatgagagaatgaacgaacgaaagaaagagagaaaaaaagagaaaaactgtacaccaaaatctcaaaatagaaccaaaacctgcaaatcatactcaggagtctattgtgaacccatatttcagcatgctgttgaaaaggttaataattttcctaccgaaactgaatgtgggttgtgaaagaacattaaaatgaagaaaatttccccgtggctgctattatattatcaccaaagccatcaagtttcagtttgagttatttgtatttatttgtgaaaacaaagattagataagtagaaacataaacctcatcctaattattgtcctggaggatctgatttttaagaccaaaaaaataagaccatcacacacacagaggcaacacaaggtatgagaagttacaacagcagaggcaagggagaggaggctgttatctcgttctatcatttgaaaaaaatgtattgtctcatgtaaaacattaatagttgcttacagtctgcgaagataatatgagagtcaatatgtacttttagctgttgacatttttgtcaactatatacccaggtggagaacttttcttttaaactgcaaactagaatttttgttttacacttgcaaaagtgtagtaaaagccatacaattcaatgttgaacattggggtggtgggggaaatggaatttaaatgctgctttaaacgatcaaaacaagagctttgggacatttacaaccaagtggggtctagagaaaacacaatgtttaggtgcagagctggctcttatttcaaatttgtctcagatgcccagggggcagcttgttttctgaagttttaaaagaaatccaaagatgaaatagttaatcagaaacaatgggtaagcagagacttcatgtatttccatcacaacataagcatcagaatgaaaaaaaaaaaaaaaacatgcaaaaaagagcttcagtggtctcacatcaccgaacaaactgtttttctacctattttgtgttgctggcttttgttatcagcccaatcggcaaattgtggccaattttgtcatggtttgagcagacattttgttcccaaactgctttcaacattttagctaccaaatacagtttatgagaaaatgaacaagccacaatacaaacagaaaaggtaccttttcttaccaaattaaccccctttaagcttaaaatgcaaaagtttttttttaatgcaaaaaaaaaggaattctagtaaattcaaattctgaaacaacctcatcagttttttcctggaaaaaggataattaatgattaacctactgatggattttgaaaccaactacacgacattccctgattccgaccaccatgacaccatgaaactagtttttaatgacacagtatgtaaatgctattttgcaaaaacacacaccaaatattgtttgaagatgcagatcacgaggctcaaggagaacagtagaactatgttaaagtaaagtaatcggttaagcagttatttactactgaaaataagtgacacccacgtagttcatgttatatattaatattgaaaccaaatgacagtctaataccgcaaatcatttcataaaaaaaagaatgaaactagttaaaattaaaacacagggttttattttataaagcattaaatattcagatcaaaacggtagaaagctgacttggcttttaaaatatttgttttgctgaatttcaacaacagattgaaaatgaaaaaaaaaaaagaatgaaagatctctccgtaaaaatttaagaatcactactgagaagaaaagcagaatttcagacagaggcttgaagaaaacttctgtttgtaatcttccctcatatttgaagacacagcaatatgtacaacatttttagccttttaaaataccagcatgcccacacactgtctcagattaaaacaaggagaaaatgacacattctgaaaccattttctaaagcttcttttcctgataacagtgaggcgcttacaatcaaattaatgagtttctaaaaagcccaaacaactctccataaagaaacagaattgttcataacagcatgcagatatttctagatttttcagacaacactttgagcattagttcttgctacttactttggaagatgtttttaaacatctatattagaaagaaatactactcagtgctttgctttgttaaattgaggaacactctgaaaaacaccaatagagtcagcccagtatttccctcatttcaatttaaaaattagttaactcttccccacactccttgcacacatatgtattctcacaatttatttatacttgaaaattcttaaagtagtgaagaaaggaaacacccacagaaaataagtcatcatttcttctgaaagtggatttcttcataaaacataaaccagcaaataaacagtgaaaagaactaaaagcaaataacaaaactcagtaagaacactgaaaaatacatattgactgatagaaaagttagcacaggacattttaaatcattgagaagaatagggacatttgtggtcagtttaaaagattctcagtgaaaggttggcattgcttctgggcaagctgaactgatgagagcaccaaggtaataacatcttccattcaagataatgtgttatgttgtttaacaccgtatctaaaacatgtgactcagaattcttacttcacttttttatatttcaattttttcagtattataggattcttctggtactttaaagcaagtagcctgatttatataagacaacagcatttaaaaacagacaaaacagccttgaaaaaaaaaaacatgacgattaaagatgacagtggataaggagaccgtggtaatcacctaatttgttactttcagacattttctgtatgagaattttactctgcaatacctgcccctatcttcatgcagcataactgaatgttcacattcagaaaaagcctgaccttaactagtacttgccactcttttaaaccacatatcctcttcccccgatgtaagacttgggaaatgagggtgattttagtcatctggaaagagtgaaacaggacatggtcttgaagcactttcttcagaaccgttgtcattttaactttgttttaccacaacagaaaaggccgtgcccacggaacaaattcaagttcaccctcaattgtatctgtaactctggaatttcttaaaagcagactggcacagcacaaaagctttccttaaatagtcaaagcattaagaaaaaaaatcccacttttcttttgcaagtatatgaattaaaatgtgaactcttatatattaaaaatgaatgtttttagcacaattacttcacaggcaaccagctaattttttcttcctctttttcacaatatgcatttgttaaaacaccaagatttttttttaaactctgttacatttacaggcattcctaagtgtaagcaaaatatacttttcctcccatttaccattttatttgaagccaatctgtcatgtataaaatgatgacaattttgttaaaacaatctggctttagaggttagggctagctcaaatgtagatttagaaaattgagctttttctcttttaaaagcaatgaataatttaccaaaatctagaaataactgcaactggaggggggaaagtcagacaagaatgaaagaagccaaggaactcagaattcttgccccggaaatgagggactcttgcacttcattttctgttgtccactaaataaataaataaataaataaataaaaattgatttctagttataaaattaaatgtgtaacaagtttaagaaatttacaatatgttagatacaaatatatataagtgagcttagaaaggtaaattgcatttcttagagcataaatccagccccctgtgctaatgctattgtgagttgacaagacagatacagacactggatctacaccactgaaaacaggatgattttggttgtaaacttggattagtgcgaaaccattctcttctgacagggtctgtcggcacaattgaaaggcatagtcgacaccggtggaccatggagagtggaatggatttctgatagtcacctaaaacctttcactgatgttggcttgaaagctgcttaattagctgtaggctgccaaccaatctccttatcaaagccagctgaaaacaaaactgagagaaacagcttgtggtttcgcaaaaatgtatttacatgaagtatattttaaagggagtttgatcattaggtacgatgtcatctgtgatgtgcggtgggtttgacatttaaagatgtcacaggttgtcagattcatctccagtctatacttagttgagatgtaacaacttctgctagcagatcttgttctgttgatttccagcctagaaatctgaaaagatttaactcttttttttttttttttttttgagacggagtctcactctgtcacccaggctggagtgcaatagcgcgatctcggctcaccgcaacctctgcctcccaggttcaagcaattctcctgtctcagcctcctgagtagctgggattacaggcatccaccaccacgcccggctaatttttgtattttttagtagagacggggtctcaccacgttggctagggtggtctcgcactcctgacctcaggtgatccgcccgcctcggcctcccaaagtgctgggattacaggcttgagccaccacccctggctgaaaagatttaactgttatttacttcatgccaatccttctcatgtcctctcacctccttacccatgatctattaaaaaggaagtgaagtggtgggtgacacgtggaacataagcctatttttgtacctagtcccaaggatggtgacagaggcaaaaataccgccgtgaacacaggccaggcagagagagttgccgataggtgtgtgcttcctaaaatcaagaaggatccacatctttctagcccgttatttcactgcgatttgtattgaaaagaacattctgacaagacgggatttccttcagttaacacctaaaaattgtcgaaaccaaggaaaacccagagtgaaagcaaacgttctacctcgtcgaaagctatcttgatagaagtcataccaaagcagcagcaaaagatcccagataaatgtcgaccttcaggtatcctcaaccaggaacgtggttcggtagttttgtcagtgtgtttagccatcaagatttaatgctttatattttatcaagagatggagacatgaatcactaccatttaactgttacaagaatgacgtctggtgaatgtttagtcatccattcactcttttccaaatgtcactttctgtcttgcctaattcgttggaaatgaaaattaagctctaaaagagaaattaagacaaaccagaacagacccaagtgaaatcagcactctgtcaccgataacacccctgaaccacagaacctcagcaacaggaccgcacagatctctcaaacagaaagggaaatggtcagtaaaattacaggaaaaaaaaggttcattcaacttcgaaactttgttacttatgacccttcttccaccttaattcatatggcagaggtcaaggggtattagtcccaggatatgaatgcagtgtgatgtgcagttagcaacatagtttttaaagggtaatagaaaaaaaagctttataaaactgcgctactcatcaattattttccatagtttgctttaaaaaggccttcttcccaaacccaattattccattgttaatcatcttgtttgaaaaagaacagtggcatgaaatctgtcaatataggttgccattcaagcccaggagaaccaggcaaaaggaagtccccaaccagggttctgacagcagttagaaaaggtagaaggccaggggctcagggaacaagcaggggacagtaatgactgtggcctatctcctgttctgtatctgtctccttagcaggaaatagcaactttgattattttataaattcaaaggcaaccagacttcatttactaggagctctcttctacttggctgagctgtggccttcatttgaggcgttaccaaaagcagtgcatgaataccaggaaagctggtctgcaatgaggagtggaatgaagggcttcactctcccccaaagcaccagggagctctgcttttgggtcctccatgccgagacaacccattctgccagctcctttgaacactagactgaggttctagcccagtacaccgaagtcccagggacagctgatcagcaaattggcattatggatcagtttccaggaggacaaataaagaaagagttacagtaaagcacaaaagcgtgtctgatggagctaatccagaatgggcaatgttagactgcacagtaaaatgtgaactcctccatttcagcaaatcaaagggacttcccacattgtcaaggtctccttcccacctgcctctggccccaggtgcagacgagaagccagagaggcaatgtggtgtgccccacatgcccctcccttcatcactgggtttgttgttgatactgttcccactgcgtttattcggtgactctgcctgcaaagcttcctttctgctgctgcctgttgctagggaatgaaccttaatcactgcgagagaacaacagcaacagcaatcttcacttggcacgagcaagcacaaatgtctcagtttagtgacaatgtagaaatcatccctaaaagcatcctcatttacatcttccctcagaaggatggcaacatttgccctgtcatgaaatacatattctcttcatcataatgtcagagatggtgcatttggagtggatcctatttccatattgaatttctgccctttgtcatcaagctgggtgtccagggtgacttcgggctcttagaatagcttggctgtggatctcacctagttgtcagcctctatttaattgttttttttttcttggagtaaaaaagcaaaccgcatcgtcaaagcatttaaaaacacaaaccaaaggaaactgggtttccaagctttaagcagatgttatttacccacaatttatttccaagaagtaactgagaaaccattgccatttttcatcagtattcaattagaagcataaaatcgtcactgtaccaatgatctataacatggttcttgctggagataagtgaaaagcaacctatgtcctcaaactctagctcacctcaattctggggttgcggcttccccaacccttttatgtgctttcatgggggtggccagaggctggccactgctggttgcagggactgggaagctggcagagatgagcaagcagggccctctccagcagccaccaccccagctaaagagaagtccaagggttactttgtggtttgaggggcacctccttttctctggcactgggaggatggacccggtcactgagcaacacacaggcctcatgcctcaggcttcccttgggtagtggagtcccacctgtggggactggctctgctgggctcccaaggaggggagagcagggccaaggtctgtgcttctcaccttcgcccctgcccagaatggtgtttggttcagagttgacgctgggtgagcatctgctgcagtggtgggatggatggtgtgaaccgaccccctagcttgggactcaaccacagttccgaggttggcacagattggtacagggagatgggcaatgctggaactgccaatcattgaggtatcttggcctctatatctgtgggttccacattactggattcaacccactatggattgaaatatttaaaaataataaaacaataaaaataatgccaataaaaatatcataacaagtgtttacatagtatttatgttgcattagatattataagtaatctagagattatttaaagtacacaagaggatctgtgtaggttacaggcaaatattatgccagtttgtatcagagacttgagcatccttggagtttgatatccataggagatcctagaatcaattccccatggataccaagggacaactacacattgtgtaaattaccaaatttgctcaaccttctgaggcaactactcttaatatcctcattagagagaaggaagttaacagaggggtggttaacctgctgcagataacaataagtcaagagttagagaaggattgcagatgtccttgcctttttaccacaccttctctgccattggagtcagtggccaccacctcacagcttatggacacccttccccagaggctgtaggtctggcccacattcctgccttcctgattggagtgtgacttctccaggacagatgccatggccagctcagttcactctgtctctctggcaccaagcaccctgcctggagcaccgtggaccttggcatatgtttacgggactctctgttttttaagaagtagtttgccatctcttgcacacaaagctttctaaagcaaagaggaactgtcttcaacattgggtgtctggatctctactaagagcaagaacttcgtagacctagagcagactcaccactgtcaccgtatttatcccaggaggtgcgcctttccggaatcaccttgtgtattagtttgtcaatgcattccttcatttattcataccactgtctgagtgattagtacacaccaggatgaagcctttcacactgatgtagacacgaataaaaatcttttcacagttgccctgttagccatgtcagcaggatcttgagataaaacagaaaagcaaaactacacacggttgtttatccaatttaataacatttatctcagaaggtgagagtgtgtataatcttcacaatcaagagtagaacatgtctggcacacctaatccaaggttctgctgaaaattctcatgggcagagcaaggaaaatgggaaggcacgcctgctgaaagatggatggccattggtaactcagaaagaaccgcttctctgtcacgttgggtcaggtctatgatgcaatcaccctgtgccagagggagcctgcctgtgttgggagaagcagggctttcatgccaaggaaagaatccaataagtctctcacagaaaaaaagtgtattagattgatggttccaatagcattattattatttgttatgattttttaaaagtattactatttttattattaaccactttgggattgcaaagtgtctcccagttcacaggagcttttgtacacatggtttcacctaaacttcaaaactgtccggagaggtaggagaggcagattcattcattcattggttgagttgctatttgacacacgcccacctgttatcagggccctgggcccctcccccatagcatcgctgcactagtggaaccagcccagagagagcacaagactatgtgtgtcaggaaaagaaggaaagaaaaaaagacacgcagagttttctttccctttcctgagtctagcttactttagacttactttccctgttcctctagctcccaccaggctaggatggggccatagtgtccccaggctgccccccaaccccatgcccaccccctctcctgaactactcggcacttcctttccttcccgcccccaccgctctgccctggaaagactggggaggccatctgtgccgtctcttctcccagaccagtggttaacagaactcccagaggaggctcctgtgtgtgtgcaactctaatagcaggatttcaggcctcatttgtggccaagacagtgcggaggtgacctttggcgacaggcctatctcattagcgtgtagtctacaagattctcccagggagctctcggatggactgtttctcctcgcctgagatcttcccctgcttggcctgaagtcccactttgagggagtgggtggctgtggtcatggggaaggctgggggggtaggctacctgcagcagcccctcttggaccccccaggtcgtggtagctttccattcctttacacgccaccaacaggacgcctatcgcctacctggtgggagcagaatcctcttggagtcactccacaattagaaaaataaaagttgtacttctgttatttgcatcttaccttggttttcttttctttctgaagactaatatattatgggtggtttcatggtttaacttcttttttttttttttttgagacaaagtctcgctctgttgcccaaaccggagtgcagtggagcgatctcagctcactgcaacctctgcctcccaggttcaagcaattctcctgcctcagcctcccgagtagctgggactacaggtgtgcgccaccatgcccagctaatttttttgtttttagtagagacggggtttcactacgttggccaggctggtcttgaacccctgagctcatgatccgcccaccttggcctcccaaagtgctgggattacaggcatgagccaccgtgcccagcccttcatattgttttttaagaaaaaaatataaaaatgctgtctttgatctttttttaacaagcaattttatgtatattggcaaaaaataaaaaggtagaaaaaaggcaacaggagaaataagaaggaaaaggaggaggaaaaagaggatgacaagaggagaaatggtttgggatgagacaaaaaaggaagcgtaaaagttaacatagaaactgacctcattcagagagaccctagaggaagacacagcctccctttggactcagatgcttattgcatagaatattttaaaagcaattggagaaattaaagggaaaaggtgctttggtcccagactttcactattccatggagcaccatcctttaactctgggaaaagttgctcttaccttgttataatagtttcactttgggcccagcacagtggttcacgcctataatcccagcactctgggaggccgagacaggcagatcacctgaggtcaggagtttgagaccagtctggccaacatggcaaaaccctgtttctaccaaaaatacaaaaaaaaaaaattattcaggtgtggtgatgcgtacctgtagtcctagctactcgggagactgaggcactagaattgtttgaacccgggaggcagaagttgcagtgagctgagatcacaccactgcactccagcccgggtgacagagcgagactctgtctcaaaaaaacccaaaaagtatccctttgtgtacctagcacggtggaggactgttttaaaagcaggtcagaagatgaagccagtaagacttactgcgggactgtaagcacaaaactgaaaacccctgctatggaaataaatctatgcctctgaagaacaaatccaaagcgatgactcagggaggcagcagggggcatccttccaggcacttttaataaactctagttttaatggaaaatatttcaacaatggtgataattctgcaatttatttgcaaagtcaaaaaatgttgttttttttaaaaaaaaaagattcacctattatgattttctctgtaattcttagctgtgactccataaacactacctcgcagtaatagagaggcttttgccgggacgctgactgccaagtttgggaagccatagtcctaaggtgataaaaagcccaacttcaggaacgtaagtgtaggggagcttccaggcatccagcagtccccaattcagggcaggtcttgctagtgtcaaactcagcttccgggactctcctggtgctcagaagatgctctgtaaaaaaactccaccaccattcctcaggccagcagccccagcctggacaaatgcaccatccttcatattccaccactctcaacacacaccctgtttgcctctttcttctttctgttcattagctttttattctaaccttctttgcaatgtcaatgaaactggcatgcagcttgtttctgataaacccatttcacactcggatggacacttccctgtttggaagtttatttctaatattacattccaggacgtcctcccttggtttcgccccattactctggttacccttctttagagcatgttaaatacttcttttacctcctgggtatcagtaaccttcacgtgtgtgagagttatggtctttttcctgcccaagctccattcaagcaactcaacattcttaattcttgagagttttttttttttttccacgaaactgttcttggtgacttttccttcacttcgggttctcctctttcccttccttccatctaggtgtccccagctgaacgtgtgtgttcaattttagaaggggcctgggatcaggaaaatgcttatcagcttagaggcaatatacgttagcctaaaacgccccactggttgaattacaaaagtagccacagcagtagcctggaataagcctgacgttgaatgtcgtatttcaggcttcacgttgggatcgtatgcaatctacagttataaacccatcagaagtatggccatccatgccacgcttttctgaatggtatttattttacatgggcagtggatgggatttgataaccgttctctccagcaagatgattttagaaagcgaaaggcgaactggcttttttagttgtggcactgcctcatttggaaagaaaaagtatgtcatgcttttgtttcacaaatgccatcacacgttcaggcatttgtggttccatgctcaggcgatatcttcattttgctgccacttccacacacgattattaatgctgaaaatgggcacaaatgtgttaaaataaaatttcacagcggtgtagtgtttgctgtcaggaagtaggtaaatggtctacaactgggacaaaagtttgtgtggaattaaatataattagtgttaattccactggggtggaagttttaaaatatatcaaatatgctcaagaactttttgtatgataagggatacgtattagagtcaaaaataaagacagcccatagaaaaggtgtgggaaatgatactccaaggccatagaatggctactgacatttgttttgtgagccacctacaaaaatcatgtagataattctcacatacatacttcccttagaaaaatggtgcacttacaaatagtagatgcaaatgaaatctaaactaaggttgcaaaagcacaagtagaccctcccaagctcaaagctctcataaagccatggcatctacatgctgtgaaaagcctcgtgctgtccttttgagcagccagtgttgctgcaaactgccggggacccacttagtttcaaacatgattttttccctgaaataacggcctcccatctaatggcacgctgaggtcacggggcacggtggaaccagtctgtgatctgggagcctgcccccagagacacaccagtggaactcgtgaaccgtctagattaaaagattaaaacgtccttactgcaggtctttatcatgaagcccatctaatcagtggcacgtttactcagaataaagaatggcccctctaagggaggggggaaggcagcaaagggtcagcaaggagccctgtgtgggggtcctgccgtctgggttccagtcattaagaaagcatatattctttgagcctccactcctgaatctgtaaaacgagagctctggactccagggtggctcttgagattgtgtttctccctataatttctataattttttgcaaatcacaactaccttctcactttattatgcataatgatttaaatgccctgtttccatgaatgtgtattcttttattgtgctaaaataggcatagcataaaatttactattttaaccattttttaagtgtactcttcagtggtattaagtacactcactgtgctgtagctatcaccaccatccatctccagagctttttcatcttcccagacagaaactctgtccccattaaacaataactcctcattccccccccttgcctccagccactagtaaccactgctctaatttctttctctatgaatctaacccttccagttatctcatgtaagtggaatccatacaattttttttatatttacaaacatcctcagcatgacaaggattgaacaagattatagttttattttgtttgtaatatgctgtcccttttctgtcctgtcctgatacatgtaaatggcactaaaacagagtggccctctccagggccgctggcatgatcaatgctttcacagatttaaaaaatggaagctgagccccaaaatctaattacatagaaagcatttgcgcagggattgcatccagtgagaagcatcagggacatactattttggtacactcaaagacacacttttaaaatcaatattttaaaagtcatatcagaagtaagataaaccaggctgctatctcaaccctccgtgtgtactctgtacatgatgtctctctcaccgctgagaaaagctatgcgtaacaacaggaaactgatcacagatcccaacatcagccccggtgactgtaagtagaaaatacaatgagtaattcccctgaaaatgagatgactgaagttgattatgtatttgctgtttaaaaataaaaaagagtcaacaagaatgggagtggggtggggagttttccacgttaacagaaatggcaagttttatttttaaaatttatctgtaaatacaaaacaagtgataaagacaccatgtgtcatttgtttttgtacagcaaggaactacatgcagcttgctaattttctcaatttgtatgctacaaggtgaactgcagcatcacaaaaattaatttcctagccaagcaaatatgaaatatgaatttcataggtaggcttttataaaatattaagttatgggcaagccaatataaaatattgatgtcatacagtatgagcaaatatggagataaaaatcgctgacccagattatgaattgttgattaaagagcattgtttaccagtttgtaagtatatcagcaaaatgtatgtgtgggcatatgacagttctaatttgaaatataattctaaatcatatttacctttgatctgaaaatacctgatagtgtgaaaaaactaaggcttgacagccaaaacagtacaaaagtcaaatgctgcattttaattcagaagtgggcaaatgtcaacttgttttaatttctgaaacctctccttttggggttattgttacacatttgatattgaaaagaaattgaggttaatcaaccaatattatttctcttttttagaagcctcagaaagtttgcatatatacatatatgtgctataagaatatacaagtgtatataaaaacataaaatattacaataaagaagaaaattcattacagacttcctagggaaaagggaaaaaatcatgtagaaaagcaaatcttgatttggcataattaattgtagggtttcttaattgtgtggagggaaaggttggaggagtaaatatgtatctgtatttacagaagagaatggatctttcaagccaacaacccaacagtaaagttctaaaattacaccacccaagtcctctactgtttccttcttttggacaaaagcaaatattgaccaggtgccagcctcgagccatttgaggcaaaggcagccgttgcgatgggcaaagccacagcctggccacaccgggccaggctccacgtccaaacccgcttgcatcgtagaattttgaaattaacaagtcaccagaccacacaccaagcaaggagtaatcacttcacagagagaaaataactatgtttaaaatgaaagcaagatcaacactggcctaaatgctggtaaaatgaccttgagggatgttccaaattgaaacggatcaaattagttttcaatccactctaaaatatgaaatgtcaaaaataaaaatatgctgatgaggctcagcgcgctgaagttttaaaatgactaaaacgacatctgtcatggaaatccctgcaattttacaagagaataagaaaggctattttaaacggtgcttagtcacgttgcatttttttggtagtaatgtccaaactttcctgtcccggtggcagaacccatgagcatgacctccacaggactctgggggaatgggggtgggcaagttccaaaaataccactcacagctcacaaatgacggctggtcaactcacatttgactgtgaaagccacagtgcaggagcgaggacggactaaaatgtctacaggagaaggtagggtgttgtgttctagaaaccctggcagctgtgggtgagcacagaattttctaatgagtaagactgaaatcagtgaaaatgcctcagcattaaagggaaaaataacttatctgctgtctaaccacggagctcaggcatctaagaaaagcctaaataattcacgaaaactgtgcccaaatagacaaaaggagctcactgcttcttgcagaatatttaaacctgactcaactttggggttttaatccaaatatcttaagttcacatttcattgctggaacattccatgttgtatcaggagctgacttaggtgggtgaagttcttaaccctgaacagagaataaaatgttaaaaatagtaatgagagtgccgatacctccatagacaaccctaaaatgtgtaatgtgttcatgaaacacactgctcaccgtctaaaggaaaggtggttaatcctgggcaattcaggtttctttgcagctacgccatggaaggtcccttaaatgcaagactcagcatggaaacctctttcactctggaatccttctccagaacttgggtgaaggttcacacacttacatctacccccatgcttccccaaaagggctaaacccagaaaagcctttcccggatgtctaattggtgacagcctattatgcccaaggggtttacttttctccaggtgcagaataacagaggagagatttgtttactctctccctttttttttttttttttttttttgacattaacaactttgtttaatggcctgggagcttgagccggtcagatccctagagcagggtccacacactcagccctggactttctcccacctattccaacccagcctcacactcccataactgcattcctagccttttcttcccgtttttaacactgtgcttcacctagtaatcaacataaaaacaaagcagatagaaggacaggcctaggtcaggcaaccatctggggtaatgcaggtgtcacagccacaggccaggcttgactggcacaggtctggggagcctgggggcagcctgggtgggtgtgaattaacagcctggaggtggtgggagggggcattctgtgtgcctctggggaggggcggaggtgaggtgttctctttgtcagggacccttggatctgctggggacagagcctgcccaactccctcctaagcaacttctgtttcctctgctctcccttcctgcaacctgcactcctgcttcctgcctggcactaccaactgtgggaaacccaagtaggtggcaccatagtggggggcaaaaggcaaagccttggttgggtagggggcataactccaggcctagttctgcaagccctgacactgaggcaggatgcttacagaggagacaaaaaagcaatgcagtgcctcgaataacaactggggtgcccccacactgccactgacaactgcccctcaataactagtacaccctagtctttctagcttctgggcactcctagaaaccagagcttccaaacccttcagttcacacaggccaggacttgctgagggcagggggcgggggaggaggtgagggttgctttcaggagtatctgttcttgctcccataatcttggagtggatcacaaaactgagtaagtgttgctatggttattaaagtcattccttttaaaaaagagcaaaacatggcagattttcttaacaacttgttcaaatggcaacagtcccgggttgtagctaattaagtgtgctaaagataaacacaagatcgcacattcctattaagattgtttgctcctggttcttttacacacacacacacaccactttgaacattcaggggaaataataaattcttatgcattcagcatgaggagtaaagaagaaaaatatattttccatagaaatcgccttacttcacctcctttaaattctacaacttggttcaggacaaataaagaggaaactactggaatgtgtgagcaggccccactagctctgaaggcagaggcctcagcaggaggtgagcagctgcagagaggctcaggcaggcggccctgggcagcctcatttctttattaacaccaccacctacagggactgctttgaataggatggtgtggtgtggcccataaagccttgcaagaaaaacaacattcagaacaattgcaccacatttttttttcaacttcctgtttattagtattttatctaagagcagaacaaaagtctgtataaatgggagaaaataaaacaaatgaatgcactgttaaggcctattcacaatgcacacatacaacaacttgtcaagtgcattatgtctttcaattgaacccacctccgaccttcaaatgtctctgatgacagagatcaagaggaaataaatggaatttgttattttataagaattatatataattaatttttaaaaaaataagtaaatgggcttgttttcggcacaactgtatgacagtattccttgccacactgtacaagtcaacatcttatcagtaagaattggtattttgctagaaatacgcatgaatataatgaaaatgcaaatgtccccctaatgtttggtgcagagcttgattgtgtaagaaaaggaagaaagtatgtggtcaaggtgtgggcaacctttgaggttctcagcctaagaggtggacaaagggctggtgacgcctccactggaatccttccagcgaagtcatgaggtcattacgaaattgttagtgatgtctgtgaactctgcttttcttccttaacctgcctgccatgttgttctttgggcttcttctctgcctacttttcgaaaggctcagggccaatgagatggaatgaatgagtggccatagggcttccagtgttgaccttgatggccacattttctcctgaaagcagcccgtacagtctgtttttgtggatacttgtgaatcaaagggctgggccttggcacagttccctaggacccttgctcttttttatctatggttataaataccactgagtctcatttattttgagtagttttaatgtcatgtttccctatttgagaaggacacctagacatttgggattatcaacttggggaattgcctaagattttttttctatgccctagtaatcaggaattttgttattatttactctccatatctcagtctcctatgacactagcacgtatggccttgtctaattattcctgatacctattacctcgttcacatgaaaataagaagtcagtaagaagaggcctcctcttgtttagcgtaacaagaaacatatctgcagatagagacagcataaatcaaagctgaaatgtgaacttagcactggtcaagaccagttaagctaatcagaaacagattgcaaatgctctagcagaacaaatactgtctttctaaatggctgaaagtgctgtgagggactaaaactgaacagaacaatcacaacaaacaacaaaggtcaccaaataataaagcagccatcatttgtgtgctggtagtaaacactgagaactcactgcatgtgtcttggacatgggagatgaagaaatgtggggttggttttgttttgccaaggggcattgattaaccctaaccagtagtcagatctaggaaggggacccttcctggagagaacgtctctatggaattcattttttattttttggtaatttttttaattgacaaaaactctattacatttactgtgtaacatgatgtttggaaataagcattaaggaatggctcaattgagctaattcacatatacttatcttttatggtgaagacaattaaaatttactctcaataatttcagaatacaatacattgctattaactagagtcacatgttgtacagtagatctcttaagtttatttcgcctatctatctgaacttttgtatcctttgaacaatatctccccattaccctacccctgccaatgcctggtaaccaccattcgactctctacttctgtaagttcaacttttttctatatcacgtataagtgagatcatgtgttgtttgtctttctgtgcctaatttatttcacttaacataatgtcctccaggttcatccatgttgttgcaaatgtcaggatttcctcattttaaaagctgaatagtattccattgtgtatatacgtgtgtgtgctgcatttctttatccactcatccactcatggacacttaggctggtgccctgtggcattcttgactggcaaacatagaggaagctttaaccactaacttctgctaagggaggaactgttccttgggcattagagtagacaaaacattttatcagcatcagaaagtattttggggccgggagcagtggctcacacctgtaatcccagcacttcgggaggctgaggcaggtggatcacgaggtcaggagatcgagaccatcctggctaacacagtgaaaccccgtctctactaaaaatacaaaaaaaaattagccgggtgtggtggcggacgcctgtagtcccagctacttggtaggctgaggcaagagaatcgcttgaacacgggaggcggaggttgtggtgagccgaggtcgcaccactgcattccagccagggcaacaagagcgaaactccgtctcaaaaaaaaaaaaaaaaaaaaagaaaagaaaagaaaaagaaagaaagcaagcatttttgaagccactcactgacttcactgataggatgcacagaataagtcagaaaggcaaagctcccgagtctgcttcacagaaaggaaatgtgcatgcacgaaataagaagtctttctcaaacacaaacaaacaaaaagcaactccctgtgctgataaggaaggagctagatgctgggaaccaggagctggggctgctgggaggacgggggaacaggcatgagggcaggtgtctgaataggaactgttctgccgccatctcacacaggggatggagtgatgggcatgatgcctaatttgcaaggggtgatcttgaaagccactgagatccctctcccaggaagcttacaaaaggaagagcgagtgtgacaaataagtgagaggtgtctacttgcaagtcaacaaatgcctcctttgcacaccaatatgcttaaatttagtgggtcacctatgtcactgagtaaaacctagtggacatcctagtgccccattagcaagcttcataactccaccctcaggacaggagtggagataatggcgggtaaattaatgagtacatcacagtcctttatccactgtgattggctcatgtgtaggcatgtgacctcggctggtccaatcagggcgaacctcataccttttacaggaatgctgtgacaaaagtttttcctgctggatttggacctgaaaggacaaatggcagccacctcgagatcatgagggttgagtttatttgagaatggggtcaaagcattaaaaactgggccaggaggagaagacagatctgaaatatctcgactccattttgagctgtatgtatgacgcccttttcctagattgttcacttacatgagatggtaaaactctggattttgcttaaaccactttgaattgagttttccgtcacttgtaaccaaaaaactctttttttttttttttttttttttttctgagacggggtctcgctctgtcacccaggctggagtgcggtggcgcgatctgggctcgctgcaagctccgcctcccgggttcacgccattctcctgcctcagcctcccgagtagctgggactacaggcccccaacaccacgcctggctaattttttgtatttttagtagagacggggtttcaccgtgttagccaggatggtctcgatctcctgacctcatgatcctcccacctcagcctcccaaagtgctgggattacaagcgtgagccaccacgcccggccaaccaaacaactcttaattaaatcagaaatgcctttgcaattatatactacccacccctaaagaagaaggtttttacaagtgtagacgactcctccttcatatcgccctcagtattatgcaacagtccatcccattgaactaaagtcacagaaacgtatataccaaaagatccaataaaatggagtgaaatgcagctctcttagtgcatctgctccttagcattctgagagatcctactcccagtgatactaccccaggctgtcaaggcgggtccctcagattgtcttttataattgcacaacaattataaggaatattaaaatggaagttaaagcatccagaaagaaaaccagattaaatgactgaaacaacagaggactaagtaatgacaagagatggcataatatcatcattaggcctccttccatttttaacgttatttctcattcagcttttttacaagacacaaatttctttaactcaaggaatttattttgcttcaggctcagtgttctttcctgcagaatctgaccaactaggatagaataatgcttgaagagctctggatttttatattataacaaataattatgtataggtttcttgacattactgatttctcactgaggttcagaatagctcagcatacataataaggggttttaagaggtgttcaccctgagtacacttagaaataacatccaacttggatcaaagtgtacttttttaaaaagttcttgatactataagctttgatttgcttcacagaaacacctctaactataagggcaactgctgaggtttgacagttcatctgccctgatctttcattcattcattcatcattgtgcagcactgagtttaaataaaaagagccatgttattgggcttagaatttaacgtgaaacccccatccatgcaagctaagggccaaggaaggaatgccagctagcctcctacaggcagtggctgaagagctgaaaaaacctagtggccaagtcaggccacggagttcgttgagcctctgctgcccatgggcctccccgttcctggcatcctgggtcaatggatggattctgactgtggaggcccccagttcagcctcttttcatacccctgggggttatctgcagtgctgcagccccttggtgggagcctccttcttgcactggggacaccctggtccccctaaaatcccacataccctgtggaactccaggggggggattctgaattccttagacaccagctcgttcactctcattttacaggtgaagggagctactctctgtccaagcagatcagggcctccatgggcttgcctcccaggcagaattccaatttcctggtccatcagaggtcctcacctgctcctctaggagagaaccctgatataaaagggaggaaagattcccctccatgtttccagtgctcattggttatcactagccacagtcaagccttcttatgactcccagtcccatctgacttgctcagagctctggagcctaacatcccagtcttcctgaaacactgcttaagccatgggattttcctgctcgaggacccacagagctccctactggctccaacacagagttgacattctttgcccaggctgagaaagacctctgtggtttgctcctaccctaagtatgcaacatttccctcttctcatgaatctctttgtgcttttattcaacaaaaatatgttgagcactggattattagtttgcttgagctactataacaaagtattagagactgacaacagaaatgtattgtctcacagctctgatggctggaagtctgagaccaagttgttggcagggtggtttcttctgaggcctccctctctccttggcttgtagatgaccacctacttgctatgttgtcacgtgggtcttccctctgtgtatgtctatatcctaatctcctttttttttctttttcttttattatactttaagttctagggtacatgtgcacaatgtgcaggtttgttacatatgtatacgtgtgccatgttggtgtgctcttaatctccttttataaggacaccagtcatattgaattagaggccacccatatgacctcattttaccttaattacctcttcagagaccctttctccaaatacggtcacattccaaggtactggagttggggtggcaccatacaaatttgggatgggacacaattcagcccttaacaagtcccaatatgatgccagggaatggggaagggaggagaaaaagggacatagaaggggacagagatggataaaacatggcctctgccctcagcagatgaaactctactgttcacacaggaggacggcgtgattttctccttgcccaccccagccccagctcctgcctctgttgggcagcctctgatgcttcacttcctcctctatctaatcagtctttcaaggcacagcctcattccctttctcaggagcacccccctactggcttacactccctgagtccctcctggacttccctcaagcgtatcacctcctccctgtgctatcctgaccaccctgtgaacttctccatggagcagctacctggatgtctagtgcaaggctgggcatggtagacatcaagccaatatttccttctcatgggataaaacatgtttctcctttctgctttctgtctgataaaagccagcaaacggcactgggggtgtctggttcctccaccacttgtctgcgtctttcagataaatattacctatttcatcgtgttctgaaatgcaaaacctttctagtatcagtaagtgaaatccccaatcagcataccatgatgaaatattcttctaagtctcatatttttactcactttacgcccagagttatgtgtgtgagaggtgacattttactgtgtgggacaggaatgccatcctcactgatgttaaccatgtcacactggaatgacatctcagaagacgagaaataaccaggggcctttaaaacttaatgcatcttgaggccgggcacagtggctcacgcctgtaatcccagcactttgggagaccgaggtgggtggatcacttgaggccaggagttcaagaccagactgaccgatatggtaaaaccccatctctactaaaaatacaaaaattagccaggcgtggtggtacacgcctgtagtcccagctattcgggaggctgaggcacgagaatcgcttgaacccgagaggcggaggttgcagtgagctgagattgcaccactgcactccagcctgggcaaccgagcaagactcttatctcaaaaaaaaaaaaaaaaaacttaacgtatcttgaaatgtaaacaaattatcttgttttacacttttcttttactgtcatcagcaataaatgccacctgatatgtgtattcaacactgtgccccagccctttcctgctgagctaaacatcagctcttaactttgaacatgccctagactcacacagacagaccctcagaggtcttctctgtgctcccagagtgctttgttcagagtctggtttagtggcatggtaattaagagtgtgcacattgggagctaactgtttgactttaagtctacctgctgtgtgactttggacaagttacataacctctctgggcctcatttttcctcaaagccaccaaaaaagtcactgaagggcattgggggcatctggttcccaatgtaaggatgaaataagataattcagataattaacctggcccagaagctggaactttttggcccccaggaaacacgagtgttaatattcacattacctttcccaactatctccccttccaaactgtgaacttccccaggacaagggcactattccttaggtgcctgggacataataatcacacagctaatgtttgtgggaaaaaaaaacacatgcaatgactcaattctacttttaaaactggcttttcctccttattttaaaatgtaacttgctcaccttagggccttaaaaaaatatgtaacaagaagagtaacacagaccaattaaaacttttaagttaactaaatgaaaccccccagctcctgtctttgggcttcatccataggttttcagggcaaacaccccacaaatgccaaacagatttgcacatgtgctaattatctacttttcactgtttcccataaaataaatactttcaaatgcaaagttgactgtgaaaagtatattaattatagagaatgaaaagcagtaccatgatgttcatcctgaggccaaatgaacaatgatcaaaacttctaactgaaaattcctggagaacaccttcatcggcagcatatgccatctccttgcagctctcccagccagcactaaagccagcctccaggctgtgaggctcaccttagcctgagtcaccatccctcacacttcctgagagtagttatgtttttattatccggtaattaaagataaaacatagtataaattgaattatgcatgtaaaagcatttgtattatttatatcacaagagtcccaatatcatagaatacataaatgctagagccacttgtgatttttgttatttacaaaggctgataggcaggtggatttcagcatccctgccaacatggtgggatctgaggctgccagggtgggaaccactcatcaaggagaacattccctgtgtctaccagcaaagatccaggccaactgctggctgaagagagagcaaaaagaaacaggctatgacgggcttctgctcttacaaccctataaggagtatatattttacactggaaaatctgatccttagagcaagccagtcctgtatcagcatatagtcctggtattgtccagaaaaaataaatcatcttgctacttagagacattagctagccaaacgcagtagaatctacaagatcacatagtattcaaattattattaaccaaaaatgccttgtagtactttaggggtacagagcaagcagagaaaaggtggtggtccatgaagtgccctttgtaacattcagagctgagctgtcccctgtaactgggcaccatccctgcactgctccttgggtgttgggctctgaaacactccagctgactcagaaaatgattctcggtgggggatggaaatcaggagctctttatttttgatttttttattttttttgagataagatctcactgtgtcacccaggctggagggcagcagtgccatcacagctcactgcaacctcgacctccctggcttaaaccatcctcccaacctcagcccccagagtagctggaattaccatgccaccacacctggctaatttgtgtgtgtgtgcacacacatgcgcgcgcgtgtgtgtgtacgcgcatgtgtgtgcgtggagatgaggtctcactatgttgcccaggccggtctcaaacttctgggctcaagcaatcatcccacttcgaccttccaaagtgctgggattacaggcgtgagccaccatgcctagctaagctctttagaaatgatttactcccattttttgaagtttgccatgtcacagaaaatgagaccccactgagagattcaaatgtgcgggaagaaagaacaatgtgtgcttcttcacagggggagagcagggagcctgcagcccgcctgagctgcaggtgcttcagctggtttcacacttgctgtccccagcccctgctcctggccagacgccggcctctgtgggcggcccggagggcaccgtgcgttggtgcaggccttcgtgggcagcagcgctgacgtttggaaacaaggccccacccacacaggctgggtttcagtttcaccagggagcaaacaccattatgcaaattattttccttgctcaactccccatcccccatcactggcttacatattcattcttcactctgaagttaatgtacacaagaggccaactaaggatttgcatcctatttactttaaaatgcccaggtgcaattttgaaacaagattctcctttcagaagggcaatcacgaatataaagtagagaattagtagcagtgtcaagagtaaagccccgaggctaataccaaacttctaacataaacggagtgttgaaaggcacatgccaggaattatataaaccgaaggaaaaagacaactggggggtgtgttcccatgcattcgatttggtccaaggagagccaggcccacggagagtggacagacagcctcgggccccttcaatcctcgctacacatgtcaagaatacctgggtctcatggggtttaggaaaacgaatgtctagttcacattcaggtcacgttctagaaattagggcatgaagtcattttatctgcattatgtgtgattcatttgcagtttaactcaagtgatttgaggtaccaactcaggcaaaaaaattctgaacccagaaacagtgttagtaaaatttgtagggggtggagggtgtgggatggggtgcacaaagctatgctttcctttcctgtcatgataaataaattcattagggatatgtttatatgaatttagacctgaataattccatgcagctgtaatcattattttatttatgagattcagataatcgtagtgaataattttgcggttgtttctaaagaggtcaagggtttctatcagcagacacacagaaggaaccatttttaggatggtaatttctatttccctcaaaaacattcttccttggtccccacttatactcagtttcatttttcaaggcggattgcaaggttcgtgtaaagctcacagctgcaatgaagtcactgacaaatctgtgaattaccctgagtgcaaagacaagctagttcatttataaacagcccttaaaataatagtaaactaaactgcaggtgggaaaccttcataagataaaaactcagacacactgtcccttcttggaaagccctggataagaagtaaacaatgccaacaagtcccttagtgacttgtcactccacttaaaatggcctttattaagagtgatgacctccgccttaactgtaagaccaaccaactcaaatgtaagtcaagaacaagaacatatttccttgcaggggattctgtgcaaactcatagatgatttgcacctctgtgaaaggtcatggctaggaggccaggttgaggaaacttgaacagctaaagtataccctggctgtctgctaactacctgcatcctaattacctgtctgctatcgctgtgtgacgtgcagagccatgagataggatctgtcttcatttacagatcataaaaaaacaaagctttagacaggttaagtagcttgcccaatgaaagcaatttcttctgacccttgtgcacaattatgtccacaggagaacaccatacacatatattgcccaacctttgaacaccatttactcaagaatggctttcctttccctgccatgcacaggcaggcttgtggttagccagtcctttctggtcagtgtggatatatctgctgggttcaggggtgtagggttagggatctcactgtttccgcacaccaaaactgttctccaacagctcagtcagtaaaaacagctgatatcggggcaggggtggagttcttggttcaggactcttctaatgtcctggactgcagaaaagcccttgcccttaccctggataaatacctgagaatccttgtctccttcccactctgtaggcactcttgtcctctccattcccttccttgcctcctgaggagcttctgtagccctgggctgatgtggggaagggagaagggtcccctgcacccctgggatgggaacatgaatgagtctgcccaccaacccctatgaaatatgcatacctgtgctcaaattatggggccatcagttctgctagtctcagagccccctagggagggcgacccagcttttactggacacccagggactttccctggaacctgctgttgtgagcgtttctgaggtgtagacaaacagctcccccacacacctagccaacaacccactctcaaggtgggaaacaccattctaaggactcgcattaacccatctgaataaccctgggtaatctggagcagaggtcgaaaccactgaatggctcaggtacggtagaaaatgcctctgattgattgttttggacatcgctgctattgcaacagagaaagatcaagccccatcacctagaagggatttcattctttgcaacaggaaagatagttcagaatccagcgccaattattcccagaaaaaaaataccatttgaaacattacaaatgaaattgagttatataaaccgccttcctcatcccttccaaggagggtggattctgcggatgtcaagggtgactgtggcagactggaagggtgggaaagagatcaaattagagaaaaccaagggaagagcaactgccagccacctaggaaaaaggagagaggcctaggtgacaggaccccaagttggagagaaagacacacagaggggtgagtcagaggaaagctacagaagggtgtgctggggacaggcgtcaagaggtgaggctgcctcagggagaggaagcacgggaggagacctggcccaggagagtttcagaggctccacccagcagcgtgcaatagtacctcctcccccaagaaatcaggattgtgcaggaaacactctcctacttctcagtggccactggagagctctgaacccagcccagggtcaactgcccggcactgtcaggcagttcctctgactccacagtacattctaattgcagtcactgtgagtacactggcaattatgcaccctgccccaaattcctaattgtagtaggaagttaaactggagcattttttttttaaattgctcaaacaagtctttaggaatttaaatgtatttatagaaacgtatgtaagtatgtttacatacatttctataaaaatattcttgtaagtaaatgttatttatatatactgcacatctaatgatgcaattggcttcatgactttagatattagagattagggagtttcttggtcaggacagtcaggaagaagggagagatgcttaaagacattggcagagctgcatggtagaagtctgatagaaagggcttgagtgaaacctggaaagacagttcattagggaaaaggtgcctgctgcctgttgggagccagtgcctcccacatagtggtgctcaatgcactgtggaactcaacagagccctggcaaagcacgctccgggactcacaaatctgaatgggttaaaagagaaatagaagaatttggtcgtgagagaaaacagaacttctagacttctattttatctacattttctgtccaagaaaaaaatattaatactgagaaggagactgtgttagtcagagttctccaaagaaacagaatcaattggatgtgtgtgtgtggggggggggggggtgggtgggtgggtgtgtgtgtgagagagagagagagagaagggcgaggagggtagtggagattgagttgtttaaggattaggttcccacaatggtaagggctggcaagtccaaaatccacagggcaggctggcaggcagagaccccaggagtccctgttgcagtttgggtcagctgacagaatccaatcttctttggggaggttcgtcattttcttttctttttttttttttttttttgagacggagtctcactctgtcacccaggctggagtgcagtggtgccatctcagctcactgcaagctccgcctcccgggttcacgccattctcctgcctcagcctccagagtagctgggactacaggcgcctgccaccatacctggctaattttttgtatttttagtagagacagggtttcaccatgttagtcaggaaggtctcaatctcctgacctcatgatccgcctgcctcagcctcccaaagcactgggattacaggcgtgagccaccgcgcccagcccatcattttctattaaggccttcaactgactggatgaggcccacccacattatgactctgctttgccaaaatctactgatttaaatgttaatctgctaaaaagtgccttcacagaaacatccaggataatgtttgaccaaatatctgggtaccatgccctagcaaagttggcacataaaactaaccatcacaaagagactgacattgtgtggggcaactgaagcccaggagagggtggagagtatgaaatggcatccaggtgatgagaactgagttctgtttctgcccagtgaccggcagtccagcagttgggagctgagctctaagaatcaccaccacaaacttctcaggagtccataagacaccagcaattctggtggcttaaagggctagaaggtggctccgtaaaccctgaaccttgtatttacctttgacaagattctaagatagattgccacaaacatgctttagaaaaccttaggaaaggggccgggcgcagtggctcacacctgtaatcccagcactttgggaggctgaggcgggtggatcatctgaggtcaggagttcaaaatcagcctggccaacatggtgaaatcctgtctctactaaaaatacaaaactagccaggtgtggtgacaggtgcctgtaatcccagctactcgggaggctgaggcaggagaatcgcttgaacctgggaggcagaggttgcagtaagctgagatagcaccattgcactccagcctgggtgacagagcaagactccatctcaaaaaaaaaaaaaaaaccaaaaaggtaggtagtagtaggttatgtacttttgggtacaaaacaaaacaaaacaaaacaaaacaaagaaacaaacaaaaaaaaacccacctaacttcataagtgtaaaatatgagacttttatgtgtgtgtgtgtatgtgtgtgtgtgtgtgtgtgtgtgtgtatttggtttgtttttttgttttgttttgttttttgtttttgagacagggtctccctctgtcacccagcttggagtacaacggcgccatcttggctcactgtaacctctgcctcccaggctcagtgatcctctcacctcagactcctgagtagctgggacaacaggtgtgcaccaccacacctggctaagacttttgtgttttgtagcagaaattaatggggaaaaatgttatggaattccgtcattaacagaagtgtattgtagccaccagccaagcaaagggctccaaggtgcactaatagggtcttatagggtgggaggaggtggcccctttctgctctgggctgatcaaacctcacctgaagcaccttacttcattctcaggtctacagttttagcaggacagaggcagcttagaatcttcaggggagagtgagagacagtgagggaacttgttaggtgtgaggtggtcaaaggaaccctggaccttggaatatcttggtggaatgtgaaaggaggtagacagattgaaccattttgtaccgagggatgcagacggaggttggaatgtggatggaggctggcaagtttccaatatacaaactgttcaatgaagaccaaatgttcaagccatcaaaagaaggccggggctgctggatcactggggacatcacagaagagtcaagaggttttcaggggctgcaggagatggttgctgggtcctccgtaactttgggcgtgagtctaggaaaggaataatagctttgcagaatgctacagcaagtgcagaagagtaaaaaaccacgaagctgatgttttctgcacacctcgtctgtgccttactctgtgttgtgtcccacagttaacactagcagcagcctctgagacaggcattatggttacctccatcctacagatgaagacattgaggcttagggatgcaaactgaattgcccaaagttacatgaccagtaagtggtaggctagttcaaaccctgatctctgggactccagtgacaaaagaaccagtagtctcaggggaaaggccaagtgggttgtatttaccaccataaaaccaaaaaaaagtctgaaagagagacctaagtttttcgtttagatagtttttatctccacttggtctcaccttagtaaatttcacatgaatagaacatgtgggtggaattacgatcaaaaattatgaaataaggctgggcgcggtaggctcacgcctgtaatcccagcactttgggaggcctaggcgagtggatcgcctgagatcaggagttcgagaccaacctggccaacatggtgaaaccccgtctctactgaaaatacaaaaattagccaggcatgacggtgcatgcctgtaatcccagctactctggaggctgagacaggagaatcgcttgaacccaggaggcagaggtagcagtgaatctagatcacaccactgtactccagcctgggcaacagagtgagactccatctcaaaaaaaaagaaaaaaaaaaaaaaaaaatatatatatatatatatatatatatatatatatatatatgtaacaaaaaacataaatccaaggcagaactcaggccaaaataccaccaaagacagccaaccctttggaggatgagcgtatacaatttagtctgaaaggtgcatgggaaaaaagccacagaaggtgggccagatggatatcttctggtgataatgtcagagccacaggttgaaccagaagcccaagcctgggagaatgaagtatgtctacagaatgactaggtctcagtaaggagggccaaaactggcctagccgactccaagggctctgactgaggtgtcagaggtacagacaggtgaggctgcccttatgatgggaatgttggatcctgcccacaaaactgggagctcccttgttcccaaagcaggagaatcacattccacatacttgcaattgttgactactggtcagaatcgttgaaaacaaaaagtgtattgtttgaaaccaaaaatagatttgatgcacctgctagcaaaatactaaatttttgtagctgccagatgtaaagcacagaatcagcaatgaagaatgcaaaggggagcatactgtgtctctataattgagcatgatgacaataattggccagacatttcacatttcacctaaccacttgctgcacaatttatccatgggtgaaataaatggaagtgggtctttttgttttattttattttttaagtaacacagtcttgctttgttgcccaggctggagggcagtggcatgatcatagctcactgtaacctcaaacttctgggctcaagcgaccctcccacctcagtcccccaagcagctaggactacaggtgtgcaccactgtatctggccaagtttgtgtgtgtgtgtatttttttttatagatagagtctggctatgttgcccaggctggtctcaaactcctgggctcaagtgatcctcccacagtgctgggattataggcatgagccactgcgtccagcccagaaatgggtattttaaacgtattacgaaaaacaaattgttatgggtggagatgtgtcccctgcaaattcatatgttgaaatcttaacctctagcaccccagaatgtgactgtatttggacatatggcctttaaagaagtaaagtaaaatgagataattactttaggccctaatccaatttgactggccctactaggaaatggaaatcaggacacagacatgagcacatacagagaaaagactgtgccaggagcaagctgccatctgcaagccaaggagagagctctcagaaaaaaacgatcttgccgacaccttccttttgcacttccagcctccaggactgtaagaaaagaaatttctgttgtttaagccaccaagtagtatttcgttatagcagtccaagcaaactaatgcacatatcaaaactactttagtttttccactttgttgcaaacaattgcaaggtgtccaggttttctgtcttcccccagcctgcaagtgctcagaggacacccaaccctatgatctcagccaactcatgaagtttgatttcacaacttagtgatgtcttcccagtggaatcctaaatgataaggaaaatggtatagagccaagacttgaacattaacaacccaggagcacagaaacagcacagttagctgagaggcgttatggagagaagcaactgaatgcacactgagcgctgtgagaagtccacgacagtggggaacagcgcccaccgtcacaaaaagaaagaccctcggcaggtactttagagtcacgttcatgctgtaatatgtggggaagaaagactattccaaatggatctggctctttaaaacaagggaattttccttgctcttgggaaccagcaaaatccagctgctcattgaactgcctgtctggaatctcacaaatttgcaccttgaagttgttaataaaggactaagttgataattcaaacaaaccctgtggtttggaagtcactgtttttctgcttagcgttcgactttcaagctcttcttttggaatagctcttcagggcattctatggatgtgtaataaaccgacaaattccttgtgagaagttttagaaactgtcaggtgaaatgagccaggtgcgagggcccagatggctcaaagctgaagcaatgagggctcttttcactgtagcttctaaatgggctcccagggtacacccccacacaccaaaaattttcagccatgttttggtagaagagtgtgtcatcctgagggtggtaccacgagggaccacatcatttgcatatttatgtcacagcaggcctgatccacacaaactcctgtcgcttaccgagttgtgcacctttacctccatgtgctcactgggcagctggaagacacacagtgaacctcttgtgctctcagccttggtttgctgacctccatgcctttgcacatgctgacccccgctccacacacccggaccaccactgcacatccaaacccacctgcctctcagggccttgtccaaatgctgcctccttcatgagcacccatagtgagtccaaggcaagtccctgtccctccctaaactccaggtcacgtcaccccaagtcatcttcatcaatttcccttccttttttatatccccattgcttagatcttgcttttatggcatggctgtaagtggtttccactgggatgcctttctagttcacctctgtgtcctcatcaattcggcgctgaattatatacctgtgattttttttcacttcctttcaatgtcattactttctaattgcaaagcagaaacattcctagtagtatattccaaagcacactgtcatttggtgttctttataatgtacagtgactatcacgtttgcccttccaagccctaaaatctttccactcatctcttctgcttatatgccttgatgcaagaggggttaaagtttcatgcataaaatgtctgcactagagggcacactagagcatgtccatgcataaatgtgaacacatataaatgtgtgcatgggatgaggcaagaagacggggatagtagagagaacagaggctggctgaatctcctcaggagatgatctggaggagctgcatttaatccaaacataaagccttggtctaggaagtgatcttcttcaaaggctcttagtctcgtgcatgaacatgaagcagcagaacctgtgacttccaaaccacagggccgtttaaattatctcctgttcctttattaacaatgtcagcatgcaaatttgtgagatttcaggacatacaattcagggagtagtggaatttgtgggtaccaaatagcaagaagtttccttgttttaaaagaaccagatcaactggaatattctttattaattatatattacctaatactatctgggagtgcagctattgaccagcgatggcaagctgtccatcacgggcagtgaaagggcctggctgggccgcctgtttctccatggctgccagagacattggccctggtcacttacacgatctccacgtgtatagcccagcagaggagctggccacactgcagtggctgcaggagcatgcaggtgtctccatttgttattggtggctacttagccaacatatacttgggggaaggagggggagtcccccagaggtgcttcaccaattccgtaataacagttctgctctgtaacactcttaatgcttgggcgagagaaactgctgccaccccatgcccaccttcacacgtgtcacgtttttctggcccatctgcacaggcaggggcccaggtgttgccatctgttctgaattctcaaaatgtcagtgtaatatgggcagcctagagtttcacaattcagccagttattcaccctgccacgtctgtcttgattgtggctctcatgtgtccattctgctgctgcctcccacaagccaggtcctttccttccaggccacaccaagatccatgctgaaagtgacttctaggagggctacaaatctccagtgtttcttcacttcaattcttcccaccaagtcattattctaaagctgcacattgatcattccatactttgctcaaaaactctaagcagcacacacacacatgtgcacagacacacagacacacacacacacacacacacacacacacacacgcccctgcaggtggaagacccaacccaacactgtgatctgacagttgggactctacacacatgtccccagcctcctgctccaccgcagcttgcctgagccagtgagcccagatgtgccacaggcacctgcactccgcctctgaccatgccactcctccatttgtaattattttcccattttaaaaatttcaatccaatgtcacttatcttctgcctatagtaatttattgcttctaatcttctacaatattcatatgttttgtcctcaaaacatttgtgttttttggaagcctggtcccatgaaattctctaagaaaaaaacagaaagttccaccatcatctacatttaacatataccacaaatgttatgctgtttcacatattttcaaaacacatatttggatatttaaaatgcacgaccaaaggctctgagaagtcttgcagatttttagaaaaagatgtttctcttgggtcaacctggcttttcccatgctatatttatttgactgtacaccctttggggacacagtatttataatggtctcctccactcactggcaccccctgacctccagtgctccctttacaggcatcaccacattacaaacaactgacccacaggtcacctgaacataaaaacagtacagaggaagtgatagcaaactttctgctccttatggggcaactgcagctggatgtgctgggtatttcatctctgaagccatcatgttggttgagctcccagattctgtaagctctgacctcagtgagctcaccttggctggagcctgatctgtacaatccaggacttgtttgggagctgtgggtttaggagagtttgggtgggaacatgggtgggatgggcatcatggccccctggtgctttctttacaactagacagtaagtttctcccaggtagggtgcttctttgcattattggcctgagcctaaggtcctcacagtgatagaaatgcacctctgattattctctctgagtccctgaatgctgagaccaggctgatacccagtacagggaggaccctaaggttgcaggatatgagtggtgagagaagaaccctggagaaactcagtttctcaatcccaagagatcccagggatgggtggataaattggaaaggctgcccaacagccccactccacagagcatgccttaaattaagacagagtgttctcctgcaactagtccttcatggcccctgacctcttagttctgggaaccaagtggaataagtgtcatcagtctggtggagcaggcaggcctcctgctggcagcctgccctctctgtggacccttccaggacagagaacacagcccaagcacagcaagccatggggctggaggctccatggtatcagaatctcatcacatattctatccttgacccttcatttctttaagttgctttgaagccacatttcatatatcaggacctgctgtttacataaagcagtggtggagagtcccattcatcaaaggcaactgcatgtcatttggcgctggccctgccttgtggcagaggccccctagagacctatgctaggtgactagaagcatcttctgggctcagcaggaaaggggctaaggcccaccaatacccagacctgcatgtccagagacagtgtcaaatttgacctgaaatattaagagtttaatgccttcttgttttacagttttaaaggggcaatttctgacattcttgtttttaataaaaaggaagagaaaagcacagagttttaaattatgtaattacaaagcggtgcaaaatgaacatgtgcggcctttgttcaaaagccattaagaattttaagatggtaacagcagggcattaaaccaagccaggcccttctgcgcaggggaggccctaagcgactgcacagcgcgcacacctgtgaggccggccgagcagatatcaacatcggccacgggtccgacagggagagtgccagggacttcatggtctcactgtaaggcctgcaaggtggcaagacagaagtacagcatcctggaaagacttccttgaaaagaggctctcagcccagccctcggtgccctcccagattcccacgctcttggggtttgggccgacttggcagcctctaatcgtttgatttgactcaagcgccacacttggtgggttcagtctccttcttgtaggttgtgtccattcctactcttgagattattttcatcaatctgttttgtttttggccccaatcaggcctattttttatttgggttgcttgtctacatttcacactcaaggtcaaactttctcaatatgcagatactaaaacgtgattctccgggggccctgcctggcctggcctggcctgtgctcagccctggttgtctgtctttccctgagctgaccacaccctggatccatttatgccgaggctctctgaagctcacctcctgaaatctctcggctgctccggccccagtggccctccactgcgttcactgtccgctggttcccgttatcaggtcctgactccttcctgtttctggcccatattctctaaaagctctgagctccattcctctgcctctttgccctgaagtcacatgggagacggaaagacacagacgttgtgtcaaagctctacccaatcccacattccaactggaaactgcccatttgacacctccccaacacataaaacttatcaacttaaatatcataatttcagcaggaaaaaagtgaatgacttaataaatagtctgggaaaatttgctacacatttagggtaaaatgaaactcccttacttcaaattataaacaaaaataagttctacttgacttgacattttaaaccaaaaataaaattactaagtatcagaagaaaaaaatctgaggatatttttcgaatctaggggtaggaacagactttctaagcaagacaaaacctgggtgttaaaaggaaaataataactacttaaaagttaaatagttccataatataaacgacacagtaaagaaagttaagacaggttgagagaaagtatttgcagcatatatatcaaagtcttaaaatccaggatattagaaaagttcccccagaacaacaataaaaaaaaggaagaaaaggagaaggaagaaaggaacgaagggagggagggaggggaaagggaagagacagagggaataaaggagggagggaggggaaaagagggcaaaaaatataaggaggcaatttataaaagagcaataggtcttcttaaaccaatcttccccagagcaaatatatataaaatcagtatttctggaggctgagcttaatcctttactttttttcagtgcttagctacaattttattggatttttaccataaaactaactcttcagcaaagagggcacattttaaatagaccttctaaatgcagagttcttctgagttatgaatgactgcaaggtagcatgactacaaaaattgttctaaacaacattattctaaattattctgcatgattattatattattctaacaactatattattccaaattttaaaggagattaattatgggagagatggtttacgcaattaccaaatacacagagaggacaggattgggaggaaatatgcctgattgggaacagtgggtaactctagtggtaggaatgtcggtggtgagttttattttcttccttgtcttttcttctaaacccctgcacctggcatcaagacaggcagtgccacctgggcaccagcagagccctcctctgtcctggggcagccgaccctcaggggcacctctgctcccagggtgtctttcacctggggcttttatattttcttcagatattgccttaaagaaacatgctattcatatcctacagacattttttttacatggtttttgcgttgcttcaaataatgtcctcaattttacaataagaggattatttaaaattttaaaagctgacactcgtagcaaactactgtgacctgtggtgcctgcatcccctgcccggccactaggttgtcccggttagagtccaaatgccccccagctgcctgctcacatttctgaggtgggcagggatccatgggccgctctttggcccactcccgtgcacgtgggatgtccacagctgggacacctgtgcgtgggcacccgccctgcaggtcgcctccagatctgagtcctcactcctccgcctcttgactttgaagtcaaggtttcactctcttgacgaatactcactgcttaaggctacccttgctactaaaataactttccatgaaatactctgaaagaagcttcttgactgtaaatgccattatattatcagaaatgccatgtttgtgtgcggttatgtcttgtgtaactgactccaccggattttcgaggtgaagattgctcgtttttgtcatttccaaaacccaacattctttcactataatgtggcaacttctcagttctttaaactatttttttctttaagttcttatgaattgatggttcctgtttttctgaactgtgtgttgaacccgtgcttctgctaggttcagagtcacctttgttcaataactagcaaatgaggcaaaaaggtctcacataaaatgtgactttgtggccacttgggagcctccatctcctctctttgtaaattttaatttgaagagacgagtgtgaacctcaaaggagggaaagggagcgggaaaatggcaatgtgggtgaaagttccatgttcgggcgaggttctctgtgtgaggtgagactgtactgtcctgctcacatgggaaccatggctcggccgccaacctcgcatggagtacagggacccacacagagacacactctgtagcccaccagagcacggatcccatcccatataaagatgaaatgagtctttttgtttttttctttttagcacatgtaaagaccaaatttttcttttgaacctcgattttcttttgaaccttgatttaacttttaggaaaagtgaaaacaaaaggagaatattgtattcacccaaataaaaaatgatttcctgcgtccaggttgactgctcatccattagcagcagatgtctctcgagtagctgaaccacaccaagctggacctgggacttgaggagcccccttcaacctctgccaggacgcacgctggattagcatctgctagggctgccgtaagaaagtaccaaaaaataagtggcttaaacaataaaatattgtctcacagttctgaaggctggaagtctgagatcacagtgcccactgggccaggctacctccaaagggaaggctatgttccagcctctctctcggcttctggtggtgtagctgtttaagtccagtcttcacatggtgcactccctgagtgtgtgtctgtcttgaaatttccccttcttataaggacaccagtgatatgggatcaggggcccacccgactccagcatgacctcatttgaactaattacatcggcaatggcactatttccaaataaggtcacgtctgagctgccaggggcaaggacgtccacatgtgaattttgggagacacaagtcaacccatcacacacagaggccctaaaggatgaatcacacacgtctggactcctactcactttcttagtcgtgtcttctaccagtcctctttccccaaactcattcccctgaaagcaagttgccttcccactaagaacagaccatttgctttctttcccttcagtgtcagtgtctatgctaaggagaaggttgtttaaaaagcagctcaaaatccaccagactcctcaggaagtgcctctcagggaggcctctagacggggctgctgtgcctcagtagcctcagtaaagacctccctccagctgccctgtgtctcctgactcccgggctttgtgattctaacctcatgggtgatctgagggtaaaccccaggaagtcctgtaggtcccagggctgttcctgtgaggacagctgtcccctgcacgcgcgtggggtgccgtgtgctcctgaggagccggctggggcaggcagggcccagtgacacctgggctggaactgtggctcccccacttgtttgctggctctgcttcctctttaagaaacgaggatgatcatgtagggttcctaagggggttaaagtgtgtgaactccttagaggcgcacgtagcccagaggagaaacataagtcagcctcagctcctcacggtgccttcggccacagacagcatttgccttcaccaggcttctttttaaaacaattcttgacttggaaagggtccttgggaaaaattaaaatttttaaaataaataaataaaatctgaggttaattcttttgaagatccaatctccatttcctcatccatctgttttgtaaatacaatctggtgtccaggcgactctgagggactgggaccctcctgaatcacacagcgtccaagtcactcactgctctcatttctggctatcagattgttccccgggggaatggagtctccgcccctgggagctcagttcgaaaccacggctgaccgtgaggatggcgactccccactcggaccccctgaggatggcgacttcccgctggggccccctgagactttgctggggctggaagaccacacacagtgcattccctgaaggccagggcctacccatccacccatccatccacacttcccctggggttgcctggataagctcagggccccacccacccaacaggggaggaggggagacccagccagccctcctggagccctgacatttacagctgcaaaggtaggcagctgcgctcaaacacacaagccaggcctctcaacacaagaaggggtttaacattaaagaatacattatgaggctgaggcaggcagattgcttgtgtccaggagattgagaccagcctgggcaacacagcaaaaccctgtccctacaaaaaatagaaaaattagccaggtctggtgatgcatgcttgtagtcccagcaactcagaaggctgagatgggaggatcaactgagcctggggaggtcgaggctgcagtgaaccgtgatggtgtcactgcactccagcctgggcaacagagtgagaccctgtctcaaacaaaacaaaacaaaaaaaaacccattttgatagattttgtggaaaataaggaagaaaagaaaaaggcccattcttttttgcttatactgtatttgcaaaggacatataagaaactaagaaaagggttacggagggaactggatgggagatggggatgggtgtgtgtttttcactggatacctttttatacaatttcatttttgaatcctattcagaaaaattaaagctggaaattctattccctcatttaccacgtttacagggtgaaagagaaattctgtatcctcatcccaagagatgctgaaaagcatccgtggaaggttggcaccacctgtcatgagcgcctttttccagatgagagttccccaggactcatcgcagagcttccggctggactccctgaggccatggagaattgccagggtaggggttacagagaaagatgccctcccttggaaataatttgtttgaaggctcctaatctgcatgtggtcttggcaaataggatccagcaaacctggatgtgtgcaagccattggagattcgtggtttcttggatgaagctgggaattccacctctgcctcaagctgtgcaccctcaaactctcaaaagcctcagtttactcatctgcaacatgagttaagagtgcccaacccccataggatgggaatgatcatgttaaaagacatacattctccaatctctactgcttccaggaggcccttcagaataacattgattcactacacacagtgtaagcagcatggctgatctctcgtaagtcctgcatgaggtagcaattagaacctcaaacatgagaatcaaagagtgccacttttgcagcagtagaagactaagaaattgtaataatcctttgaatcagtttgctcagattactcccagattactctgggacttttctgacatatgaagaacaatttctatttcaatagggtgtccattgcctgccactaacttttcattttcacagagaatggctgaaattagaatggagagattctgataattctggcaagcagagggcagatgggggtgaggatgtgcggacaggggctgtgttactctaaacggcagggaaggacttggggacagcatttgttcccctctccagtgacattcctgttttgttcaagtgcccctctgatgaacccagtgggtgaacacagagcaggtgacacacactttggacaggtgagacagtcacgggtgagtcacctccttaccaggaacctctggtgtgcagtcacctttcctgcggctgggtggcagtctgtactcattctgtgccttacctcttccctcccgagcatgactctgagcaggcacttctggggacttcaaagagactgtcacatgcagatgagatgagccatgtgcctttcaggcccagctcagcagggccagcttgaaaggcatatctgaattgaatcaaatgcatccaccccacaaactgaggatgtgattatgtgtaaacaatgaaaatgacaatcattgacagcccagcgtttaaatgctctggatgttggaggtaacttacagccagtatctaattcacagctgccccgaagttagctaacctcgccaaaagctccctgtgcttgaggatggaggaaagagagagcagcagagaaggatgggtatccatcaagacaaggctggctgagtgtctaaatcatccccacatgctccatttgtctgtgggatcactatcacagatttgatcacatgatacatttcataaccccctttacccccatcagtgaaacttgtgcagcaaggggagctatttgtgttcaatgcagtgcccgagagcactgggatagtggcaacagtgaagacaatcgctagtggatgtcacaggtctctgctcttggtcttcactgatccaagtggtcttctggtgaagatgtaaaggggataccactccaagttatagatgacatgaagcttcatgttttatattagagaatacatgggctaaatctaaaagacaacaccagcgataatgcaaagttctacttaggttaaaaaaaaagtttttttttaaaaagtcaccacctcatattcagaatgatcccagcactttgagaggcagaggtgggaggatcactggaggacaggagtttgagaccagcctggacaacacagtgagacgctcgtctctaccaaaaaaaagattttaaaattagccaggcatggtgccacatgcctgtagtcccagctcttcaggaggctgaggtcaagggtcacttgagctcagaagttcaaggctgcagtgagctatgattgcttcactgtactccagcctgagtgacagagtgagatcttgtctctaaaagatatatatatatatacacacacacacacagaattagagagatgtggctttgcagcacgttcccacacagagaggcagggaggtcagctggctgtcagtgcagtgcccaggtccaacagataggtatggttgccaaaaaccagacaaaggaggtcactgtgcccacctgaagtgggacattggaaagttgccaagtagatgctgtggaaggcagcacaagatcaagggtagctgaacacctcagcacataaagaatctttccaggaatcatgagaagaaggaagagcttgaacagaagtggtgaggtccgcctgtaatcccagcactttgggaggccgaggcgggcggatcacgaggtcaggagatcaagaccatcccggctaaaaagggtgaaatcccgtctctactaaaaatacaaaaaattagccgggcgtagtggcgggcgcctgtagtcccagctacttgggaggctgaggcaggagaatggcgtgaacccgggaggcggagcttgcattgagccgagatcccgccactgcactccagccagggcgacagagcgagactccgtctcaaaaaaaaaaaaaaaaaaaaaaaaaaaaagaagaagtggtgaggtccatgcagtcggaagggctttggtgtggaaggagctggggctcatgcaataattcagcagtttctgggacaggatatgtgctcaaggtatatgaatgggcatgttgagttatgaccatccttcccatcgtggctatgcttatatgacttcgggggcaaagctaggtccaaaatatggatgtgccagagaataggctttggataatttatagaacgtcttctcagctggcgctttgcagtgatgcgctgggctgcctctttgggagggaaagggcttatggattagacagccctctgagggctcacagagaggggcttctatggtgggaagtgcccttcacactgagaatcgtgattccaaatgaagggtgtctaagtaatgatgatgactccatgttggatggttaagcatctgccactgtgggtcacctcgcccatgtatcagggaggatcaaagaggaccctcgatcatggccacacagctagcaagaggaaggcaggactggcccagggattctgattccacatcaacagagtttttaacatccccagagtgtccctgattccctcttcatgacgctgcactagctgccatattcatacagggaagcacaccagcacctgcatctcccctactaacagccctcctcacaaccgcactgcttctcagctgccctgactggtctcaattaacattcattgaataatgagtaaataactaaacggatggacaattgaacctcttcccttagatgtccagcactctacacctaatgctgcccctgggtgtcagcaaatgaaacctggaggcaggattgtggtactcctccaatgccagagttggaggagagagatcattgctggaatggagatctggggcccagagaacagctcctacagtcaggagtaaatggcaaaaagccactaattccaatctaaatagctaatgctattgaatacctactatgtgcagcactttcctaagaatttttcatgcaagaactctttgcatcctcagaacaactctctgtggtaattgttcctctatttctagtttacgggtgaggaaactgaggtcagtaggtgttaagtaacttgctatgcatgcattaagtagctggttgagctgaggctcagccctggcagtggcttcatcattgtgccttgtgagcccctccaaggtcacatggtccagcaaactacagcaaactggggagtagccaggagtaaaatcatgtggggaacttgaggggtgacttcaggggaggaacagccccatgtctcagtctgtgatcccacacacagaaggacatcatttgtgctcaaggtaacttgagcaggcagggcatgggagagaaaagaggctcaggcctggggccctgggtctgctcatctccgcacaacttgtatgtttcttgtcaattgtgcctgaacatactgtaaagcttctcccttaaaaagccaaaagagtaaagtttgagggatttgtaggacactaacaagaaccaaacctgaggcttatttatgccagtctaactattaatagttcctggaatggctttacacaaacaagaataaggctgtctatccccacgcaggaaagttcatgtgcaaataccacaaggctggacagtccggctgcatgtgccctgcacctgaggcccccagcccaagggaaccctcaggacaaacagcagagaagctctgggtgccagggcatcctcctcgacaggccccctaccctggcatgggcacgtgaggcctgagagcccactggaggtggagacattgaggcttccactagtggccactcatggcagaggccagggaccccaacctgactagccactgctcgtagcccaggggctgtgcaccttggaggggtcaccagcccctctgaagacctgccgagtgccaccgcagggctcaattcaggccctccacctcatcagagtgacggctcatctttcaaggctcccagatcaggagtctgtgttccacatgtgtgctgtccaacctggtagccacatgcagttgtgggcatttaaattaaaattaactgaaattagataaaactttcaatccagttcctagtcacagtagccacatttcagttgcttaggagccacatgtgacttgtggccgctgctttgaccagcacagatacagaacttttccatccttgcagaaggttctatcagacagtgctgcactagagagtttgggaagccaccttgtgacttccccgggtcctcggagagttttctgtttctgcctcctctgctgtcgctgctgtctcttggccttcagactgagacaggaggcccaggctgggagaggcccagcagcagctagcagcaagcaggacaaggcccacagagggtgccctatcaatcagacattgctgggtgcatttgccgagactgggagctcacacagtggccatgagagcagcgacacatttccagcagcggagcctacagttagaggacagatcacgagaggtgtggggtccaccccaactggagcaggccctgagcagctcccagagccccccacacactgagactgcaggtgtcgaagttgcaatggtagcagccactgcagacaatggatgctcccccccaggtttcctggcatcacctaagcccaagtttgtttgatgacatctggagcattatgacaagaaaggatccccaataatgacagaatttgaatctcccaataaccaggcagagagggtgaggtagggcagggcgatcttggagcagatttaatataatttagagatttctagagtaaaggtacgtcacattttgataccttggcattatagactggaattcatacccgttaaacaaataattgagccagtatggagaattattacatggggaataaggaggctgaaattaaaacagggacaggacagagaatcctgttctgaaaatcctgcttgtcatttccaaagctcgagtgagcattgaggatgtcgggctcatcaacagtacatgaaaccaagcctgcctgccttcctcagaggcaagagttaggtccacatttcctggcacgcagctctgggtaattcacaattccgaagctgcccctagagagaccagcctatgttggccagggcaagtccttctgtgattgctctctgccctcttggggcctacatgtccactgggcatgctgggcacagtgcatggggcccatgatactgttaggggcctgcacaagtgttttaattttgatttattttaaaatcagaggaaaaccacaaataaacgaaaatgaatgtataataatgaatcagcctgaatgacatttatctttctgccagagcagtcacactctgctttttcataagaaagtggtctgcaaagaccaaagcacctggggtccctgggcatcaccatgaggccatgacccttgccccctataccagagacctgaaaggcagctccacacagaagtgaccctgacaccctgaaaaatactcctacaggttgaatttcagctggaatatttttcccacctccctctgcatccggctccaaaaatagtcaaatctccaggcaggcaaaatagctggtcacccaaagacctgtgaccatctgcctgctctgccatccttagcactggtttctttcctccacattgtcttatggcttcatgaaggctgttggagctccagccatcacgtctgcattccagacagggggaaggagagaattcaggtgcaaaatgctaagcctattacatgtcagtctcctttagagagcttttctagaatccctagctaaccctttcagcctatatctttcattggccaccgtatctgtaaaggagactaggaaatatcgttttttaactgggcacactgttgtccctaacaacatggacttgtggttgacaacagaggaagcagaagagaatgcatactggaagtctctacaacagagtgctgaagacaaccagcttgatattgtatagtactctctcctgtgagtgggcctggggacaaatcatttaacttctctgtaaccagggtctacttgatgaagtaacctcattgcccacaccagaagcatcaggaagggtaccaaggagatggtagcttcaaggactttggaccacttggaggagggtattcaaagggacagaagtcacttgcttgattcttgtattaaaatcaagtgggatttcttttcattcatgcatttcaccagtacttatcacgtatccaataaagcaacaaggacaatccaaacactgttctgttgcctgagggctgacttggggccaggcactgttccggatcctttgcacatgtggcctcacttagtcctcagaaccatatgtggcagagtctaccattatcatccccatcattcagatgtggaattgggacaaagaggggttaaggatgatgcccggggtcacactgttaatacacaaaggagcctagctttgaacaaacagcctagctcttagaccccaaggaggtggtagcgaattggcagacaaggtctcacctttttttgtctttctagtgaaacacatataagcccaattatgtaaggccatcataaatttcccccaggagactggcacagggagatgggggctactctcaccttctgcagcacacaccaagaatctctgctgtgcttgggttcatgactcaccccttccctcaaagccagctcttcctgagtcaggaccatgtcctttgagtcctgaggtgcagcaaggaaactgtccagacttggcttcaaaagccaggctactttccagcaaagagccaaatggctggttgcttagaatttttagaacaggttcatctccaaggacatggagtctattcacataaatcaacctgatcaaaggccagagaagctaaaactgtcacatacccattatctactggcataatcaaggccaaagggattcataaggaggcggtgggttttggagggagagtgcttgctgctatttcaccttggacctgagtcccctcttgtgtgccccttgctctgcatcatctcagggccttgcctcactcctccatcttcctcctccagctcctttacagatagggtggccagtgaaagactaggctgaaagggttagctgggaattcaaggaaaggcctgcagaggagtctgacatctaggaggctttgccttttgccccccacttccttcctctcttctgtctggaatgcagaagtgatggcaggagctccagcagccttcttgaagcataagataacttggaggaaggaagccagtgctaaggatggcggagtaggcagatggatgaactggctgcctgttgacccttgtcccagaaaacctgcttcctgtttgaggacggaacagaaagagcaatagaatcctttttctgtgcaagagaaattaagcctgactcttttcggagcccttgctattttatacattttcccttgtatctagctgaattgatagaaacttatcaatgtattaatcaacactccgtaagtgatttgtccagtgagaacagctaaaataatacattttctgtcatcattaaaaatcctgtgatttttagtccaataaatgttttaaagggcaggatgaagagaagagctacaagaccctgtaacagaagccctcactcgcagggttatcactcctaaaacaaaagataagcaggaaaaccacagtggataagatctgctgtcaaccttagcttttctgattacacaaagtgcaataacatctattttttttaatccgaaggaatcctctgacaccaccaagcatcctgcccactcctccttcctgagcgctcaacttccttctgatctattgtcggcttttccttgcctgagctctgtgatctaaccagaacccaacggaacctatagagagtccaatccttgcccgacagccctgagccaggcccatagctgcctagcctacagcactgggggcagagggaggtcctctggattatggcacagggggaagttgcaggaaaaactccccacaaattagcaccatctacaattgaccaacaaagtgcagatacttctcagcattcaaagcctaaacaatcaggatggagacgtataaagcattcaatgcttcacgttggcaggacgataccaggtatttcactgacaggtgaaatagcagagtgacgggacagagtgatcaaggcagagtgatctaaaggacacagtagtacttctttaggaccctggcagaatggaagagagcatctggcttctaaggcactgcacaaacttgaatgatcttcttcagaattgacaaggaaaggccatgttatgttcaccctgggttaagttttaagtgtatcttatttaatttttttcaatatgagtcatctccagatactgtgatgatttccaaataaccagaatctagatgactagaaatttactctagctggctttagacaggaagcgtgaggacagaatccagctgcttccactccagggtaggtctgaagccaaccgtcctcggtttcctggcctgtggcatcagtctggttggattacacacaaagccctgcagatctgctgcttttcctgattctcctgtcctgagtgagtgcaaggggctcccctgtcgtcgatgtgttctttgaagcagatgctgtgcctgatacctgctggagagtcccaccgccttgagtgagtcaacaaacctatcatccttcccatcttccaggatggatattggggtggggggaggttaaagggaataccataaagttgctaccatacggttagggctgaatacaatgggagtacttattgtgatgatgtcaatgatgatgacagtgatgatgatgatgatgatgatatctagaactccaggttttcctggagagaaccaaggaggattccccacttacctaataaataaatgtcctgtaaatgcagaacatgccatgtaattgatgacacaagcgggatctcacttctgggggatgagaatcaattctttatggattcccacagggcagagggacccgggtggagatactaagctgtctgttgtatttccgaacgaatgagtacgtacgtaacagttatcgtgtctccttgtaactcgtgtgctaatcataaaatcttcacaaggattcatgacattcgtgctatgactattctcattttacagtgaggaaggcgggacacctaggaattaagtaacttgccaacatagggacgagctcaccacacaacaaccaagggtggggataccagtcaggtactgcggaaaacactggacatgaggtagaccaggtgcaccaggtccaggtgctgatgagaggtggagagtgggagacagggtcagtgagccacaggccagtccctaggctgagggcaatatgacaacaggacattggccaacttccagctgtcatcactgtctgtgtttcattttcacagttcgattaataaatgctctatattcagggatgcctgcggccttatttcttgatgacagaagtgataatatcagtccccccacaggcttgttcctcatgggtaggaggtgactcaactcctaatgtccagacaactgcccaaattctgcatgaaaaaaaacatgatcaatgtctgggataaaaatcagccaccttaaaaccctttaaaggattgaaggccatgggacccagtcataagcacatgtctggggcccggcaccttctctgaaacaaggatgatcgaatgttggtgtccataccgcatggaagagctgtctaacgcagtttgcctttgattggctcccgtctccatgaaggtggcacgtctccgactgcttacaaggagacagggtctcaccctgagaggactcacccagagaaacaagcggagctgctctactggcttagaaatgcctggcacctgacttgtggaggcttctagttggcgtgaaattgttagccttggaaacaactgctgctcacattggaactgcaggatctttcttgaaaaagccatggaactaactcaagggccacaagcccaaatgccttcagagggcagattaataagagagtctagcagagttagtgctgatggagttccttctccatccaggccctgttccggcggccgggcagatgctaacccatggggaccacacagcagccccacgaggctggcaggccctcagcctggcttctgagcctcgctgtaatcgcactctccaagctttgtggcattagggtgtgacagggcctgagatccggagagtgtggaccccacccacagttatctcaacacaaaaaaacaatcctgagcaggccaaacagaacctggtgggggatgccttcaccagggctgcatctggtcccagagctgctggtttgcagcccaactatttcgttttatttttttaattttctcaatatttatcttcttttatctataaacgagtaaggttctggggaggttttcttccttggaatcttgttctctcattttaagctgacttaatcttcccacgctacacgtcacatgcagagcgccaactttgaagttcactcggtgaccgactctcccgcccaatccctcggcgagggtgacgtgcaagcggaacatctcaaggctccagatgcaggctcagccctcagctgccctggccttaataaacactagatttttcatttcagaaactatgttcaacctgttgcctcaagacaacctaaaaatcgtcaacattagccaaaggttggaagccaaatgtgttagctcctgcctcagagacagatcccttagcagagggggtctctcagcagaagcccagaggagctgggacccaagctgggagctggtcacttacataaggggggcatcctaagtcgattttaacccgagatccaccagccaagccttcctacggggggccggccagccaccgtgctgtgctgaggagcagattgaacattctcttagctgctccaattttagaattgggtgctgactcattattaactcaggaagcccacacactcaaatgactgtactgaaaaagctccctgtcataccctgcctactgatgtgttgctttttaagcaaatttgaaaaatgtttatcataaggtatttatgacattttaaccgtttcatttacagtaactagaacaacattaaaaaaaaaatgtttcctgtattttacttgacagtaaagctaagcttcatcggaatactaacagcctgagaaatacctatcaagatcaagtcaggcctcaaagactgagtggccccctcctcagtcctccccagtcccccacccccagcgctggcccccagcatttttacgttcttcctgattttactacagtttgtgactttcaacgttaaggaaaaggaaaggacgtaaaatacgctcctgcaatcattcatatgcttttagagaaggcagccaaagttctgcctctctggtatttctcacactgaaattgggcagctctgaccacgaggccagaaatggctcaggagctgcctctcctccacctctgagaagcggaagctcacccaacctcagcaaccctgggttagcacaagtatacccacttccatctctgagcttcactttggcttctcagaggagtcccgagcagcttattttccagccaagcactgcagtctcttccaagacaacagaaggtgcaaccggcatctacattcttacaacgaaggactgagaaacacctcctgacagtcacactacaggacagtaaccatggggctggtgacagaggcagccacttttctaaaacgacagatcttcaaagtctgaaagaaacgcagtgtcctcaccaggacgcagcagcctttcccacagcccagactccaaggcaaactgcagaagcaaccctaaaaatgacagaaacatactcaccagggagaggctggtggctccaccttcccaggaactgtgctgtgaagatctgaagacaggcacgggctcaggcaccgcttgtctggaatgtcaatttgaaacttaaaaagcagcgaccatccagtcatttatttccctccattcccaatgatgtacacacgactaagaaggaaaaaaaaaaaaggcgcacacctcagccttcattctcattggaacgagatgactcatgctgac

SEQ ID NO: 362 - DNA, 8076 bp, Homo sapiens
cactattgaagttggctaatgtcactattgaagtcaagtgagagagagggccctcttggagtcagaccacctaggttcaaattctggatcctgcttccggctcctttcctctgtcccccttctcccctcggtgccctccaaccagtgggcctgggaaagcgtgttcatgctggaaatgcctgcccagcccttgcccagtcacacagagcaagtgccccagaaatgtcctgaacctcagtttactgaggggaaactaagaaccttctggctacagctcttgggctgagcagggattaggctcgggtctgcgatcccaggccctgcggcctcccagaggcttggttgagagctctggctctcactcccccacctccacccagcacctgccccggtccaggctcaccccctacccctccacctggtcagtggtggctcggcctcctctcagcccctccacccctcctggctgtacacaccctcaagctaacggaattcaaactggtggaggaaggcctgccctgtccctcccagcccctgcctctccctccctactcccagcctcactggaccactttcaagtcctccagtgctccaggctccatcttcatgcctccaggcctttgcacgtgctggtccctctcccattctcctggttaactcctccacctccatccgagctaggatcttcccctggagagtgtcccggttagcactaccccacaacacacacacacaccgacatacacgccccacatcacagggaccacatcccacacaggcacagacacactgcatgacgcagatcacaggcacaaaggtgcatgcgtgcacacatacacactcccactccatatgccaatacacttatccccctactcccacatcacacagacggttccacacactcctcacacgctctggccacacagtaaacacacacagaccacagagctcatgtctgggctgccctggtgccctcctctgggctcgtgcccccagcctcagcatttaccccccattgagggcagggacccacccagctccgttttcctccatttcagctcagggccctgcaccaagtctctcccagttgttgcttggacccggactcctcccacagtcaccactgtcacagtcccacctccttcaaggtctcaaacacccctcccctgtttctggcaggagccgtcctcactccctctattgcctctccagacccagacttcaccctcaggtcaccctcacctggactttggggtgccccacaccccgccccaggccctggcctctggaatatttggaaacttgaactgggccagaggcttaagctcacatctgtctggagcctcaactttctcctctgtaaaatgggctaacactgaaagaaccttgcagaatctcagcaacgtcacagaggacattgttagcacagccagcgggctcctgctgggctgagtttgtgggtaatccaagcctcggcaggtacagttcctccctcaggtgagtgttccacccccaagtgagcatcctgctgcccttcctgcaaatcaggcccctgggacacttagtgctgagccttgggggtggggtatttgatcggggttcctgacaagtggctgggttgtctgttccctctcttcagagggagcctccatgggtggcctgggctcacatcggctcctccagtccagcagagcacccccccctggctgcccagcttgttgagagaacttgctgagcaggacagtgagcccttcctggtggggaaccggaatcaggagaagacagaggggaggtggcaggccccaggatggagggagggcagctgagctgcctgccctcatcctccctgcccttcaggtattagggcccttcccatggcccagtaggaacccagcggctcacctgagcccggactaaggatggggcattttaccccatatgcagagatgagaaacagaggcccaaggagggaagggactgaacacagggtggaacagccctgggctgcgcctgtgtttccatccgccttcctcctgcctgtgctcgagtcacgtgctggtgtgcagggaacaggaagacagccgctgccctcacaggctcagggtctagcagagtccacagtgaccacaggcgaataaacaaaggcagtgagacagaggtgggcaaggagaggtgctgggatggggagcaagggggtacccatgctcatgggtatgaacacatggacccatatacccatatgtatgtcccagagtttcttccagaacttttttttttttcccaagacagagtcttgttctgtagcccaagctggagtgcagtggcacgatctcggctcattgcaacctccacctcctgggttcaagcgattctcctgcctaagcctcccgagtagctgggattacagacgccctccaccatgcccggctaatttttgtatttttagtagagacagggtttcaccatgttggccaggctggtgtcgaactcccgacctcaggtgatccgcccgcctcggcctcccacagtgctgagattacaggggtgagccactgcacctgaccccttctagaacttctctatcagttcactctcacatctacactgaacacctttgcccaaggctgggggcagagtggttaaaagccaaatctagactccttcttgctgtgtgacctcggccaggtcactgtcccccactgtgcctccccatcatgtcctcctctaaaaaatggatgcatagccctcagggctgttgttgaagggtccctgagatgactgtggagctcttggtgtggggacccaagctcaaccctgccccaagtactgtcccccagcccaactgcagtacttggcccccctcaacttctagcctccagtctctgcctgaaccccagcacctggcagttcagctcagttcatttacgtagcccagcctgggttcctgtgagatgaaggccggtcacaatgacaagactgctggggacgattgggtccctggccaggtactcaggtctacagcctaacacacggtgagctgtttcccagccacccaactcttgggcatccctgcaggacctccacggggagtccttggctccctgaaggatggatcatcagaggagctgccaggctgccagagctggaagggacctcagggatcaccactgtggccaaccctccactgcacacacagaaaagctgcagctcagagctgggcgtggtggctcacacctgtaatcccagcactttgggaggccaaggcaggcagatcacctgaggttgggagttcgagaccagcctggccaacatggagaaaccttgtctctgctaaaaaatacaaaattagccaggcgtgttggtgcatgcctgtaatcccagctactcaggaggctgaggcaggagaatcgcttgaacccgggaggcagaggttgcggtgagccgagatcacactattgcactccagccttggcaaaaagagcgaaactccatcccaaaaaaaaaaaaaaaacaaagctgcagctcagagaagtggagacactggcccagggacccacagcaaggccttggcccagctggggctagatggcaagaggtggttcagcattggagctccattgcctgggttcaaatcggggtctgtcactggccagctgtgagcctaagtctctgaacttctctgtgccttagtgtcctcattctgtagagtggagatagtaatcattcctatttcaaagattgttgtgagaaataagtgaactaatacatgtcatatgcttaaaagcagggcccaggacacagtgagcatacaatagacattagctgctgtggtgtcttgatttcaagcccagtgcagatgcatctgacttacgaaacttcagtgacacctgctctgtgccagacactgaagatggagcagtgaacagcactgacccagcctgtcctcctgttgcctgcaggccaggtaggaaacacactggaaactgataactccatgtgctcatcgccatgtggtttctgctggtctggggagccggggacaaagagcagaaaacatggttccaggtagaggggggtagcacgcatgaagaccgtgaggcagaaagcacacaaaactgaattggagagaaggcccaaatggctagagctcagaacccgaggagaggagaggggaggaaaggagagacctccagagcctggggatgatatgtagagagcccgggaaccagcgctggttagagagggaaggaagcctgcagccttgcattttagaaagatctggctggctgagctgaggagggcagataggaggttagggtggcggaggggggttggggggcaggcagagagtaggggctaggagcccagggagcaggcgggagatggagcagccggataagggggataagggtggggggcagtggggacagggtaaagggagctgactcattgaggtgggaagctccccagggtcggcatttggttggggcatggggaatctggctggggcgggggtacatggctggaggtgatggttaggagcaagctcaaggatggagggagaccccgtgtccagctctggccaccccagctgccgcagcaccctggggccatcagcccacagacttgagccctgtgctttagagggcagcgctcctggaccagggagacatttccagctggagccatgggccccttgaccatgatctggcacctggggccctggagttccctgttcaatggccccagcctgcgtcctgtgtgcatcctcctgagggttgtctgagccacctgtttgggcacccctaaaccccaggagtgaccaggaggtggctgttggcagggggtgtggacagaacatgtgcttacagcctggagtgcctacacctgagcatgcacagcccctcagggaaaaggacagaacctggggcaaaaagaaaagaagaggcgagtgtgaagccggaggccagaggctgagaggcgggctccccaacccgctacagctcctcctgtggtctccaaggagcctgagaattctaaacacaaacccagccttccaggtgtgtttgtccttatgaaggtgtatttgtcaaggaaggaggacagaactttttttttttttttgagacggagtttcgcttttgttgcccaggctggagtgcagtggtgtgatctcggctcactgcaacctccacctccctggttcaagcaattctcctgcctcagcctcccgagtagctgggattacaggcatgcgccaccatgcctggctaattttatatttttagtagagacgtggtttctccatgttggtcaggttagtctccaactcccgacctcaggtgatctgcccgcctcagcctcccaaagtgctgggattacaggcgtgagccaccgcacccggcaacagaacatattttatttagcagtttgttagcttgatttataacttgtaaatacctagacatgaggtatgtgggcctcggcttgcactcctgccccaggctgacccctggtgctgcccagagagaagccgcctccctgggctgacccctaaccagcaggctgacccccaggggatcctgcaggcttcttcagagcttcctactccatgcaccctcgctgggctcagtccagccccctgcctttgtctgagggtcctcctgcctccctgtttgaggattcaactccagcccctccctgccctcacccttcttcctgtcccttgtccatggagatcctgggctctggttttatttggccacagtggcatctgtcacgagctgaccagctgggtatgagtcctgtccctccttccggagagacggagagctcctagaagcagcgcctcccagcagaagcagaatcttgccctggggaggagtacagctcagaacccgcagactcggggtcaaatcccagctctgtgactttcttgatgcgtgaccttgggaggcagctttgctgccctgagccctgtttcctccccggaaaacccataataataactgtacctcttccagtgaggagacaaggtggaatagaacgcagagcccacgtgtgcctggcacttggcaagtacaccgggaagaaggaattgggaagggcaggagttacatcattcacctgtttacagctgagcaaactagcggaggctcggcgaggtgaagccagtcccccaaggtcacacagccggccggccggccgcaggacaggggccgaagacgtagttgtctgacctgtgctctaaccactgtgctctctggcctcaagccggctcccacactacccttccctgttctccgtggccctccagcgcctgaaagccgcttgggggccgcggaggcaggtggcatggccagggcagagtccgcggggcggaaagggttaacgggctccgccgcattgggctgtccttcaaggggggagccagccaatgagcgcgcgccgcgatgaggtaatgccgggaccacgcggagtgggcggggctgacggggaccccgcagagctcagcgcttcttctctccccacctacccctcacctttgaccttgatgtacaccctcccctcccccaaccttacccctgcagaggcgcccgaactgaaagtcggctgcagggccgcgggcctcccttagtctgggacaggaactgagagacgtcccggcctcagtcacaccctctgggcctcagtttccctttctgcaagaagcagagtgggtgatcgctaaagaccctaccagctgtggacgtccttggatcccaggacagttttcagcccttccctgcccttggcccgaactttaacggtcccagccccggcttcccctcaggcggtgcccagtgccaggacctaggagtccctcgggccacggggagagagcctcaccggcccagccacgccctccatgtgaccccgacccatcccttgggtgtcgcacctggcgcgcccaccgaggccactaagctctgctagctgcaccagcagcaggacctgccggcgtggcggtcagaagtcaacattcatcccaccgccagtaaaaatcgagggcctaccgcctgccgctcagggcctcgtcctgagccgtgtcccggggccgcccgcgcccgccacccctccccccgggcctgcagggagccggtccgcccctttcgcgcagtccgggcacgaagtggttaacgcctttccagccgagctggcaccgcgcggccgggcttattagtcagctcgcggggaggcggcgaggggaggggaggggctctagtggagaaccgcagaaagctattctcaggggctcccgagtgtggggagggcggctcagcaggagctgctgcttcccagaaagttgattatttttaacccaggaagaagaaaggaaggaggcgagggagaaggactcagagaaaagaggagaggaaaagagaggagaggagaggaaagaagtgagggcgggggaggtccgggaaggggaatggggagaggggagggaacgggaaagagagcaggagaggaggggagaaggaggggaggcagcagggtgatggagggagagggaaaggcagagcccagttggagctggagaagccagctggcagggcctggggaggaggaatggatgcggagcgggcactgccacctctcccgtacccctggggctctgtggagctccatcctggcctcctggtgccccagctgagagcagccccccagcatcatcaacctaggcccgggcgggggcggggaggggggcggtggggcggggcgctgggcttggaggagtggaaggcacaaggcagccgcagccctgttctgggggctctccagccaatatgtccttgccctttggtggccactgggacacagggcttgggagccctaggggaggggcaaggaggcctcccctgatactccagggtctctccagggagggcttcctggaggagagggtgggagggactggggctccctttttcctgcctcttggtggagccaggctgaaaaccaaacccagagagggccccaggagggtgctggggacacagtgacaaacaagacagccacagccaggcccac

SEQ ID NO: 363 - DNA, 18652 bp, Homo sapiens
gatcttacttgactagataaaaagaaaaacgaaaagacctgtcctgctttcttaaaggactagaaagcggaccaggcgtaagatccacaaagagaatctccaggaccctttgaagctcacatttagcatatgacaactccataggtcagtgaggacactggctggcttgaatattgtggaagacaggaagaacacatttatatgcttccaaagaagttattgctctatgtctgggtaatgccaaaataaatttgaaaacaaaagatcacctcgttcattttgggcactgtgcacgtaaaacacttgattaacttttcctgctggcttttttgatagctattgttgtggatgtatacacaagcctaaggagatagcctctactattcatattattactacacccaaattacaatggtcttcagtgacacttagcacttgtacacaatctctgaaaagtcaccgtttcaagctgtgtcatgtcagcgttttgtatgtaaaatcccatcctagaattgatcacaccccaaattattatccttgattgctcagctttctctcagtagctctggagttgcccctgatatggatgtccaaagggcactgatgtggactgccaaatgtttgcagtgcactttaattacttctctgcgaacgaaagctttcctgtagttagcagaaccccttgttctaactgtcgtttgggaagatttgagagtctaagcaacctcgtttatgtcttatctttgcattttcctgtattcagctattttcttaaaggaaggcccaggtctgtattatcctactgccacataggaagtaaaatgagtactcacagccttgcgcctaatcactgaacacagcttttagtaatgttttacacaagaacaggatattggcaactcaactgttaagcctttctgtgattattcttccttgagatcactctgatgtcaccagtgtaatttgagcctggagcttttgttcacactttaaatagcagtcccagaatgatttcactacagactctctggaaagcctgggagctgaattccggaagatccccacatcgatgaaagcaaagcgaagccaccaagccgtcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaacttttttttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaactttgtggcttttggtctgtgatgcttggtctcaaaggaaaaaataagatggtaaatgttgatatttacaaacttttctaaagatgtgtctctaacaataaaagttaattttagagtagttttatattaattaccaaactttttcaaaacaaattcttacgtcaaatatctgggaagtttctctgtcccaatcttaaaatataaaatatagatatagaagttcatagattgactccttggcatttctatttatgtatccattaaggatgagttttaaaaggctttctcttcatacttttgaaaaatttcttctatgattacagtagctatgtacatgtgtacatctatttttcccaagcaatatgttttgggtttagagtctgagtgatgaccaagattctgtgtgttactactgtttgtttaataggaacaaatatagaaataatattatctctttgcttatttcccgttaaaactataataaaatgtttctaggacagcatacgtaaatgcctgctatgctttcctaacaaaaatgaaatttttccacaagttaagcattttagaaacacctaaagtgtttttcaaaatgctgatcacagtaagtcaaaacaagtgaattacctcacatctgctgggagggttacaagtcaggattataaatactatgtttttaaaaagaaaatcaaatggcaaattctattttcaaatagtaatttactcgttcactgaagataatgcaaagcactttattaaaaatgagttctttccaagagagcattccggaagataacacattaatatgcaaaattgtgtgtgtgtgtgtgtgtgtgtgtgtgtgtgcatttttctaagaggaatattgataattttcacgagatttgtagagacagctataactccaaaaaaagttataaacagaaaaagggtttgcggagtagcaggagaattggaggaagcctaacccaggctggggacatactagacaattccatagaaattttccctgtttcattttcactgtgctgtgttacgggagtatgaaagagaaggctgtaaagaggccctcggctccataaccctactttcccatccttatgaactgagctttcttaatgttcactgcgtgtgctagaaataacttccttctcctgatagggcccatcagtgaaaatctttattttctattcaaaaattgaagcacacttggatgctaaatgtagttcaagagttaagtgtattatacatactcataactatttactctgccactgttgttttcaatagggtacaaagtatatcttctcctcttttcacattagcatgtattaagttgttttcttgcagtatattacgttattttctgatttcaaggctgtaacatgggagacaaattaaaaagcaatttggatgcactccacaatggtatggagaataataacacatccagtagattatcacaaacgtgtcatctttaccattcatggagaacaaaagttggaatcaatttaattgcataaggatgatttttagcttcataatacattcattacttaatgtgaggtgaaaataaacatcagtagaacagggaggattggttcagtttagaaatttatggcacaaggataaacaaatatatctcaggacatctcactgtaattgaagaaatgaaagcagcaaagattaaatagctcgttaatcatatttgtatcatgagatcacagtaataactttcactgagtgtttactctcagtcagacaattttctaagtgttttttttgtgtattactaatacatcacttaattagtgccatgacataaatgctaagggcatgtgcgtgtgtaatatagtaataaaactgaagcacagagaggtgcagtaacttggtcaatgacacgcagctaataactccagaaatcaaatccaggaactctggccttcattcccagccactagactataccggttctttaggagaaaccaagcttctctttttcttttaagtaacgatacttctatgttagtcagtcatgaagacaggaaggcctggcctctgaagcatcacttttatctgacctgggtatgtttgtctatttatttgttacacgtgctacatggggaaagcgtcttagtttaatagttttaattgtatcaaggatgtgcttagatacaggctttcaagcctgcagttaaaataacacttgtattagcatcctggaacacaaggccacacgtaagctttgggtcttagtttgttcattgaaggaactcagaaaccatggattcaatattttattcactcagttcatcccctggcccacagcaaagggggatttgtccagcagataggattttctgagaaaggggtccagggtgtatggttgactatatttttctcatcatcggagggtaaccagggtacgcaattgacattcccttagaaagtttcatctgctagtaaactaataatgaagccatggcctgaggattgcatgttttttcagagtatttagttgacctttctatactccacatgagggtttctcagaacagcctgtatggattcccagcagaacagatgtggggggcagggcagcatttgtatcttacccattcaacaaaaatacagtaagcacccatatgtgggagcctccatggccagaatggatcctggttctccatatcagaagaacaggaaaggtttttaaaaggggtatcacacggtgagaagtgtgatgggagtttagacagaatgctctggaagcataaggcaggaattatgtgtgtgtgtgtgtgcgcgcacgcgcgtgtgtttgtgtttgtgtgtgcgtgtgtgcttgtgcatgtgtgtgtgtgcttgtgtgtgtctgtgtctgtatgtctgcgtgtttggggagtagcaggagaattggaggaggcctaatccagttggaggagaccctagcaaattccacagagaattttccctgttttaaagtaggagttgggggagtagagagaaaaatttttatttcagcctatgcctatagtatttgccaagacaaggaggcaggaaagagtatttgaaaatctccaggcagttcagtctgactaggggcctaagcattcccagctaataattaggaaggcagccagggccgggtgccgtggctcactcctgtaagcccaacactttgggaggccgaggcaggcagatcacttgcggtcaagagttccagaccagcctggccaacatggtgaaacgctgtctctactaaaaaatacaaaaattagcagggtgtggtggtgcgtgcccgtaatcccagctacttgagaggctgaggcgtgagaatcacttgaacctgggaggcggaggttgcagtgagcccagatcaccccactgtactccagcttgggctgcagagcgagactccatcttgaaaaaaagaaaggcagctgggttttaaatgacaagtgtaagtattaattttatatattctggaggtaatagagaaacattaaaagtaacatttactgtctagctactgtgtattgggtcctaggaaaagatacggttaatagcttgaaaaataatccaccatctagcagttgaacttggtcagattctgcagaactctgtagcttcacactgaatgaaaagctatagaggacctttgcagttcaataacagtgggcagcaatgtggcagctgaagataaaacagaagtaaaagattatgaagaaaagcattgtgaggcccgattgtggaaacagcaaactaatatattgcccaattaaatatttaagaaattgtgactacacctgatccttataatgagtcttattatttaacaagtattataaataaatggttataagctctttttttttgtcttgaaaaactcttctgcaaacagtttccagatattttaagtgattatcatgggtaatgcaaatgtgttctatttcaatgtctatacacattgacagtggatatggttcagcaaagtactggcaaaactatgttacagagctttggaaataagcatcctgtgccagtaagatttagcagtgttgttgtcgttgttgttgtttaaattaaaagtggatgagtaatcagaagacttttagtgtagctgctttctcccctctgtactccttacacacaagcatgcacacacacatacacacacatgtgcacacagacacatgcacacacatgtgcacgcacacagtacagacacataatcctactagaagcatatcagcttttttccctgagcttttgtttcctcatctgtggacaatagcatcgtgttgagcaaacaaccccagactgagcctggaattctggggtttttcccgaccctgccttagacaaattccttttttatctctgggtttcatctgtaagaaaaaaaacagctagaccagacggatgatgtctgtgacctttatcagctcttatattctacatcaatgggaaatagcaactgtgccaccttacgtgataggatttttttctggaccagttggtattccatatatgataagaatttctcttaagtatgataaaggcctagtttaaaagttttcatctttagccaatggttgctgaaggcacaatgtgaggaaaatcagtttttgtatgtatatctctgctttttaatagcctgcctccgttctggttggttggtgcctgtgccagggctggctggctggcaatattttgactatctcttccatagccaagcaatgacagagtcactgagacaatctccactgttggtgagaattgcattcatatgtaaagttttcaaaatagagattcttggtcccaaactctccaggcattgtttttaggactaggtatttgtacaaagctctacagtcagctataaagaacatgagatatatggaaccatttcttatgttacattggctcttctgttggtagcacttcataatataaagaccaagaaagagggtttgatttcatggcattagttagaatttgttttaccatattaattctgtcattaattgaaaatgatactgatagggtttggctcagtgtcccctcccaaatctcctcttgaattgtaatccccacaggttgagggagggacctggtggaaggtgattggatcatggagacagtttccccaatgctgttcttgtgatagtgagagagttttcatgagagctgatggtttaaaagtggcagtttcccctgacctccctctctcctgccaccatgtaagacgtgccttgcttccctttcaccttccgccatgattgcaagtttcctgaggccccccccagccatgtggaactgtgagtcaattaaacctctttttttataaattacctagtctcaggtagtatctttataatagcgtaaaaacagactaatacagataccctccaaaaataaatatattttgaagagaataattacagtatgtatttatgttaattaattcattctgggttttttctttcttgaatttcggtctgatatttatctaccttgatacatgtatatttgaccaaaaagaaatcttctgtttcttaccactacctatcctttaaatttttttgcaatttgtctatgtttattatttatgcccaggttttatcatctgaaagattccagagaagcccagtgatcctgaagggtactggcagccacagtatctgaaatgctgtgtctgaggaccatcttcccctgacattgcagaatacctaggacagagcaactgtttccaggcctactcttatcacagtctccttggggacttttaaaaatccaggcctttggacttaatgattcagagtttctggggctggacacctgctagctccgtgcttcagtcactccccaggtgattttgctgctcagtcatattgagaagcactgacctagattaaaatcacaaactgtgcatggtgtgaggacacggctcatttcagttcatccatgtatccccaggcatattgcaggcctcaatacctttcggaccgaacaactgcagcaaaatgtgactaggactttattgtggaatactttattcctactatctctaattcaaataataccatcattttgattttgctctaaattttatttgttttaagaaatcctaccaactcacaatgatcacatcattatctaactcccatcaggctcccataaagcatacagttgcagcaatgaaaacacatttttccaaagaatgtaagggctgtctccccctaaatatatttaccacttgcctgctattatggagattcatttcttagtccagagaagtttgtcttttcaaaagtaagaattaggctgggcgtgatgactcacgcctgtaatcccagcgctttgggaggccgaggcaggaggatctcttgagctcacgagttcaagaccagcaagggcaacatgacaaaaccctgcctacaaaaaaatacaaacatggtgaggctgaggtgggaggattcctcgagcctaggcagtcgaggctgcagtgagctgtgattgcaccgctgcactccagcctgggcaacagagtgagaccctgtcaaaaaaaaaaaaaagaatgagtagcacttatcactagcagtcacttctataaactagaatattagcatttaacaaagcacttccttcctaacagcaaatatcttccactgagatcgtgtggttttaatcatacaaggagagtggcagaagaacagaaagattgaaaccaaggacagagaacacctgaaattggtaaggaagaaaacaaccaaaggtagtatttcactaagaaaaacatcttaatttttcctagccctggtcttggctgttacatagtgggatagctcgatgtgcatacagcgtggttggcagtagaaagatcaatagaggagtttatagggtttacgaagacctggattctaatcctgcctcagctatttatgaggtatgtgtaaatttttagtaaattacttaatgtctcataacctcactttaacatttataaaatagggacaataataccttctgtattagtttactaaggcttctgtaacaaggtaccgccaactgggtggcttaaacaacagaaacttacctcttcacagttctggagggggaaagtctgagatcaagctgtcaactgggttggtttcttcttggccatcttctccctgtgtcttacatggtcttccctctgtgtgtgtccatatcctaatctcctcttcttataaggacattagttatattgaattagggcccactttaaatactttagtctaacttaccaacctctttcaaggccctgtctctaaatgcagttgcattctgaagtactggggattaagaccgcaacacgtaaattttggttggggaaacagagttcagctcataacatctttgtatttctttctcttgcttgttgtaagcataacataaggcaacatatgtgaaaacacccacaagttaagtatgatatctgtgaaggtaaggtccttggggaccaggacaacactttgctcatggttgaattctacaaagcttcttgcacaggctctggcgtggggtgggttcctcataagtgttttctgaacatgaacacacaaatatcccttaaaaatgaggtatttgtttattaacctctgaagtcaacatctgtaccctttttgtctcttaagcatctccaaggagggctaagtcaacagtgttccattagcattaaatagctgaacctggggatgaaccacagttcatgctgaaagagccatgtcgaaatggcattgtgcaatggtgcatttctgccactaaaaactttgtttgcttttcattatacaggaatggcttcaaatgttcagtggaagtgaacaagttcttgtattgttttctcctattctccttccagcttcagggtcatatgtcacagcgctgggcatttcatttgggtgagtgaaaggagggaagggagcaacgctgggaaggtttaaaatctccaagtgatatacgaggaaaaaggctgtgctcatcacaaaagtaattctatctatcttaccttatatagtaagaatttcagcatgaatagaatgagtttagagggcttcataatctgtgctcaagaagtgtgggaatcttggtggaatagagccctgcacgatgttgttggagatcaaatgccattggctactatctaatttcaatttgagaagaaaattactaaatgtatatcatatcaactctgaagaccctattactttgacacagaaaaataacttcataaaatcaattgactaaaataaattagccaagcaagggtgggataccttgtggccaaagtaacaatctgaatatctggtttttaacttttcattgttaatgatcacatgatcgcgctgagtagacataagccagtgttgtcatttcattctacatatatttggaagatgaagatacctacatcctcaccttgtttacaggatcaaagaggcctgggattcttcaatgattatctagcctggcatgtggactctctgtcatccttgagggacgtcaagaccaggattctgtatatattggatagatttcatatgtatttcagttactattcctttatacctttaaaaaaatttaaattgatataagaaagtgattaaatttttctctttcaattttaggggctcatttttgctgttagagaggtttgtaaaaattcaacacaaataagacagagctggttacttgggcaggacaagtgcatgccagaggcataaccacttaaaactctgctcttcagctaagaaacaccagaaattcaatactctaggcaccatggttgagagatgggaagacttacttatgccaactaaactctcagcctgcaatatgaacaaggaccaggcttggtggctcacacttgtaacctcaatactttgggaggccaaagtgggaggatttcttgagcctaggagtttaaggccatcccgggtaacatagcaagacttcatctctacaaaaaattttataattagctgagtgtggtgccatgtgcctgtggtcccagctacttgggggcctggctgaggtgggaggattgcttgagcccaggaatttgaggctgcagtgagccaggaccatgccactgcactccagcctgggtgacagagtgagaccctgtctcaaaacataattaatacataaataaattaataaacagataatgtaggaccattaatttattcatccatgggaaaaatttaagtgccaaggaggaggaaaaattataagtgaaagcaaagcaagatcaagagtcttgaaggcaatttctccctggttttggcaaggtttgaaggattagcttcacagcagagacctcttagctactgaccactacaacatttaccttttgctgcataacaagctgccccagtgcttagcaacttaaaatgacaagcattcaatttaactcatgattctgtgggtcagcttgggttcttctggcctgggccaactcagctcttgtctgctgagctctctcaggcatccgtggtcagttggtagctgggtgatataggatgacttcactcacctgtccgattggcaggtcgttggccacggcatcttgactctcttccaccattttttgcaatctgccatattagcacttaggggctttcatcataacagtgctggataagtatttgtcaaattctatctttctctttgctctgtttgtagacaccatgctcaccatcttctttctttgtgacattatcttttctggaagagggtgcactataaatgaccacattttaccttattcatcagagtcaccctccaggccttcttccctgaaccgagattcagattagttcatgaaactcagtcactcatttagaaatatatttttattgactcccatggctaacaaatttgattcaccaaactcagtcactcattcagaaatactgtttactcactcccatcactaactaattttttctataatgtgtgaatgttaccaatgtaatattcagaggatattcactgtggtttttctgtaatttcttgatggtgcagagatggcagagacatctctcttatcctcaggtacccatggcagtgccaaagcagttgaagggcatgagcagatttctgaaaaatcataactgccgtaaaccaccctttcttagtgccagcttccttatgaaatatatagatgcataccactgaatatctgagcttgttcctctcgttaacctcactttgtggaaaggtttttaaatcaactgctaaaaatgcctgttcttttctctggacagtggacatggagagacatgagctgagggagacagactgactcagggaaaagaattaatggaagcacatggctcccgcgggcaggaaatgctttgatagaccttttcctctttttgttaccaggaggaccttgacaatagactccaccttggagcagctgctctgtcccccgtaggatgatcacagcacattttccttgtcagacttggagtctgcaccagggagtgctcaggaagggaccagtacaatgttggggatctgcccttgagcctccaagctgtgcgatgggtggagacgtcaccccaatacactcacaaatccttttggcacacgcttcaggaagaccatctgctttcgttgttcctctgaccttttgttagcacccaccctaaattggaaataaattgccagaagaaatctgaagcctaaagcagttttagaccctgttgtcaaagcaagtcaaattagtaagtgttggtttagcacctaacatgtatcccaaattgtgctagatgttggcagtggaaggaatattttttcaatgtctaaatagcttcaggactatataggatcttgaataatttaatttaatcttttcaaaatttctacaaggcaagtattactatatgcatctgatagatcaggaaactgaagctctggaggttcaccaacttttctggtgccagtctaacttcgtaagataggagagtataaagtcagacttctatctcgatttcatatatgattttatgtcagctctgatgtattctcaagtctgacgcttaactgctttttttcccgtagtcttatataccatgtctaataggctctatgaaacattggcaaagaagagacctggttctagccccattctgataggtgacatgggataaggcactgaaaattctgggtttcatcttcttctggaacataagagactaaatgagatgacagaccttctaattcctaaatttataactatgttacaaaatgtggtatgggctccacattcattaagatggcaagtaaaaaaaatggaaaagaagtattgaagagaaggtggagaaattagatccattgtgcactgctggcaagattgtaaaatggcacacccattgtggaaaatagttcagcagctcctcaaaacatgaagcgtagaattgtcacagaaatcctgtaattccacttctggtaatatataaaaaaaaatgaaattaggaacatgagtagatacacctgtgttcatagcagcattatttacaatagtctaaatgtgagaacaacacccatgttcatcaacacatgaatggataaacaaaaaatggtatatacatacaatggaatatgatccatccttaaaaaggaagagaattctaacacaaactacaacatgggtcaaccttgaagacattattgcaaagtgaaataagtcaatcataaaagaacaaatactgtatgattccacttatatgagatacctagagtagccaaattcatagaggctgggctcaggagaggagaaattaggggttaatgtttagtgggtgcagcatttcagtttgggaaaagaaaagagctctggagttagatgatagtttctcagcatttaaatgtactttatgcccctaaactatttacctaaatgtagttgaagtggtaaataaagctataatttaaaaaaggaagttaaaaaaatgtggtttgaatttcagtaacaaaacacaataattcaaaaaagaattcactttttttttagaaatgttcacatcattcaatttccaaattatttagtgacctttaaaatattgcagatttacaggcttacaggaggactaagattacactcatctgcattataagccacagtgaaaaggatgagaagttatcctggcaaaagatggagaaaggagcattttaaagaggggaactagtttaaaacaagattctattttggaaaaagcataacatgttcgataaaattagagcaattttctggagcaatgttgcttaaactcagagagcaggagaaagaatagcatgagctggaaatggagataggcagggccaaagcacttgaggctgggttagagtttacattgtgttataggtaatgctaatagagccattgtagactttcaagctagagaatatcaatatttttattcgtgcttttaaaaggtcaagctggcagcattttggggaagaaccagagggtagagagcataacatgctttaggcagctactgtagttgtctagattagagcatatgaagaagagatggaaagtagttgagtgtcagaggtaattagggagaaagcatcaccagaatttgaagatgcattggcttcatcctctgcattatgatttcccaattaatcatttccccccggggtcatagtcaccttcactgggcatcttccactagagtgctgcaatagctgaaggagttcactgccttctgctcttacccttcagtgggtcttttatattacagctagatttagctttctaaaatgccactctacacacataacttccctgctcagcactttcaaagtctacccattgcctacagtattaagtccagcttccttagctgggcattcaaggcccattgtaacctggtctctctaaatctacctagcacattgctttaacatggactggccagccacagtggctcatgcctgtaatcccagcactttcccaaactacctcccaggccgaggtaggtgggtcacctgagcccaggagttcaaggccagcatgggcaacgtggcaaaaccctgtctctacaaaaatacaaaaattagctgggtgtggtggtgtgcacctgtagtcccagctactcgggaggctaaggtgggaggatcaagatcgcttgagcccgggaggttgaggctggagtgagcatgattacgccctcactgcaaaagagcaagaccctgtcgcaaaagcacaaattaaataaataaataaatgtggactcagttaataaaaaaaaaagtttcttcagcatctatcagaggccagattaactaacttgttacaaagcattcctgctgcttcattttctttttctgtcttatttatatttgatttttagaaatatatagaatataccatacatataaaggagaaatataaaatgcaggtgcaggttaaagactactgtaaaaaacactacctagcttaagactagacgctttttaatatatttgaagatctgtgtgctctgatccctcttcccacactcccctaaacattatcttggattttatatttattcccattctatcttcctggaatgcccttgcccttcttttttttttttttttttttttttttttgagacagagtttcgctctttttgcccaggctggagtgcagtggcgcggtctcggctcactgcaccctctgcctcccaggttcaacccattctcctgcctcagcctccagagtaactgggactacaggcgcatgccaccacacctggctaatttttgtatttttaatagagacggggtttcatcatgttggccaagatgttctggatctcctgaccttgtgatccacctgccttggcctcccaaagtgctgggattacaggcgtaagccaccgctcccagctgccgttgcccttcttgttgctttaataccattcttcctctgacctggcccagaatttagaaagatttttctgaagattttagctcttactaagtacagctagtgttgtctccatcacccatgggcactggcatcttctgtcattaatgctagtaatctttttatgtgtcagtggaagcagaaatctcattttctattgagaaggtgcttggtatgcagagcttgctgctgctgatgggatcaatactcatgtgctttattcagagtggtcagatggtctgagggaccagggtgctgagaggtggtggcagggagacattctcaggaaccagacggggaaggtagaaagtgcctggcatgccatgaatagttgttgaactagtgaattaatgaatgattgacaactctttctggtctacaatactgaactataagcaacgtgaggatgggctactgtgtgactcagtgattcatagtcacaactcagttcagttgagttatttcttgagtaccaggttcaagagatgcaacgacaaataggtctgttttaaaatatcagcagtggggtcaggggaaagtgggaggagggaggaaggcagacacatagatcaatcattgtaacagggcagcaagcacaaccaaagaaaaatacgatcatcaatcagaggaggaagcggttaatgtttccaggagaaagtattgattgcctagagtttactcccacccagtctgaagaatcctacttggattccactgcagcattttctccctctgattctccagcctcctccttgcaccctgcctgggattctgtgctccaaccacattggcccaggttaccatcttccaacaggccccgacttttcatcctctgtgttctacccagtgcgtctcaaattttaaagcatctacaaaccacctggggatcttgctaaaatgcaaattctgacttggtctgggaagtgtgccctgaggcctgaggatctgcatttccaacaagctcccaggtgatgccaaagctgctgctctgcaaaccaaagcttagaactgcaaggctactctctccgccatgaaatactgttctcttcccacactcttactcaaatcctctacatttctatgagctaagtcaaatgtcttccctgtgatgacatctcctcagtttcaggatggggcatcagtgccgtttttctctccactgcctggcaaatctttctctccaagtctttttcctcaatgaactgaaggctccttgagggaaggacttggtcacgttcatccaaacccctggatggtgtctgttatagagttgggccttaaatacttgctccattgaatttgaattgaacttaaaatattatggcagtcctggtaaagtggcttgcacctgcaatcccagcattttggaagtctaaggtgggtggatcacctgaggtcaggagttcaagaccagcctggccaacatggcaaaaccctgtctctactaaaaatacaaaaattaactgggcatggtggcagacgcctgtaatccaagttactcaggaagctgaggcaggagaatcacttgaacccaagaggtggaggttgcagtgagccgagatcgtgccattgcactctagcctgggcaacaagagtgaaactccatctcaaaaaaaaaaaaaaaccatatatatatatatatatatatatatatatatatatatatatatagcatatggattaaatgtgtatttgtgtggttatataagtgtgtttgtgcatgtgtcctattcaatgtactatgtactatacaatatactatacatataatgtatatatacaatgtactatataatgactagatcagaatacatagacaaaccaggtcattttagcattgtgtcaccaagaattataataaaatataaattaacatagatgataatgatcagggtggcagaaataacctccaatataaatttgatgaaggcaaaacactttttttctagtaggtcactgggtccccctgagtctaggcccgtgtcatgtatgttgtaataatcagtaaatatttgtggaattctaaatgaataaagggagaaggtactgaactttagttctatgaataaacacaattgtaacccctggaaaaggaagtggttaaagctatgttaagatctaagacaaaaacagaaataaacaataataaagacaagccaaaaaaaatctgaaaatcttcccctatagtgaatgcacattacattttttttcactaagaatatcttcttacatggcagcaaaactaaattgaagacatttttccatgtgaattgttttttcctaaaatatcaaattgttgtagatcaacaaaaactttgtttttcttactat

SEQ ID NO: 364 - DNA, 22569 bp, Homo sapiens
tgtgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggtgagccgagaaggccagtgacggtgggacgagcaggcgccgaggaggtggcgtggcccagacgggccgggtacggaagcgcgcaggaacctgcgagttgcgggcagccggcctcggcctcggctgggcgggggttccaacctcggcggctccagggcagccgtcacccgccttctgggtgtgttgcacggcccacccctcagcccgtctcggtccttcccagtgccgtgcctttagccacctttgtgctttctgcttgcacccacacggggctgtatctggcagccgctgcttctgccatcgatttatttttcgaagaatatctttgttttattgatttacttatacccctcgccttaggacttcgttccccctctttgcccgtcagcggtatcagttgaggcctgttgtggctctgagtattttgtgtccccagcccgttgaccttgagacttgtaacaggtttcccttgggaattgcattcgggtgtgtttatcgcggacaccctggtgcaacttttactaaagccgtccgctcccactcccacctcccaaacttttatgatctgagtaagcggttctggcactgatgtcctgataacgttctaatggcgcattaattttggctgatgccagggtcttgatagaattcaccgtttttggtttccgacccagaagtacaggagttcagtgtacaatattgtttttatagagacagaatgatagggaaatgttattagaacgtagtttgtgtaaagtggtggggttgcacagtgtcaacactgaggcatttggtattctgttctcctttaaccgaacgggttgtctcttttggtaatttggattgttgtaaccttaccctcatccggtctctcaggtaagattctaggaaagttcctgttactaggtttctgaattggtgtggcctgtttaaaactggcacattagttaagttccaacggacacaccattagacaaatgaatgtttttgggtatgctctttgttggccctggatttgctagagctgaaaaataatacagaaggacttttatatgagaccttttttgtcgctctgtcagtttattttttgtttttttgtctttgtctcatccaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgtgagtaataaagctatttatttcacctgggtgcaggcgggctgagtccaaaaaggagtcagcaaagggagttaggggtgggcagttttataggatttgggtaggtagtggaaaattacagtcaaagggggttgtgttcttgcgggcaggggtgggggtcacaaggtgctcagtgggggtgcttctgagccaggagatggaatttcacaaggtaatgtcatcagtcaaggcaggaactggccattttcacttcttttgtgattcttctgttgcttcagaccatctggatatatacgtgcaggcttgggctcagaggcctgacacaaaggtcttaagtaggggtccataaactactggaaattttatgcacaattatacatttttgtgggaagaagaaggtccatagtatcagattctcaaagaggacactgtttcataaaagcttgagaaccactgctccaagacttgacatctttttaaaattaatgccagtgcaggtagagagtaactgctttcttactgttccttttgaatagtttatgatattgatttttttttaacaatagcttgtctgtttgagtaatattgtatactaaaattactagcaccagtgagggccatatccttaatgttctttttctttttaggttccttatcacaggaagaaaattttccttgacctttaggtgcttttatattcatctcaaaaacaaaattctgaactcaggacttggcaagtaagtaattgtgggctaatcgttccaaatactgtttaagtagcttgaaaacaggtacatagaagtggaacaataagccgttagcttcagcagaagacgaacatgaaaaatgactgtaagctattgaaatttaagttaaatcttttatttttcaacaaaagaaatgtattaaataaaaaggagtaatcttgatcatttgctcaaactaccaataattttcactgtctaaagaaaacagacacatatttaattagattgaaggaaatcaaatgattaaaaaataggcctggcccggtggctcacgcctgtaatcccagcagtttgggaggccgaggtgggcagatacttgaggtcaggagtttgagaccagcctgggcaacatgggggaaccctatctctacaaaaaatacaaaaattaagcaggtgtggtggcacgcgcctgtaatcccagctacttgggagactgaggcaggagaattgcttgaacttgggaggcggaggctgcagcgagccgagattgcgccactgcgctccatcctgggccacagagacagactccatctcacccaaaaataacgattaaaaaaaaatgttactgggtggttttatttaaataaattttgtgtatatttcaggtatacaacatgatgttttgggatgcatatagatagtaaaaaggtttctacagtgaagtaaattaacatccattgtctcacatagctattttgtttttgtggcaacagctaaaatctcatttagcatggatcctgtttacagtataattttattacctatagttgtcatgttgtacattagatcgttagacttgttcagcctacgtacctgttcctttatattctctgacctatatctcttcctttactaactcccacatcactgttttgttctctaactctgtatatttgattttttaaaaaaatttcacatgtaaatgagattgtgcaatgtttttctttcagtcctcctgactcatctatgctgtgacaaatggcaaaatattttgtttttttttttttttgagacagtcttgctgtcttagcacttgctctgtcactgcactcaggctggagtgcagtggtgctatctcagctcactgcaacctctgcctccctaattcaagcgattcttttgcctctgcctcccaagtagccaggattacaggtgtgcgccaccacgcctggttaatttttatatttttttagtagagacaggatttcaccattttggccaggctggtctcaaactcttgacttaatcccaaagtgctgggattacaggcatatgccactgcgcctggccaagatctcattcttttttagggctgagtaacatatgccatcatatatatgcactgtagtttctacagtttatccattcatccattgatgatggacagttaggttttttctgtatcttggctattgtgaataatgttccactgaacataggagtgcagacatctttatgaagtgatttcatgttttttggttatatgcccagaagagggagtgctgggttatgtggtggttccatttttaatttctttagaaacctcccagctgggcgcggtggctcatgcctgtaatcctggctactcaggaggctgtggcaggagtatcgcttgaacctgggaggcggaggttgccatgagccaagatcgcgccactgcactccagcctgggctacagagtgagattccgtctcaaaaaaaaatttccatactgtttttccatagtggctgttctgatctacactcccgcgaacagttaataataattcattcttctcttaaacgaggcaaattttggaatatatttatttaattttttttttgagacagagttttgctcttgtcgcccaggctgaagtgcaatggcgcaatctcagctcactgcaacctccgcctcccgggttcaagcgattctcctgcctcagcctcctgagtagctgacattataggcacctgccaccacgcccagctaatttttgtatttttagtagagatggggtttcaccatattgggcaggctcgtcttgaactcctgacctcgtgatccgcccaccttagcctcccaaaatgctgagattggaggtgtgagccaccgcgcctggccagtgtgtcctttcttaattgacagtgacattatatctgcaaaataggcttcatacctactgtgttagttttagtttcctaggcctgctgtaacaaagcaccacaaattgggtagcttagaataacagaaattgtttgatagttataaataaaggtcagatgtctaaaaccaaagtgttggcagggccgtccctctgaaggcactgaaaaaaaaatttccagtccttctaatttcttgtggttccttaacttgtggcagcataactccagtcttcacatgaagttcttcctgtgtgtgtatctgagtcctaatataaggagactagtcatattggattggggtccatcctgctctgttaatgacctcatcttagctgctgacatctgtaatgactctattaccaaataaggtcacagtatgaggtagtaggggctaggacttttaacatacgaatattgggaggacacagttcaacccattaacacctacttataccttgattaattatatgaaaaccattcagtgtacaactgcttcaaggattgaaaccttgtatgtagtcccagctactctggaaactgaggtagtaggattgcttgaggcctgaagttcaaggctgcagtatgctgattgtgcctgtgaatagccactgcaccccagcttgggcagcatcagaattatagagacagaaagtagaatgatggttgccaggggttgcaggaagggcagcgagagggaattactgtgtaatgtgtacaaggtttcagtttgggaagaagaaatgagtcctggagatggattacggtgatggttgcacagcagtatgaatgtacttaatactactgaattgtatactcgaaagggttaatatggtgaattttatgtgtattttatcacaataaaaacattgaaaaataaaacaatctttgtatgtatatgtatatatgtgtgtgtatatatgatatatatgattgatatatatatatcagtagtaagaaagggaataaaaactgatgaggcaaaatgccctttagagtgaagaaggccttaccacttggatttacaactttaagtccaagtagacaataatagaaacttgacattggtatagcacaatatttatagtaatctaaatatccatctgtaggctgggtgtgttagctcacacctgtaatcccagcactttgggaagccaaggcgggtgggttctttgaggtcaggagttagagatgagcctggccaacatggtgaaactgtgtctttactaaaaatacaaaaattagtcgggcatagtggtaagtgcctgtagtctcagctactctggaggctgaggcaggagaattgcttgaacctgggagatagaggttgcagtgagctgagattgcaccactgcctgggcaacaaagcaacactgtctcagggggaaaaaaaaaaaaaatatatatatatatatatatatatatatatatatatatatatatatatatatatggtgtagagaactgatgtaaataaagtacatcaaaggtagtactttacttacagactggtactttgtcctgatatggaatgatctctaagatacattaacagaaaaagcaaggtacagaacaatatatagtgtgctttcatttgtgggaaatgtctctagagatgttttgtagccatagaatattcctaaaaggatatgcaagaaacactgtttaccctattttaccttatctcgtgcatatatttattcaaataaataatttagaattttcaaagaaaggaagcactgaataaatatttgataaatgacaacttaaatttttgctcaagcaacagttttacatcgatatagtatatccctatctagggggcagaaattgagcacctagcccagcaagtttttttgttgttgtttgtttgttttggttttttgccctggctggagtgaagtggcacaatctcagcttgctgcaacttccaccccccaggttcaagctattctcctgcctcagcctctcttgtacctgggattataggtgtctgccaccacacccagctaatttttgtatttttattagagatggagttttgccatgttggccaggctggtctccaactcctgacctcaggtgatccacccccctcagcctcccaaagtgctaggattacaggcttgggccaccgcgcctggtaagtttttttttttttttaattatttatttttttgagacagagtctcactctgttgcccaggctagagtacattggtgcttgctgcaacctccgcctccggggttcaagtgattctcctgcttcatcctcctgagtagttaggattacaggcctgccaccacgcccagctaggaaggttttttttttaatatgacacttataaacttaatttgattgatagtgataatagtattcattgtgttttgtgaaatatattctaaattccctatttacatagtgaagtaaaaaaggtgcactaactcccgggatacatcattctctctgtccttagaggaagcaaagtatattagttattgctgtataacaaataacccaaaactcagtagattaaaacaacaacaaatatgtattacgtctctcaagaatttggtaatagcttagctctggggaggttctggcttagggtctcttaaaagcttgaaatctggctaggcacggtggctcatgcctgtaatcccagcactttgggaggccaaggcagtcggatcacgaggtcaggagatcgagaccatcctggctaacacggtgaaaccctgtctctactaaaaacacacacaaattagtcgggtgtggtgttgggcacctgtaatcccagctactggggaggctgaggcaggagaatggcatgaacctgggaggcggagcttgcagtgagcagagatggcacgctactgtactccagcctgggcaacagagcaagactccgtctcaaaaaaaaaaaagcttgaagtctgatggagttctgtggtgacacatttacatggctggcacattcatgctgtttagggggaagtttcatttcctcccaatgtaggcctctttcagggctgtctgagtactcttatacggtggctggcttctccctaaacaagcaatctaagagaataaggcaaaagccatagtctactctatgactttgccgcagaagtcactcactgtcacttcctccttgttctgttggtcagtattctgacatcaagtggtacatggcaatacatttcttttttttttttttttgacacgtagtctcgctttgttccccaggctggagtgcagtggcgcaatctcacttgcaagctctgcctcctgggttcacatcattctcctgcctcaccctcccaggtagctgggactacaggcgtctgccaccacgcccagctaattttttgtatttttagtagagacagggtttcacggtgttagctgggatggtctcgacctcctgacctcgtgatctgcccgtcttggcctcccaaagtgctgggattacaggcatgagccactgagcctggccatggcaatacatttctgacaccacccaagaattagcatagacctcacaggtcaaagggcatggtcctcaacaagactgtcctcacttcagatgccagctgtacttcggaggtacccccagccacctgcattttcgaccaagtggctacagatttggagagtcccatgaccctcttagaaccagcttttgatttcgttggttttcttattgtttttagttcctttaaagttaggttggttgatttgaggtctttttactttttttttgagacggagtttcactctgttgctcaggccagagtgcagtggcacaatctcagatcactgcaacctctgcctcccgggttcaagcaattctcctgcctcagcctcccgagtagctggaattacaggtatgcgccaccatgcccagataatttttgtatttttagtagaggtgggttttccccatgttgatcaggttggtctcaaactcctgacttcaagtgatccaattgccttggcctcccaaagtgctgggattacaggtgtgagacactgtgcctggccaactttttagaaacaaggtcttgctctgttacccaggctggagttcagtggcttttctcaggtgtgatcatggcacactgcagcctcgcactcctggcctcaagtgattctcccaccttagcctcctgagcagctgggactacaggcatgtgccaccactgctggctgaggtctattttgatgtgagcatttacagctataaatttccctcttagcattgctttcaccacatcccataagtttttgttaagttttcatttgtctcaaggtactttgtaatttcctttttgatttattttttgactcgtttaggagtgtattatttaatttccactggcttatttactccaaattctaaggatttagagtatcctttccaggaacaaagggcagtcaaagtctttattatacaacagtcacatagattaaccctgattcattgttggaggagactgtaaaaaggcctgaataccaggaggcagcaatcactggtggctattttggaggctggatagcacagaaaatcattggctcacaagctagcttacctaaggtgtccacataaatttttttttttttcttctttttttgagacagagtttcgctcttgttgcccaggctggagtgcaatggcacaatcttggctcactgcaacctccgcctcccgggttcaagcgattctcctgcttcagcctcccgagtagctgggattgcaggcatgcaccaccacgcccggctaattttgtatttttagtagagatgggggtttctccatgttggtcaggctggtctcgaactcctgacctcaggtgatccacccgccttggcctcctaaagtgctgggattacaggcgtgagccaccgtgcccggcctgttctccttttcgatcctcccaataagtcaggttttttagtagaaagttactttgtataatcagcaccagtaagcaagtaagtaacttcagccacttgaaagtacctaatgtgaggccaactttaggggaaatttatttgtaagttttgtgtatccgttgtatagttgcagttgataaatccagaaaactagattttcagcagctggttgtggtagctcacgcctgtaaccccaccactttgggaggccgaggtgggtgaatcacgaggtcaggagttcgagaccagcctggtcaacatggtgaaaccctatcgctactaaaaatacaaaaaaaaggtcaggagtttgagaccagcctggtcaacatcctgaaaccctatctctactaaaaatacaaaaaaaattaaaaataaaaaaaattagcatagtggcaggcacctgtaatcccagctactcgggaggctgaggcaggagaatcgcttgaacctgggaggcagaggttgcagtgagtcgagattgtgccattgtactctagcccaggcgatagagtgagactccatctcaaagaaaactaggttttctagattgtgtctaattatatttttagttcatgttggctaagcatttaagagccctactattcatgtattcaacagattttttttatttttaatttttttttttaagataaagtctcgctctgtcacgcaggttggaatgcagtggtgcgatctcgtctcactgcaacgtctgcccctcggactcaagttgtcctcctgccttagcctcccaaataactgggactacaggcgtatgccaccatgcctggctaatttttgtatttttagtagagatggggttttgccatgttggccagactggtctcgaactcctgaccttgggtgatccacccaccttggcctcccaaagtgctaggattacaggggtgagccacggcacccaaactattcaacaaattttcatcaagtgcttaccatgggtcacatgctattctgggtgcttgtaattcatcagtgaacaaaacaggatccttccagtggatcttacattttagacaaaacagtaagtgagaaatgaaataagtacctcttgtaaattcctagatagtgtcacgtgctgtggataaagggaaaagtagagcaggataaagggcagtgttgggagagtatctgtgtgtaggatgaggggaagatacaggtttatataggggcccaaggtaggcctcattgaagaaatgatatttagagacctgcaaggggactagttacgcagatacctgggggaagagtcttcccagtgtgggaacagccactacaaaggctgtaaggagcatgcctaacgtttcagaaagagcagagtccattgtggttagagcccatgatcaagctatggtcagaagagatcagggtgcagatcttaggaggaactgaaggtcataaattttggcttttacactaagctgctatttattcagccattctgagttttgttgttgtttgagacagggtctcactgtcgcccaggctggagtgtagtggcacagtttcagctcactacaacttcacctcctgggctcaagcgattctcccacttcagcctcctgggtagtcgggactacaggcacatgccaccgcacttgctaattttttcagtttttgtagagacagaatgtcagtatattgccaggctagtctcgaactcgtgagctcaagcagtctttccccgcctcagcctcccaaagtgctgggatcataggtgtgagccactgtgcccagacagccatcctcaaatgggttagttacatcctgccgttaatgatacatacacatatatacctgtgtgtaagagtgtataaattgaatagtcatgtctgagatatgaaattgggcattctgaagagaatataagcttatgatttgctagtgttattgcctaatattaagatatagattgggggacaaagtttatatatgttcaaggtgtgcttcctcccccatccagacggcgtcttgctctgtcacccaaggtggagtgcaggtggcctgatctcggctcactgcaacctccagctcccagtttcaagcaattctcatgcctcagcctcccaagtagctgggattacaggcgcccgtcacctcacctggctaatttttgtatttttagtagagacaggggtttcaccatgttggccaggttggtctcgaactcctgacctcgtgatcctcccagcttggccgcccaaagtgctgggattacagatgtgagccaccgcacccggccaaggtgtgcatttttttttacatacacttttttttttttttttttttgagacagagtcttgctctgttgctggtctggagggcaatggcgctatcttagcttactgcaacctccacctcctgggtttcaagtcagcctctgtaatgaagcagccctgctgctcatagggttctaaaggtgtacctgtggatctttactttttcttcttccatgctgcttttgcaacaagtgcaaattctgcactatttttcctcctgatttgattctggattaatatacgtttggctttcctaggctttgaataagaaccctatcttcaaccagaagaggttatttaggttcaatttacagttgaggtattttttaatgtatatgacagactgaaaatagtgggctagaaagactagttagcgaatcgctattggccatttttgtaaactaaaattatttaagcctttgacgggcatctgtgatgtatttattattgtagagcatacataacaaaactcttaaatattttacagtgtacagtttattggcattaagtatattccacattgttgtatacgcattaccattatctctagaattttttcatcatttcaaacaaactcagtactcattaatctccccatctccgctcccacagccctagtaacctctctactctaaatctctatgaatttgactgttgtatctgatgtaagtggaattatacaatatttgcccttttgtgtctaacttctttttgcaaatttaacagtttttagatttagcagcaatgaacttgatgtactttttaaaaaaaattttcagacagtctcactcttgttacccaggctggtgagcagtggcacaatcttggctcactgcaacctccgcctccaggttcaagtgattctcctgcctcagcctcctgaatagctgggattacaggcacccgccaccatgcccagctaatttttttgtatttttaatagagattttgtatttttaacatgttggccatgttggtcttgaactcctgacctcaggtgatccacccgcctaggcctcccaaactgctgagattacaggcgtgagccactgtgcctggccttgatttagtatttacatgtttacatttggtgataatggaacagtatatattttacttacagttatattttataaaataccgtttattgctggtagttgaaggtgattcagagtaagatatatatggttttgagtattatatatttagatatcaaatttggagtacagtgctacttgtgtttatttttgtttcttttttcttttgataggaggtgcaagcgaagatgcag[450 bp omitted]tttctactaaaaatacaaaaattagccgggtgtggtggtacatgcctgtaatgccagctacttgggaggctaaggcaggagaatcacttgaacccagggggcagaggttgcaatgagctgagatcacagcactgcactccagcctgggcagcagagtaagactttgtctcaaagaaagaacaaaaacaaacaaaaaaaaatgttttatatgcaaaagttttttgtatcatgcttgtataaatccagctttttttgtatcatgcttgtattttttttttctagctgttattgcttttctgataatagtactgaatttggtgttatggttggtcattttcttctagataatatgtaatccaaaatattcttttttttgtttgtttgtttgtttgtttgagacggagtcacgttctgttgcctgggctggagtgcactgatgcaatcttggctcactgaaatctctgcctcccaggttcaagcgattctcctgcctcggcttcctgagtagctgggactacaggcacccgttaccacgcccagctaatttttgtatctttagtagagacggggtttcaccatgttggccaggctggtcttgaactccggacctggtgatccacccacttcggcttcccgaagtgctgggtttacagatgtaagccactgcacccggcctattcttttctttacattttagatattgttttgagtcagcttatgcaaaagtacctgtcctaatctttctgtttttattttgtatttctaggtgtctctatgttgtctcctagagtgggtagtcctgcttcttttacccagttactttcccgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatcccagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgaggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggttttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaaaaaaaaaactgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgcactgaaatctca

SEQ ID NO: 365 - DNA, 2867 bp, Homo sapiens
cattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggtaagttggggtcggcttgcagtttggggtaccccgagggcggtgtacgtcggtaagattgtaacagtattactggaagacttattcgactgtcctgatgatacttgtaataggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggtgagaggctctctggtgtagggtttaacatggaacgtagttttgtcacttgaatgcacggaaattggcgttttgacagttttctacgtttaggtgttttatacactttagggtaacgttatcatgtcattgcatagggtggaacttaaatagaaactggagatggctgcttcagccacagtcctaacctagaactgcatttaaagcaaactgataatgcagaaacaaactccttcgttaagaaatgtctccagtagcagggttagcttaagtttcaggtagggtctagatctgcggttggaacagtactggagggttgtgaggtgcttgactgctctgatgaaatcactaataggaagtgccgtcagaagcgataactgacgaagactactcctgtctgattgcagtcaagtcttcaccacttgctggttcccaggagtaaacttgtttgaacggtgacctaattgctatattcacctaggttgcaaattcgtgaagaatcagcatcatgtttggcagctgagtattggagccaggagcctgccatgaggtaagccttgctctatggggaggctagtggctgaccacgcctagctgtcaggtcgaatattggcaattggatttggttaacctaataccttgtaacagtgtagcctatcccagagatactgattttagtttccggtggcagtggagccagggtggattacctagaaagaggggctactctatttacctcttggctgtttagtctcgggcaaattacctgtctgctgagatgtagttttcctcagatgtgaaaaggaaaagtaatcttagctttgtgaagtttaaattgatatgactgaaatggagattacaactcccctgaggctgggcacagtggcctgtaatcccagcactttgggaggctaaggtgggtggatcacctgaggtcaggagttcaagaccagcctggctggccgacatggtgaaaccccatctctaccaaaaatacaaaaattagccgggtgtggtggcgtgtacttgtaatcccagctactttgggggctgagccaggagaatcgcttgaacccgggaggcggaggttgtagtgagtcgaaatcgtgccactgcactccagcctgggcaacagcgagactccatctcaaaaaaaaaaaaaaaattacaacctactgagaagctaattaagatttgtagtcctcaataatttacaaaaacttagaaaaattacctctaattaggtcttaaggggcttttgttaggatggacttaaatttgtaaagtcattaattgactgtcatcagaaatgcctgtcctgctctgcatctgcagtctctaaggtgtatgcgccttctccattcccccaggttttgagaacagagtgctgttttagagctggcagcagcatctcagcccaagagaaggtaagccttgagctggccaatgatcccttcaaccccatagtggaatgaataaacagctgatcttgttaaaactcgcttcaaaaaaaaaagatatcaaatgatgaaatcacccaaaatagctggaattaccggcagattgtgtagtggtgaacctatggttttctgaagatatctcttaccctgtgattgactgtcagttggtgcagaaagtgagattgaaatgtagtttctttgcaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggtta

SEQ ID NO: 366 - DNA, 1666 bp, Homo sapiens
tttttctggatggttttcttatcagcttttcacacaacagtcaagtaaacctcgtggcactagccctagaaaaggaaaaacacgagattcttacaagactacaaacattacaacatatgtaaaagcattaaaagtattaaaaaaaaatattgtccttataacggtccatctcagaagccagatccgtaaaagtttttttttttcaacagaagttcaggttcgggataagatcatcacagataagaccaaggacacaatattcactgatctctaagcaaacagaaaaactccacttacagaaatcgttgcaactttggaacttccaagacaatctggcctctatcaatgggcagacagcgaccctcactgttggcagaaaaaaaaaaaacccaggattttataacacaactgttataaaatcacggcaacaaaatttactccacctctgaattactggtcttaatctcagaagccgaatccgtacttatttttcttcaggttatcagcttcgggataggtttcatcattgattagaccaatcagaccttgtatatgtacacataatacattaaactgcacttctgtgacactgactacaaaccaaggtaatgctaaaaggcaagtattatagtacaaatactacagaacttttaagccatacaacctacttcaaaatgaagctgctagtcagtcacattcgacattcattatcttcactggctactcgtccacactcagaacgctgttcactgacaaaaaaaatttgatttagtctaggtgtggattaaatgctatgctcaatcataaagtactaaaacaacacatacctgttaaaagtgtcaggttttaaccaagcgattttccattaaatattctcccagatgttctggaagttttttcgtgtatctaacaaaaaaaagtaaatttcaaacgatgcaacagttcctattcctgtaaatcaacaggtttactcctttagtttggaaactaagcttaactaagctcttacctttgcatcttcagagctgctccactgtgccactgaagacagcgccattgttcctgcgggaaatcggtatttaagcattctcgcagaaatgtcacactccaaggcgtttttccacacaaaacccttccccttcattaatccgaattgcacacaacgccgccttcgaacagctcagtttcaatacagggtcgaggcttcccattttaaaacaacgccgacggaaggccttcgccattttagtaaaggccctttgctgttaaaactaaccctccgccccaattaaggtggtttttccgccgccgctcaggcacatgccggaggccagcaagttcggcgcccgtggccgatcagcggttcctcacgccaaaactcggagcctgtggccgtcacgactcaacctcagtacatgtggcagtccggccgcacgtttcccacgtgcaagctttcaactctcagcactctaaactcttcactaagatgtcttcacaggattaaagctcttaactcggcctgcgccaccatcttttgctcggatactagcccgcaatacccactcacctaccacccgcccagacgctcgcgaaggccgacgtaaaagaccgaagtgcgcagccagtagctccttatatagcctcccggagtcagaacgaggccgtc

SEQ ID NO: 367 - DNA, 169892 bp, Homo sapiens
cccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggaggtgaggcgccccctcgccctcttcctgctcctgagcctcctgctcccgccctccccttcctaggctttgggctctggcgatgggctggggaggagcccacaaggcctaagacgtgatggggagggcagcaccctccgccccgaggctccaagctcccaatggccctggggtccagcttggcctcctgacccttggtccttgctggtgaccgagatgcacgaccttcacccccctcaaccctccaccgtggccaggagggccccgagccccgtctgatgtgccgcaggaggcgagggcttcccaggggcagcgtggagaccccgctgaagtgcgaggtcgggatgtacccgtgctccgccctctagagtccaggatggcatcacccacgggtcaactggggcgcagcctgcaccctccccagcagggccagggccagagtcgtgctgccacccactgggggctgcgctgtccccctgggcccacacgtcccctgctcctcacctgtcgccagccggtggcctctccactagggctgagggcttcctcgacacagggccggcgccaggtctgtggctgtccacgctccacccgtccctttggggctcaggcagtgcttttgggcgctctcctgggtggggtcttgtccctgccaggtggagcgaggccaccctgcccagcctgagcacatggccgtggtctctgcagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggtgaggccttctccaaggccggggtggggcgggtgggcgggcgaccggccgcggtccccgcgaggtcaccctgaggctctgcgcaggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggtggggcggcctgcagggtgggcacgggcggcaggggcagcctctgaccccagccccgaaaacaaggccggctgcttcctcttctcccagggcgggtagtgtggggggcgggcgggggtggcctctgacccggccctctgcaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggtaagaggaggggcactgcgtggtcagccgcgttgggaggagaggcgaggcggagcggtgggagatgtggggctggtggcccctgacccagttctgcttccacgaggtgcccctggcgtgggctgaccccgcgtggccaggccacagccccaatcacctccccctccctgggcggggctggagctggccttctcatgccaggaaggccacatcctggccaggccgtggggcgagaccgatgccgtcaccccggagcaggtgtgagcggcgtgtcgagtttgacctgggccgtggggcgagactgatgccgtcatccgcctcggggcaggcgtgagcggcgtgtcgagtttggccacactctggtcagcgggtctgtgcctcgacccccaggggcctcctcggagtgccccggtgcgagcaccttgaagctcccggagccctcctctcagctgaccctgggcagtgctgctgcccaccccccacccgcccgggagccacagagcccagagccagccccacaaggcctccaggggacccaggcctgccacccctgactcaggccctgtgcgcttcaggcatggtggagggggctggtccagaccctcctgaacacttcacgtggtccctacaggcaggagtgggcccttctctgctgcgcctgcctgtcttggtggcaaggtcgcggccagcgagggcactggtcagcaaggccccggtcagtgagggccccgctcagccatgcccccagtcggtgagggccccactcagccatgcccctggttagtgagaccccctgtcagtgagggttccctgtcggtgagggtccccggtcggtgagggcccccagtcggtgagggtcccggtcggtgagggtcccctgtcggtgagggtccccgtcggtgagggtcccggtcggtgagggtcccctgccggtgagggtcccggtcggtgagggtcccggtcggtgagggccccggtcggtgagggtgccccgtcggtgatggccccggtcggtgagggtcccggtcggtgagggtcccctgtcggtgaggtccctggtcggtgagggtcccggtcagtgagggtcccctttcggtgagggtcccctgtctgtgagggccccggtcggtgagggtcccctgttggtgagggtcccggtcggtgagggtcccctgtcggtgagggccccggtcggtgagggccccggtcggtgagggtccccggtcggtgaggtccccggtcggtgagggccccggtcggtgagggtccccggtcggtgagggcccctgttggtgagggccccggtcggtgagggcgccccgtcggtgagggtcccggtcggtgagggccccggtcggtgagggtccccagtcggtgagggtcccggtcagtgagggtccccggtcggtgagggtcccctgtcggtgagggtcccggtcggtgagggccgctctgccacacaggttcctcatgggtgcctcctgtggcgggggcaacatgaaggtggacgattcggcctacgagagcctgggcctgcgcccccggcatgcctactccatcctggatgtccgagatgtccagggcaccaggtagggccggcctggctgagggtgggtggggtgccggtgagactcgggcagtgtggttcagatcctcacccctgtggtctgcaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtatcggcaccgtggggcggtgtgcacgccgcccccgccctcctagggccgagtccttctctggagaacaagcctgtccctcctgctgacctggggtggggcggcttgttcgtggcccaaatgggacctggagcttcagctccaaggtgccaacctcagaattcaggtccacccaggtcagcagattccagcgccctgaagagccggccctggagggcttcctattataggcctcagggatgggcccccgggggccgggctgcaagaggacggtgacggagcagctggcacctgctggggtcaccggcctgtggttgcggtaggcgctgagccacggaggtgtgggccgtggtaggctcagggccccgtcctcccgccacctgcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggtgggtgctgcggggccccatcgggctgggctgggctaggctggcggccgtgaccacgcgtgaccctggcccgtggtgtctggcgcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccagggtacgtggcccctaccccaggctcatgccccaggcccacggggagggctgcggttcacacgcccgtccttgtagcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgaggtgggtgggggtcccgggggagggtggcgtggggcagggggagtatgccccagcacctcccctgccccacaactgccattcctgtgcccagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacaggtgcgcccccgcccctgcccccccacccctgcacaggtgccccctcccctaccccgctgcacccacacccaactcgtgcccccccacccctgcacaggtgccccctcccctaccccgctgcacccacacccaacccatgccccccccacccctgcagaggtgtgctcatacccctgcccccacccctgtacgggtgtttgtcaccccactcctgctcctgcccctgtacaggtgggcacagccctgcccccatccccaccctgccctccacaggtcctcaccggtcccctcccccaggcaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtgaccaccatgcctggggcaggggctgtgcacagacggaccccccacccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaatcacgcctcctcctcctgctgttgccccgcgcagggccctgtggaagggcggggaggttgcaggtctgaggggtaggccctgcccaggcatcccgggcaggcggacgggtgggggcccctggagatggccgtggtggggtgactcacaagcttgtaaggggcagccggccctgccaaatggacgcagccaggaaggacggagtgactgggcgggggcaggggtcagaccctgcggccgcagccccagggccgggaaggactgggcagacgggacagcagcgcatgcagcttcttccagcgaggcatccgcacggggggctctgtctgaacccatcagtcacccggcaggagcagatggagtgagggggcgcgtggggagaaaagtttcctgtcccctcccagcctcgtcccagggtggcctctgcccccacacgggtgctgctgagcaaagcgcccgctcggaggctctgctgtctccctggacggagttgggggctggggtgcggccggcgcggggtaagaggctgtcacgggcagcgtatcgaatgtgaaagcaattaaagccaccagcagtgttcgctccgggcgggcctcgggcggcggggagctgccagaacacatctcacctcggtgcccgcggacgccggccctgctgctccgcgactgcgccacgtcacactcctcctgtgggtgggggccgggctcgtgcccgctcctgtttggcacagagctggctctgtctagtcctggggtatctgggacccccgttcctcccgagaccctgctcctctgtccctggccccacccccaccaccacccacctctctggcttctgccaccccagtcctggggtggcccaggacagaggcccacaagaaggaccctccttcttgcaggagtcccgcacagcaggcaaggggtccgtgcccaccccctcagctgcccagagtccccactagcccagccagcagcctcctctccacttgaaagcccccgggagcagctcccacagggaggtgatgagggaaagggggggcgtctgcagaggactcagggtcccacagcacagaccctgccaggtgttgggccggggccacgtgaggggctgctgcggaggcctggaggaggcggctggcagcaggtaaggggaaaagatgcgagcgtcctgcaggcagcagggaggattggctgggcaggacacacagccctggcgcggggcagaccttggtggcagctgtcggggctgactccttcccactgtcactgcccggcccccgcccagccctcccctcccttctctgtgcaggcctctcccctcccccgcatctcctcctgggtctcacccccaccaacagcaccatctctctggtgtatctggtctgtcccagccctgtgcccccacggtgccctctcctggcccctcttgttggcgctgctggccacagccttcccggggtgggcagtggcaagttctcacttatgaggcatcgctgtcagaagcatttagtgtacaaattagccgtggcctcctcgcctccttccacagctctgggctccaggctgactgggccgcggctccaggccctctcccgcctgcccggggcgcactgctgcccagtgtggacccctggctgcctgcccatgtcctggcaggagtgcccgctccccactggccggccagggctcctctaggaccccgacctagacctgggcaggggtggccatggcaggccgggggtgctcagtgaggttttggggggtgggaggccaaggcccaggacccggatctaccccaacagtggccagccctggtgctgagggctatgggggggctggacatggggccccaccaccccacctgccagttggaggccccgccaccccgcccgccagcccgcctgccactcaggcggggaaaatcatctgtgacaggcccaggaaggccagccccgggggccgcagagagacacacacagctcctcttcccaacatatggctgctgtcggccccgggcgctgctggccagtgccaggctcgggagccggtgggggctcgagcagcctcagcctcccgtcccacccgcctggctggctgccccctctgtcagtctacatcccagcctcctgggacggggctcactcccaccacagcagctcagccctccaaggagcgtcctgtaccctcctccgtcccagaggctcaggacacacagagggtcagccccgcacccggcccagggtggccagtgacccggcacgtctatgagagtgtagtgcatggggaagggcccagctggggtcttccagagccgggaggcgggtggggaggggactctctggtgtggactctgggatggtcagggctgctggggaggactatccctggtagtgctcgagccggaagactcctggagcccccattcaggcgcctcctaacagggcccccgttccctcaggtggatggacccagggaccccagagctccgcaggctcttcgtgtgccccccacacccttgggccgttgtcctgggcgctctggcccactcggttgcccagccccctccgttctcccctggcacccccactgtgtacccgcccatcaaggccagcagcctcaggctggtgccgagggccctcacgtgtatccatgaccccttccgccaaggctgggctgcccctctcaaccagggatcctcaagtgggcagcaaggaggaagcccccaggaggcctatgctctgtagacctggggttcttgaagtgctcagggtggccacaggccctggggtccgttattgaaaggacagacatcagctgtgtccggacaccttgcaaggtactgaccccacgtgggggctccaacctgctgccgctggatagattgccccggtctcaggacctgcgtggggcctccagcctggctgcagccctgacactgccctcactgtgtgggtgcaggcaccccggcccctgcacctgtcctgacactggctgtgtgtcgacactgaggggatgagacaggcctgcccccgggcactggccatgccgagcgctgcctccgctgccttctctgagcccagctctccgtcctgcccgtgagcccccggcacagagtcccattgttaatggaggtgacaggcgggcagccgtgggcagaccgggcagaagaggttaatggccaaaaatgagcttctggctggaggcagaaggaggggccatggggtccccatcccaccctgcactgggactggctaaggagacatcagggcacccactaggaccagagcagaagtgcccggacactgagcaccccactgcccattctgcagatgggggccatgggccagaaagttgggggggtgggggcacaggtgccaaaacagagtcccagtcactgcctcaggaagcagaagccacctctccaaacccaaagtcagcccagtgtgcaagagctgggaccaagcaggtgggtcatggccacagtgaggaagctgacgtgcccagggggccctgtggttgcggggtgctggcactgatatcccggcctcgcctggctgtttgtgatgggaacagtcatctgggcacccagtgtactggcctcacatgctcctcaccccccacctcgtgcacggctgaatctcaggacccccaccagcaggtgcagggccccctcatcctccctgccagagtccttccgggaggccagaaacacgtccaagttgtgccccggggcccctctcgaggctgcccctcttctcttctcatgcaaacttctgcaaaggcccatcggtggtgaggggtggaggtgctccttcagcctgctcagcgctagacacggccttgttccccctctggggctccttggtcccctgagcttcactgggctttatttcctgtatgctgacatctaggtgctccaagaccaggcctccctgctccctactttcctcccctggacaatggccagagcctccagccagttggtctcctgtgctgtcagctgtggcctcttccagaccttcaaaggggtcagtctcgggctggccactgagggactactggtgtcagggtgaccttggaccctagtctcccggggcagtgctcagctgaacacgtccagagtagagtctatgtacagaagcagccggcctcctggcccccgctctccacggggctgctggcgtgacggcagcccaagctgtctcccggcccggagctgcctgcacggtcagctggtcagctgggccaggccaggtgggcagagagaaggctggcatgctctgccatccacagcacccctcccagtcccctgccccgccccagggacttccctcagacgggcgtgtgcggctgtgtcagggaaggtggcatggaggcaggagggagacagagccccacgcccaccccagaaccaggggctgttcctcatggaccctgggtgtgctctaccagggggctctgccagcagccggaccggggccacggagatgctgctgagctctcttctctgccccattcgaggggtgacacccagaagccccgtggggtcctcccttcttccccaaggcacccctgaccccgacctgagctggggacagcccgggagcctgcggctgagcctgcagagagccccaggtcctggggagctatgtgggccgggctccctgtgctgtttcagagtcagcagggagtagcacactcccctctggctggagaccccgagacgcccgcctaccgcaagtgtcgggtttaggacgtctcccctgagcgaagtcaggggctctgccccagccatgcctgtgtccgggagggagcaggccggtcaggcgaacctcccctaggccccagctgagcagtggggctccaggcctttacgttctggcagctcagggagctgcttggaacttggtgcagcccgggaggtggggctgggagcagccctggccctgcttctctcctccaccgccccaggtcctctcaggaggggactcccgtggggagggggtctttcaaacagcagggaagtgcgtggcctcgtggggcagcgctgaggcacctcccacaggagccgggagtgagggctggaggggtccgcatccaggaagggggagggtgctggagaccagccccaggtggaggcggtcagccggcagggcggggtgcgaggggccggtccgggcagcctccggtttagaggaaaagagaacggagggcagggctcgcccagggagggcaaggaagggagcccggctccgctggctcagtccgcggcacccctgtcccccaggacagcccccaggggccctggctcgggtgggccggcggctgtcaggggccagagccctgatggataagcgctgacggcccctctcccgcgccccgcgccgctgacacccatcacgccgcggcggggacccgggagacctggcggcctctgtgcacccccgcggcagcctgcgggcaacgggggcgggaggcgccgggcgcccctgactcggccgcacacctgcgccgcagtccgctctccgtccgctgcctcccgggttcccggccgctccaccgcgcgccccgagagctgagccggtcccggcgcacgaggccggtgagtgcgcgccagggggcggcggggggcgcgcgggcggcgggggcgcggggttcgggccgggggctgctccttccctcccgccgcgagcgcggtcggaggtcgcagcgccccccggagcccggagcccaggcgcacgcgcgcccgcctctgccgccaacttcgggaggtgcgagcggcgtcggggggacgcgggcggcggcggaggctgcgggagtcgctgccgctcgagggaccgcggacccgggaggtccggctcccggcgccgggcctcagtttcccccacgggagccgcatcccacccccagagccccagcgcgtccgcggggtccgagtcgcggccggcgcggggcggggaggggcgggaagtttgcgccctacacgcggcctcgcagacttggcggctccgctcccggccgggcgcaggtaggagcggcgggagccgcgggggcggccagttgggcgtcgcggggccggctggacgcggggcgcgggggcagcgggtggccaggcgtgtggggggcgcggggggcggccgggtcccccccaccctcttctcgaagtccaggagcagcgcggggggagggagggccgccctcaggggccaggcggggagggcaggggccgggtctggggtctggggcagacgcctgacctcgcgctcgccgcacccgcctgtgtggggcgccctgcgttcccgggggggggggcagcaggatctgcgggtggccgatcagggtccccggctgctgggtgccccctcctgccctgtgggggtgcctgtgccccccgtgccaccggttctcccccagctctcccccaaacagggacaggtgagtggggccgggtgtcggggcctggcacagggctgctggctgccccgggagcgattgccgggtccggctgggacgcgcgtgtgagtgcgtatgcgtttgtgtgtgcgtgtggctgctgtccaggggtgtcttttgctctgtgtacacacaccaggtgggtgccagctatcctccgggtccccaaggggtcagcagctgctgagacagccccttggacaagcccctgacccgggagcccccggtccctgctgggaggcgggatgggttgtggcatcggctggcacagctgtgtggctcccagggctgggtgatcgatggcccggcacagccgcctctgtcgccggagcgcccacacccatttgtcatccacatgggtggggggggcggcgggcagggagaaggggccgcctctgcacccaccacccagtccaggccgggtctgcagcccctcggggagccccaggacctctcctggcccagcccctgcctcccgaccgccaccctgtctcagccacagaccagctggtcagcctctgcctgcccctgcagcccgtgactgccctgcagggccccaagcctttggacgagtggacttctccagccctgttggtcgtccccccaacggcaccaacacagtgttttgggggcagcagacagcagtgccccagccctaccctgctcaacccactggccatgcatgaccacgggtgcgacccccagccaggtctgcgtgtgtcctggggagtcggtgtgtagggcctgtgtgagcatgtgagtgccgtgttggagtggtttggaaagcccccccacacctggatgggtggtgagtgtgttatcacggacaagcagccgtgttcaccgtgatggagtgtgaggtgtgtgcagccagggccccgcacttggtggcagactccgttctgagcttaggtggcacagaggtggcttctccgggcactgggtgagggctctgtgtgagcctgtgggctgtgtacacacacccaaagcccgtgtgcgcaggcgtgctgtgcaccccacacaggcgcgtgctggggcggtggacagcccaggtggcggcccagatggagtgtggcgcgcataccagcgccgtgtggggcgtggggaggagcgggtcttggctgagtgtggccgctgcaggctcggccgctgacctgcccgaagccacccagatggagctgggctgagcaggtggctgagccgtggggccatgctgggacgtccactccccacagcctggcctggccccacatgagactgaccccctaagagacccccagtgcccacctgacgccctgctagagcaggctctgtgccgcctttagacacacacgcatacacacgcactcacacatgcatgcatgcacacatgcacacacaatgcacacacgtgcacatgaacacaagcatgcacagaggcacatgcacacacaggcgcacacacgtgtgcacacacacgcacatgcacgcacacacacgtgcatgcacacgcacacatgcacacacacagacacacacaggcacacacacacacacgcagcatcatcccacacagacccttccgttggtgtctcatctcagtgccttttcctaggctttgaacaggcagattggcaggggccagggttgctggagggaatgagaccaggaggctgacgtccacccgaagtgagctctggtcacgctgattcttttagccactcacatgctgtggggagatgggtgtgggctgaactatcctagaaattggccagcaagtcggcctggcctcaggggtggggatgtgtgtagggtcaaccgataaaataaaggacgcctagttaaaatcgaatttccgataaacaatgaacacctttctagtgtgcctttccaatattgcctaggctacacttaacactcagaaatgacgtgctgctgatcggcgtcagatgcagctcgctgtcctggacttttttttttttttttggtgccctggactttgctgccaccctggaagtgcacgtggggaggagccgaaggatggggctcggggggcacgttgcagggcagaggcggcggggtggggggagcacccaggctccagtccctggagcctggggagccatggatggagaggagtggggagttagtcagaggcaggcttggcactgactgtggccccatctacaggtggccatggtgcccggccctgcctcatagcaggctgccatgtcgcgggaggcgggctcatgccgcgtgggcacaggggcgagggcgcggtctcggaagcccaagaagccacactacatcccgcggccctggggcaaaccctacaactacaaatgcttccagtgccccttcacctgcctggagaagtcacacctctacaaccacatgaagtacagcctctgcaaggactccctgtccctgctgctagactccccagactgggcgtgccgccgtggctccaccacgcctaggccccacgcacccaccccagaccgccctggggagtccgaccccggcaggcaaccccagggagcacggcccacaggtgctgcccccgcgcctgacctcgtggtcgccgacatccactccctgcactgtggcggaggccccaagtccagggccaaggggtccccagggccaccaccccctgtggctagggccacccggaagggtcccggccccagtgggctcctgcctgagtcgtggaagccggggatgggaggggacccaaggggcgtgggtgcgggggacatggcctcagcaggccctgagggcagcgtcccctgctatcccccgcctgccccaggggagttccctgaggcccacagcctccacctgtctctgctgggcgtcaactacccgctcagccccggcctcttctcctacttggggccctcactggccgctgcagcccatgtgcccttcctggcctcggccagccccctgctgcccccggccacggccttcccagccgtgcagccccctcagcgccccaccccggccccccgcctgtactacccgctgcttctggagcacactctggggctgccagcaggcaaagctgcccttgccaaggcccctgtctcccccaggagcccctctgggactccggctcctggcctgctgaaggtgccagttccagggctggggccctggccccgagtcacccccagggacccagggcaggagggggagctggagcgggcagcccagagtgaccccaggaggaggctgtccctgggaagcaggctggagcttccgaaggcatcccccagcctgacaaggttctgttcccggagcaggtgggcgtcttgggctcccggttcctggggtggacggaggggctgggcggctgggcatggcggttgggcggctgggcatggcggctggggtccgtcctgagctcagtcgctgggaaagtgggctccaggccacagaggggaactgagacccgagagccagcgcgggggtcctcggggtctccaggagagcctaggctctaggctggggccacagggcagaggccgtgaggggagaggggcaggggccgggggcgctgtgggggcagtgcggcctcctgaccagcttccaccccacagcctgcccaccggctcctctgtgatgctgtggcctgaggacggggatccaggcggccctgagacccccggccctgagggccccctccccctgcagccacggggcccagtgccaggaagcccggagcatgtgggcgaggacctgacccgagccctcggtgactacgccagggtggagcagcgcctgggacagttggggcccgcggggggcctggccccgagacccctgcgggagcagctgggcaagatccgcctggagctgctcaccattcaccaggcgctggagcaggccgtgaggccgccagacgcacccctcgacctctctgtgaaacgtgcgcccgccaaggggccccaggctcttggagaggcgtgggggcggcccgagctgggtcccgtgttgaccgggggcacccccgagccacccggcatgctgggccctgcagcgccccaacccttctctggccacaccaccaagtgtgaggccgactccagcgtcccacccccagggctccccctcgcagccccagatgaccctgtcattcctggcagtggctggggcacctgtgttgcgacgaggagttcccagacccctgaggctgtctgtggcctgcagagcccccagggcgccgaggtctgacctgcagcgcctgaggtctgactgtctctgcctgcagcatgccggcccctctcctgcagcccctgcccctcacctgcctgggacctgccccgcctccgcatgcatgtggatagacccccacgggccgtggccaacgcttgtccctggggccacacagggacactggaggtcacagttatttattgatcacaattgtggacattaaaacagaaactgttcacacacgccgtctgtgcctccttcctttggggccctagtgtagccacctggacacccccctaaggaagtgtcctggcctgggaggcctgggtgggcagcagtcctgctgggcctctgtcttcagactcggccctctcctgtgggctgggccctccccgcggggctggggtctgggggtggggcgggacatcggcgacgggagctgagccaggagagccgtgtggactgggctgctcggcctgtgtcttggtgtgtcgggggtggagaggcgtgtggactgggctgctcggcctgtgtcttggtgtgtcgggggtgggcacggacccctgaacatcctctagcctctgaatccagcaaggccgcgctcatatcagctctcctgcggttaaacggtggccccggggctctgtggctggaggctgctcacccagcgtgggctctgctggcccctgccagcccctgcagccgtgataggtatcagccttcacagctcactgcctccctcccagcagggcctggcttggccctcccacgggcaggggatgggcagacagggaggggcacccgggacccccacagcaaatcacttctctcctgggagagctggccacaccctccacgcccaccctggaatgggctctggagcccacatcgcccccccaggaggagaagcagttcctgcctgcgtccagccgggctggggccagtccaagcaggctggcagcggccccattaactaccagggagatagcatcagccccgaccctgcctcggggcagctagagctggggtgctgcctggccaggcgcggagtgctgtggggacaggtcccagccgggcccctctacccagaggcttcctggaggggctgcagggggctctgggcagccaggaactgttcccaagtcccgagtctgagggagactccctgtcctcagcccccgccccccatatgtccactgcaccccatatgtccactgcacctcagtttctcacccccactgagcagacaggtgagcatggccttgctgggggcaacagcacccgtctcccaggtgtggagacacgacctccttcgctgtcacccgtggggagcaggacaggcctcatggagggtgcctcagccagcaggtcacccgcctgtggtccagacccaaggaccctgcttgggggtggcagcctggggctgccttgccacttggagtaatgaacttgctggttgtggggggaccatgggggacccctggaggggggtgggctgcatggcatctggccgtgtaggggacgtgggaatagtgtccgggcagagggcgcagcctgcaacaaggcgcggaggcaggaacaccacagcatggggagtcctcaggggacctggtttttctttcatagaagcttcaggggccaaggccggagactgcactctccctcctccacccggcccagctgcgtccctgccagtggctcctcccacttcctccagttctagtttccaacaacagaggctgcagccacccagccccgaagcagggcccagcgagacagggcccaggtaagagacccctccccccggcctctctcggtggggcaggtggaggccctcggaataggctgcctcgcccctaaggggtcagaagtctccctgacctaggggctcgggtagaagggctgtgtgtgggtgaccgcccccccgccgtagaaaggggttccacaggcagatggatttgagaaatgttgcttatctgtctgaggcccatgagctcatctggggctcaggggaaaacccacagcgagctccacgggtcatgtgtctcccagactcaagtcccaggcacctagacactagggtggccgctgggcttggtggccaggtagaccctcaggaccaggaggacccggcctcataggaagaaactggaggagtgactttgccattcccacacacagtggggccttattctctctcttgcagccccaagcgtgacccagctgcagagaagctgagacggtgattcggactgactggactctggcctccaggtgtctgcacctcacactggacccacctggagactccacgggctcccggcagctccggctgcttgggtggatccgggtgcccgcaggggctgtgggagggccccggggcctgcactgctcccccgatggcctgctcttcctcacggccggggctgcaccctgtgtccacgtgctagatctggagggacgccccatctgcctcctgccctgccgcactccggggagcggggccttcgttccagaggacgtggctgtgacagcgtcagggcttgtggtggtcagcgatcccatccatggggctgtccatgcactccagcacacagcccgggaccccgggggccactgggtgacagtgggcaccttcctgtctccccgagggctggctgtggatgccctcaaccgcctcctggtgacggactacttgcctggggctgtgcacagcttctcgttgggtcctgcttgggagcccctggccccagcctccatgctgggtctggagggcccctgctgggtgggcccagggcctgatgggggccttgctgtgagtgaggagtttggggatgtgaggctgtttggcagtgcccgccaacccctgggctccctggggggctggacggggcacactttcggctgcccagcgggcatctgctccaactcagagggcaatgttattgtggcagacgagcagaggcgccaggtgaccctgtttccccgggctgggccacccatctgcctggtgtcagaggggcttgggcagcccttgggagtggcctgtgcaccccagggccagctcctggtggctgatgccaaggacaactccatcaaggtgtaccagggcctcaaggagctggcctgacctgaggctgggttggagcagccctcctgtgcctgaggccagctcccaggcccttggatcaccgcgggaggaaccctcaggatgggtggagcctccaggctatgggcattgcctgcctgatgccagcaccacctgggctgggccctgggcttggctcgagttctcctgctggtgaggctccggatctcaggagcagccctgagtctgcttcccaggctgcccctgccaggcctgcagcctccccagccagggctgctctctgctgtccccattcagtgccctggcccctgcattcatgccccccacaccccctcaggccctgtgcctggactttggggctggcagctgaagccttgagatcctgggccagctgccggcacacagctaggcagactctcccaccaggtgcccctgcccaggcctcctaatcgggggcagacaggcagggagggtgtggctgggctgggctgggcggggcggcctggggcaggggtgtggcccctaaatgtccccaacctcagagggacctagagtcctgagcctccagtagcttctctgggcctggcagaggtaagggggaggcaaccctggagtgtctggaggcccatggctggctgaaccctggatgccttttcttccgcgtccccatgaatgaaagctgtctgggccttcattctgcagacagggacaaacagctccatgctgtttgtcctcccagtgcagccgtgctgggagggtctgggggagcttcctacaaggagagactcctgctgctttggaaaactgagaaaaaataggggtctaaccctctcctcccattttacaagtggggaaatgaggcgtgaaaggagaggcgtctgggttactccgtgggtctggggtccagggaagggcctgtatgggggagggagctgggaggggacggtgtctggctctacccctgtggggtggggaggtggggctcccctgtatcacaggacatcccccctgagaggtccctcatatgtctgggtcctgtgggtgggggactaactgcgcaatgtagttaggtgctcaataaacggagttgccgctgaggtctgggctggggtcttgttcctgggatcgggaggggctggacgcctgtgtgttctctcctgacgatcgctggcggcagcctctgggctggtcctaccagggctcaaaattcccggcaccactggccttggggatctgggggcggcccctctgcagacaacagagtgacgggggcgggaccgggctggggctggggccttcctggaatcccgcagggcctggggacctgttcacttggggaggctgggagccaggcggggtccgggttccacgaaggccaggtccagtcagtttctcaggtgaggaaaccgagctgacgcggggctggcggcccggaggcaggctcgggaggtccgggcctggggactgggcgggcacgctgcgccgcggaacgctcgggtcgggcgggcgggcgggcagcccgggcgcctttgggggccggaccgtcgcgcggcaacgcgcggagccggcggaagtggggctcgggtcccgcggcggggctggaggcagcgagcgccgtcgtctgcccgggcccgcccatcggggtccccaaccccatccggaccccgccgcccgagcgcgcggccccggaagcacccggtgagcagggggggtgggcggcgcgcggcgggacctcgggcagcgcccctgcggctccgggcctgggctgggggctccgcactcccgcccgcggcgccgctgctttctcctcccagaagtggggccgcccccgggcccgcgccgacctgggcccctgtggaccctgtgcaagggcggtcggcggcccgggcctggctgtgggcccttcgcagttgtcccggtttgcaggaaagggcaaaaaacggaatcgtaggctcttcccaaatgagaggggaaggccctgcttgaggaaggcaagcaagtttgtttgtttgtttgttttgagacggggtctcaccatgttgcccaggctgaactcgtgtttgtttttcattatttatttattttgagagggagtctcgctctgtcgcccaggctggagtgcaatggcgcgatctcgggtcactgcaaccgctgcctcccgggttccagcgattctcctgcctcagcctccccagtagctgggattacaggtgcccaccaccacgcccggctaatttctgtatttttagtagagacttggtttcacccccatcgaggctggtcttaagctcctgacctcaagtgatccgcccgcctcggcctcccaaagtgctgggattacaggcgtgagccaccgcgccaggttggtgtttatttttcaaacaaggcgctgggaaacgcaaattctccagagctcttgtggagcggtggcagggaggggcggctcagccagagatggccctggcccgtcctaactgggctggggtgcccccattccctcattcacggggaggagagggaagtcttagtcttactactttatatggtcgacctccctacctgcctggtctgggaatggcttctcaagagcactcgggctcattcttagcagaggaagctcttctggctagcctggcgcccgtgtgtgtgtgtgtgtgtgtgtgtgtgtgtgtgtgtgtgtgtgtgtgtgtgtgtgtgtgtgtgtgtgtgtctggctagcctggtgcccgtgtgtgtgtgtgtgtgtctggctagcctggcacccgtggctagcctggcgcccgtgtgtgtgtgtgtgtgtgtctggctagcctgtgtgtgtctggttagcctgtgtgtgtgtgtgtgtgtctggctagcctgtgtgtgtgtgtgtggctagcctggcgcccgtgtgtgtgtgtgtgtctggctagcctggcaaccatggctagcctggtgcccgtgtgtgtgtgtgtgtctggctagcctgggacccgtggctagcctggtgcccgtgtgtgtgtgtctggctagcctgtgtgtgtctggttagcctgtgtgtgtgtgtgtgtgtttgtgtctggctagcctgtgtgtgtctggttagcctgtgtgtgtgtgtgtgtgtgtgtgtgtgtgtgtctggctagcctggcgcctgtgtgtgtgtgtgtctggctagcctggtgcccgtgtgtgtgtgtgtgtgtgtgtgtggctagcctggcgcccgtgtgtgtgtgtgtgtgtgtgtgtttcctcagtctttaaagatgctcacgttgctttctcccgtcccatacctcctctgctatcgatcgcttctctttcatcttcctctggctgtgtgatcccagcagctgctagtgcaggcttctttgtgccgccgaccgtcccagaggctgaggtgggagtgtgatgggcgtttgccccacagtacgttgagttttctctcactactcgacagagaagagtagcttctgccctcccatctccttcggtagacacaaggcactttttttttttaaggtaaactttgtagatgaagcacaaagaatacacacaaagaaagcgcacagatcgtgagcacgtagctcggtgaatttacccaaagtgagcccaccgcagaaccagctccccctagaacatctgtttactgttagacccattgtgtttcttttccgacgatatctgtgggcagttttccttagtccctgtgaaagctcttccccagcagggcgtgatgggtccctgggctgagctggtgtgaaaggtgggctgtactgggtggtcccctatggtggtcacacagccagacacgctgggccccttgcaggcagaatcactttgtccctctcacgatgtccttggtgcctcacgtcagctggcctccaggcatccacccgccgcctgccctctctgaccactgaggaaatgggcatttgaggagttctgcagcctgacccagaaggtcccttttcagctagaacccaccgccttgagtgactggatcctccagccccagtgcgggctgcctgcaggggaggagagcagctgcaccaggggcctcttaagccccaggcatttccgtgtgaggcctcttccagagcccctccaagcttcgggagaggacttacaggtcacaccaccccgacgtgtgcatcctgctctgttccctcgtccctaaggatgtggtgggctctgagacctccaggcatcctggtctgttccctcatccctaagggcgtggtgggctctgagacctccaggcatcccactctgttccctcgtccctaagggcgtggtgggcactgggacctccaggcgtcccgctctgttccctcgtccctaaggatgtggtgggcactgggacctccaggcgtcccgctctgttccctcgtccctaaggatgtggtgggcactgcgacctccaggcgtcccgctctgttccctcgtccctaagggcgtggtgggcgctgggacctccagacccaggctcaggccaagctatgtccctccctcgagtgtggctccagcgtggggggtctctgctcagggtggccgctccactcttcgtgcaggcgagatggggctttctgtgtctgaggaaggcgagcggcccagccagccggccagtagtgcccccaccgctagggagtcctcctgccctgtggggccccgccagggaaggcatcagtggagaaggagccccagctggctgcatggctccgcaggggcctgtgagaaagggggaggagaggcccagggcctgggaaccgcggtagctcaggtggcttcctactcaacagccaccttggaaggctggtgtccctcagcctgagagtgcaggatgcagtttctccacacctccgggacctgtaagcctctctctccccgtttctaggcacccatgtcgttggagaaatatatcctggagagaaaatgctccctgagggagccctgccctggggtggctgtggggatgtcagggagggccaggcactgccgggtgccaccgtgggcgggggtcagagtggaggccgaagccctgtgtgccctgagcaacgaggcaggtccttcctgcccccagggaggggcttgtgggaggcagggaccttctggggggctgcccgccgtgcgcacgaggtagtttccacagcccagcagcacatcattttacattttcatctttattcttgcttaatacgtgaatcatggtttgtcaaggtttcaattggcgtgaccttgctaatgagattgtacagttctcctcgtgctacacctttaagcacacctctctaatcaggtttcttaaaactaagaagcctggagttcggttcggccccacagccgcgtcaggtggtgccgaggaggccgtgccctgggccggcctggaaatgggagggcaggcctggtggctgcatgtgcgtcctgcctcgtgcgggtggggctgagctgggcctggggtggacttggggccagcactctggctgccccttggagaagcatggcccacgcgaggcggcagccaaggagccctacggcgtccaccaccgaacttgaagctgaggtgccccgacctggggccctgtggctgcacctgtcaggccgtctgtgcaacatcccgcagcccacggtgggggggcagcagcagctctgagccgagcctctcctcttctcttccagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccggtaggtgtcccgggacaggcaggtggcaaagagtggggtcccatgagtgctggcccatccctttgtctgcagtgggcacagaggcccagatgcgctcttcctgggcccgggccccctcccactcctgcagcccgggctttggccccatcctgctctcccaaccctcgcctctcagagggtgtccctcacccctggggtagagccaggtctctgggcagcctcagggattgccaggggccctcccagaaggtgtagagggtgaacctcagtggcttaggtccctgaaagagaaatcagaaggtgagcacagacatgactactgctgcctgggggtgctcctgagggcacacaggcccgctggcctccctgtagccctgcctgtgcccccagcaggcctctggacactgcagcgctcatgggctgtgggggtgtcatccacttgctggccccgtgtgcctgggggagtggtctacaggccctgcttctctccacaatcacaggtgctgctggccaagggtcagttgaagcccaagggccctgaggggcacgggggtagccccgagctgtggctgagaacagagggcccccttccacaggggacctcatctgcctggcggaggtgccccatggggagcagctaggggtcacctgcagttgccccctgccttagacccgggggtgcatactctggaagcctggggtgagaagctaggccagcccaggagaccccgggcagctttctgggccctgtcggcggggcgaggccctgggcccgtgggagttgctgctggctggcaggcgcttcttggcaccggctctgggagcatgtggtgaccaggtggcccggggtcagcacctgcgaggaggccaggctccgtgttagtcacgtgcactgtgaggtgggcgcgttgagcgctgcctaccaccacctgggccaccgagggcccctcccacctgccccctgtcctgctgagctcaggagtgtggcctgggtgtttgtggtcccctgcacagtgggggacggtgggaggaggatctggagagggacacatcactcctctccactcccacgcagagtgttcaagctctggcccctgtccttcctcgggagcaaactctccacgtgcgaacagctccggcaccggctggagcacctcacgctaatcttcagtacacggaaggcggagaaccctgcccagctgatgaggtgtgggcctgccctggtctctgcagggctgggtgcgtgccctctggccccttctccatccccctctgcaccacgctgacccctccggccaggcaggcctcctcctgcggccccaggctgtgctggccaccctcatgccggccgggccggacctcccttccaggaaggccaacacggtggcctctgtgctgctggacgtggccctgggcctcatgctgctgtcctggctccacgggagaagccgcatcgggcatctggccgacgccctcgttcctgtggctgacgtgagtggactggggtggagcccggtgtcccgggtgggcgtggggacccctcctgggcagcagagccttcccgggccagagccaccgccccacaaagccagttctaccttctccatgctctggagacacggccctcccctgaaccagaagcaggaactccaggggcgctggggcctgggcagggcaggcctcgcaggtacacccccctttccttctgaaggggctgtgtgcaggagccagccgggctgaggctctggggagcccgcctctccctgtgggcccagcgtcctggtatctcccttgtggtccctgagatcagcgttgccctcctggctctctggggccctctgcagagccagggtcatgaaacctttcctgtccagggaggcccatgtgcagcccagctgggacttcctgccctgcccctgtgctgattctgtaactcctgtgctgagagccagaggcacagcttgtctcccatctcccaccttccctgcatggtctgtgccccgtttccagccgggtgcagccccctcctctgcagatctagtgcatttccatgctgcctctgggccttcagcttctctgtcttcctccctcagcaccaaagccccgtctcttccattaggagcttgtcttcctgctgggggtggtacctgactctttggcccaccctcgggcctctgtggaggcctccttgaggcctgactgggtgggtcttgtgtgggctgcaggtgtgcactgggcctgcttgtggccaggccaggcctctgggggcagcatcaggcacgtctgtgtggctgtgggggtgcagggagctccagcccagaaggaaggaggggcggggctggggaaggggctcggcagctttgcctgtggtcgtccgcacctgccaccggcctactttgtcctagacctcccttttgcaaaagtgctcagaaatataaatatttaatttaaaaatgaaagtctcttcctgctgccaagctcttatcctttaaatattaaataagctctatttataaagaatgttcttttctcagccgggggtggtggctcatgcctgtaatcccagcactttgggaggccaaggcgggcggatcatgaggtcaggagatcgagaccatcctggctaacacagtgaaatcccgtctctactaaaaatacaaaaaattagccaggtatggtggtgggcacctgtagtcccagctaattgggaggctgaggcaagagaatggcgtgaacccgggaggcagagcttgcagtgagccgagatctcaccactgcactccagcctgggcgacaaaacaagactccgtctcagaaaaaaaaaaaaaaaaaagtgttcttttctccttcttgccagtcctgctgtggctgaggccttggcccaggcttggaaggggcctgcgcaatgggcaagtgggggccaaggtgtcactcactgtctccttagtggggaggctgaggctcccttggggtctgcccgctggggcacagcctctggatgctgagtttcttcctgggcggccaagaccctgcttccctgtttgctcttgggggtgcctgtgccctcaacttgacgccatcctccctctggggacctgtcctcctgcctggtcgctgtggccctgatgggcttggcactgtctcgctcacctgtggtcatcccgggcagcccccagcctctgcgatggggtggggcctctggaggggactgtgtcagctgtgggcttccctgcagggctggagccgaatcagggtctgccaggcctcagtgcgtccacgtgtttggggccgagggctccagtgggtcctgtggccgaggtagtgagaggggaggaagatggtagaggtgggtgcaggcagggggccacgcggatgccctgtgggcccggccatgtcacccaggcctgcagagagaggcctccagaccagcctcctcagaccccaatcccggagccatctgtgaaggggagcccgtgtgctgtccacgctaggacgcggtagaccctggaggagggaaggctggccaaggtgggagcccatcacgaaagagcctggggagatgcaggtgctgagcctggctgcccccgccccagcgtggcccctgtgtccctgcagcacgtggccgaggagctccagcatctgctgcagtggctgatgggtgctcccgccgggctcaagatgaaccgtgcactggaccaggtgctgggccgcttcttcctctaccacatccacctgtggatcagtgagtgcagggcaggcgggggccccagggaccccagagcttgctgaagagggtagggacccagccagaccccgccccctgtgcccccaactctgctccccagcgtcctgtgtgtgtgaggcctgctgtgctcagctgagggctggggcctgggcacctcccgagggctgaccccaccctgccaggctacacgcacctcatgtcctgtgtgtgtgagggttgtgctgggccgagggctggggtctgagcgcctcctgagggcctaccccaccctgccaggctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggtgggcgtgggcttccccctccccaccgccccctgggaggtgcagaggctccggctgggcgggcgttcgagtggggcgggggcggggcggggcggggcggggccgggcccgacagcactgcgtcctgtaggctgtactgcctgaagatccatggcctgtcctcactgtggcgtctgttccgggggaagaagtggaacgttctgcgccagcgcgtggactcctgttcctatgacctggaccaggtatggggcagggttcgtggctggaggggctgactgcctccggcctgtgcccgctgggccagcgcggtgcttgggcaccacaagggggcagcctgctcccgtcctgcagctgaggccgcgcacaggccctgggaatagataagtctgcggtgtgggctgcacgtggggctctgaagcagcgcagagcttccctgggccacagagaagagacagacacacagccccgaaggtggtgcaggcacaggccctagaggtgccccgggcccagagactagagatgccccgggcccggagactagaggtgccccgggcccggagactagaggtgccccgggcccggagactagaggtgccccgggcccggagactagaggtgccccgggcccggagacttgaggtgccccgggcccggagactagaggtgccccgggcccggagactagaggtgccccgggcccggagactagaggtgccccgggcccggagactagaggtgccccgggcccggagacttgaggtgccccgggcccggagactagaggtgccccgggcccggagacttgaggtgccccgggcccggagactagaggtgccccgggcccggagactagaggtgccccgggcccggagacttgaggtgccccgggcccggagactagaggtgcccgggctcggagactagagttgcccgggcccgtctgctgctcacacttgccgcagccgctggatgctgccatgcagagcatgttcttggtgactgtgtggccacgcaccgtcttgggtggtctggcccccacctgtctccctgcgagtcccctagtccgtggggtgtgggtggacagccctcctgctactgggactgcttctgagcaggccatcccgagttccctcaggaagccgcaaggtcccgactgcagctccgggatgggggagggcacagtgctgggccgtccctgggcgcggggtcctgctgatgcccggtgtgctggcccctccctacagctgttcatcgggactctgctcttcaccatcctgctcttcctcctgcctaccacagccctgtactacctggtgttcaccctggtgagctgagcacccacaggctgggcctggctgcagtgctctgtgtggcttctgccagcgctgcctgggagcagtcagctgtggggcgggctgtctcctgctgcaggccacgtgggtggcctttcaggaccctctgggcagtgagtgctgcgctctggagtgggcgaggccctatcctggccagtaagacaccctcactgccctggagcacgcagctgggtgcgtggtggaaggaccccacggcaggtggggtcacgcaagaggcctcccctggtgcctggcactggggcagacagtgggaggtgagcagaaccacctccagcacctgcttgattcccaggcctcgatcccctctgcatgtgaggctgtggggaggcacctctgacctggtgagagggccgggtgctccgcctccagctttgctccagagcaaggcccaatggcagactccgtgccctgctcagggtggggtccctgctctccccaggaccctgcagcctctgggcccccttcatcgtggcccaggatggggtcggactgctctgcccccaggcgcgtctggccgggccggtcctaaatgctcctctgccacagctccggctcctggtggtcgccgtgcagggcctgatccatctgctcgtggacctcatcaactccctgccgctgtactcactgggtcttcggctctgccggccctacaggctggcgggtaagtgctgcgtattgggcagctggccctgggtaggtggaggggaaccacacctgtgggccctgcagaagcaaggacagcatgggccactgtgcctccagcctggaagccgtggtatgcatgcgcaagcgggcagggaggacagggcctcctagtcccagaggtctgcaggaccagctgcctccagggaggtggagagagactcagagactcacctgccgcgcaggttcagaaccctggagacctgaggccacaggcctttgttcttctgccttgggattttctgggcttgggagtctgaactgcaggccaggggccaagcgcggcaaagtcagaggcactaggagccagcagggcggccaccatccagtaagtgccccgtccgctgtgccggaaaaccccgtccactcaacagcacagcctgcgcccgtccctcactggggctcttccctgcttgccggacacctggcttctttcagtggagtctgcaggaggcttttttttttttgagacggagtctcactttgtcgcccaggctggagtgcaatggcgcaatctcggctcactgtaatctctgcctcctgggttcaagcgattctcctgcctcagcctcccgagtagctaggattacaggtgtgtgccaccacgcccagctaattttttgtattttagtagagatgggggtttcaccattttggccacgctggtctcgaactcctgacctcgtgatcctcccacctcagcctcccaaagtgctgggattacaggcacgagccaccgtgcccggcttttttttttttttttttttgagatggagtcttgctctttttgcccaggctggagtgcaatggtgtgatctcagctcactgcaaccttcgcctccctggttgaagcgattctcctgcctcagcctcccaagtagctgagattacaggcacacgccatcacacccggctaatttttgtatttttagtacgtatggggtttcaccatgttggccaggctggtcttgaactcctgacctcatgatccgcccacctcccaaaatgctgggattacaggcgtgagccaccgtgcctggctgcaggaggctttgatgccggcctggcagccagctccaggagttgggcgacggagggggcggggagagcttcgtgggtggccacggccagcagcacccgggtgcccctcagagaggaaggtacctgcagcctctgctcatgtgtggggccagcccccacgcgtcccctcgtcagccgcttgctatccttgcagctggcgtgaagttccgtgtcctccggcacgaggccggcaggcccctccgcctcctgatgcaggtgaggccccttgtggccaggacgcccctacgctgctgcccctgttctgggacggtggggtcagctgggtgtagtgtctgggtggcaccacgccagcctgcgatgaggtacagggagggcccagtggagctgagggggaaggcccacgcgggaccccctcccccttacccccagggcctgaggacactggtgtggtcctgtggatggggcccattctgccctgtgtcggaggcgcccttggctggctggggctgccctgggccccacagggctcaagttctgggtggaacagaaccgactgagtgagtcctggggtggggtgtgcgtccctgtggcacggcccctcagagttgggcagccccgaggggagatgcagcttctgcctccccccagcgctcccttctggctgcaggctcacttgcctccttgggaactgggactggcttctcccacaggcaagggaatgtctgagacagcactggccctgcctcacaactgcccgcccccaccctctctctgcagacggggttggagctcagaccaccccactgaccgctgcccttgtccttccagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctggagcgcaggctcggtcccgggtccatgtgcagcgcgggtccagggaagctctggggggggggtgtgtggacgctactcgagggacttgggctgcctcacgtgggtctgccctgcagagtctacaccggcctcctgctggaggccctgacgacggctgatgggacgggctcacaggccctgggcccttgaggactttggtgtaggcaggtgaacccgggccgcccaccctgggggccgcccaccctggggtcgtggccttgcctcgacatagatggtgcaggggtgtaggcctccaggggtggggcgagcagctcctgctctgaatctgtggactccatgtggggtgggcccctcgtgggtcctggcccagtacagcctgcgactgccacagctgctaagaatggtctctgtcgcctgcagtgctgggggcccagctggcgggccccacagcccgttcccagcccgaagtgtacaggcctccatccaacctggacttccaggcaaccagaggcactcagggcccaccaaccccctacctgtgtcccctgcctccccccagctgcccacctggcccaccacccctcccatctgtactctcccccactcaccctccagttgcctacctggcctaccctgctcctaccagctgcccacctggcctgccacccctcccacctgtgtcccctgtcccccaaagctgcccacctcgccccccaccctttccacctgtacccccaactccccctccagctgcccaccaagtccaccaacacccccaacctgtacctcccgctccccccagctgcccaccgggtccaccaacacccccaacctgtacctcccgctccccccagctgcccaccgggtccaccaacacccccaacctgtgcctcccgctccccccagctgcccaccgggtccaccaacacccccaacctgtgcctcccgctccccccagctgcccaccgggtccaccaacacccccaacctgtgcctcccgctccccccagctgcccaccgggtccaccaacacccccaacctgtgcctcccgctccccccagctgcccaccgggtccaccaacacccccaacctgtgcctcccgctccccccagctgcccaccgggtccaccaacacccccaacctgtgcctcccgctccccccagctgcccaccgggtccaccaacacccccaacctgtgcctcccgctccccccagctgcccaccgggtccaccaacacccccaacctgtacctcccactccccccagctgctcactgggctgccacgcctcctggggcttccaccaggtcaaggtcttgacacagctcagtccactgctctgtgatggccatgtcatgggtcgtgcctggcagcggtcaccccctctgctgggcactgggctgactgcctatcccgagggccagctaggtttggcgccagagctggccaatggaacaccgtcaccccagccactcgcagccaccaagaggtgccgcctgcacctgcaggctccgtctgtccttgctgcacagcccctgcctggagacagcctacacctgtggggtgcccctcatccctccaccagagctctggtcccccctgccttgccgacccagacagggcaatgggctggagcttttccaaggcctgcccaggaccatttatggaccctcagggcaccctcagaagcagacaccttccctttcagagttggggccgcccacagagaagggtctcaccagtacttcacagattcagacttacagaaatgctgtgagaataacacagatgcttccagcacccttcacctacatccccccacgaccacatgccatgtgtatgttttcacattttttctttttttttttttttgagagcgggtctctattttccaggctggagtgcagccttaaccttcctgggctcaggtgattctcccacctcagcctcctgactatctgggattacaggcacccaccaccacgcctggctcatttttgtacttttagtagagatggggtttcaccgtgttactcaggctggtctcaaactcttgggctcaagccatgtgcctgcgtcggcctcccaaagtggtgggattacaagtgtgagccaccgggcccagccagcacattctttatgtttttctgcaccatttgagtcagctgcccattttggctctggaattttcagcgtgcatttcctcagaacaaggcagccagtgcggtgctcaaacccggggcttttgcagggatgccgtccaagccaccgaccccattccagcgtgtcccacgtgtcatgggccagtctccaaagcctctgggggcttagggatggagcccgttactcaggagtgtccctggctgggtctgctggtgaccctcatgatgagatgccactcatgcttgtggcagcagcagagggcaccacccagggtggcacacagagcccacctgttcatcccagtgatgccaacgtgactacttggtcgaggtcttgtctgcaggattttccgctgcaaagctacattcccttgtcattaatttgtccacagaaatgggaccatgttgacgctccatccctcactgccctcatccactgcacgctgtgtccaccaaggtgattggctctgtccactcatgggatgtgagtgaggcctccccttggcagcaggccaggactggggggggtccctgagtagctgaaacttgtaggtgctccctgggcacagggcttcaggggccaaggcttgtctgccccactgggcaactgtccacccccttagcaggactttgaggacatcccggcggctgctgggctccccgggggcagggtggacaccccaaactgctccctttgtctcccaagcccctcacttggacagaggctccgcttagtgtcctggcccgtctctgccatggccattgagtgtggggtgtggcagaagggggctgtcagggtctccaccagacactgctcaggcctccgagatgggcccagaaataccctgactgctcaacaagtgggtgcccaggtggtggctcaccccaaacttctgggtggaggtctcttcccacactccactgtctttggctgccctgtccctggcctgagatctctcagctgcagggatggtgtcctgcccctgcccaggcctggcttggccatggtggaccccaggacaccctgcgtaagtgcacgcagctgcccctcggtccacaaggcctggatgccagaggatggcacccctctgtccatccctcccttcactgggcctgctgccccagagtccgtccctcccttcactgggcctgctgccccagagtccgtccctcccttcactgggcctgctgccctagacccatctgggttccctgggacacttttctgctcggaggctgggaggtcagagggcacagcagctttccaaggatctcaccctatggaaaggttcctgaacccaggaacccaggacagggctgtgtccacaggctgtggtgggcagctccagtgggagaaacctgacttcttcatcagccaggggatgaccctttcttgtcccaggaggtgggaactaggcagcagtggcccacggctgggtctggagagcgttttactttgtttttcttttttaaaaaagtttatttttgtgaagaccataagaacatttttaattgtttatttttgaggcacttttttttttttttttttcctgagacaagagtctcactctgtagcccaggctggagtgcagtggcacaatctcagctcactgcaacctccgtttcccgagtttaagcaattcttctgcctcagcctcctaagtagctgggattacaggcacgtaccaacatgcctggctcatttttgtattttcagtggagagggggttatcacgatgttggccaagctggtcctgacctcaggtgatccacccacctcagcctcccaaagtgctgggattacaggcatgacccaccgtgcccggcctcagaaagcgtttctgatttatgttctcaggaaaggaggagacggctgctcaccactatccaccccccgcttccaggcagtctcagaaaccgaggaggaaacatcacatctttggtgcttcccgtccctggagtgaggggcctcagggacttcacagccagggctcaagtctgggcacaatgacctctgagcagaagaggctctccctgacccgccaggttgtttccgggttaatgcctggggaacttggcaaggcgccatctctacaaaaaatacaaaaggtagccgggcatggtggcgcctgtagtcccagctactcgggaggctgaggctggaggatcgcttgtgccggggaggtagaggctgcagtgagccgagatcgcgctactgcactgcagcctgggcgacaaagggagaccctgtttcaaaaaagaaaaaactggtgcgtcgatgtggtcgccgcttagtcaggccatgtcttcagctctgggggacgggaggtcactggaggtgtggggctgcccgtcctggcgtccctctgtgtaagcagcacctgctcccggaggcacagccctggtcggggcccctctggaggagggttcttgccgggctctgctcctcgccggcggggcagacgtgacgggctccgcacccggtctggagagggctgcgctgggtcggcgctgacgttactgcttttacttacgactgtaacagcgctactgaacgcagagcacgtatcacaaagctcacccgttccgagtgagtaacttcaccgagagaggcaggaccatccccacgacggtaggaccttctcgtcaccccagaaagaaccacgtgcccactcaacccccgaccccacgccggggcccgcggacgcagccgcctcgctcgcccacgcacctgcggcagccgggcccggcagggacgagggctcggcggcgcccccgggaagagcgcggtccgggccctgggtccccgtccaggaggcgccgctgccgcagtgagcacgtcgggccgggtcttgagctcgcgccggccgcgctccccgcgtcccgagctgtggcggccgcgtccccgggcggaaggctcacgctcggtgacgccgcgctgtcccagaacctcagcgactttgcagactcactggtgacccaacggtgcgccccgccgccgccgggcggaagtcccgcccctgccccggagaggaagttccgcctcatcgagcgccgattggccgcaccgccttagagaggacgcgcccggggccaccccgccgctccctccgagggttctgcggaagcaggcggcacagcctgcgaggggctttcgtttcccggactcagccgcatcgcctcggctcgggcgcgcctgcatcctgccgcccgtccgcgcgttgaaggggcggatacaaacaacgtggacttccgagcccctgattggcgagcgtgtaggaaaggggcggggttagcagagccgtgatggacatgcaagcgacccaatggcgccggcgacggggcgggcgaggacaacggcgttgtgggccgggggcggggcggccggcggctctgggatttctctgggaggcagccgcagggaagggaatgatcttggtgaacttataatcgaaccaatggttccgggaaagcaggaggcgagtggccaatggcgacggcgatgaggcaggcgtccgctgtctccgcaacgccgtgtgggaaaggcgggggaggggcggtcatgacagacgtgcagacaggccaatggctgagggaaggagggcggcgggcgacctctggtgactacgggaaggcagggcggggtggtgaagaggcggtgcgaccggaggtctggcggcgccgtgtggaacgccgtgagggcggggaagtcgtgacggacgggcgggtgggccaatgggctcgggagggcgggcgaagggtggccaatggcggcggcgcggccgggggtggggcggcgcggcggccctggtggtgcgggaagcggcggggcggcggcgaggctgaggtgcgcccgggcgcgggcggggcggggccggcgctgggcttcgggcgcgcccactcggccgccgtggggcggacgcaacgggcgcaggtgcggggcgcgggctctctcacgccgcggcctcacccggcggtgcttcggcaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacggtaaggcccggcccgcggcgcgcgctgctacgcggggcccgagcccggcgagctgggcacggagctcgccctcggcccggcccttccaagcgccgccgaacgttcccaggaacgcctttgcctggcttccagactcggtagctcggtggctgcggggtgcccgtgctccagtcccgaggtgacgccggggggcaggaggacggaccagagggacgcgcccagcggggacggtgccatggacccggggtctgggggacggtgtcacgggtccgggatctcaggggaaggtgtcatgggtccgggatctggagcccaggggaaggtgtcatgggtcctagagaaggtgtcatgggcctggggaaggtgtcatgggtctaggatcatctggggtccgagggaaggtgtcatgggctcgggggaaggtgtcgtgggccggagggaaggtgtcatgggtgcaggatctggggtctgggagaaggtgtcataggtccgagggaaggtgtcatgggtccaggatctggggtccggggaaagatgtcatggtcccggtagaaggcgtcatgggccaaaaggaaggtgtcatgggtctaggatcatctggggtccgaggaaaggtgtcatagatctgggggaaggcatcatggtcctaagggaagctgtcatgggtctgggatcatctggggtccgagggaaggtgtcatagatctggggaaaggtgtcatgggtctgggatctcaggggaaggtgtcatgggcctaagggaaggtgtcatggtctgggatctcaggggaaggtgtcatgggtctaggatcatctggggtctgagggaaggtgtcatagatctgggggaaggcatcatggtcctaagggaaggtgtcatgggtctgggatcatctggggtccgagggaaggtgttatagatctggggaaaggtgtcatgggcccggggaaggtgtcacggacccaggtctggtggcaggtgctgctgggctgctcttgggaccctgtctcgagcgtgcacagatgacaggtccttataggcacgctgttcccctgaggtatttgcttactgctgagggagtcaacgctttgtgctagaagaaaatacctctgtaatgagttactgaacatttgttttgttttgttttcttttcttttctttcttttttttttttttgagacggagtctcactctgtcgccaggctggagtgcagtggcacaatttcagctcactgcaacctccgcctcctgggttcaagcgattcccctgtctcagcctcccgagtagctgggactacaggtgtatgccaccacgcccggctaattttgttgtgtgtattttagtagagacggggtttcagcatgtcggccaggatggtctcaatctcctgacctcatgatctgcccacctcggcctcccaaagtgctgggattacagacgtgagccactgcgcctggcctgaacgtttgtttttaacttccagtggcatggctaaaatacactagataggtggcatcactggggcttgcctgcctgagcatgcctcttaatttaggtggttaacagagtgagtgagacggtgtggtcctcatcccctctcatgggggcctggacccagccgaatgggatgtggccccagatgaactgggagcagtcagcatccagcctccccagagtccatctgcgcttcagggaatgccatctacgctggcgaacttacctctcctggtccctgccctctccccttgctttgtttcttgggctcttgtccgtcctgtctgactgccctgagcgtctgctatttgctgaattgtctgcctttggctgctgagagtgtgggcgcagcatcccccactctctcaactcgggggttggcagagcgtgggattacctggactgaggctgagcgcgcttcctcctggcatggcttcagcagtgggcagcagcaccgggggctctggaagcttgtgctcctggcttcagcctggaggaggggttggaaagggccagggaggaagagctctgtgtccattttgaggtgggggaagtgtaaggcccactggggcattgggggctcacacgttaggcccctgcacctgccgcctcctggtcctgcacttgacagtgactgccccagaattggtaactcctgactcaggtggtgggcggccaagttgattgtgaaggtggcgttgccttctaaagcttggctccaggggcgctgcgcactcccaggaggctggcggcgtgcgtgtttgtgcatgttcagaagagcacgggaaggattgggtttcatcaatcggtgttttcccaggacatgaaggcgtgcttctgagggccggctcagccatgctggccagctcgcctacccaactgcaccacacagccaggagctggagagacaggaccctccttcctccctgtccccttcgtcgggctgtggggcattgccacacttcctctgacatgctcactgaagtggggccagtattgtgtaagacgtggagacctgcctgcttgcagagacttcagaggctcacagtggcttggaccagaggcagagaggagagtccactcttagaaagacaccacgtgctctcagggcccggggcacacttccaggtccccgcaggagtcctgtggcctcgagcagagaaggaagcgcctctgggctgtggaacgcgctttctgtgtctaaggtctcaaggttaagacgtgcacagcacaaggagcaggtctttgtggtcaggtggcagcttgccaacctcaggggccagccctcttcatcagggtgaagttggtggatctgagggtttcccaagggggctattcagggtctcagaagctcaggagcagctggttctcaggactcagcatcttgagaatttattctcctttgaaagagttgtagcaggagctttaggcctctggccctcgtgggaaggacgtacgtgttaacctccattgctttctctcctttgttgggaggtgccctctgtgtttccagcttccgtgtttcttcagggctgcctgctgggcagtgggtgcccttggcagggaggccccttctgtgcaaggcttactgcttcagcatggcccacagctccttcagctcacaccggatcgcttacctgcctggaagtcttgtctggcatgttcctcagacaggtgtgtgagcgtacattgccctctccagcttcacaaacaaatgagtcatcgaagtgacctttttcttagtactggcacctgaggcagtggcgtgtgaccacacgcccagcacctgtgggagcccctgtgagctcttccgtgtctcctaatgtgggtgtgcgctgggtttctggatctctaggtctggaaaggctttcctttctttgacacccagcagtgatcttagggagtgcttcatgctctcttcaggatggaacagagcgctttgcatagagtgcccctgggtgatggtggcgagttacccggcaggaattatgcttcatccaggagtgtgggtggtgcacgcggcggggaggagaaagctgcagttcaggagcgaacctgcagtcaggctccagggtgtgggccagggtggtgggcccgtgttggcccccaggaaccacccgcacagggtgcacacccttccccaagcccagccgctcccgctctgcagggggcatcgaaggtcctggattaaggcagttccaccctcggcaccgtgtccccacaaaccttcctgggagcaagttttcctcccgccacgttggtcagggtgtgtgtgcccgggtcctggaagacttcagaaggggttaatcctggcttgactttatttctctctctgctcttttggggttcagtgttggtggaagctgctgagtgacactccggtcctttgagcctggcaagttgtggggagaaacggagggaggcggttgtggacatggcgaggctaacatcacggtttgctgtggatgttggggcctggtggtcactgagatgtctgtggggccacacgctgcctgctgtacccatgggagcgagggcaccctgtgtgggtgtcccagcttcttcggcttcacgactccctgagctttctccaaacagttacaaacgtttcttctcatctggcttgaagttcgtggctccgaagtggccaattccaggggacactatcttgagaggctcctccgtgtttcattgtcctgatgtgtcgtcggctgcttatccccagggctagctgagggtttcgtgggaggttctagctgtgtgtctttaggtgactggacagccgtgcgtggcttccctgtgcctactgttggtgttgggcaccactgaccactgcagcccagagtcccttctcctcccctgcacttgattaggttttgctcgtcttccttttttttttttttttttttagacgaagtcttactctcttgcgcaggctggagtgcagtggcgcgatctcggctcactgcaacctctgccttctgggttcaagtgattctcctgtctcagcctcctgagtagctgggattacagacgcctgccaccatgcgtggctaatttttgtatttttagtagaggcaggtttcaccatgttggctaggctggtctcaaacccctgacctcaagtgatccacctgcctcgggggttttgctcgttttctggggcagtgttttggggtttgcctttcctctgtgaggtgccgggttttccagcagggtggtgttgtgggaggaacggggtgttcaccatggcaacagctaatgctgccagcgtgtgatgagtgttgcctgccagcaccggtgggcgctttccgctgcccccgtgtagcccccaccaccacctgtgagaaggcagcaccacccccactgtgcagacgagggattgaggctcaggaggcggcagctgtaggggtgggcttggggtccgggaggagccgccctgcaggcctcctgtgaagcagcgggcttcatggctcttcccctgtcctcctcacgtccacctgggcctggggacggctgccacacacctgcttctgctgcaccgcgcacactaagttctcctgagacccaagcctcagaggaccgcctcaggcccgggatgaccctggctggcatctgagaacccatgtggtcaggaggtaggacttctgtgggtcattataacttttttcttctttttttttttttttttgagacggagtctaactctgttgcccaggccggagtgcagtggcacggtctcggctcactgcaagctccacctcccgggttcaagtgattctactgcctcagcctcccgagtagctgggattacagccacctgccaccacacccagctaatttttgtatttgtagtagagatggggtttcactgtgttggccaggctggtcttgaactgctgaccttgtgatccaccctcctcggcctcccaaagtgctgggattacaagggtgagccactgtgcctggcctctaattgtgctgttttataagttggactggcatggccttacttaaattttcaggaaactgttgagtcagtaggtagaatattgaatgttaagtttgtccagaggccagatgccagaacttttggacaagtgagttaatgtccacctccagtccttagcacttgctctaagcgctcacaggcaacagggcaaatgcttgcatggcaggtgcacggcagtgccagccaggtctctcgcagggtggtgtggacacagatgactcgtgtcgagcacacgtgttgtggcctgcacgatgagctaaattgaacagtgtttcaggaaggaagccacatcggggagctgagaggtgggcgggaaggacacaagggagggatctgggtcctcgcaggtacttttgcctcttgttctatttgaagattgcagctgagaaggcgcgaagctgctggtccctgaaaagctgccgcctaccctggtctggagcccctgcgagctggcgtagagcaggaaggggttgcatcacagctgagtcctcccctgcgcagcacatggtacgatgccaccccaccgagggccgttctggggcccaggggccacgtcagccagggtgtcatccgccgggcgtttggagtaagcagggaaaggtgtcggcgtccagcatcctggtgcggagaacgctgccgaaccactgtgagaaggcggggagactgcttgtcaggctgagctgacttcctgggcggtcgggagaaggatgtgcagactgtggaactggcgggtgtcagggaccagaagttacgaaggcggtgggaagaggagcagctgtgggaagaaggactggctgccaagaccatgggctgtgggcatcctcagggcaggagctgggtggaagaggggcctcttcagtcctcttggcagtgaaggtaaacagatgtcagcagggtggactcgcactttgagcctaaggtagcgaggaggcttctgagccgacctggggatggcggcgcactctgatacaggcagtgcgcggctgtctcgtgctgagatcaggattttgagtaaagcagagatttctggacgtttgtccttcagaaattagcggagggacaagggcattggcgctgtggagaggtagggacccatgggtatggggcggaagaccagggcacgaccagacaccgccagggtgctgcacatgtaggtagcagggggaggtggtccaggcaagatgggatgggaggggctcaggagcagccaggttctagtgctggtgatgaggtgggtggtggcaggggcatgtggaagggtcttctgaccatggcttacagagggcttggtgctggggggcctggagttgtggaaagggtgaagggaagagttggtcccatattcccagatggcagagtggaaacagaagcactcggcccctgagcagccttcgccgtctttacagtgaacacagtcctcaaaccaaactgggaaggattcgaatcctggatgggtgatgtggtcctggctgtgtaaactgaccctgatgaaagacatgcccatcctgtgagagggacagccatctagcatcttttttttttttttaatttttattttttgagacagagtcttgctccgttacccagggtgtagttcgatggcactatcttggctcgctgcaacctcttgagcctcatgggttcaagcgattctcctgccttggcctcctgagtagctgggattacaggcatgcaccaccacacctggctaattttttacatttttagtagagacagaggttttgctgtgttggccaggctggtcttgaacttctgacttcaagcaatccgcccgcctcagcttcccaaagttggtggaattacaggcatgagccactgtgcccagcccagctcagcatctttggaaaagagcagagggctgggcacggtggctcacacctgcaatctcagcaccttgggaggccgaggtaggcggagtgctggagcccaggagtttgaggccagcctgggcaacacagtgagaccccatctctacaaaaaaaaaaaaaaaaaaaaaaaaaaaggccgggtgcagtggctcacacctgtaattccagcactttgggaggccaaggtgggtgaatcacgaggtcaagagattgagaccatcctggccaacatgatgaaaccccgtctctactaaaaatacaaaaattggccaggcatggtggctcacgcttgtaatcccagcactttgggaggccaaggcaggtggatcacgaggtcaggagatcaagaccatcctggctaacatggtgaaaccctgtctctataaaaatacaaaaaattagctgggcatggtggcgggcacctgtagtcccagctacttgggaggctgaggtacgagaatggcgtgaatccaggaggcagagcttgcagtgagccgagatcacgccactgactccagcctgggtgacagagcgagactccacctcaaaaaaaaaaaaaaatacaaatacaaatacaaaaattagccgggcgtggtggcgcatacctgtagccccaactacttgggaggctgaggcaggagaattgcttgaacctgggtggcggaggttgcagagagctgagattgtgccactgcactccagcttggtgacagagcgagactctgtctcacaaaaaaaaaaaaaaaaaaagaaaaaagaaaattagctgggtgtggtggtgcacgtctgtagtcccaattacttgggaggctgaggtgggaaactcactggagcctgggaggtggtggctgcagtgagtctgactgttgcactacgttccagcctgggtgacagagtgagaccctgtctcaaaaaataaaaaataaagaaaagaggatggaagaagagaagagctgagtcctggaaatgggcaggtactttacagtttgtacagcggccggatgtaagaacctcatgtcaaccctgagtgaaggtgtaggccgggcggtcaagcacagcactctccagcagctccagcagcgtgggtaacccggtgggagcctgtgtgctgctttccctgcccggggccggcggctgctgctgggctttcgcctgacttcctggtcagcaacgttgtcggccacctgggcacagcaggtacagcctgtgtgtcagacctagctgggaggggcggtaatagggtagatgacatcaggattcaggactctgaacacaaacacagtgacactgatcagggttgccgaggtgctgtgtttcggtccagaaagtcactgctgcaggggaggggagtatggtcacagcccaggccccggccccggccgaagctgccactgacaggagacccttctctgcctgtgccaccagctttgctccgaggggtgtctgtgtcctcaggctctgccaaggcagtgtcaggctgatgcctgcccgtgtcggccggccacagccctagtggctgcccgcagagtcttgcgcccacctgattcctgcctgagaggagccgccaggtcagctgatgccagcaggacccacttcaccaggtcagcaaggaggaggcagcttcccttggggccacgccgtgcctcctccgtgtgcgctgctgccatggctgcttctgtcgataggcatgtacgtgaaaatgcacacccgtgggtgttcgctactgtcagcgtggattcagcaaggttttgttccctcgtggcatcagtcagcgtggattcagcaaggttttgttacctcgtggcattaatcagcgtggattcagcaaggttttgttcccttgtggcatcagtcagcgtggattcgcaaggttttgttccctcgtggcatcagtcagcgtggattcgcaaggttttgttccctcgtggcatcagtcagcgtggattcgcaaggttttgttccctcgtggcatcagtcagcgtggattcgcaaggttttgttccctcgtggcatcagtcagcgtggattcgcaaggttttgttccctcgtggcatcagtcagcgtggattcgcaaggttttgttccctcgtggcatcagtcagcgtggattcgcaaggttttgttccctcgtggcatcagtcagcgtggattcgcaaggttttgttccctcgtggcatcagtcagcgtggattcgcaaggttttgttccctcgtggcatcagtcagcgtggatttgcaaagttttgttcccttgtggcatcatactcctttcctgtttggtttgggactcccatggcccccttgatgttggagcctcttcaggtggcacctgcgtcctgggctatgccctgagttcccggagctccctgtgtcctggaacagtctgtacttccagcagatgtgggtcctgcctgccctggaaacggccatctctctgaagagcctgtgtcctcctggtggggagggatagctagtatgtcagcttcttaaattactttattaaaaattgagtatatgcaaaatagtagtcataataatagtaatagtagcaagtgcaaagtgtaagtaatagaaatggatgtcacctaacctgccgagtttaaaacattgttgttggacttttttaaagagctttggtgccggatgggcacggtggctcacgcctgtgatcccagcactttgggaggccgaggcgggcggatcacaaggtcaagagatcaagaccgttctgaccaacatggtgaaaccccgtctctactaaaaattcaaaaattagcttggcctggtggcatgcacctgtattcccagctactcagcaggctgaggcaggagaatcgcttgaacctggggaggcggaggttgcagtgagccgagtttgcaccactacactccagcctgggcgacagagtgagactccatctcaaaaaaataaaaataagagctttggtgcctacgtgcgtcacacagacagtttaacacataattcattatcagcaagcggtgactgcccaggttttgcctgtggggaaacagaaaggttttgactccagtctctgtcttctgaagagctggcagtcacaactgtggcagagcctggtgtgtggcagctgcgtgaggctctcctggactgctgtggaggaaggggccctctggcaccccaggagcagcctgcccctctgtctgcctctgcatttagacccttagcctccttgcagagccacctcctggtcattagcgttaaagctcttctctcctgatgtagttttcctcaccgttcagtaaatgggcctgctgcttgtgtttggaacagagatagaagctgtagctcccacgtgtgtgtggagctggtttgacttttaaaaaattgtagtaccaaaaactatgattttttgtgtgttatccacaccatcaaggctgtatcaccgagtatctgctcattctgaaagtgtgcatcctttctgaattgaaatgaaagagcaggagaaaccgtctgtgtccagcctgttagaggtgttacatttgccctaggtgggctgggcagaaggctgttctgctcgggagcaacagtgtccacacgtcagtttccagagcccgggtcgccaggatccggctcagagtgtgagtttgctcaggtgtgtgctgagcacccctgggtgccagactccgggcaggtccccgccgcagccgcgtcagcagagcaatgtgatcgttgctgggactgttcccctagtctcagtcagttcactagggccatgcatgcagtgttcagacaggagattctcatgaaaaatagaattgttatcctaaaattacatgagagggaatgcttataagtttatcaaatagtaaaacatcacaacacaggaccgggtgcggtggtgcacgcctataatcccagctacttgggaagtcaaggcaggcgatcccctgaggccgggggttcagactaggcaacgtagcaaggccctatccctgcaaaaaaaagtaaaaaaaaaaaaaaaaaaaaaaaaaaaaaaggccggatgcggtggctcacgcctgtaatcccagcactttgggaggccgaggtgggtggatcacgaggtcaggagattgggaccatcctggccagcatggtgaaactccgtctctactgaaaatataaaagttagcggggtgtggtgtcgggcacctgtaatcccagctactcaggaggctgaggcaagagaatcgcttcaacccaggaggcagaggttgcagtgagccgagattgcaccactgcactccagcctgggcaacagctctcaaaacaaaacaaaaaactactgatttggaggcacatttaatgattattcaatgaagtgtatatgcttgatatcttaagtatgtaaaataattgtggaatgaaatatatgacaacattagcagtggtcatctctgtttttttttttttggttttgtttttttttattagagagacagtttcactcttccaggctggagtgcagtgatcatagttcactgcagcctcaaattccagggttctagtgatcctcccgcctcagcctctcaagtagctaagaccataggcatgcaccacaacacctggctaattttttaataaattatttttttatttttgagacaaagtcttgctcttgtccaccaggctggagtgtgatggcacgatcttggctcactgcaacgtctgcctcctgggttcaagcctcttgcctcagccccccgagtagctgggattacaggcacctgccaccacgcccggctagttttttggtatttttttagtagagatgaggtttcaccatgtcggccaggctggtctcgagttcctgacctcaagtgatccacccacctcggcctcccaaagtgctgggattacaggcgtgagccactgtgcctggccaataaattattttttgtagaattgaggtcttgccatgttgcctaggctagtggtcttgaactcctgggctcaagtgattctctcaccttggcctcccaaagtgtcgagatgacaggtgttagccaccaagcacagccagaaatgagtcttaaagtggacatgagattggggtttaagccacactaagctggatttgtaatcattgaaagtaatctgagagctatgggatctgctccttaaaagatgggagaggagaattttaagagatagggtctcactgtgttgcccaggctggtcttgaaccgtggcgctgaagcaatcctcctgcctcagcctcctgagtagctggggccagacctgtgttttttgttttcttaatgttctgtgtttagccaggtgttctgtgccaagtgtgcctgctctttgtagacacgagagcccttttggcttgttgtgggttttaaggcgttaagtaaaagctctagcttcgcaggaaaccagtccacaaactgccctagaatttcttctgacatttggcatgctggtgtacacagacacatttgaaatttgttagataacttttccttcctttactgtcctccatcaggcaggcgccggtttgcctgcagtggggttggtggacgtgggctgtccttgtctcagaagacatccgaggggagtggtatgccggaagattgaatgcggagcgccggccccgcacgtgaatgacttagagccccaggtcttcagggacaggcagtgccttcacatctggctctgatatgtgttcaggctgtcttgtagggtaatccggtcccctaatccttagacctccaaattcaaagcagatcaatgccctgtgggtttaatttttttaaatcaattttattgagagatgatgtctatttaataaatgtaccctctttgcatgtacagttctatgagttttggcacatatatgtacctatgcagccagtaccctcatccaaatcaggagcacatccactctcctcccagaaagcccctcaggccctgccgagtcagcccccagcccccagcagtcggcttccatcacatgggctgctttttcctgttccagacatcatggatacgaagcagaccctggtttcttttgctcagcagttttgaaacttattcatgatgtacaatagtagattcttctttttttgttcccaagtggtattcctttgcacaaatataccccagtttgtttatgcatttaccttgttgatgcacatttgggttatttcctggtttggggtattacgaataatgctgatgtgaacgagttcttcttttttctttttcttttttttttttttgagactctcgttctgttgccccagctggagtgcagtggtatgatctcagctcactgcagcctctacctcttgggctcaactgatcctcccacctagcagctccctagcagctgggactacaggcatgtaccaccacacccggctcagagctagttcttttaaatttttttttttaattatttttcttgtaaaatacagaaaacacgtcattttagccatatgtagggatacagttcagtggcactagcactaaactataacacaaatacgcacgaggccttctgaaggtgtttctctagaatacacgtgaatccttctgaaggtgtttctctagaatacacgagtccttctgaaggtgtttctctagaatatatgtgagtccttctgaaggtgtttctctagaatacacgtgagtccttctgagggtgtttctctagaatacacgtgagtctttctgaaggtgtttctctagaatatatgtgagtctttctgaaggtgtttctctagaatacacgtgagtccttctgaaggtgtttctctagaatatatgtgagtctttctgaaggtgtttctgttcccttaggtagatctaagagtggaattgctgtcatatatgagtgtacgttttaatttataagcttgcccagcctgggcaacatagtgagaactcgttgctataaacatattgaaaaattagcctggggctgggtgtggtggctcatgcctgtagtctcagcactttgggaggccgaggcaggcagatcacttgaggtcaggagtttgagaccagcctggccaacatggtgaaaccgtatctctactaaaaatacaaagttagcctggtgtggtggtggtgcttgtggtcccagttacttgggaggctgaggcaggacaatcacttgaacccgggaggcggaggttggagtgagctgagatcatgccactgcactccagcctgggcgacagagtgagactttgtctcaaaaaaataaataaattagcctggtgtggtgacgcacacttgtaatagtcttagctactcaggaggctgaggcaggaggatcgtgtgagccctggagttggaggctgcagcgagccgtgattgttccgctgcactccagcctgagcagcacagtgagacctgatctcaaaagagaaaactgtttgctcaagcagccccattgtttcatagtcccatcagcaatgcatgagagttccaggtgctccacatctttgccaacatttgatgttgtcagctttccgtcttttaattaatcagctttattgaggtgtaatttgtgtacaaaaaaacccctttaaagtctgcaatacagtgagtgcggacaggcatgccggcctgagaaagcatcagccctcgcagcctcgccctctgcaggcctctcacactctgcccccggcctggcatgtcactgtggactcatctgccttgtctagttttcacgtcaatggagccacacagggcaaactctcctgtgtccggctgccttctttccatgtcttctgggtgagcttcggccacgtggttgagtgcagttgctccctccttccccgcgccgagtggtctcccgtgtgtcaaggctgcagtgcattggctccactccagatgggctttgggatggtttccatgttgggtgactctcacagggctcctgtgaggagtctcagacgcgtttggtcaacacaggtgcccattgctgttgggacgtactgaggagtggaagctgggctgtagggcctgtgtagatgctgccaacccgttctccaaagcagtcacacagtttctgtcccacaggagagagggagagtcctgtttgttctaagtcctgccttccttttagccatgctgatggctgcaagcttgtttctttgtaatagccatagaacatttctattctgtcagtaaccattccccagtgggtggatttttagtttggattcagtttatttataataaatacagggccgcaatagatggcctttctactccttttctgttattgctgacacatagtcctctcggtcctcagtccagtgtgggtttccctgggctgaagtcaaggtgttggctgacacacagtcctctcggtcctcagtccagtgtgggtttccctgggctgaagtcaaggtgttggctgacacacagtcctctcggtcctcagtccagtgtgggtttccctgggctgaagtcaaggtgttggctgacacacagtcctctcggtcctcagtccagtgtgggtttccctgggctgaagtcaaggtgttggctgacacgcagtcctctcggtcctcagtccagtgtgggtttccctgggctgaagtcaaggtgttggctgacacgcagtcctctcggtcctcagtccagtgtgggtttccctgagctgaagtcaaggtgttggctgacacacagtcctctcggtcctcagtccagtgtgggtttccctgggctgaagtcaaggtgttggccagggctttgctttttgcaggccctacaggaagatgttctcttgctcgttgggaggttggcagaattccgttcttgctggtggtaggactggcagtagcaccttgctgggtgcaagccgagcctttcccggcttctccaggccgcctgcgttgttcacggagggcccttgcccatctgcagagccagcactggcgggtgaagtccctctcatgctttgactctccttctgtctcatctgtagctcagccaggaaaggcggttaaggacttatgtagttaattggccccacccagataatcccggataatctcccacctcgagatccgtgcaccttaatcctgtctgcagagtcccatgctagcaactcagcagcaaacagcccctgcactgtgccctgcaggaacatggctgctggtggcaggccggcccagacagacagactaccacctgagccaaggaacctccactcaggtggccgagggtcccacttccgagccgagggtgctacgcaggctcagcagccagcctccctcggctgccttacagcaactctgctgacagtccctgggcagattggcctccatgggcaggggcacaggtgccacgtccactccccagaccaccagcacgttgatgactgttgaaaacaaagtcgcctgggcacggtggctcaaccctgtcatcccagcgctttgggaggccgaggtgggtggataacctgaggtcaggagtttgagaccagcctggccaacatggtgaaaccccatctctactaaaaatacaaaaaaaaaaattagttgggcatggtggtgggtgcctgtaatcccagctactcgggaggctgaggcaggagaatcacttgaacatgggaggtagaggttgcagtgagctgatattgcgccaccacactccggcctggacaacgagagtgaaactgtctcaaaaaaaaaaaaaaacggggggccgggcgcggtggctcacgcctgtaatcgcagcactttgggaggcctaggcgggcggatcacaaggtcaggagatggagaccacggtgaaaccccgtctctaccaaaaatacaaaaaattaggcaggcgcggtggtgggcgcctgtagtcccagctactcgggaggctgaggcaggagaatggcatgaacccagaaggcggagcttgcagtgagccgagatcgcgccactgcactccagcctgggcgacagagcaagactccgtctcaaaaacgaaaagaaaagaaaagaaagtcgcatctggtaaagcagacaaaaaagaaaaagaaaagaaaacgaagtcgcacctagtaaagcaaacgcctcagtgacattttcagaccccttcctccccctccactgcccgttttcagattgatgctgtgagaccccctctgaagggtgcctgagtctgcagccaggcaacgtgctgtgcccgtccccacctccctccacacgttcctgggcagcctccacgcccatgtactcacctgttctcacgctgctaggaagaaataccccagactgggtcatttgtaaagaaaagaggtttaattgactcacagttccgcatggctgcagaggcctcaggaaatttacagtcatggcggaaggtacctcacacagggcagctccagagagaatgagtgctgagtgaagggggaagcccctcctaaaaccatcaggtgtcgggagaactcactcacccgcacaaaaacagcaggggggaaccacccccatgatttaattatctccatctggccccgccctcaacctgtggggattagtcaaggtgagatttgggcggggacacagccaaatcttatcactcctgagcctgcttagctcccacctcgtcctctgtccttttttgatcctgaagggctaggtgctgtgccaaacctgggaggcccaggatgctggcttcaggctgccaatctgtggccctcagcgccatcagacccaggccccttctagacaaatggttgtggcattccctttaccatcctgaaaagaatgaaactcggctggccatggtggctcacgcctgtaatcccagcactttaggaggccgaggcaggcagatcacttgaggtcaggagttcaagacaagcctagccaacatggtgaaaccccatctctacaaaaaatgcaaaaaaaattagctgggcatggtggcgggcacctgtagtccccactccttgggaggcagaggcacaagaatcacttgaacccagaaggtggaggttgccatgagccaagattgtgctacaattgtgtggcggctcatacctgtcatcccagcactttgggaggtcaaggtgggcagattgcttgagctcaggagctcaagaccagcctgggcaacacagcgagacccctgactgtacaaaagatacaaaattagccaggtgtggtggtgcacacctgtagtcccagctactcaggaggctgagctatgaggagcacgtgagcctaggagttggaggctgcagtgagccttggcctcaccactgcactccagcctgggtgacagaacgagacaccttctcaaaaaataaaaataaaaacgtggactgataggtgagagaggtttgatggtttgggaacagcggtgctgccacggctgggtgaggggccatgcgatctgcttggaatgccatgtgaggggaaggggaggtcagggcagtgcctggtgtggttcccagcagggagcacaggaggtttattctctgggaaaattgagtcgtggacagcagacaccactggggatggtgggggacagggtggcaggggacagggtggcctgagcaagcccctccttgcctgggaactcagggcctcctgatatgcagatgggagcccgtggcaggatgatggcaggataaccgtcagcccaaaagaagcggccacgagacgccgccgagagccccaacttagaagccagagtcaccagcttcctggctagggtctgtccttgagggtcaccagaatgtgaggaaagacccagacaggcaggaaaagagctcagggaaggacatcttaccattggcgtcatcagagataccgcatccacgaatgaagagccagacgctgccagaggggaacgctcagagcaccggaaggagcttttagaaattataaataagcagcacattttaaaaaagccatagaagggctagaaaagaaagttgaggacatctcccagaaaatagaacaaaaagagattaaaaaacaactgggcagtccctgcagaggtcaccctggctggcgcggctcaggatggagggcgggagctgtgtgcctggaggggggagctgaggcacgtcaggatgtgtctccagactgcaagggccacagagtacgaaaaagaccacccagagcaatgtggtcaaagaccatgccttaaaaggttttaggaaacagaatgggtcccacgggagggtggggatgtgaacggcaccagcctggtggctcgggtgccaggccagggccagatgtagcctcataccagcccagctgggagtccgcttgctgagacttggtctcctgtagctggtggggaagcggcaccctgtgcggtagacagaaccagcagccgaggcgccggtggctttgctctggtggcaggacaggtgttctgacctccctgcctctgtcccctgaggtcagagcgcctgtcctgtggagcggctctgaccaggacagtgccgtgtgtctcatggggttgtgttcaggtcggctgagaggcagcgcctggctggggctagatgaacaagagggttattgggaacagtaaacctgaggtggtgagcaaggcctgtggcacccagcagatgaggaggagagcagggggaagggtggcaggagttgctggtgctgcgtgaggcctcagtgggcctgcacggagcagctgaccttcactggcgcccttgccttttcactgagccgggtattagcttagcttatttttgaaaagacatttcaacaggaggtaaaaatgaacagcacaccaagagaatatgtcacagctgatgcctagggacccccttatggggtagtgttgagctctgcagccggagcccactgcccctgcccctgcgccgtcccccagcgcgggctccaggcctctcctgggtcactgctctgtgcctccaggagctcctccctctaccccgccctgccccaccccgtcacctgcttgccctgaccctgcctggataattgagaccttccaggccaagggccccctccccaggatcctgacacctgtccctctgagagtccagaccttttccagagtgacatcctggggccctgtgtggtcagagggctccatgtggtcagtggctgtggcttgctgggaacaagacactcggctgactgtgcttagagaacaggccgctgtttgtgtctaaatggtatccatggggacgttgtttcatagtcttcttacacttttcctcttcactgttgctgagaatcctgttctgacgcgcaccgtgggcaaccgggtgcggagcctgcaggatgggtgggacgcagacgtccagcgggaggagcatcccagagcagcctctgattcaagagcaaggtgctctagaggccccggctctgtgggtgggtgacgtggtccccaggcttttcccggcatccccgttccttttgcagcagccatggctcctggtggccctgggccatggcgccatctaggggtggcctaggggagtccccgggccatcagcatctgtcttgtgggtgttgctggcgcctgcctgcttggccacattggcacgtcgaggtgaccgtcaaggagaagcagctatggcctttgtggcaatcgtggtgtccaactttggcctctcaggtcagcctcatgggggcttcaacagccaggaccaaaatgaccaaggcccctccgtccctgtgtccctgcttgacagaaccaccggaggagggaggtgcgggaagggtgttgacggcctgagcgcggtgcctccctgaagagtgttgtttcacttgtgagtgtgcacgggacagccgccctggcctgtagaatcaagagcagggacagccgccctggcctgtagaatcaagagcagagacagccgccctggcctgtagaatcaagagcagggacagccgccctggcctgtagaatcaagagcagggacagccgccctggcctgtagattcaagagcagggacagccgccctggcctgtagaatcaagagcaagggacagccgccttcgcctgtagaatcaagagcagggacagccgccctggcctgtagaatcaagagcacgggacagccgccctggcctgtagaatcaagagcacgggacagccgccctggcctgtagaatcaagagcagggacagccgccctggcctgtagaatcaagagcaagggacagccgccctggcctgtagaatcaagagcaagggacagccgcctttgcctgtagaatcaagagcagggacagccgccctggcctgtagcatcaagagcaagggacagccgccctggcctgtagaatcaagagcagggacagccgccctggcctgtagaatcaagagcagggacagccgccctggcctgtagaatcaagagcagggacagccgccctggcctgtagaatcaagagcagggacagccgccctggcctgtagaatcaagagcagggacagccgccctggcctgtagaatcaagagcagggacagccgccctggcctgtagaatcaagagcagggacagccgccctggcctgtagaatcaagagcagggacagccgccctggcctgtagattcaagagcagggacagccgccctggcctgtagaatcaagagcaagggacagccgccttcgcctgtagaatcaagagcagggacagccgccctggcctgtagaatcaagagcacgggacagccgccctggcctgtagaatcaagagcacgggacagccgccctggcctgtagaatcaagagcacgggacagccgccctggcctgtagaatcaagagcagggacagccgccctggcctgtagaatcaagagcaagggacagccgcctttgcctgtagaatcaagagcagggacagctgccctggcctgtagcatcaagagcaagggacagccgccctggcctgtagaatcaagagcagggacagccgccctggcctgtagaatcaagagcagggacagccgccctggcctgtagaatcaagagcagggacagccgccctggcctgtagaatcaagagcaagggacagccgccttcgcctgtagaatcaagagcagggacagccgccctggcctgtagaatcaagagcacgggacagccgccctggcctgtagaatcaagagcacgggacagccgccctggcctgtagaatcaagagcagggacagccgccctggcctgtagaatcaagagcaagggacagccgcctttgcctgtagaatcaagagcagggacagccgccctggcctgtagcatcaagagcaagggacagccgccctggcctgtagaatcaagagcaagggacagccgccctggcctgtagaatcaagagcagggacagccgccctggcctgtagaatcaagagcagggacagccgccctcacctgtagaatcagcagggacagccgccctggcctgtagcatcaagagcagggacagccgccctggcctgtagcatcaagagcagggacagctgcccttgcttgtagaatcaagagcagggacagccgccctcgcctgtagaatcaagagcaggggacagctgccctcgtctttagattgaagagcagggactgccgccctcgcctgtagaatcaagagcaggactgccgccctggccggtagaatcaagagcacagtgcagcagcacgcagcacactcagcggatggagggcctggcttctgcacgccggctggcacttgctgccagttgcccttttctgcgaggctggatcgtggtgcggtggtggcttggatgggtttctctgctgaacgatgatgtggaatgccttttcactgcttcttggtcgtcggtttttcttctttggggaaatgtctattcaagtcctttgccctttttttaaagtataatttccgtatttttttccccagaggatagtttgtctttagtccttaaggactcagctccttatgtgggtcttagtgggagtcgtgggcaacacccaggtctagacccaggtggaatgcatggtcttggggccttggtgggggtcgtgggcagcacccaggtctagacttgggtgacgtgcatagccctggacttgaggagcaggattcctgactggcttgctgtgaagggcaccactggggcagtgacgcagcttcacacgcagctcgggaagcacacagtcggcgcagatgcttccaaaatgtctgcaaggctgcggcctctactgcatccagatggtgaactgcctaactctaccgcgtcccgatggtgaactgctaactctgccgtatcccgatggtgaactgccgaactctaccgcatcccgatggtgaactgccaaactctaccgcatcccgatggtgaactgctaactaccgcatcccgatggtgaactgccgaactctaccgcatccctatggtgaactgctaactctgccgcatcccgatggtgaactgcctaactctacctcgtcccgatggtgaactgcctaactctaccacatcccgatggtgaactgctaactctgccacatcccgatggtgaactgctaactctgccgcatcccgatggtgaactgccaaactttacctcgtcccgatggtgaactgcctaaacctcgtcccgatggtgaactgcctaactctaccgcatcccgatggtgaactgcctaactctaccacatcccgatggtgaactgctaactctgccgcatcccgatggtgaactgccaaactttacctcgtcccgatggtgaactgcctaaacctcgtcccgatggtgaactgcctaactctaccgcatcccgatggtgaactgcctaactctaccacatcccgatggtgaactgctaactctgccgtatcccgatggtgaactgccaaactttacctcgtcccgatggtgaactgcctaactctacctcgtcccaatggtgaactgcctaactctaccacatcctgatggtgaactgctaactctgccgcatcccgacggtgaactgccaaactctacctcgtcccgacggtgaactgccaaactctacctcgtcccagtggtgaactgctaactcagccgcatcccgatggtgaactgccaaactttacctcgtcccgatagtgaactgcctaactctaccgcatcctgatgaactgcttaatggcgttgtccctgggtacacattgggtgcagctcctgcagtcatgggctgctcacagccgtggcccttttggcacaaccattgttccttcttgtcttggaaacgaggacccgagggagaccatccgtccatcctaaaattgggacgtttggttttctgttgttgagttggagttatttgtagagtctagagatcagtctctaggagacgtgtgatctgcagacatttccctccatctctgggttgcatttttctgtccattgatggtgtccttcgatgcatgagaacagcctttgatgtacatgtaggggttggtcaggcagaaggacggtgtgggtggaagcgctgatgcctgaagaagggcaccgtaggcagagagaccgcatggctggcttgcagggctgggcccgcacggagagacagatgtgcacagacacacacacaagcccactgggcaggtgcactccgtgggagggcgtcgcttatgtttaaaaagtgcccgtttccaagccccttggagaaagtgtcataaaaagacaaaacgtgaatggtgtttctaaggtgggggaaggggctgagccctaaaggtagaagcttctggaaagtttccagagggcccagagcctgtttaagatgtcgtgcctgcgttaagtgtccagaactgtctgctcctttcagtttctcttggactgaccttttcctataaaactgtaaggaaataaaaagtaatgatgtgatgtgggccgggcacggtggctcacacctgtaatcccagcactttgggaggccaaggcgggcgaatcacctgaggtcaggaatttgtgaccagcttagccaacgtggcaaaaccccgtctctactaaaattataaaaattagccggctgtggtggtgggcacctgtaatcccagctacttgggaggctgaggcaggagaatcgcttgaacccgggaggtggaggttgtagtgacccgagattgtggcactgcactgcagcctgggcgacagagtgagactccatctcaaaaaagaaaaaaaggccgggtgcagtggctcacgcctgtaatcctagcactttgggaggctgaggcgggtggatcatgaggtcaggagatcgagaccatcctggctaacacggtgaaaccccacctctactaaaaatacaaaaaattatccgggcatggtggcgggcgcctgtagttcagctactcagcaggctgaggctagataatggcgtgaacccgggagacggagcttgcagtgagcagagatcgcaccactgcactccagcctgggtgactgagcaagactctgtctcaaaaaaaaaaaaaaataccaatgtggcaggcaggctggtggctgtctgaggtcagtccagagtccggagaagcagcattttatttatttatttatttatttatttatttattgagtactgtcacccaggcaggagtgcagtgacatgatctcggctcactgcaacctccacctcccagcttcaagtgattctcctgcctcagcctcccgagtagctgggattaaaggtgcccaccaccacacctggctaattttttgtatttttagtagagacggggtttcactgtgttggtcaggctgctctcaaactcccgacctcatgatccgcccgcctcggcctcccaaagtgctgggattacaggcgtgagccaccgcgcccggccagaagcagcatttttaaacttgtttggccctccctaacaccaaccttggcagttcctgggctgcagtaagccgagacttggaaatacattcgccttggagaattcaacttcaaaatgcatacgaagtaggtcagggtggaaataaaggcactgccctttctccaggcacgctggagtccacgccctgcctttgcccaatgccctctgagggagaggccctgtgccttgcacccagcgcgggccacaggcggaggccccattccaggcaagccgtgcccatggagaggctggcctgctaggctgtggggcccgatggcctgacactgtatggaccacgctcctgccctgccctgccccgccctgcccgtggcccgtgtgcagaagtgggcaggcctgggttgctgggccagagccccgagatttccccctgccccactggctgagtgtgggggagctgcttctccacttccgcgtgggtcttggccctgggaggccagtggccgaggctggtctcgcgggcgctcgctccaggagtggcgcgtcccctcagcgccctgtgcttcctcgcagggatcgactacaagaccaccaccatcctgctggacggccggcgcgtgaagctggagctctggtgagttggggctgcggcacttcagttcctgggtgaggacacaaatgccgaagggagaacagaacccttagagaaacaggaaggcgtcctgtttgcatttcacttggaagagccacttacacagcccctgtttaaacatagaatggattttactccaacaggaaaaagacagtctgggacactgtgtccctagagatcgcggctcccctcctgccccggaaaacctgattccgtggtggctgtgagccccttccctccccttctgtcggcttcaccttaaaaagcatttcccagcggggtgtggtggctcacgcctgtcatcccagcactttgggaggccgaggcaggaggatcacctgaggtcaggagtccaagacaagcctggccaacatggtgaaacgccatctctactaaaaatacaaaaattagccaggtgtggtggcgggcgcctgtagtcccagccactcaggaggctgaggcagtagaatcacttgaacccgggaggcagaagttgcagtgagctgagattgcaccactgcactccagcctgggtgacagaatgagactccgtctcaaaaaagaaaaaaaaaaaagcatttcccagaacgtcagcgttgatgagacgtgaatgtccacagggttggggttccccagcctggcaggacagtctcctggagctcccaggctcatgtgaggagcttgctcactccccaggtgggcgggggccccttctgctgcctgcctggctcagcggcacggcgccaggctgctgtgacctgtgcagacaaagccgcttagcacagcctcattggcacctgtcctggccgccccgctcccctcaggacatccaggtgggtcggcagaggagggaaggaggtgagcctctcacagggaccacagtcccggcccctcccctccccgtatgtttcagggacacgtcgggccagggccggttctgcaccatcttcaggtcctactccaggggcgctcaggtaagaccagcaccgctctttccattgcttttcaaaggatgtttctcctgattctttctgaatgtgagttgttgtcctgtcaaactcccaaggactttctttctttataaggatattctcacattggtttgtttatttgtttgttttgagacagagactcactctgtcacccaggctggagtacagtggcacagtctcggctcactgcagcctccccctcccgggttcaagcgattctcctgcctcagcctccccagtagctgggagtacaggcgcagtgggtgtacttggagctgtgtgtgtgcacaggtgtagtgggtgcactcagggccatgtgtgtgtgcagccatgtgcacaggtctggcgggggcactggggccatgtgtgcagtgtgtgcgcaggtgtggtgtacttggagctgtgtgtgtgcacaggtgtagtgggtgcactcagggccatgtgtgtgcaggcatgtgcacaggtctggcggacgcactggggccatgtgtgcagtgtgtgcaggtgtggtgtacttggagctgtgtgtgtgcacaggtgtagtgggtgcactcggccatgtgtatgtgcaggcatgtgcacaggtctggcgggggcactggggccatgtgtgcagtgtgtgctcaggtgtgtacttggagctgtgtgtgtgcacaggtgtagtgggtgcactcagggccatgtgtgtgcaggcatttgcacaggtctggcggacgcactggggccatgtgtgcagtgtgtgcaggtgtggtgtacttggagctgtgtgtgtgcacaggtgtagtgggtgcactcggccatgtgtgtgtgcaggcatgtgcacaggtctggcgggggcactggggccatgtgtgcagtgtgtgctcaggtgtggtgtacttggagctgtgtgtgtgcacaggtgtagtgggtgcactcagggccatgtgtgtgtgcaggcatgtgcacaggtctggcgggggcactggggccatgtgtgcagtgtgtgtgcaggtgtggtgtacttggagctgtgtgtgtgcacaggtgtagtgggtgcactcagggccatgtgtgtgtgcagccatgtgcacaggtctggcgggggcactggggccatgtgtgcagtgtgtgtgcaggtatggtgggtgcgcttggccaccctcgtttctgtctcctctgggcccccaagcacgcttttgtgctgactggatctgctggcgaatgtgaggccggaaggagggcaaggacgtgaagcccatgtaaacagacctgtcatggccactgttgttgctgcttcagtgggagggatttgagcgggtctgtcctgtctgtgatgcccctaagagttctggaagagccaggagagcccctccggggccagttcgtgagcctggagccccccatgtgggcccagggaggccgcctgggtctgggtctggatccttcttgggggaaggttcaggtctgtgccatgcagcttctggctcaggtgggtccgctctgggcaggaagctgcccaggtgcgagggggatggacactggagcttcgtcccatggcaagctcatttccttccatttctacactgaagtgtagtcggtgttggatctgatgtcttctacctgctggcggtgggtgggaaggacgccagggcgggctgggtcgcaccctgtcctgggagttccctcggagatgttggcagctccctcatgggagcagaagggcctgcaggctccgtgccatccctgtgagaactggagcaacatggccgtgattcgtggagcaggcaggtggaagacgggcaggctcaaggatgcattccatgggccctgcctgctattgaaagaggagttggggctggtgcggtggttcacgcctgtaatcccagcactttgggaggccaaggcagacagatcacgaggtcaagagttggagaccaacctgaccaacatggtgaaaccccatctctacgaaaaatacaaaaattagccgagcatggtggcgggcgcttataatcccagctacttaggaggctgaggcaggagaatcgcttgaacccaggaggtggaggttgcagtgagccgagattgtgccattgcacgccaacctgggcgacgagtgaaactccatctcaaaaaaaaaggaggagctgtgtgggtgatttacatctacaaaaatgccttcttgtcttccttttgcttttaagtatttcgtgatttttctgcaataaacatatactattttggtattaaaaaatatggggcgcagttatgttggatgacaataaagggttgttggggagatactggaaaaggcagcagggaggctgaacctgacaggctccactgcgggcatcccagccccccccgacgggctccaccgcgggcatcccagcccccccccgacgggctccaccgcgggcatcccagccccccccgatgggctccaccgcgggcatcccagccccccgccgacgggctccaccgcgggcatcccagccccccgccgacgggctccaccgcgggcatcccagccccccgccgacgggctccaccgcgggcatcccagccaccccccccgacgggctccaccgcaggcatcccagctcccacacagggaggtctgtgggacacgaggccagtacagtcgtgatttctgttcagctgcatgagaactaaaaaagaaaaaagcagttcataagctctgcatttgccaggctgaggtcctggaaagcaagctctgttatcatctccgtgttctttccaaagcatctggcacaactggttatgtctttgttttgtcttgttaactctggaaattctgagctgtcattttccacatgcgaggagcaggttacagacccaggtgcacatgttggtcctgggttgagggtgccaggtgcttccttgccccgggagaagcacctgagtctccaggcgggcctctgaccgccgtgactgagcatttgggccaccccgggagcccagccctgtcctgtgtctctcctgcctggtgagcagcggtgaggtgcgggtgcatccagccgaggtgcagagcccaggtttgcagcagggtttctcccgccgcccctgatgagacacagactagcaaggactgtctgtcccagccgggatttgtcactctgcctccctccgttagagagtggagaggcctggaaggtccccgcggcctgggtcttgcagatggcaccagcaaaggccaccggccactccccgctgccgtcacctgtcacacagcagcagtcccgcggctcttcccgcgaggcccttcacgtgccgccgaaggccgggctccctagacttcatggtcgtgtttgcatattctgttgctgtgatctgagacggcccctctcagaagcgggtgccacaacccgctggtgggatgagtgggtcacccaggtgcaggtcccttggtgtgtggagggtggggtaggctccttgtaactgcagtgtggctgacgggatgtgccatcctgtttagctgagaatttggggtcagcgggcttagtgccaggaaggctgtggccaagtgccatgtctgcttcaggacaaaggtgtggatttgtttccctgagagggggtttatgtggagcgtggtacgggaggcacacgtgctgctggcttgtcggcacacaggtgggcgggtggatgtgagtgggcgcggcttggcagtagctcccattttacatgtcagttgctcctgggcagagcctgggtgcagggatgcaggaggagggcttcactctcgctggctgtaccttgggagcttcagccacatgggtggaaggggcatgtgtttgtcaaaattcatcaaaatgttcaaacctcggatctttgtattttgtgctttgtaagttacagctcagtaaaaaatgatagcaaaaaggacacccactcttaggcccagcagttctacttctgggaatttatcgtgtaggtcgagttgatcaaaaaaaggtgtaaacgtgctcagatgcatattgccaccgttacccaagagctggcgcagtaccagttcacgagcaggcgggggtgctgggcctgagctcagggcgtgcgggtgggagcagcgccaagtgcctccacccccttgaccccgcccgcgaggcatgagcggcaccgtggacacgtctgtagacgctgaggaaactgactgtcagggcggctcctagaggggcctagagcagggcgagcgcgcgtcctgactcatcccctagagcactcgctcgttcttttgttttgttttttgagacacggtctggctctgtcgccaggctggagtgccgtggcgcgatctcggctcactgcaacctccgcctcccgggttcacgccattctcctgcctcaggctcccgagtagctagaactaggtgtgcaccaccgcgtccagctaatttttgtatttttagtagagacggggtttcaccatgttggccaggatggtctccatctcttgacctcgtgatccgcctgcctcggcctcccaaagtgctgggatcgcaggcgtgagccacggcgcctggccgaagtcgctagttttttaaaaatcagatcagttttagaaaacagaaggcagtggaagagtctgtttgtcccgtgctctgccccttgagacacgcagctgagggtgcttagggtgccgttcgttaggcggctgctggtcaccgagagtctccttttggtttctcactccgtggtcatttgggtccctgcggcctcactgtgacccacgccggagcaagcctccgggtcctcctgtgccatcgcccctgcccgtaacccctactcctcagacatggccatcccaggaagtgggggcccgctcagggcagcagccgggaggtgtggccagggccccccgcgtcacagcacacttggagcctgaggcagcccatcagccgggaggcgggccttctgctctctttctagagttttcagtgtcatgcgaataggggtgtttgccacagaaaacaggtcagcatcaaaagttacccctctccagccttttagcatttgttttatgtccatataaacttcttcagtgtaatgtgttgtgtgttcatacttttattttttaaaaatcatgctgggccgggcgcggtggctcacgcctgtcatcccagcactttgggaggccgaggtgggcagatcgggaggtcaggagatcaagaccatcctggctaacacggtgaaaccctgtctctactaaaaaaaaatacaaaaaaattagccgggcatggtggcgggcgcctgtagtcccagctactcaggagactgaggcaggagaatggcgtgaacccggaagcggagatcgtgcggctgcactccagcctgggcgacagagtgagactccgtctcaaaaaaaaaaaaaaaagaaatcatgctgggctgggcacagtggctcacacctctgatcccagcactttaggaagttgaggcaggaggatcacttgaggccaggggttcaagaccagcctgggcaacatagcaagatcccatctctaaaaaatgtttaaaaaaacttagccagatgtggtggttcacacctgtattcccagccactcaggaagctgaggctcagaatatcaggctgcagtgagccatgatcgtgccactgcatgaaccccagcctggctgacagagtgagaccctgtttcaaaaaaaaagaaaatgccatccgcagtgctgggacctgcgttcttacctcacctgggttgcacatctctccttggccagcatgcacgcttttacatgcactgctgctgtcttcagcatctgcacggtacatttcactgccgcttactcagctgtcccctgaggctggacatttaatttgtgtctggcttgtcgttgttatcagcgccactgtgacacacatcctcagttacttctgagttgtgggcttgccatgcgggaggttgccatgcgggaggttgccactagggagagtgggctgtgttgtacgctttggtggcccactccccagtctctccacctcccccagcagcaaatgagccagccccagtccctgtgccccaacctccagggttaacccctgggtgtgcatttgtttattctgaatcttatcatttatcgcccaccagactgacttggccatctctggcctcgaagggtctccctcagcgagaggtgtccttcctgagctgtcgctccatcctgagcaaggccttcgccctgggagcttagtaatgtcaaccttgttctaaacaggacctggggctacacttcagtcttccagatatcgaaagatggttctaagaggctctaaaaaccctaattttcagatggacagtgccctcttctttcagcctcagcctcttgtgtgataggctcttccattacgtgaaggttttgtcagcctaggagtagggtggatcacagctcattggctggatctggttgcagaattgtagggtgggagtggacgttggggagaggcgggcataggggaatgggcctgtgatgtcaccgtttcgcccgacagggctctgagtgtgagcagtgtgctcccctgtgctgctggagagccatgactgtcactgccgagatatttagggcaggtggaaacagcccagagctgagctccaagtaattggtctctaagggatgtggcaaaaagtccccgtggcaaaacctgctctgcctggctgggggagcttcacagaaactgtcctggagggactggcattctgctctgcaagttttaggttggaaaactcagaaatgcccccactcagctctgtcccaggtactcccggggggattcactgatggactggccgagaggacacttagcttccacagctgcacgtcccccggctgccagaaccccgcatctgcctgcccaggaaacttccacaggctgatggctccaggggagggaggggaagcggcatttctgacaccatggaaggcgcccacccccctgctgcagtcctgccaggtgagggcaggggtgaggggcagggctgcaccagctctgcctggagggcatggctcatctgcccatccgccaagtaataagcatccttggccctgcccgggaactgaggcccctgcacctgagcgtccctgggcctgggctggccatgcgtgtcagtgacccctgatgacccccaagtctctgttgcaggggatcctcttggtgtatgacatcaccaaccgctggtcctttgacggcatcgaccgctggatcaaggagatcgatgaggtaggcctgggtccggggagccctcccggggaaggcaggctggatggaggtacctgggccccgggtaggctctggattcccgcctgccgcccctcctgtggccccggctctgcaccctgcactgtcccacggcctacgcctgggcatgctggtcactgtgcacacgacagtcgggcgtggagcccagcaagaccaggagctacggggccacccggaagggctgcactgtagggcctgagccctggggtctgcccaccttgacctccgcccaccttgacctcccacggccctcaccccatcatagtccagacaatgagggcgggccctgctgcggctgaggggtgggtggcaccctgcgtttgtgcgtctgctgagttctgtgcccccagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgaggtgggtgggcgggcgccggccagccctgaggtccccgaacctgggctgccctgatcacatggaggctgaggggggccaggggccagtgagggaggttcaggcaggtcccttggcaacgcgcagtaggggctcggccggcggcaggtcagtgacttggtaagagcagcctcgggggagaggcggcagcactggggggcacaggagcagctgatgaccccccctcagggtgccgccgtggccgctgcactctgccatgcctgtgggtccctggcattgctggtgtgggcagtgtgtgctcgctccttcctggttccggggctggtcctgctgtcaggggagcacaggagccgtgcctgcagctttgtgttgtgtcatctgctcttcctgggtagccacatccttgatcagaggctcccgtgaagcccccctcagggaggtggtactgttgattttgtggtgcctcccagcagggttcactgctgaacagagagagggtggctgacggtgtcactgtccttcttaagaggaagcacgggcctggcacggtggctcactcctgtaatcccagcactttgggaggccacagcaggtggatcacctgaggtcaggacttcgagaccagcctggccaacacggtgaaaccccgtctctactaaaaatacaaaaattaaccgggcgtggtgacgcacacctgtagtcccagctattcgggaggctgaggcaggagaatcgcttgaacccaggaggcggaggttgcagtgagcggagatcgtgccacggcactccagcctggcgacagagcgagacccgtctcaaaaaacaaaacaaaagaatgagcgagtgctctagggaatgagtcaggacgcgcgctcccccgctctaggggatgagtcaggacgcttgaagggccagatcacgcagccctcacactgggagctgcatcatccaggccaggaactgggcagagtgccctctggaagccccgcagcagcaccgcccagcgtgcctggctttagggagcaaggcaggggatggggtgccagtggacacatctgtgctgggcagagaagtttgggcgtccaggtcctccaggagcccagcctgggaacacctctaggagtgtggagaccccgccaggcttctcttgggcacctcaggtctccctgcacagggcctcctcccccacagccccatggtctgacaccccctctgccccacagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggatgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtccccacgttttgctgtgtctggtggggtgggtctggcagtggcggtgccccgtgccaggggccagtgctgcttcatacccggcaaactgacctctggcctttgttttgcctgctgttccctgcgctgaccgggctgacctgccgcggttggctgggttcgcctcaaagtgagggctggagctgggctggagcagctgggcctggtcacggccattctcctcttcccggtggatggaatcccagctgggctgtgctgagccctcgctcacagtccccggcagcagatggcctggggcggactgtccccaacagcagcaggactccagagggccaggtcctccagtcagtcggcccgctcagcagagccgcctgcacgctggccaatctggtgtctgctatgcccggcccaggggggtgtggacgccccggaggtcacagctgagctggaacggggcactccagttggtacagggaccagaccacagcctctggctcaggtgcctccctgtgctgtttcgtgggcatgtccgggccttaagcccctccttggcagctccagcccagccgcctgctgctgggtctggcctagctacccccacccccacgctatcagggcccacccccagtctccttgtagagcagggactggcgcctggagccgtctccgggtctcattctgaccagaccaggctcctgttaccctgcctcctgggtcagaggtcagacacagggtcagggggacactcccatccggtctcaagagaaccactccctgaggccccagacatctggagccacagagggtttggaagggtagattccaggcagccttttgtcctgctgcaccaggcaggccagccccctgccctccccaacgaagaggagccagcctggggatgtgtgccccgccgacggggggctggggcagggcaaggctctggtgccctgggacacttgctcttttcagctgcagacgcccttgcacttggccttccctcgggcggtgccatcccacgcggagccacgtccagggctacacggtgcgtgggccgaggctccggcatcagcgtttcgggctgttcttatgcttgtggtggccacaggcctcttcctgctgcacctgccccgccttggggacaggcctgagccccaagcccgctgcctggtttcagggatggggtctctgggaatgcagtcctgccgggttgggccccactccaacaggggcagcagagcagaggaggccgggctgtgctgggcgtcctgcagacccctgtgcccctgaaacagccatggaggggggaaggaacctcggagcggagtgaagccctcggccgcacgtgaccgttgccagcctggacctggcccgggggacccaggctgtggtcagccacgctctgcggggagggcccgtgcctgccacccccatggcataggagcctggggtccagagggcgccagggacaaaagctgggatctgctggccctgcccccaccctactgagggtcgtcaaggagattgatctcagcccaggggtggacgaaggggttcaggttacagggtcccctcccctccccctctccagccagagccagcccttccccgccccggtgaccctcatggccagtggctctgtgctcatgggcctctggcccctccccaacctcctcccctctgccctgtgctgaccagggcctgggagcccccgcacggttcagacagaggggccaggctgaagctggagaggaaccagcgtcacacagacggcctctgagaacttggagaccccgttacccacccagcaggggtgtcaggacaagcatctgctgcaggcttcagcctcaggggcaaaagggagccccggggtcctggtgggggcaccgaccacaggcccggagggtggatgcctgcaggaagctgggctctgtggagcccgaggaggggctggtggccacaccccccggccccctggctcggcggccctcatgcccgccctacgtccactcctgccgctcctgctcctcctccggctgacctcgggggctggcttgctgccagggctggggagccacccgggcgtgtgccccaaccagctcagccccaacctgtgggtggacgcccagagcacctgtgagcgcgagtgtagcagggaccaggtgagtgtggtcgggccggggtcctggggctcagagcagccagcctgggcaagaccctgctggaggtgccaccttctgcctgggctccccagacttctggggggtctgggtctgggccccttaaggggcccagagacacccccatcgttgccctcatttgtcttaagaataagagccctccccactccagctttcatgctccccatgtgcctccaccctggggcaccatcatcctcggcgaccacccccaccccgtcactgcctctcctcccaccctctcctcccaccctctcctcccatccacttctcccaccccttcactgcctctccttccatcctctcctcccaccctctcctcccatccactcctcccatccacttcttccatcctcttctcccaccccgtcactgcctctccttccatcctctcctatccactcctcccatccacttcttccatcctcttctcccaccccatcactgcctctccttccatcctctcctatccactcctcccatccactttttccatcctcttctctcaccccgtcattgcctctccttccatcctctcctcccatccacttctcccaccccttcactgcctctcctcccaccctctcctcccatccactcctcccatccactcctcccatccacttcttccatcctcttctcccaccccgtcactgcctctccttccatcctctcctcccaccctctccttccatcctctcctcccaccctctccttccatccactgtcctccctgtcctcccaccctccttccatccgggaccagtgcagatggtggtgggggtgctgcagccgatgtccagcctttgtcctggcccgcaccacctgctgggtggtcctgagcactgtacgccctccttgggcctcagtttcctcgtctgtacaacgtaaagaataacggaacttgcttgtgggtgtgaggattctggaaggtaagccaggtggcacctctggcgaggtggctcctcacacaggatggaaaggacactgagtccccggggaggcagccacagagcggggggctccctgctaccccacctgggcctccccttgcaggggccaggccagagccccggggcggggggcattggggctcccacctaagtgtcccccatccccaggactgtgcggctgctgagaagtgctgcatcaacgtgtgtggactgcacagctgcgtggcagcacgcttccccggcagcccagctgcgccgacgacagcggcctcctgcgagggctttgtgtgcccacagcagggctcggactgcgacatctgggacgggcagcccgtgtgccgctgccgcgaccgctgtgagaaggagcccagcttcacctgcgcctcggacggcctcacctactacaaccgctgctatatggacgccgaggcctgcctgcggggcctgcacctccacatcgtgccctgcaagcacgtgctcagctggccgcccagcagcccggggccgccggagaccactgcccgccccacacctggggccgcgcccgtgcctcctgccctgtacagcagcccctccccacaggcggtgcaggttgggggtacggccagcctccactgcgacgtcagcggccgcccgccgcctgctgtgacctgggagaagcagagtcaccagcgagagaacctgatcatgcgccctgatcagatgtatggcaacgtggtggtcaccagcatcgggcagctggtgctctacaacgcgcggcccgaagacgccggcctgtacacctgcaccgcgcgcaacgctgctgggctgctgcgggctgacttcccactctctgtggtccagcgagagccggccagggacgcagcccccagcatcccagccccggccgagtgcctgccggatgtgcaggcctgcacgggccccacttccccacaccttgtcctctggcactacgacccgcagcggggcggctgcatgaccttcccggcccgtggctgtgatggggcggcccgcggctttgagacctacgaggcatgccagcaggcctgtgcccgcggccccggcgacgcctgcgtgctgcctgccgtgcagggcccctgccggggctgggagccgcgctgggcctacagcccgctgctgcagcagtgccatcccttcgtgtacggtggctgcgagggcaacggcaacaacttccacagccgcgagagctgcgaggatgcctgccccgtgccgcgcacaccgccctgccgcgcctgccgcctccggagcaagctggcgctgagcctgtgccgcagcgacttcgccatcgtggggcggctcacggaggtgctggaggagcccgaggccgccggcggcatcgcccgcgtggcgctcgaggacgtgctcaaggatgacaagatgggcctcaagttcttgggcaccaagtacctggaggtgacgctgagtggcatggactgggcctgcccctgccccaacatgacggcgggcgacgggccgctggtcatcatgggtgaggtgcgcgatggcgtggccgtgctggacgccggcagctacgtccgcgccgccagcgagaagcgcgtcaagaagatcttggagctgctggagaagcaggcctgcgagctgctcaaccgcttccaggactagcccccgcaggggcctgcgccaccccgtcctggtgaataaacgcactccctgtgcctcagacctcctggcttgctgctgctggtcgggcgaccctcatccttccaggtgccccatgcccagccagtttccgctggggccttgacacccactggggcttgggctttggtacaaggtcaccagggagtgcctgtccgcccctgcatccccaaccagctccatcctgcctcagcagctgtctcggccccaatcccactgcccgagctccagcagcaaggatcaggacgtcccaagcccttgaccccacaggagaccccgtctcccacccaacctcacaaggtgctcctaggaggaggtggggcagacaccagcaagccggcagcaggacatgctttattctgagcaggctgggcccttcggccagcggctgagagcacagactgggtggggctgtcgtccacaaggtccggcctagggaggcagggttcgtgcctcacagagcctccggcagggatgcaggtgtgcgggggtgaaggaggggcttagtttttccggaagatcaggcatttgttgttggctggcatgtccacctggagaaacactttgctggaggacggccctcaacccctagagaggttgcctgggcccccgctcccccacctaccatcctctccaggagcaggccactggcctttcccaggtcctccaggagggctgtgtcccgaagcccccattctgggttcctgcagagggtggggagatggagtcatggcctggggggtgccacccaagccacctgccacctgagccagaccccccgcctctagctctgacctgcatctgagcatcaggtcaaagtccacgttgctctggggggagatcttcccattgatggcatagggctgtgggcatggggacacagcccactggaccaaggtcggggtatttcccagagagcctgggacagacttgcaggctggggtttggagaatgaaagggcaccccctccctgtccccaagagggagtcagccaaggccagcctggtgggcaagggggtagggaggctggcagatgacccagggaggggtacagactggaagtggaggggaggccgtgctggtggctgggcggggggcagggagcccaggagggaggactctcagcagggcaggagacagcagctaggactgggagcgggaggcccgccgtggacaggcccactcaccccgtaggtgatgagcagggccctgggtttgagcaggtgtcctgctgctctgaagagcccctggtgagtaggaacaggacggcagtgaggtgctgcccccaacagaagccaggccctgaggctggagaccctcaccccgactgtgatgggggaggctggagaccctcaccccgactgtgatgggggaggctggagaccctcaccccgactgtgatgggggaggctggagaccctcaccccgactgtgatgggggcaaatctggcatcccagctgcccccatgcagggtgagtggtgccacggcagacacccatgctgggctccccacagacctccgtgcagcgcagggggctgacatgggccatgttgatgcagagcaacaggtccagcgactgtggcaggatcccgccccagtgctcccagccccacgtcacgtccaggtgtagcggggccttcacgttggtcaggccctgggcttgcgtggtggccgcgatgctgcaggaggcgaacgcttgggtgggggccgagtcctgtgcacccgcctttccgacgcccccacagaatttcttaggggaggctggggggcacgttgaggagcggagaccaaagcggctgggaagggggaccccgaggtccacccacttccgcagccgcgggggccgcacagctagggcctgccccgggggcacccccaggctcccaccccgcaccctcagagcccgagccgcatccttttcctccggggctgcgggccgtgggctcttgaggccccggaccgccgcaccgatagaagtggccgccccgggggccgcacctgtccaggcagcgctggtccacgtccgacggctgccactcggccagggggaaggcccgcgcgaagtgcgctgcgtgctggccggagcccgaggccacctcgaggacgcggacgccacgctgggccggatccaggtactgccgcagcacgtgcaagatgggatccttgttccgctccgcggccgccgccaccagcatcgcggcagcaacaactccccgccgcggacgcggcgcgggtcgcgtcgggggcggtggccgggcttccgcggggcacgtcgggagctgtagtccagataccgcggggcacgtcggaagctgataaactacaactcccaggagcacgcgcgcctcctgttaaaggaccagcagtcgccagaggcacggtggggagcggctcagcggtgtgtggcggtcccaggcaggggactgaacggcgagcttggcttgctggtttacaggcgcctcagctcaggcaccctgtcgcccatggccgtccagggttttcagggcacctgtgtcactctccgaaatttgtgtcagcgctgcgccagactgggcgccttcccttggtttcgggttttctctacttttaaatttctggcgttagcgagagttcgatgttcaaatgggaaaaaaaactaagtgcgccgcccgggaatcgaacccgggtcgcaagaatgggaatcttgcatgataccactacaccagcggcgctgtctaagacagttgctgcccgcggagacaagagactgtgacgcgggaagtcctccgggcgtgcgccgccgctggcgccgggctcagcgcaagggagctggcgactgcataggaggacccagctggcgggaccgcgagggtaagagtctcgcggtgccccccagtgccggaggggaaggagcgggcgtgaaggacgcgagctggaggacagtctcgattcgggcctgagccgtggaagccgttggccttcgtgagccgatgggggcgaggccctgtcggggcggggctggggagagggcggggctgggctggggccccctgttggtccgagtttagggcggggttgccggaggggcggggccatatcggggcgggtccgagaggggaggcggggctggggggcgggacatgagtgtggactggcgggttggggcggggccagagcggggttgcggcaggggcggcaggggcggcaggggcggcaggggcggcagagggcggggcgggcggtcccagcctgcagaactgggcggtctgcgggaggggcacgaataatgccccagggtttctctgtgacactggggtaacagcaccagctcagggcccacggatagcgtgaggggtcggtcggtgacccccgaaatcaagtcacaggccgcgatttatgtgcgcccgagggttggggtcccagcctcagagccgggctcttctccagaaagtgccaagcgcctggctctgcattcaggactggcttagcgcctttgctgagccgtttttcaccaatgggaaccccatatcgctctggctagggcaaggacgttggaaggggtaaaccagggagggccagtcacgtggctcagggtaggagagtggcttacaggctgccagtctgggactgggaacgcgggccatggggggctcagggagtcaggggtcagggacaaccctgccaggagatgttggtgtccgccgtggtggtgactggccagaccctgcagcaggctctgcggcccaagcccacgctttcctcgcctgactggccgcctccatctctctttctgtgggctgagcactttccctgcgcctccttcaatgcgcaccctgcccccaacccccacctcgaggagagccccaggaggagggacctatgatgaccagtggttctcctggggcccatgcacctctcctcacccagatttcacctgggcttccctaggcacaggaaagaggagcccgagatcagtctctctgcgcctccctgcttccccccttgaatggagctgcgttcaggagctgcctacagtgcccagcgcatggcaggtttagtgttgcctgacttcagatatggcctattgttggggctggatgtttgggcctcgtggcttgaccaccaatggctgaagcaaacgctagctctgctgagctctgggccagcccagcttgtccttgccgcctgcagtgggccccaaaggtggggggccgccttcgggagcctgtgtgagctcgggttatgcccttccccacatggggcttccctccccagcaccgccctcactctaactcagctggtccttgctgccaggtcttccacaggagcatatgccctcaggctgtgcacaggccccccagcaccccgtcctgcctccctggcctgtgtgagtgattgcgctgaaggccactgggagaagccagggcaggacgcaggctgcacagatgacggggatcacactggccttccttgaaggacacgatgcccgatgctggtggggggagggcagagccaggtggggggaggggaactgggggagtggggaaggtgggggcaggggtgggggtgggaggtagaaaagagtccgtgaggagtccttcctagggggcgtctcaggcttggcctccctggctgtggcttgccatctcctttgccctctgagggccacaggcctggcccaaccctgcagagaaggcagctggggatggaaacctctttccttccgctcttcagccatgctgaggaggggtacagggccaagagacacctgggtcagaagcttccctgagggcctcccagtaagtctggagctcccagaagggaggagaagcagggccagtgcatggggtgggggctcctcgggctggccccccaccaccaagggcctcccctcacccctccatgtggtgcatgttgcttgcctggaaatttagacaggaagactctgggccctgccgcccacccgccacagctccgttttcagccacagcatccctgacctctccttggagaatgtgggggccactggacacgccaggccctgatgccggcacaggcagcctcctcttgttcctggaccaaactgagagtcgggctgctatttctcgtggcccagtaacgagatgcagatgaactggtgaggaagagggtttttatttctgcagccggttacaaggagaaggcctggaaattatcaccagaacaagtcaaattacaaagttttccagaggttatgtaccttccaacctagatgtctgtgtgtaagtgtgcattcatctgaagacataagtggttaacttttttcttttttcttttttttgagacggagtcttgctctgttgcccaggctggagtgcagtggcacgatcttgggctcactatttttagtagagacggggtttccccgtgttagccaggatggtctcgatttcctgacctcgtgatccgcccgcctcggcctcccaaagtgctgggattacaggcgtgagccaccgtgcccggccaagtgattaacttcttttaatctataattaaggcctgagtcctgaagaccttcccctggagcctcagtaaactgacttaatcttgtttcctgctaaatcatgaaggtttggggagttccttcgggctcccaataaacttgtctgtggaggcctggagagtttcttcagacctccaataaacttgtttaatcctaaacgggtcctattaagaattccttcgttatcttgtcgcgcttcaaggcccaggagaggcctgggcacagctcttggtgggcttttgttacattccagcctttgaagaagggcactggcttttcttctttagagtcctgctctgtcgcccaggctggagtgcagtgatgtgatctcagctcactgcaacctccacctcctgggttcaagtgattctcctgtctcagcctcccgagtagctgggactacaggtgtgtgccaccacacccggcatttttttttttttttttttgagacggagtctcactcttttgcccaggctggagtgtagtggcacgatcttggctcactgcaacctctgtctcccaggttcaagtgattctcctgcctcagcctctggagtagctgggattataggcacctgccaccatgcctggctaattttttttttttttttttttttgtatttttagtagagatggggtttcactaaattggctgggctggtctcgaactcctgaccttaggtcatccacctgcctgggcctcccaaagtgctgggattacaggtgtaaaccaccgatcctggacagctttttaagcttttaatattgaactaaccactctgcactgaaataattgttatggaggcctgcgttagtgagacctggcctgccacactctcacatctgtggggcgggtacaggagccccaggggccgaagaggcacacgtcgggcctctgggtgcacctcagcctgggggccaggacgtggggcagagtgcagccagggttctgactcctggggtggaagggagactcccagggcatcatgtctctacccaagtccagggggatgagccgctttttctcttcttagacccagtcccaagacccaagccaagggtgacccttcacactggcccaggcctctgcaggcaccttggctgaggctccccaagtatgaatggtaaatccttgcctccagcctcggcacagaggagcccagcacagacgcccccagcacagagtcccccagcacacagcccccaacacagagctcccctgcacacagcccccctgcacagacacccccagcacagagtcccccagtacagagcccccagcgcagataccccccatagcacagagcccccagaacagagacccacagcacagagtagccccccagcacagggccccccggcacagggatccccaagcacagggacccccccagcacagggatccccccagcacagggcccctcagcacagggccccccagcacagggacccccccagcccagggatccccccagcacagggccccccagcacagggcccccagcacagggatccccccagcacagggcccgcagcacagggatccagcacagggactcctccccagtacagggatccccccaagcacagagacctccagcacagggatccccccagcacagggccccccaatacagggatccccccagcacagggatgcccccagcacagggcccgcagcacagagccccccagcacaggcacagggacccccccccagtacagggatccccccagcagagagacctccagcacagggatgcccccagcacagggccccccagcacagggatccccccagcacagggatgcccccggcacagggcccgcagcacagagccccccagcacaggcacagggacccccccacagtacagggatcccgccagcacagagacctccagcacagggatgcccccagcacagggacccccagcacaggttctcctccagcgcttgtcaaaggtgggccctggggctccgaggaccctgctcgcacatcgccgctgaccccgcagggcccctgggtcctcgccgccagcagtctgagtgcggtgccccgacactgacatggcctccaggcagcaacggccttcccgggcagcagggcgcctcgtccgccttggcctcgggcctccgggggctggggcggggttgctggcggctccgcccccgcctgccagtttcccaaagggcgcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtgcgcacgggccggggaacgggaacggggacggggcggggcgcggcggcggctgaccgccccccggtgcccgcaggtcccacgcagcagcaggtggagggccggctcggcgagctcctgaaatgccggcagcccgcgccgccgacctcgcagcccccgcgggcgcagccctttgcgcagccgccgggaccctggcccctgtcgaggtgagacgcgcgcggccccggcccggcccggcccggcttcccctcccccgccggccgccctagagcggagggtgaccttggggaaatgttagtgaggtccggccacgtgctgcaggcggggcgggcgctccgggcgcggggggtgcgcgggtcctgcccactacgcgcccgcgggcctgcgcctcgcacttccgcctcacctggccgggcccgggcccccagcggggagaaagccggccagttcctgggtcgcaggggcctccagcgtccgaggtcggtgcttcgggcgaccttgggttgctgctggaaccctgacgtgcagcaggcccaggccacggttcgcggagagcgtcgggcgctggtcctcaagatctcccggctctgcccttgcagagctcagtgggggagacgtgcgtgcgcttccctcgggcagggccgctgccctcctccgcccttcaccccagacaccctggggcagtggggcctccccccatccggttgcttctgcttttcctaacccagttaggaaactccgagaccacaggagcctcagtccggccactgtggcctccccgtgaccatgacccagaggttggacagccccgcagggctggacgtttgactttggctcagttcctccaccgttcccttcatttatcctgtgcctctcccaggcctgtggattttgctgtggccccaagccggcccgaaggctcctggaggtggtagggtcatggcctgaggcggtgctggggaggagagctcgggccaggagttcagggcagctacaggtgggggggtgccgagccaccctcagcctgccccctgcctacctctcagaaaggtgtggaggttccagcggggcgggggctctctggggctccatcctagtgaggtaagtgccctctaccagaggcgccttctggcgggaggtgagtgggcccctaggtgcttccagcatcccagctctgctgggacgctccgcggacatcacccttggtcctcgtggccgctctacttcccaggggaggaaaccgaggcacacctgtagccaccacctggtccccaggcagggagcatgaggctggagtggcccagggtgacgccgtctctcttaacctggggaaaccacctttcttctctctccaagaccccactgctagggagggcaggggtaaggctgtggcacagttaggaggagttagggaagaagatggaaatgcttcccagagttctccatgggaccccaagggtcccagtgggcaacaccaggcccactggctgttgtctctttttttttttttttttttttggagacagagtctccatctgtcgcccaggctggagtgcagtggcgcaatctcagctcactgcaacctctgcctcccgggttcaagcgattctcctgcctcagtctcttcagtagctgggactacaggtgcgtgccaccatgcccggctaattttatatttttgtatttcaccatgttggccaggatgggctcgatctcctgacctcatgatccacccgcctcagccccccaaagtgctgggattacaagtgtgagctaccgcgcccggcctgttttcttaaagtccccatgtgaggtcctctgtcagccagtgggacctgtgggagttgagtgggcttcaccccgtgtgcagtggggctagaggagccctgggcagggcaggatgtgtgctgccctctcctccctggggtcacccaccttcccacccccaggccccagcgctgggagcttctggcagcagtgggatctctgcatgaagcccccatcctgctcctgcaccttcttggggcaaccaccttccctctgtttctttttttttgaaatggagttttgctctgttgcccaggctggagtgcaatggcaggatctccgctcaccgcaacctctgcctcctgggttcaagcgatcctcctgcctcagcctcccgaatagctgggattacaggcgtgcactgccacacccagctaatcttgtatttttagtagagtcagggtttctccatgttggtcaggctggtctcaaactccctacctccggtgatgcgcccacctcggcctcccagagtgctgggattacaggcgtgaaccaccgtgcttggccaaccaccttccctctgaaccaccccaccccatgctgccacccacctcgctgttttttacttcatttaatttttttctttttgagacaaggtcttgctctgtcacccaggccggggtgcagtggtgcaatcatggctcactgcagcctcaacctcccaggttcaagtgatcctcccacctctcgacttcctgagtagctgggatgacaggcgagcaccacacctggctcatttttaacttttatgtagacaggtctcactatgtggcccagggtagtattcaattcctgggctcgagcaattctcccgccttggcctgtggaagcgttggggttataggtgtgggccaccgcgcccggccctgccctgccttttcttctccttggtgctttttgctactcctcatctctcactgactgggcgcgggaggggggtgtcggggtccctgcacatctcctggtgcacccagagggtcaaggcttgtcacccatgatgtatgctggctctggttcctgccaggcatgggtctgggcactgcccacgacagtgacagaccagataaaccttggtttgtttttttaatttttatttttattctgagatggagtctcgctctgtagcccaggctggagtgcagtggtgtgatctcagctcactacaagcttcaccttccgggttcaggccattctcctgcctcagcctcccgagcagctgggactacaggcgccctccaccacacccggctaatttttttgtgtttatagtagagacggggtttcaccgtgttagccaggatggtctcgatctcctgacctcgtgatccacccacctcggcctcccaaagtgctgggattacaggtgtgagtcaccgcgcccggccacctttgtttgtttttgagacagagtcttgctctgttgccaggctggagtacagtggcgtgatcttggctcactgcaacctccgcctcccaggttcaagtgagtctcccaccccagcctccggagtagctggtattacaggtgcccgccaccatgcccggctaatttttagtatttttagtagagacagagtttcaccacgtatgctaggctgatcttgaactcctgacctcaggcgacccacccgcctcggcctcccaaagtgctgggattacaggcatgagccaccacgcccagcccagatacacctttgacaagttcttcctcctggtgggagatggataggggaggcagtaagataaactgaggcgatataagtaataagatgaaacggggccatgtgatcacccgaccccagggcagatggagggtgtggggaccgccacaggaagggacaatggaatgaaccccacagggcgagaaggggcagcctgcaagagacgggggtggggaggcccagtgagggcaggctgaggggctggcttgggggctgtactgggtcagggccatggactctgttgttggatttgctatgatatcctggtgctgcccccacccagcatgtaatatgctcaggtggattctctcccaagcccagcttcatgggctgaaaaagggatgggctgtggaggggagaggagaggatgcactccacagccttcacctccctgggctgaagtttgcccggagcagtgtccctggaagtgggagaggttggcggtgatccataggtgctcgccgggccggtgccctttcccccagagagcagcagccttacgtaaccagagcccctggggcggtgcctgcctcctggggcccatctctgcccgagagccgccacctccgcccttcgattcacagcccctggcaatgttcttgtcttcttagacattgataatccaacctccaagctttcttggagtttctggctttccgaggtgggagtgggttgcaggcaagggggctttccaagtggacaaactttattccctgtggtttgtgcagaaactcaggcagcgggcaggcctgggaggtgcccctgcccctgtcccatctccacctgcacgttttaagatcctctgtggccaccagaccctgccagccctggggccggcaggaccctgcgcccctcaagacactcctctttattttagtgcccctctcagctgaggaggaaccgagagcggcgctggggcacctgagcccaggaaggcaacaggccggccgggaccgcgagtgcctggcggagcaggcgcagcccaggactcccggctcccacctccggctgtaggtgcggccccattccctccacggccctgtcccgggctttgtgtgctcagggctcggccagctggggccgctcatccctgccctgggcccggctggccgggacgggcccaggggcccaccagacgttgcgtgcggcactgcgggagccatctcctttggcatcgccccttgtctcgggccggtggggagtgggcgagggttatagtcactctcccgactcagggactgcccatcccggcacccagtcctcatcccatgggacgtgggggcagccagggagagggcaaaggcccccgttcccgtccaggtccatccgtccatggagggaaacatcgtggagatggaggtgcttctgtggggcgagaatgtggcctagaactacacccagagtgggggggttggggcagagagacatggtcatggactgggtcgtggctcaggtcagaatctgggctgctgatgggatgcaggtggcagcatgggcacctgcaagaccctcggggaggggtactgagtggggcccgaccaaaggtttgggacactctaagactgaggcccccaccctacagtcactcacttccctcaggacacagggctgcaggtgtgagctgagctgccgatggcttggggactgcaagagaggcctgggccaccggctgctgtgggtggctgctctctctggttcaggaagtgcctaggctggccaagtctggggaaagtgggctggcccggggctgctcctgagttctgccaggcagcaccgcacctgggatgggcaccaaccatgtccgtctcctcccttcctgcagtccagggccaaggcttgtgttcaatcgtgtgaatggccggcgggccccctccacgtccccatccttcgaggggacccaggagacctacacagtggcccacgaggagaatgtccgctttgtgtccgaaggtagcgagcggggccagagggtgcggcataggctgctgggtcgcaaaaccatggacccgggatggccccacttcaagctgacccacagccgctgcatggctgtgcttttccttggcactctgcccttgtgtcctgtgaccagccctgtgtggggctggagtccagggtgaccatcaggccctgggtgggcgatggggtgcctgggacctggctcagcccgactgccctcctcccacagcctggcagcaggtgcaacagcagctggatggtggcccagccggtgagggcgggccaaggcctgtgcagtacgtggagaggacccccaatccccggctgcagagtgagccccccaaccctgtccccccaggagagaccccccagcccctctgatcctgacccaggccctgccaggttcccaccccaggggatgagggaggggactcttgtgcagaaaccccttcttcccagcgcctgccgcactcggagtccgggtgagcggcttgtggttagctccaggggagacttgccggctggcctgggaggcagcatcactgcccagccttctctgcccacagactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtctttttggagtgtctttgacttgggagggtgtagggggggttctcatgtccagttccagtccacagcctgggacgccaggcccagcacaaactccccttgtagccctgttccttcaagccgttagcttctcacccagctgccctgcgacaggtaggagggacgttagccagcccaccttgcttggaagtctggggaccccacttggttcctctttcctctcccgttggcgttgactgggaccgaagccgagactcaaggcctaaagacattaaatggccccggagtgcagtccaccaccccccactaccggcactggggctgtgtctcagaacgccaggtcccattctgaatccgccgggcccggccgcaggacactgggcgaaggagtacgtggggaacctgataggacgaacgtgggaaccagcccctccgcgggcgcccgcactaccttccctgatggacggggatgacccagcccacctgagtcaggacccagggtacccaggtgtggagcaggggcctctggacggcgagagagcggcagggtgaggcccggccgtccgtggcatggccaggcctcagcgcgacctcgcctcgctgcttgcatgcggcgggagccccggccggccgaggcgctgacaggtgggcgcggcggaggatccgcaaccggcgcgggcttcgaagccggtcgggctaacagggggctgccttgggaggcccgcggggcaaagggcagcgggattcgcggctggagcaaccctggaggccgctgacgtgagcggggtactcccaccggggaggtcacgtggccagggcgccgccatgacggcggaagtaatggcggaagtggcaccgttgccaggcagccgttgcctggcgtcgcggggcgtactctgcgctgggcgcgcggaggcctaggcgggaagctcgagcggcggcgccatggcccgaggtagcgcgcggctggcgggggtcccgaggatcccgggttccggggttccggggtccagggtcggcggccggagcgctcagggcccccgcctaggccctgaggccagagtccccgctcaggcagggtcccgtctgccgggcgcccaccctcgggctcccggagcttggcttccctcgggcgcccggcctcgtcccgccagcctagctggcgttggcgtcgccggggaaggcgcggagagccccggctcctgcctggtccccgaggcccggcccagccccgcagtggccccggctcgcgtggccgagtcccctgacgcccggcgcccgctccccgcagcgtggcagcacccgttcctcaacgtcttcagacacttccgggtggacgagtggaagcgctccgccaagcagggggacgtggccgtggtcacggtaggcggccgggggctcgcccggagcccacacccctgccctgcccccaggagagctgccccgcccccgagggccccctcgcccccgctgcacttcttctgggtgctgtcggtgatgcgggctcccgcttctccaggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggtacggagcccgcggctgggggctgcgtgggagccccggcacccctgcggcccctgtctcctcacggccctgctccgtccccacaggacaaccaagtcatccgtgtgtctttctccaacctcttcaaggagtttaagtctacggccacgtggctccagtttcccttggtcctggaggccaggacacctcagagaggtgacaccaagatggggtgtggatgatccaggacaggtggctggagggagttggtgcaggcccagtgaggctcctctgcggcctggaggacaacctggcgggggcacaagctcacagttctgggagtcgcgggctgtcaggagggtgggcgctgaccctgagtgcccatcctgcagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctggtgagggccgcacctgcactccccactccatatctcacccatgctctcagccctggagaggcccaagtccagggtgcttgggaaaatacagtgctcgagctgtgctgtctctgagctctggccagaacccatcccagaggcagccctggggtcagaacccatcccagaggcagccctggggtggggcggtggctgggctggtggcgtggcagtgccttggcgggtgccctgtgttcaggtggctaaacagcctcccttgacctggaacaaccctgctccttgtagccatctctggggcccagtgggcaaagctgcccgtgactcctatgcctcgggaaatggcattccctgtgcccaagggagagagctggcatgaccgctacatccacgtccggtgagtggttctgcttctttcgagggaggcctcggtggtgggagggtgggtggcccttgggcccccagacactgactctccctctgcctgccaaggtttccaagtgagagcttgaaagtgccttccaagccgattgagaagagctgttcccctcctgaggcaggtgggtctggggggtcagcggggacccaggttaaggcctgtagggtgcgtggggctcggtaggagagggcagggctgggaaaggacccagtggtgtgctggctgcagctggtgcagggacccagggaagcccgtaggttgtccgagttcccagaaccacgagggtgggaagtctgtgtgaggggtacccgggggccccaagctttctagctggaagaggagactttcagggcctagggtggaagtggggatactggctgtgggtcctgcagagccggtgaggctgggccacttgctgctgccctccccaggcgtcaccctcaccaggcatctgcacagctggcccctgggtcactggggttctttgctctgttctagtcctcctggggccggggccacagcctctcccttgcccggtggcctccagcaaacctgtgcggttcagtgtgtctccagtggtccagacgcccagccccacagccgtgagtacccccttcgccctatgagatggggttggggtgtgatggcccaggacgctgatgggcacttgtcccccagcagtccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaagtgagtgcccatcccacagcaggcggggcctggtgaggtgtgggctggggcagctggtagcccgccccgagatgcattcagaacggatgtgcctccaacggtctcctcttgttcagcctcctggcaaggagcagagctggcgggaggcggctttggggaagaatctctgtccacaaagagtaaggcagggcttctgctcacccccaatgcgtcagccccaggtggtctgtgggggaccctcgaaggtctggcagtgcaactggagtcccagcttccaccttaccacagccagcaggagccacccaggaccagggcagtcttcttgagaggcaggacccagctaggggttggcggggctcggagttggtcgggcattctggggacctggctgagcctcccaggactttgatgcgaatggctgtttcagggcttcctcccagacccagtcctgaggctcaagggcgtcatcggctttgggggccacggcaccagacaggtgaggctcctgcggctgtgtccagagcagctctcgttggccggctcgagcgctgagtacagaacggggagagaggagagacctatgtcctgtggtggctgtgtgtgggctcccgagcccccctggcacagcggtcccgtccccctgcagtccgctgcttcccgcgtgctcaggcatctgccccgcccacagctgctgtcacctcctggtgcccgggggctctcagggtcacgggcatctcttactcactggctgggctaagtgctccccccgaagacccagagctctcacgtctttagagctctgatgatccagaccagcagtgtggggccaggctgtgggcacaacctgtaggtccctcatgggtgacgtgggccttctaggagaggagccccatggcagaggaggtggccttcccctctgcctcagtggccttgggcccttgtcaggccctgctgggtgcctgctctgagtgtttgggggccctttggccttttgttacccccaccccggagtttcttgcactggaggcggggcttagaggacaggcgtctgtgcatgtgtgtacacgtgtctgcttgagtgttccagctgttcttttgacacatgcagcctgtgactcgtgtatgtagtgtgtgcagggtgtgtgttctctcttgcccctgggtggctgtgtgcccaggtgtgtgtgccaggcctgccaccccctctccctgggctggagtgggaggtgaggctgacctcccggcagccaggaggggcctggcgtagcaccggtcctcagccccccgcccccttgtgccaggccctgtggaccccagacggggcggctgtcgtgtacccctgccatgcggtcatcgtcgtcctgctcgtggacacgggggagcagcgcttcttccttggccacacagacaaggtgggtgctgcccgggcctggggcagctcacacctgcagcccctacaccctccctcacccttctgcctcctaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcaggtgagcacaggtctgccccatgcagggggagggggtcagcccaggcgacaatgaccacctcctccctgttcacagcttctctgacagcggggcccttctctgcggggttggcaaggaccaccacgggaggacggtaacagggccctggctgcgggttggggtggggctgtcctgatgcacgcagacagctggaagggtcttggttttctgaaactccagcttcatgtgaccctgggtccctgctctgtgtcctccctgtggtggggctccctgcactctggtgttcatgccgcccccgtgccctgcacaaaaaccaccaccagcagctcacatttcacgtctcggcttttcggccatcggagtcggtttaagccagcgtttacacacctcgcctcgttctctctgctggtgatgcggttgtaagattttcacgtggcagagcccctgcagctgacccacgcttgggcatcaatggcacctccacacagccgaagcacccggcatcttggtgggggcacctttttaaacattttttttttgagagagagccttgttctgtcacctaggctggaatgcagtggtgcaatcatagctcactgcagccttgaccccctccctgacctccccgccagctggactccagccatcctcctgcctcagcttcccagatagctgggccacaggcgtgtgccaccacacctggctaacttttttttttttttttttttgagatggcatcttgctctgtcgcccaggatggagtgcagtggcgcgatcttagctcactgcaagctccgcctcccaggttcacaccattctcctgcctcagcctccccagtagctgggactacaggcgcctgccaacatgcctggctaattttttttttttgtatttttagtagagataggctttcaccttgttagccaggatggtctcacgttttgtttttttaactttttgtagagatagggtttcattacattgctcaggctggtctcaaactccagggctcaagcagtcctcccacctcagcctcccaaagtgctgggatcacaggcatgagccactgtgcccagccacgagctgctttttatccaccttccggcttgcgggggggtttgtacttctctgcgaatgggttgcagtgctcagcattgcgggtctctgtagaagtcccaaagcttcaggatgagaagatggaggggctggtttccttccactctccacggccgcacgctcagaggctggtctccgcatgagagaaaagccacctccgggtggggctcggctgggccttgcagaatcgaggtggccccgactggccctgccgtgcgggctcagcctgggcttgttgcagatggtggtggcctggggcaccggccaggtgggcctcggtggcgaggtggtcgttctggcaaaggcgcacactgactttgacgtccaggccttccgggtcaccttttttgatgaaaccaggtgatgcagccgcccatccacgatgttgggagagggtctgggcccggagtgggggccgaggcccgagcacctccccctggcttggctgtgcgtctctgcgtctcccggtgggtcagggcgctgcgagctgcggcagtgctcagtcctcattccttgcaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctgtgagtccctgcccttccccacggcctgccccggcatgggggccctggtgcctgggcctccccttccctgagggcctcaccttccctgccgcctcctcgggcagcttcgtgtgcagccgcagtggccacatcttggagattgactgtcagcgcatggtcgtgcggcatgcccgccgcctgctccccacacggactccaggcggtccccacccacagaagcagaccttcagctcaggtaagagggcgcccaccacgtggccagggtggcagggacaccgaggcactgacgcctccctgcccccaggccccggcattgccatcagcagcctcagcgtctccccggccatgtgtgctgtgggctctgaggacggcttcttgcggctctggcccctggacttctcctcggtgctcctggaggcaggtgatgctgtgggcacgctctcccaactccgggagagcctcgcctggatgctggggcggggaaggcccagtccccggggctctgctgtcagccgccctggctcctggctgcacagggtgccacggggccaagtggcatatccagagccctggggcggctgatgccagggcggcccgcggggcagcctcacggaagggcccggtgggacgtgggtagtgtgtgaagcccctcagcctgggtcccgcctagcctaagagtggtggcctcgagggagctgcatcttgcagccgtgtggagcctgggactttgagcagcagggagtgcatttgctggggtgtcggggacccgaagcctgagcatgcggctcaccccggggtggccctggaggcccctgaccccaccccacccacagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcaggtggggtttggcaggggcagcacggcagggagggccgggaggtcctgaagctggggtttgtcagcgggggtgagaggggcctatagggacctggactttccagcctgtgtcggccccatgggtttgggccgcctggagagcccctgggcccttgagatccctgccctcccctcagcacggcccctgtcccacagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtaagtgcccagctggccaccagccccacggagaccccacggtggaagctggggtggccaggtgggggtcatgtgcaggatggccagtgctggctggagccccaccctttgctgccccatggggacttccatggccaggctggttggctggaggtcgagggaacccatggtacctgggcttcggggctagggccagcggggtccctgtgtgtgctgcaggtgccaccgaggagctgtcaccggcctgaccgccacccctgacggccgcctgctcttcagctcctgctcccagggctccctggcccagtacagctgtgcggacccccagtggcatgtcctccgagtggcaggttgggccccctgcagccactctgggggactcctcagggcgggggaggcctggatctggtgcaggcccacacctggacacacatgccggtttcctggtgcaccgactgggtcctgtgggggggcgtggccgcctcagtaaccttgtcaaggccctgaggagactgtggtttagcgttcactggaccccaaggccagaggtcagctcgggtctgtgcccaggaggcggcaggcagcccaagctccaggtcagcagctggagtcagacccaggcatgggcacctgccctgtcctgcggccaccataacttgggccccctgagtggtcacttatgactactgctggcccacggggactcccagctcccctggcagcgcctggcgcccactggcaccttggcaatcctctgccggtgtgatgcgtctgtgctccggggctggtgtttcccgaaagtgggggcaggggcggcggcctcctcgggccctggccacgcgcaccccggcactccccacccagctgacccctgccccgtgtggccacagcggacatggtatgcccggatgcccccgcgagccccagcgccctggcagtcagcagggatggccgcctgctggcctttgtgggaccctccaggtgcacagtgacagtcatgggctcggcctcccttgatgaggtgagtccgcagccctcctgggtccagggagactgggccatgagaggctggctgcaggggcaggagggaggtcacggccactcgggagcaggacccaggccctgtcccgcctcctgtcgcagagtacacatcagccatgtggggcccacgtgcggccaggttcctgtgcagggcaggtgctgcctgggtgccgagtgcgtgtccccgggacctccctcccgagcctgaccctgggtggcaccggctctgcccaggggccctgactgtcggccacttaccactacccccagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggaggtgagcctcagggctgtggcccgccgacctggccctccctgtgctgtccaggcctggcctctgtgcctgcagcctctccagctgggtggggggccgtcgccacacccacaacgaagggaggccccaggctgctggccactctcctgagacacggcatttcccaagagcactgtgttccagctgcccggtgtccaccctgagccctgcccctccttgacgctcagtgaggacgcccgcttcctgctgattgccgccggccggaccatcaaggtgtgggactacgccacacaggccagcccaggcccccaggtgtgtgcgtggggaggcaggtggctttggcggtcaggagcctcctcaggtggccctggagacccctgcaggtgtgggtgggggcagggagagcagaaggtgaggggtgagagtgaccccccaaggatcctctgtgcctccggggcctcacactgtgtggggctcaccgtccctggggactgggcacacggcagcatccatgccccgcctcggggtcctgcatgtgacgccgctacccctaggtgtacatcggccactcggaacccgtgcaggctgtggccttctctcctgaccagcagcaggtcctcagcgcaggggacgccgtcttcctctgggatgtcctggcccctactgagaggcaagtgcctactctcagctgtgtctgcctaggccccccaggccctcctgaaaccctctctcctccctctccagcgaccaaagcttccccggggcccccccagcctgcaagacaggtgagtggctgtgctcagctggggtgcaggtgctgcgctgactctggggcccgtcctgtgtctgcctagtggcccttcctcttccttcccaaacatcacagggctgcttcttccccaggcccgggcgcaggaccgctggaggacgcagcgtccagggccagcgagctcccccggcagcaggtccccaagccatgtcaggcatctccaccacggctgggcgtctgtgccaggcctcccgaaggtggcgatggtgagcagcaggggtcctggaggagtggggggattcgggggtctgagagggcacaggcccagtggcagcaggtactcacgcacgtccagctctggggtgcaggtgccatcgctgctcatcaggtggaacacagtggggtcggggtgggggcagcttttcctctcctccttagcctcatcaggtggaacacggtggggtcgggatgggggcagcttttcctctcccccttggccccaggcaccttgtccccgtcagatgaggaaggaccctgtgaggagagctgtgaccccgaggggcttgggcaggcctcaggcccacctgtgctcacggaggaggaggctggcagggctggagacggggcctgggctgcggcagtgggctcctgggggcttgccctgcctccccgttcccccggccaaccccgtgagcagtggagggcagggcagggacgctggtgccggtgcaggggcctgaggacggtcggtgagtcccccgtgtgacgaggcaaggtcacctgcagtgggacacggtttgcctgcgtctgtggctccggcctgtgccccgccgtgcagttctcactgtgtggtagaccaggggcttgtggggagactgcgtgtagtgtggggtctctgaagagctcagggcagtgtaatgccacaagctctgcctcctccctgccaggcgccagggacaccaggaattcgggggccccacgcaccacctacctggcttcctgcaaggccttcacgcctgccagggtcagctgcagcccccactctgccaaggtggggagtggtttctgggagccctctttatccccagcaagcacagaggccccccgcagggctccccagcacctcctcagggttgcttttggtcgccaaaggtgatggctctggcccttgggcgcctgtcccctggaggcaacttcatcccacacccccacccctgccctccgctggcctccagacgggactctgtggtggcctcctgctgacctgccttcccctctcacccagcagctgcccttgatgagagccccacgggcctgtgcccctcctggccctggcacagtgcccacagctcccacacctcctaccccagcttccccgtctgcccctgggtgtcctctgcagctggcctgggtgtgccccaacacagcctcccatgtgcaggctttggggcacaggtggccatgctgggccccagcagcatccgggtctccttcctcgcagggcacttgcccgcctcccgccagcggtgggtggctgcgtctgaaggctgtcgtcggttacagcgggaatgggcgggccaacatggtctggaggccggacacaggtgggggccaagagcctacccccacccccagccaagatgcggccgcgcgtggtccagccgtctccaccccaaggccaggacctggtggcaaatgagcgccagccatcagtgtggggctctgttctcccggtagcgcctcctggcgctccagccgaggtcctgtgaagcactttggctactggacgctggggagggcgcagctgggacgatgctaaccccttggccccgccccacggctcggcccaggccccgccccctgttcggcccctccccaggcccctccccgcccccccccccccccggcccggcctcaggccccgccctctctgcgcacaggcttctttgcctacacgtgcggccgcctggtggtggtggaggacctgcactctggcgcccagcagcactggtccggccactctgcggagatctccacgctggccctcagccacagtgcccaggtgcccgcctgcatcgccctcctcctctcccagggccaccgtgcccggcagaacccagctcccggaccggtgcgggttctcaccaccaaagacggagcagacggccaccccagcctccactccagccagccacggcctccccactcacgcctggcctcttgcctgccaggtcctggcctctgcctcgggccgaagcagcacgaccgcccattgtcagatccgcgtctgggacgtgtctggcggcctctgccagcatctcattttcccccatagcaccaccgtgctggccctggccttctcaccagatgacaggcttcttgtcacactgggtcagtgggagggagggtggaggccaggggcttccctagaccccggggggggctgcatctgtgcacctgacgtggctgctctgtgtccttcccaggggaccacgatggccgcaccctcgccctgtggggcacggccacctatgacctcgtgtcctccacccgcctcccggagccggtgcatggtgtggccttcaacccctgggacgccggcgagctcacctgtgtgggccagggcactgtcaccttctggctccttcagcagcgtggggcagacatcagccttcaggtgccacccgttcagcgtttgggcccaggggttgttttgtggggtggaatctgcctgggccccgggacactgctgacccatggccactctcatactttgccaggtgcgtcgagagccagtcccagaggcagtgggggctggagagctgacctcgctctgctacggggcacctcccctgctctattgtggcaccagctctggccaggtctgtgtctgggacacgcgtgccggccgctgcttcttgtcctgggaggcggatgacggtggcattggtgagtgccccgcagaagccctgtggccctcaggacccctacctgggatcctcagagctggggcagaagcctcatctgtagccctggcgtccgggcagccttgtgacccagggcctctgggaaggcagccgtggccccttatggctcctcctgcccctagggctgttgctgttctcgggttctcgattggtcagcggcagcagcacggggcggctgcgcctgtgggccgtgggggctgtgtcggagctgaggtgcaagggctcaggcgccaggtgagctgttcacccctacgtgttttggctgcacgtgggtgttggtgtccctgactggggcttgcagccagtgccccgcccccgcaaaggccgccctgcagaccggccgcctgctagcccctccaagggacaggcttgggtgtggcctgggcctcactggctgctgtcgagtacgggcatgggcccagaagccccagctccatgggctttctcttcttccaccgggagggcacagccaggtcctgagatgcaatgctgagggccctgcctcggctggggacccagctggctcttgtcatcggccttgagacccattgttctctccttccctgcaccctgaggtccagttctgtgttcatggaacacgagctggtgctggacggggctgtggtgagtgccagcttcgatgacagcgtggacatgggcgtcgtgggcaccacggcgggcacgctgtggtttgtcagctgggccgagggcaccagcacacgtctcatcagtggccacaggagcaaggtgagggacttccagcctgggcagaggcggggcagccgaacctggtgccctccctgcctgccggctccatctccaccagcccagatgattccaagtcctgccgtcactggctcgcagcggccgccttggggttcccagcggggaagtcttgggtgtgcacgtcccctcaaagccgtcccggttgtgtctgcacaagcgagccgcctggcaggccttgcaggtcttctcaaactgtcctttccctgctattgctttgcgtttttttgtttgtttgttttttgttttttgtaattgtcaaagaaatcacatcagtccgggcgtggtggttcatgcctgtgatcccagcactctgggaggccaaggcaggtggatcacctgaggtcaggagttcgagaccagcctggtcaacatggcgaaatcccatctctactgaaaatacaaaaattagccgggcctcttgatgtatacctgtaatcccagctactctggaggctgagacaagagaatcgcttgaacccaggaggcagaggttgcagtgaaccaagattgcaccactgcactccagcctgggcgacagagactccatctcaaaggaaaaaaaaaagatgaaaaaccccacatcgtctgtccctgcacctcccatagactggctttgctgactcagtctcatgggattgttctctgaggctcaagaggtcaggaggcccaggtagctactgggtcaagttctgctctctctgggtcaggtctgttcaggttctggttggtgttgggtctagtcctgtaaggcccagctctggcctgcagcctcctggtgctggagctgcgtctccaagaagtacacagcactcatctctctgggacctcctggtctggaagctctgtggcctcatggggttgggacagccaccgtgtcgccccctcacccgccagctgcagccttaggagaggtggcctcctgggcggaattggggcggcaggacaggtgccattccttcccctgctggaccaggttcctggcgtggcgttggtctagcagctgtggccatgggcttcctcctgtgggtgtaagagctctgcgtgtggtcagctgggccccacgggattgatttttccttgatgctgagtcccatcatccagttgcccctgggttgtttctttagaaacctgtctttagtatttggagatgacgatagccagcaaagaaagttgagtttgagacaggtgagggttgtttacttttctggaagcaggtttgctgaggtgtagtcgtcacagcacaagctccgtgtgtttcagggggtggcttttggcatattcagcagctttggaaaccccgtgcgtgcctagaggaaaccccgtgcgtgcctgttcctcggtcgctccctgcttcccgcctccccagcccctggcgaccgttgagtggctttctgtgtctgggtcttcccattcaggatattctgtaggaactggctcacctggcttctcaccctgagcatggtttccagggtcatcccagccgctgtgtgtgccaagccagtcatccctcttgatggccaaatactgttccattgtacggatagatcatgtgtgtgtccatccaccagggctgggaaattcgggtcctgagaccgtgacctgagcccgtggtcactggtggccttcctgtgatgtggaagtgcgaggaattctgggccccgcctgtgtggttctgcctgggcggttctgcctgggcctggactttgccgtttccttgtagggcccagggccctcccggggagatggactgagctgtcctggtctgagtccctgcagtccctcattgctcagctgaactgaattttttttttttttttgagacggagtttcttgtcgcccaggctggagtgcagtggcatgatcttggctcactgcaagctccgcctcccgggttcacaccattctcctgtctcagcctcccaagtagctgggactacaggcacccgccaccacgcccgactaattttttgtatttttagtagagtcggggtttcaccgtgttagccaggatggtctcgaactcctgaccccgtgatccgcccaccttggcctcccaaagggctgggattacaggcatgagccaccgcgcccggctgaactgatttttttttaatgaagtgcatcgtgttcccacttgcacttaaagttcacatttggtgccaggctgtattgcttcttctcactggtgagtggcagctgtgtctcctttctgccagtccagcagtcccagctgtcagtggcacctgcataatgacacgtctgcatttccccccaatcagcgtgcagcggttttgggaggaggaatgcgactgcatggcgcgctcgctgcaacctcagtctgcagcctgctagggacgcacggccacactcctgtctttcagcctcagtctgcagcctgctagggacgcacggccacactcctgtctttcagcctcagtctgcagcctgctagggacgcacggccacactcctgtctttcagcctcagtctgtagcctgctagggatgcacggccacgctcctgtctttgaggtgctgtcagaacagctttctcctcggtatcccgccgggtttgactggctagtgggcttgctttggtttggactcacccagatctagtgcagggacacacacgggggccggcattgctcctttccgccatgtggagttggccggggccagaggcacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccaggtgtgtggggagtgcccgggccgggggcgggatgggggcctgctcagtggggggcctggcatgggcggggccgcctcctccctctggcctgggtgtgtgtcctcagggcccctgtgagtgctgaagtttccccactgtgggtccccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtgaggagttgggtgtgttggggatggtgccgtcctgacctggcccaggtccagtctccgggctgggggctcacagggtgacggcatggtcccaggtcagactgtcctctctggagacaaggatgggctcgtggctgtgagccacccctgcacagggacaaccttccgtgtgctgagtgaccaccagggcgccccaatctctaccatctgtgtcacgtgcaaagaggtaaagcagccccaagagctggggagagggggcctgggtgctggtgggggcaggcaccatcttggcagaaggcacctgtcggccctcacccactccattcccagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggaggtaaaccatgctcctggcactgtgggtggggccggtacccatccaccccaccgcagcatgctgcgcctttgcagactcagggccacctgccaccctccctcgctgccttctgcccttgggatggggcgctcctgatgtacgtgggccccggtgtttacaaggaggtgatcatctacaacctctgccagaagcaggtacacgcagctgcccgcgtgtcactgggagccccagggatccagggtggtgggtggggcctggctgagccctgagcccacaggcctggagcctcacgctggctgctcacaggtggtggagaagataccactgcccttttttgccatgtccctgagcctgtcccccgggacccacctcctggctgttggctttgctggtgagtgctggtggatgcagtttgggcctgtcttaggtgggggccaagtgggctgactggtgccctgttccaagacaggtgcctcacctgtgccccgggctcctcgtctctggggtggggtgaggacatctgccctagagagggtcctggagtcaggagatgatgaggcaggtgaggaaccaggcacagcgcccagcacagggcctgaatgcacgggtggcagcgacttttaaggagggaactggcccagctgcaggccgacagcctggcagtgatggaccccctagtcccagtggcacgtggagggcacagccaggagcccttttagcaccagctcccccgaccagcatcatgcccagtggggacagtctgggtgggttgggggagccctctgagtgctgcctggtcctggccctggcccacctgcaccgtctacccacagagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgcattattgctgcattgttgcactggctgtctctggtcactcctggcctgagctcagcctctgcccgtcccttaatcggctgtttgtcaaggcccctgtggtgccgtgaagcaatggccgctcggcctgccagggcgccaggaccctgcgctgtccgccgtggccggcgcgtccacacggtggcgcgccgcacagcctgtccgctctggcccgcccggctcgctggtgcggctgtgcgggcggggccggaagtgtggggacagcgcggggccgagaaccggaagtgcggggcgggcgcgggggcagagcgaaaggcttgaggaccaggtcggggccgggttccgggtcggggagcggctccgggcggcagctatgaggcgggacgtgcgcatcctgttactgggcgagggtaggcgccggcccgggggtctcggagctgcggcggccgtgaggcggggtgagggtctcgggggtcggggggcgccgtgaccttggccctcgcgctgaccgcctcgccccgcgcagcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcaccatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaaggtgagccctcagtgcagaccccaacagcagagacacagtggccggtggtggcccaggtggaccttcacccaacccgtggccagtgccatcgctcacagcattttggggagcctgacgtggagttgcctgacgtggagtcacccggccctctcctgtgatcccacttcccctgagagggtctggggcgtcccgcagtctgagccattgaggccggcagtcctctttcttccccagtttccaaacccccggggggggacccgcagagggcctgcgttgggggcggccctaggcttgggccccagtgacttgggggtgtttgggagccattggggtcagacagatgaggctgcacctgctgcctgccttctcccaccagctttgttcctgtggccgggacttgggccctcagtgggccttgacctcccccttctgctctcccccagccaggctcatgctccagctgggagccatgtgcccgcgggcagcctcacttcacagccaggctttgcttttcagattcgaactaagtggatcccactggtgaatggggggaccacgcaggggcccaggtaatgaggggatgtggaaggggctgggacccctggctcccctgcccctggtgaccatgggccttcaacccagggtgcccatcatcctagtgggcaacaagtcagacctgcggtcggggagctccatggaggccgtgctccccatcatgagccagtttcccgagattgagacctgcgtggaggtgagtaggtcccaggcagggccgcctccttcattccttgtgttctcagtcggtgccctcctcggggcacttccctgaggctgttcccactttcccagtgttcggccaagaacctgaggaacatctcagagctgttctactacgcccagaaggccgtcctgcatcccacagcccccctctatgaccctgaggccaagcaggtgagcatcggctggggccccgcacgctggttccccaggggcccagggggtgctgggtggggcggtgtggcaggtcggcgtgggtcacctgagggtgctgagccaacatccccacagttgaggcccgcgtgcgcccaggcgctgacgcgcatcttcaggctctcagatcaggacctggaccaggcgctcagtgacgaagagctcaacgctttccaggtgtgcccctgccccaccctcggtgcccagcccccttgaacctccgctgccgttagtgactggaacgggtcgtctccgggtggctggctgactcccaacaacgttctctcggaagcagaaatcctgctttgggcaccccctggccccgcaggccctggaggacgtgaagacggtggtgtgcaggaacgtggcgggcggcgtgcgggaggaccggctgaccctggatggtgaggccgggtgcccgcctgtgcctggggagtgtggggagggggctgtgcctggtgctccccctgctttgtctcggtgcaggtttcctcttcctgaacacgctcttcatccagcgcggccggcacgagaccacctggaccatcctgcggcgcttcggctacagcgatgccctggagctgactgcggactatctctcccctctgtgagtgatgccggggcttgaggcctgccctccccgagggtcaggagctgactgccgactatctctcccctccatgagtgacgctggggtttgaggcctgccctccctgagggtcagtgaaggtctcgctcagcaggccatctggggtcgtgcccttgcctggctgtgccctgaacccctcagcatccacagagctctgagtcggggggtgggggggctggccctttgccaaccccgctcgcgtggcttgtttaccctgctggggtcggcagcttggggtgtggcctgtgggcctcagccaggcctcccacgtgctggagccaggtgggcaccctcctcccctatcgcagctgcaaggtcgggggcgtacaggagcctctgggtcctgtagggagggtccggctgcaccgatggggctggcagggtgacagatgggctgagcgtggtgctgcagagtctcctgggagctagacgggctgtggcctccctgcaggatccacgtgccccccggctgcagcacggagctcaaccaccttggctaccagtttgtgcagagagtgtttgagaagcacgaccaggtgagagcatggcgagtcccctgcccctgcccccgccccctccccggcacacacatcaccacatccctccttctgcaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggacgtaagtgcggcccacaccatgcccgcctgccgcaccaccctccccaccataacactgtgcctgcctcccgcccacccccagcctggtgacctacctggacgtccggagctgccttggacacctaggctacctgggctaccccaccctctgtgagcaggaccaggcccatgccatcacaggtaggcacccaccctccctgggcctgggcccagtatcctggcagctgccctaacccgtgtctatcctcacagtcactcgtgagaagaggctggaccaggagaagggacagacgcagcggagcgtcctcctgtgcaaggtggtaggggcccgtggagtgggcaagtctgccttcctgcaggcctttctcggccgcggcctgggggtaagcaccctagactcccccaccaccccaggggctccaggggcagggcagggcaatctggggggcactgcagccagcgagtgtcaggacttcacctccctcagcaccaggacacgagggagcagcctcccggctacgccatcgacacggtgcaggtcaatggacaggagaagtacttgatcgtgagtgctggggcggcgcggcctgtgcccgagggtggacccggggacacccaggcctgcctggcagatctggcccagcatggccctagggggaccgagccccagggacccttcctaaggccgctgtctgtcccagctctgtgaggtgggcacagatggtctgctggccacatcgctggacgccacctgtgacgttgcctgcttgatgtttgatggcagtgacccaaagtcctttgcacattgtgccagcgtctacaaggtggggccctgcaggggccacgtggccatggggcagggtctgtccctccagctgtgcctcggccaccccaggactgtacctcataccactctctgcccacagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccgtgggtacccagtagcgcagccctggggactagcagtgtctgtcatccgagcagtgggcagcggtggtgtcaggcctggaactggggactagcagtgtctgtcatccgagcagtgggcagcagtggcgtcaggcctggaactggggccagagtggcggggtggagctttgtgtggcagagggaggcagtgcccaggcatgtccctccagggcctggcctccaccggctgtgcctctggtctgggatccccgcctgtggggccctgtgagtccaggacatgggagggtgcccagcagcaagctgggggcatgtgcctgaggtatctgcagatgattcttctctcttgcagacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaacctagaatgtgttgtttgtctttatgtgggctggaaacgccacccctcctttcattcctgggtcactgttctgaggtctcaggcgtgtgcatatggcctctggaaggtccactctgggctgctgtggcctgggagcccagtgtccttggaggtcctgcggtctgggagtgggagcccactgcgggaggacggtgcgcgcccggcatggactggggggcgccggtgcctgagatgtttccccggtgactgaccccttctcagggtccagtgtgccctggcactgcccactcactccccagagcgtcctgccagcctggctgagctgcgccgagaacctgggcttgtgtgaccagatgtggtcactgcctgccacagaacggggtgaccctggggccctgacctgagggaagcaggatgggccagagggagggacgggctgggagttgagcccagatgcctgcttctcgggacccagggcgtggccttcccaaggtcacccggacaagtatcagaaggcctggtcccccccctcccatgtctgcctttagggagtggcaggtggggccccttcccaagtcctggcccacacgggccctgccttggagcttgtggcattggcccctgaggtccctcccgactgatggtatttgagcccgctgtacccccacggcctgtcttctgggactactgcaaccctaggagaagccctctgagtggcccttgcaggggctgccatagtcacacgtgtcttatctgtcacctccattgtggaggggttggcccgccttcccaggagcaggtcccctcatcccaactgcagccctgccccctgggggttctgctctgtgttggaatgccccttgtgcccagccctggcgccgccttagggcgggaggttttgctgtcctgcatggagttgcaagagtggtcaggggcctccagcccagggtgtggacgagtgggctgggcttggtcgtcagagccaaggcggctgcagcagcgtcttcctcctcctaagaggcggctgtagtggccatgcgggacgagggacttccttgctgctgcgctcggtggggggttgcggggggagggggtgtgtctgctgcaagcagggagctccagccggtggcaacatgaaccgcagggagtactgggtcagcctggagggggagcaagcagtggtcagggaaggcttcctggaagaggtggcatcctcacaggcctgagcccgggaaggctgtgagagggcgaacggtcttgcatggggggttttaggtgccccccatccccgtgactccatttaccagcggctgccgtggaggtagtccagtgtgctggagctgcgccagagcgggggtgggggccggcgctgagacgcggtgctagctggaggcggttcctgtccggggtgtgcgtccgcgtgcagggtgcgcgcgtgtcttggccgcgcgtggcggcgtgtgcggcaggggcgggcaggcgggcgactcggtgacgcggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcaggtgcgtcggggggtggtctggggagctggcaccgcccccaatgcggccctcctgccgctgagctgagcttgtgcgggaccgagctccccgaaagccccgctcggtacctacctcatccctccacgaccttggtccgtgtgtctgggaccccaggagaggactgactggaccagagctcctggctggagaagggagagtcggggggagggagggagggagggagggagggcgggcagctggctggtcttggaccttggccctcgctttccaggatgggtagggtggaagacgggggaacaactgaggagctggaggactgggacccaggcaccagtgccctgccagctcctgggatcaagcagggtcccagggaacagacaggcacggggcccctgtcccaaaagtgctgggagcctgagcctgatgctcccagccagcctggcccagccctttggtccaggggtcgggcccgcactcaggccttggctggcggctcctcactgcagcagctggaccccgagaacacaggcttcatcggtgcggacaccttcactggcctggtgcacagccatgagctgcccctggacccggccaagctggacatgctggtggccctggctcagagcaacgagcagggccaggtctgctaccaggagctggtggacctggtcagtgccacggtgggcaggcggcaggggcacggtgtcctggccagaggaggcgggcaggcagctcctcacggcggtgggtggggggcttgtggatgcggggagctgggtgagcctcacaggcaggggtgccatggggaggtccgtggcccacactcaggcccctgcccccagatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccaggtgggccccccggccgctgccccgggagcctcccgcgctcctggccatgaccagcctaacactcgtgtccccagatcatcgtgttcctgtgttacggggcccgcctcaacaagtgggtgctgcagacctaccaccccgagtacatgaagagcccccttgtgtaccaccccgggcaccgtgcccgcgcctggcgcttcctcacctacatgttcatgcacgttgggtgagtagcactgctgcccggtgagccccgccccaacctgccattacatcagaaaggcttagccgcaaggcaggtgcggcaacttgaggtgacggctgggggtggggccggatggctgaccccacccttcgtacccgtttgcttccctgtggccaggctggagcagctggggttcaacgccctcctgcagctgatgatcggggtgcccctggagatggtgcacggcctgctccgcatcagcctgctctacctggcaggcgtgctggcaggtgaggcaggcgcgcacccccgccccctgccctggccggctgcaccctcacccgccgcttgctcacacaggctccctaaccgtctccatcaccgacatgcgggccccggtggtgggaggctccggcggggtctacgccctgtgctcggcacacctggccaacgttgtcatggtaacgggcctgcccggtggggggcgtggggaggggccccaggtgagcctcaccacttctcgtctgcacacacccatagaactgggctgggatgagatgtccctacaagttgctgaggatggtgctggccttggtgtgcagtgagtaggggccggggggagggccggggggcctctcagcctgcagccagggcacctcccacctgccgcgtccctctgcagtgagctccgaggtgggccgggccgtgtggctgcgcttctccccgccgctgcccgcctcgggcccacagcccagcttcatggcgcacctggcaggcgcggtggtgggggtgagcatgggcctgaccatcctgcggagctacgaggagcgcctgcgggaccagtgcggctggtgggtggtgctgctggcctacggcaccttcctgctcttcgccgtcttctggaacgtcttcgcctacgacctgctgggcgcccacatccccccaccgccctgaccggctacctgaggctgcacaggccagggctcgggcatgtggtggccgcccaccaggggccttcacgtctgccctttgtgaacggacgtctcagggctgctgtgccccttgggtgtgggtggcctcaaaggaggccctgtcccagccacccaccccccactcccaggacttgcggtctgagcctttttggataattaataaatattttacacagcaccagggggctgtcccgggctctggagactcgtcagggcccccacacctgctgcacagaccgcgacggccctccccaccacgggggcctggacttccctccttgtgcatctctgcacctggggtcaggcgtgggagttgttcctgggccacaggtgctgtgtctgtgggagctgggggcacgcgggatggctgggggccgggcgtgtggtcaggccaggtgtgtggtcaggccgggtgtgtgatcaggcgtgagtttgggaagtgtttattgagctcccgtagtggccagcctcctcttcagcctccctgccgtccagtgagacccggaggcctgaggttctgtggcaggtgagcaggcctgggccatggccaagtttactcggcctgggttccatgcttcttggctggcctagcatcctcgtgggtggccaggctggggccaaggttgggcagcaggtctgggcacagcctctgccccacagcccaggtccacagtgctgtctccactaggtagggagtccactgtcctgaggcactggctagggaggggcacacggactcaggcccaggggcacgggccaccccaacctgcccacacacagttcattccccttggctcagagctgtggcccgctcttgaacctggcccaggtacagcaggtagtacctgagggtgtactgtggggccggccagccgggcactgtggccaccgcctcatctgacatgaaggcctccatctctggagctccagctgccaggactgctgtgaacagcgaggagaagcagccagacacaccccatcaggacaagctctgggagaccctgctcccagcagcccagggccctatggttcctgctcctagcgacacgcaagggcccagactgcccgcttcacagacaagaacgcctatgtacccaagtcgtgcccacccaactcacccgaggctgtggtgggcccacaccgcagagggcacacagctcggtgactgcagcccccacatctggcaggaggcagaaggtggcggtcgaacagtgcacaaccagctcagggggattggtggccaccagctgctgcagacgtggccggaagcgcccctctgtgggaggccaggtcagggtgcctggggtgctggacccaccagggaggccccgcccccactggagacacccgccccgccgatgccacgccccaatgaagacccgcgctacggaggccctgccctcggggcgggccgcccttcacagtcaagctgccaggccagcagccgctccagctccctgtcacatgcttctctgctctgcccctgatggccgctggcaactcttcccgatacctgaggaagggcggtgaggggaggactggccacggaggacgctcgccccaccgatctctatccccttccactctaccaacagtccggggcttccagccgccctcgggggctcgcgctcgcccgtagcacctctcgtggcgctccagaatggcagcccagcgactggggtcctcacaccccacagcgcgtgggaagccgctacgttcacgcgcaggggcgggaggcggcggctgggggcggggcctctgctgatggggccgggtgctgggggcggggcctctggattgggcggttgctgggggcggggcctctgcggatggggctgggggcggggcctctgctgatggggccggcggctgggggcggggcctctggattgggcggctgctgggggcggggcctctgcggatggggccggctgctgggggcggggcctctggatggggccggctgccgggggaggggtctctgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcgtgagtgcgcccgcgcggggagggcggcggcggtggcaccggggagggccgggcccgggcccggccggccccaccgagggtctggctcctcttcggggcgtgtcctcggctcccaaagcccagccgtggttctcgagcccagcgccgggtgccggagaacgagggtgcgatgctggatggaggccggccgggtggggggagggcaggggccctcgacccttgaggaccccaggtcctaagcccggactctccaaagatttggaaaactttacaaaaccaagtggaatcaagcggataggctcagccagtactccactgtgcacagatccttggacccaggggctttgacaactgagaaacctagtttcttgattctagccagagcgcagaagctgggacgggccgtgggtcagagtgggcacgctgagcctacgccctcatgcggctggcccggccttggtccctagacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgaggttggctgacaagctgcccggttgtggggcctctggggccaggcgggtggactggccagagagtgacgtgaagcccccgttccccagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagaggtgggaccctcaccccaggccgccctgtcttgggataattctgaatcaccgactcccgacacaagcgtttatcgaaggctttactggcaagcaggaaatgtggggaagtgtggatgttagctctgagattggggtgtggtcagacatctggccaggtccatctctgaccggctcctggtcaacccccagggagctggaagagtgccagcgaaaccacgagggtgatgaggacgacagccacgtccgggcccagcaggcctgcattgaggccaagcacgtgagggtgccccccacccacatgtgggtctgtgtgtgtgcacgtggcgtgggagcatccccgccttgtgttgggtctgtgccccatggaggagggaggtggggtgtctcccccaagcacagcactcaactcttcacaggacaagtacatggcggacatggacgagcttttttctcaggtggatgagaagaggaaggtgagtgtgtgtcgcttgctgccgatggctggcaggtgctcgtgcagtgccccttttcagcctctgaccgtgtgcccctgtgccacagaagcgagacatccccgactacctgtgtggcaagatcagctttgagctgatgcgggagccgtgcatcacgcccagtggcatcacctacgaccgcaaggacatcgaggagcacctgcaggtgaggcctgcggctgggggagcagggccagtggcatggtcctgggccccatgactgccctctgcccttcttgtcactgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaggtgggacgtgctggtgtgtgaccggcagtcctgccagctgttttggctagccgaggaaggtggagatgaagacgctggtgtcaaggttgagcgtagcatgccaccagcggtcggggaagtacagcacctggtggaggaagggggtgcagcagagattagctgcgggcctctagcctggcctggccctctcctgccagccactgacctcaccagcccggatggtacactccaggggccgtgcagacggtggcagggctgggtatgtgtcccggagccaggccagcgtggtcttgttggggtggaactctggcgtcttctcaggtgggtaaaggaaccagcgctgggggcatgagcagcagtgtcacccttgcccgttttggtcagcgagtcccaagcctcaacccccaccccgtgctgaccttacgaccgtagatcacttctgagtacccgggtccatgccagtggaagggcacccccgagccagctcctgtggggttatgagcacctggtgaccaacccattttgtactcaccgacagaagcctcagtccttcccagtcccaagaagcacccacctgcgattccaaagctgtaagctggagcggttcccagcaggccaaatgggggtggggagtagtgccgaaagagagaggcccactcggtgaagttgttgtccccgaagaagtacagggtgtctgccaacagagacggcggggacagggatcctggcacctggagactccaagcgtccccaccccctaccgccgcctagggctgcctcaccattgcccagggaggtggggtcctgggggtgcagcagctgctccacatactcctggaagggcaagtccactgcaggaaagagacgggtcaggaccgtctggtccagccgccccggtgttggcaaatgggcgggccccaggggtgaggccgcgtacctttgtggtaggagtaggtgttggcggtgctcagccggaccactctgtccccaaacgaagccagcaacctgtcgcgggagcacagggcccggaacctctgcgggggcggggaggggacttagtggccgggcccagcacgggcgagagtggccggggacggacgggcacgcgctcaccgagttgtccgtgagtccctgcaggatgacgggcctgacgaaggcgtacctggaaagaagggcagagtcgcggccaggccggaccgccagcctcgccgccccagccccacgcgtgcgcgcgaggtcaggggaaggcggccttgggcggtcggggcagacgggccggtgaacaggacgcgacctccgcgatcaggggcgcacgtactgctgcacgaactccgcgtaggtgaggtcggcccgacgctccaccgtgcagcgctcctcctccgccacggcccccggcccgcccgggcgcctgcgggcacagctgggtcagcccgcgccccgcccgccgcacgtgaccccaccgcccggcccctcccgggccgctcaccacccgccgtcgccctccgccccggagccgggtagagccacagccgccagcgcccagagcgcgagcaaccgcgacgccggcgccatgagcctgccgccctcaggcagccgcgctgcacgccgggaaccttgggcccatccgccagccattggccggcagcttcgtcgtcgtggcaacggccgggaaccgggacggaccccggaagtgacctcctttggcccgccccggaagaggcctctacgggaggcactgggaaggccgccccgagagcgactatgggcgccgccggttaccatggcgacaaccccgccgaaagcccccgcccgccagctgccccgcgggcctacggcgagcccgccgcgctatggggtgacacgcagtgccgacagcggctctacttcctttattgaggtctcaagttccagcctccgcccgtctcgggcacaagaccaggcggggttctgcacgcggccgcccgggcaagcccagcagatgccccgtcaggagtactcgcagaggtggccgcagcctgcgggacagtgggagctgccttccagccacttcatgatgtgctgcaggtggccgccgtggctgcagccctggcaccacacgaagagacccttgactacgtggtggcagacggcacacatgctggcgcagcggtggcacctgggggcgggcgggagggagggtgcctcagcgggggctgctgcgctgcctgcaggcccctgccccacctcccgaccccactgccccacctgtcgcagacccagccccggctgctcatgggccgcttgcagtggctgcagttgacgtgcagggtggtggaggcctggttgaggcagctgacggcgcggctggtgctcagcttgaccacctcgttggacacgttccagaggcggaagcgctgcagcaggtcgatgtaggaagtgtaccagtgctcctgggggagggagcgcccggcagtcaggatctgggtgccaggggcggcgctgcaggggggaggccccgcccaccacacacctgggtctgctcgtcgatgtccttgcgcacccgttcacccaggacgatgagcacagacacagccatctgcacgtcgccctgctcagcgtagaagtgcagcatgtcgcgcaccagcacgccgaagaagtcgggcggcaggcggctgtcgtagagcgcgtgtgagacagacaggagcgagaaggaggagtccacgggggccagggaggccacatccgcctcgctgccgctcacgtgcggggagtcggccttgtcctgcaggtgctcgggcccgggaggcgtgtccacgatctcgtggcgcagcggaaaggcctcctgcggcagcacgcactcagggtcctcggctggaaggcagggaccagcggaggctctgagtctgtcctccatccgcctctgaaccccaccctgcccggacccccactcacggtgcgcgtgttccggatccagcaggtacagctcgtcctcctcaccttccacgtcacccagcaggtagtcggcaggtacgtcgctgccctcggtttcctcgttatctgcccgacaatggggcgggcattcagggtcgtctgggacacccccacccctctcccatcagcacccctacccaccccagcctaccctcattggtgatgagtgtggccgaggagtcgagcagaactgtgtcgctccgtgcatctcctttgctgcggtccagccgcgtctcactgcccaaccctggggccatatccttcaggttgaaactgggggcaggaagggcccatgggtgggtgggctcgagcagccccagcccctggggagagctgcccccggcatctacctgttcatgagcgggaggccacaggagccacccttgcccacactgtggttgaggtttgcagtgggcactaggccagggctgcagtagatgatccgcagcatggtccacgtttgcgccacctaggggcgggcactggtcacttgtgggcgtcctggacacccagcaccccatgcaggtccctctctgcctggacagtcacaagccctcagcattcagctgccctcagtacccaatgtccaggcccaccccaggtaggaaagctgaggctcatgggaaagacaaaaaccccggtccccgccctacagcagcacagaggaaaacagaattgggcagtggggacttgcggggcagctagagatgggcatgggaacggcagctcacggctccaccgctgctggtgcctggagagctccagaagcaaggggggaagaacagagagcttgagccacacgactcccgagacccccgcccctcagaggacagtcctgggtctggcccaccctggagccctggccctgtgtgatcctgacaccctcagctaccaaggcaaggcctgttggtgcgactggctggagtccattgcggagcttgaggtggggtgagcgcagctgacggaggaaccagcccctgccctgaggtcgtggcccagggacccccaggctcagcacctacctacctggttgcggccaagctctcgagccacctttgcgttgtggtcacagagctcggccagtggccggccagccagcgcataacgctcagctgtgtccacaaaccagcgcatgccgccgccacctggctccgtctcaaagacactgagggcactggaggcgaggcctgcgaagggctcggcagggtccagcttgcgcttaaagaagatggggtggcgccggtcgccagtgtagggcttgcgccccgactcggcagccacgaggctctccttggcggcgaaggccaggtccccgaagaggccgtagcagaggccctcagggttggcgcgctcgacgggctggctggcgtcgcggaacaggtgctggcacagcgagctgtccttggagccagacagcaggaaggaggggtcgtgggggtggcgccaggcaattcccgtggtgacgtctcggtgttcctcaaacatggcagctggcacgaagggccggcgcacgtcccaaacatagatgttgtggtccaccatcatggagcacgtggccaggtggtggcggcactctggccgccacttcacacgggccaccgaggcgatggtctgcacacagtgcatctccttggcacggtgcgtggtcatgtcccagaccttcaccatcttgtcgcgccctccagtggccaaccagcccctgtgggaagaaggtccacccaaaccctcagtggcctttcctgcagagaggggacccccccgctctgctgctccggactgtctcatggatctgaggcagtgagagcttactgtcaacctactgcccctgcacccccatgccacacctgtcctcggggtgccagtcgcagcagaagacgggtccgttgtgggctgtgaacatcctctcgcaccggtcgggacgccggatgtcccagagctgcacattgccgttctcaaaggtggaggcgaaggtgaagtagtcccggatactgaactgcacgtcccgcacgctctccgactggcctgcaggcaggaggtcgatgcaggggaagtgacggggctggcccatgaggtgcgccctcagaacagctgtggcatggtgtcacacacctgcctgtggcccagaacagaggcccagagggtagagtggacatccccaagatctgcccaaggaagcagccacacagagtcgccacaagagcctgggcccgggagcaggacaccacgtgatttgtaacacatactcccgggcgtcatttgccgtagattctgcatcctgcatcggtccatgagcaaagctgtggtgcagcctcaggatgcggcagctgagcactgggagaataggaacgcacccagccatcgcccactcccgtggccctgtgggaggcccaaggaggtgctgaggagggtgccccagccttggcccagtcccttcacctggagctggaactgcctggtcagccccaaaggactggatgactcagggcccaggtccaccctaggggaccaccacaccaagaaacttcaagggcggtacccaaccttcctccagggccctgcaggggaggcagctcaggatctgtctttttagacggagtctccctctgtcacccaggctggagtgcaagtggcacgatctgggctcactgcaacctccacctcccgggttcaagcaattctcctgccccaacctcccaagtagctaggattacaggcgcgtgccactgcgcccagctaattttttgttttgtatttttagtggatatggggtttccctgtgttagccaggagggtctcaatctcctgacctcgtgatcggcctgcctcggcctcccaaagtgctgggattacaggcatgagccaccgcgccctgccaggatctgtcttaagtggcctgaaaattctctgaggcccctgagggctccgccttgtgcttcatacctagtctcctccaggtgaacaagggagagctggctcagggcagccatcggggagctgggcctgttaggaaaagggccccagggcactggacagcaaacccacctcctctgcctccctgggccaggaaacctggaagtcctggcagacctcctgctatgaggcagcctctgtagctccgacatgagggaagggagtcagtggctctctgctcaccacccaggctggctgggagaccgctggggctctgccctccctcaccccacacctagcctcaatttctgctggtctcatctcttgcctcttcccacttgactgccctggctcacatgccgtccagcccaacttgccccatccctcccctgccgattccctttccccctgaggaagccctctgggagtgatcctgagggcctctgatgcacggagcccttttccgcctgcatggacaggctgggcaccggcagagacgcccacctgccctgacctgcctctgtggcctcacccgagaaggtgctgacagagtcctttctgcggaggtcaaagcacttcatgaagccatcctgggagccactgagcagcacgtgggcttcggtggggtggaagcagactttgtttaccgtgcgcttgtgttctgtgaacagctggtcctgcttgttgcgggatggccggcccaggttccacgtgaccaccacgccattggtggctgctgtggccagcaggttctcatccatctggtgccagaccacgtcagcacagctcaggttaagcgaaggcttgcgccccacacgcaggttcagcttttccacgaactgttcctcctcgatggcatagatcttgaagatgctacggcctgccacgaccacctgggctgcgtcgcggcacacactgatggcattggcgggagcatccaggtggcagtgcatggtgcggcctgtcagcacgctgccacccagggctgtggtcacacgggacatcttctccatggctgcacaggtgatgaggtcaggggtcaggaggtcagtgaggtgggctggcctggtcagcctgggtgggtcatcagttcagaccttccacccaggttgggaccccagaactgcttggtcccgggctggtcagtcttagtgagccaatccagggctgtctatcagccaatcagcctgacaggcaagctcaaattcactggagtctgtcagtccagcccatcaccctggctgagcggtgaggggacttcctagcttcccttaggcctgtcagtttcatgtctgacttccacggaagactctagctggacattcccggcccaggccacctctcggtacccccatcagccagatctgggcagtcactaaacgctcggtcagtcaatcccagcaggggagcgaggagactcccgccgtccacactgtcagccctgagggcggcggggctctagggaggaacaaaagaggggagggaacagagggctagaggggcccggggactcaggcgatagacgcgggaagggcccagagggacgtcaaggaccgagctacttaaggagctcgaggtgtctggcgggaccggaggcaggagagaagccggcgaccccggagtacagggttcctgggagcggcgcagtggcgcgggggagcggacgctgcgggacgagaaccagagggcccggggcagcccttctcccccgcgcgaaccccaatcttttactaaaagcgcacggttgtccggaaccgccgcgccggaagccgctgtctttcccgtccctcgccggaagtggtcctcttcttacccatccctctcaggaagtgggcacaaactctcgcccgacaccacgaaagttccgggtcagggagctgcgttggcagaggccaggaggggcccgggattggggtctgcgggccgccctgggcgttgccattgcgctgcggtgctgtgcttgtgtgattggtttatttatttatttatttaaacggagtctcgctctgtcgcccaggctggagtacagtggcgcgaccttggctcattgcaacctccacctcccaggttcaagcgattctcccgcctcagcctcccaagtagctggcactacaggcgcccgccaccacgcccggctaatttggctaattttgtatttttggtagacacggggtttcaccgtgttggccaggctggtcttaaaactactgaactcaagcgatcctctggcgtcagcctcctgaagtgctgggaatgcaggtgtgagccaccgcgcctggcctgttttttaagtctcaatttcagtattttaatgccatcacctattttaatccccaggtccatcatgacatctggtcatccctagacaagttccgagtgcccccagtcttcccctccttcctcactcctcgacctcgggagcagcctcccaacggctttcctgggtccgtctttcccctttgatcagaaacccgcacagaagtcaggcaccaggtcttctgcctgaggcctctggcagctcccactatgctgtgaatgaaccccaactcctggcctccgccttcccctgcccacctccagccatggcagcctccacccccattcccagcccaccaagccctttcctgcctcagggacattgtacgtgcgtgcgatgcctcctccacagagcggacctccctgaccactgccctaatgggcttctccatcactgtggcctccacggcacttgtcaccacccattcgtttgtttactggttgttgtcggtcacatacgagtgtgaattccaccaaggcaggaatcacattctggctcaatccccaccgaatgcccagtgcctgacacacctgttcaaccagttgctctcgttcttttttttaaaaaactttttgagacggagtttcgctcttgttgcccaggctggagtgcaatggtgcaatcttggctcaccgcaacctccgcctcctgggttcaagcgattctcctgcctcagcttcccgagtagctgggattacaggcatgggccaccatactgggctaattttgtatttttagtagagatggagtttttccatgttggtcaggctggtctcgaactcccaacctcaggtgatccactcgccttggcctcccaaagtgctaggattacaggtgtgagccaccgcacccggtctctttaaaattttttgagacggagttttgctctttcgcccaggttggagtgaggtggcgcagtctcggctcatagcaacctccaccccctaggttcaagcgattcagcctcagcctccctagtagctgggattataggcaaccaccaccacaccctgttaattttttgtatttttagtagagacagggtttcaccatgttggccaggctggtcttgaacgcctgacctcaggtgatccacccgcttcggcctaagtgctaggattacaggcgtgagccactgtgcccagcctcagttgcctttttcgacctctctgtctctcctgggtgtgagccattgtctgctattggtgcattttgtaatcttttgcgacatccttgtccttgcctgttactgtgtatagaacagggtttatttctgcctctctggaagggtgggctagagtctggatatgttggagggaatattatgtgtagtgacttcagtgttgtctctccctttaaggaatgggaggtcctctgccttccatgtagtcactgctgtttccattctaccatgtcggcatccagcctctacccctttgttgcaagaaagaataaatctgataagaggtacaggagaatcccgagacctgggatgcgcagggcagatatgcccacctacaccgctgtctggggacctaaaaacaactcagacacatgtttttacaacttttttaatatatatttttataaacaggtcacgtgataaaatagcacaagaaacacttaccaaatataaggttatatcttccgcatatacaggagaatgaggtcgttatgtacaataagaaaatgattttaggggttggttggttttgttttcctctctccccttaatttttcctcctacagtcgttggaaatatcacagcttcagttgcattaatactttgggcaaatggacagctgcccctccccactaggggttgtggggaggaggggctggagaaactggctcctgaccactcagccctggagcttcctggggctggcactccagggacaggaaaatctttgggctgttgatctgtttctgattcaacagcatctctctctctctttctctctctctctcactctctttctctctctcactctctggctctctggaaactggttactctcttccaaccagatagggagtgtcccaagattgggtgtgggcgcggtatctcctggggctcaaggttgggatgggaaggggtcccagccccctcctcagcaacagctgagatttgccagcatcccccaggacttccaaatgtctcgggccgacagagcacggtcagagcccatttgggcagacagaagtttgggaagctggggaggggtgaagtgggggtgggggggcaggctagaaaggagccctccctcctcggggtgtctagggtgtgctggccactggaagattggagtcgctgacccagtgctgaccctgacccttggctgggtccactctgcagactccacctgaggagacccacccagggtgaagctcggtgcccaggcctgaactgagcccggccgggtgcaagggctgaggtgtgaggtcggcccaggcctcttcccaggcctgagggtggctacagctcgaggcttgcaaggtgcctgcgccacccctgggttgaggccgaccggagtcagctgggatcacgttaatgactccaagcgatcgccagcccttccgccctctccctgcccaattctctcagcctggccagggaccaaggccgggttttggggcggacaggggactgccccacacagcggcaaggaggaggagaggccgcgtgggtcaggctggatgggtgaggaggtgcgggtggggcctgggctctcggcggcgggccatggctttggcggtggcctgtttcccctgacacccctcggagggctccaggtatggtgcggtggaagatgcaggaagcccgtggggctcttctgggcccgtgtcctgggggacccagccccctcaatcccactgggccctgcccgggatgggggggacagtgggaagacagagcgggtgtggcggggaaggcggtaagggcacagtctggagagctcaaagcccccccaaggaccgagccccgccccccaagcgggagggcgagcgagtgatggcggcggctgtggctgtggcgtggcggagggcggcgtgcagtgcgggcacgaggggcatgcacaaagtccccgagtgtgcgtgcgtgcgtggggcgggcccacccgccgcccccctgcccggggcggggctgggagggcggagggaccgaaggtcggggaggggctttccctcggctcgccccgcctcccgcgctgggccgggggcgcgggggctcccccgagcgcaaggcgggaagagggggctcggcggcgccccgcgcccccgcccaggtcatggccgggttcccgcgaccggggcgggggcctcgcgctactcaatgacgaggcagcggggcaggtgctgcgagaaatacttgaagagctcgggggtggccccggggcagttggtcagctccagctcctccagctcctgcagctgcaccaggcccgacagcccggtggtggtgagcagcgggcagcctgcggcggggtcagagggcggctcagtgcgcgcggcccagggctcgggcggggacggccgggccgcgcctccctcctcctccgcctcggacccgggactgtgtgtccgcgccgggtgtgagtttgcacaaggaccgggcaggttgggcgggtggactaagtgggggtgggtggtcactgccagcgtcagagcagaaacgggggtctcacctgccagagacaggaggcgcaaactccccagggccaggaggtgcttcagcccgaagtcttgcacctgtcgggagtggaggagcgacttaacgatttccgctcgcaccgaggcggagggcaccctggggtccatggagggctaggcgggttcaagcccggggttcctccgtcccccccggagccgggaggcggctgggaagtgctcgtgggggccgccgggacccctgcgttccgcttaggtcggctgctggatagggaggggccccagactctcccaggatctgagtggggccgggagctctccccgcgcccccacctccccgccgatcccccaatcccggggcgtgagagccggtacctggcagcaccatcgcaggtagaggctgcggagggacgacatggtggacagatagctgaggccagtgtccgtgatgcgtacacacctgtggttgcaccagaggggacccccaccttcaaatcacctggccccggccatccctcgtcttcctgggagtgcccctggcgtgaatcccttcctgccccacccggagcagccgctggcccctcctcgctcccacccaccgggaaggacgggggtccagccaacccgtgctgcggttctgcggttcccactccccaggctccgagggctctgcccgccgcgccacagccccagccccgccggaagcccccgcccccggccccgtgcagccccgccccgccccgccccgtgcagccccgcccggcccagccccgcccggcgcggcccgggggcgcgcacctgtcgagcacgagctcctctaggcggtgcaggtcgcaggccacgtactccagcgccatgtcggtgatgcgtgggcaccacgagaggtcaaggctgcgcagcttgcgcaggttctcggccacgagctccacgccgtcgtcggtgaccttggagcagcccgagaggctgagcgcggtgaggttgggcaggctgtgcaccacgttgaccacgccgtggttggtgatctcccagcaggagagcaggcgcagcgtgtgcgtgctgtggccctggcgcgccgtgaagtaggccagcgccgtgtccgtcacgtggtaggcctgcaggctcagctccgccaggttgggcagcagctgcgagatggccgcgatggcgtcgtcggccacgttgatgcagtcactcacgctcagcgaggtgatgcgcgcgctcaggctggaccacagcccggcctcggtgaagtcgttgcagcccgacagctccagacgcaccacgccctgcatctgttcaagcataacctgcaggcgggcgggcgccgggtcaggattgcaggagaaggggtggagcccgcagggaggaagcagtagggtgtaaacatgcagggagctgaaccctgaaaacatttggcagtgtgtgaggaggcggggcatcgggacgagagcccagggcctggccagggcaggtgctgggggcgttggcaccagcgttacaattagactccagacccggctgccaggcggctcctctgacctctactcctgggggatcctttcccagctgcccctcagctccccctcgcatcctccccacactgcatttgtatttatttatttatttatttattcattcattcattcaatcattttgagacagagccttactctgttgcccaggtcccaggctggagtgcagtggcatgatctcagctcactgtaccccccgcctcccgggttcaagcgattctcctgcctcagtgtcctcccaagtagctgggactacaggtgcccaccaccaggcctggctaatttctgcatttttaatagaaatagagtttcaccatgttgaccaggctggtcatgaacgcctaacctcaagtgagtggcctgcctcggcctcccatagtgccgggatgacaggcttgagccaccgggcctgggccctgcatttaatccactgccctgctgctgccatcttgaaaatcttgagtgtctttgaacaagggacccacattttcgctttgcgcgaggtcccctgtagtcagtccttctttcctcccaccccaaagccaccatccgctcccacctccatagggttgctgctgcccgcccctgccccccagccctgtcccccccgagcctggtgcacacctcgaggcctgcgtccgtgatggtggagcgcttgaggctcatggctttgacacccttcttggagagcgcatagttgtcaatgaactcacagatgtccaggtcggagacgccaaccaggcagaagccctcgaagcctctggcggcaaaaccctgcaggttcacgaactccttctcgccaccaggcagcacgttgtagagctccttggcatgcagcaccggcgtgaggcctgcccagaacttgggctggtacagcacgcgccgccaggccttgcacacctgggccagcacacacttctcgcaggccgagaaataccagaagagcccattgaggatcttctcgtccgtggccagcggcggccgctccgctgggtgcccaggtgccaaggctgaggctggtccacctgccggggtgcacgggcccccagccagggcagcccgggacagtggagcagccaggctgggtggtgggagggtgggtgggggtggtggctggcaggggcggttcttggtggctggcgtgcccttggtgatgctggccgcacccaggccgttgggctggcccggcagcttcaccagaccgtttcgaggcaagcatggaggcttggggtcgccgtcgatgcccgggctcgacatcttcctggcacgctctgtggatgagggccgggagggggagtgagtctgttgctgagtctggaaggccggggttgggggcgggtgcagtggggctccttccctccttgggcgtccctatggtgctcccagaaccaccagacagagaggatgggagtgcctgcttctccctcccagactgtgagcagcaacaggaagccaaccatggccactggcagcactcactgggcacctacggtatgcactgagcccaaccttcattgcccatggacaccctctttttcttttgttttttttctttttgaaacagagttccggccgggcgcggtggctcatgcctgtaatcccagcactttgggaggccgaggcgggtggatcatgaggtcaggagatcgagaccatcctggctaacacagtgaaacaccatctcttctaaaaatacaaaaaattagctgggcatggtggcaggcgcctgtagtaccagctacttgggaggctgcagcaggagaatgacgtgaacccgggaggcggagcttgcagtgagccgagattgcgccactgcactccagcctgggcaactgagcaagactctgtctcaaaaaaaaaaaaaagaaacagtttcactcttgttgcctggagcgcagactggagtgcagagacaggatcttggctccccgcaacctctctgcctcgtaggttcaagtgattctcctgcctcagcctcccgtgtagctgggaattcgggcgcccaccaccacacccggctaattttgtatttttagtagagatggggtttctccatgttggtcaggctggtctcaaactcctgacctcaagtgatccacccgcctcagcctcccaaagtcctgggattatgggaatgagccaccgtgcctgaccggaaacctttttgtttgcccagtgaggcgaagaaacgccgacactttttagcacttaggtaccatgatggccattttacagagaagaaaatggaggtggacctggtgaggccaggactgctctcttgacctctctgctgtgccgtccactgtaggtacccaccaggcccacccctctgggcaggccaggggaactgaagggaagggtctggggtggcctctggcccctcccctgcagggtgactgcacagcgctcaggaggggctctggtgctgactctgcagccaccctccacatgcacaggagcttccctggctcagaatctacccaaggggctgggtgcagtggctgatgcctgtaattctagcactttgggaggctgaggtgggtggattacaaggtcaggggtttgagaccacctggccaacatggtgaaaccccttctctactaaaaatacaaaaattagccgggcttggtggcaggctcctgtaatcccagctacttgggaggctgaggcaggagaatcacttgaatccaggaggcggaggttgcagcgagccgagatcacaccactgtactccagcctggggaacagagtgagactttgtctcaaaaaaaaaaaaaaaaaaagaaagaaagaaagaaaaagaaaaaaagaaaagaaaaagaaaaaagaatccatgcaaagaaagggcgggcatcttcccagggtgtgctgtggtgccagcatggttagccctggacacaagctgtcgctttaatcttctgcccaatgagaacgatgctgtgatagctgtacccactgcacagatgaggaaactgaggccaaggctgggcaaactgcctgcccgaggtcatggccagataagtggtgaagccaaagttcgggcagagctggctgaggaaggccatgcggaggttatcttcaggccagcgacatccacgcacagggtggagtgggagcagtcccgggcaccctcctcaggcctccagtctgtaagtgggtggcagggggcactgggcacagccacggaaagaagcagaggtgggaccctcactgtgccaccatctgctccacagttcggatctcctgccgcccccaccccgacatccggggaggaggtagagcccctggggtcacacgccctggacttgaaatgggccccaccctggctctgtggtcttggcaagccacttcccttctctgagcctcaatttcctcaccttgaagcctggggaggtgacggtacctgctcccttggggcattgcaaagtgaacgagctcagtgcgtggctcatagcaaggtctgggagagtgatgtctgagccccacggccacactccagggcaaagcaagatgcatcttccccggtcttaggtgactccaggactaagcctggagcctcatgcaggtcctgccttcctgccccaaaatctcagaggaggggccaaagcctctcccagcccaccctgccccctcctgccacagcctcactggaaggtctcttggagccaccaagggggtgtctgagagtctcccacgaagattccaacgcttggggtgggccctgcaatatgcagactctcaggaagaggatggctcacatctttttggctgagtgtcccttctggggctacagggcctggcctgctccaccacagagagtggcggggtctcggacggcactgcaaccccaaggcccgcagcccattccccataatctggtcaggggggaggggaggcagggaggcagggaggcagtgggaggtcctgccccgctcttcccagcagcaggtccccacactggcttccaagccccagacagggccagccttgccaccggtccacatctggggagggggtgtagaccggagccgggaccaggggtctcgccagaacacgtggccctcgtggctgagaacccagctttgggtttaaagtccttcctgccctaatggcaggagccccagctccaccctctgtaccatctccccctccccagagtatcattcgggtcctggaaggtgaggccgggccctccacagaggaggcacccacagccggtgacccccatcatgtgcccatgatcagaaggcgcggcctccggaggccgacatcacaacgtttgcaagggccggctggggtcggcacatgattcgacctcacggccgcccttaggggtggaggggtcgctacctcaggtttggggaaggaacacgaggctctgaggagcgaatttgccccaggtgtccggggaggcctggcgcggggctgcctcggttccctcccagagccggggagaggggatatcgcaggatgccggcgcccgaggcggcagcaccaggcccacgggcgccccagtctaaatatcctccgtgcccctagagcggggaccctcgctccccagacccggaagcgccgccttccccgccagggacgcctgggcctccgcagaccccgccggccggcgcgccacccgcgccagcaccatggacagcggccgccccagccgcgcgctcagggccaggcccgggctggcttccaccgcggacggctgcggggtcggggcagccccgcaatcccaaatcccggcagcccccgctcagcagggaggggccccgggggcgaagagtgggggagaagccgggaaggatccggaggaggcggcgggggcggcgccaggggaggaataatcccggcgcagtgccgatttaggttgaaaacgctcccagtcatgggcctgcacgtggagcgccggggctgggggaggcattcgcggggctcctttcccgccccgctcgggagctcacgtttgccggcgcccacagtcccgtccccacctccaggcctcagggtcgagatggagaaaccaagccgcactttgagagcccacaggagggaggggacaggctgaggagcggccgtctgggtatgggtccggggcctggcttccctcatccacacccgcagcgctgccagaaggcgctgctctgcctgtggtcagccctcgacccgtgtgcttggtgggagctgcatccccgcacaggcagccccactgctccccaatctcgcgtccacgttcctgccggcccccgctgctcctcacactcccggcttgactgactcagcccgaatatcccccaccccgtagctcaaaaatgcaaacagccacacactttggcccaggcatgggcgctgcgggagaaagctgagctcaactggagactggggtctctctgcccgttcagcgagaagtccctgggggctcacacaagggcccctctgcttggccctgggcccggccccacccacccagccagacggtcaccaaggagccggttcccatggctcacagagccccctttcctgcttggcgactgtgagagccctcgttccacccagaggggctcggacgacctgcgtgggctgctagggactgcctctccctttagggacaagcagcccgggtgctaatacggggaagagacttgttaaaaaggtggccatgcctgcaccatcctcagcctcagcccctgtggtgctggctcagcttgaagtggaatcctgtcaaggctccggggctcaccccaggggaaagagagagaggtggccccacctcagctgtcttgtcctcagcagcctgagcctggcctgggagctgctggggagaggtggccgtggcctctgtgtcctccccaggggacgcagtgtgaagcgtgtggccagagtgagcctagggagcacggtggggcctgggtgctcctgggggtccccacatgtacatgtacagcatccaggctgaccattcccagacggccatgtgggggccccgcaggagctgcctcttctgcgaatcaagtcactgagcccggagacctcagctccggccccttcccagccctgatgccacagcccagccatgccattcctcctcccctgctcctctgcctgggcacacgccgttccccctgcttgcctggcagggtttccctgccttagccctgcaagctcttctcctccatccctcagttcctggtgcgaggtcgcccctgcctcctgctccgggacccccagctcttgagaaagcgtctccagggtcttgcaatcacatgggttatcatcactgtccacctggtgtctctcctcctggcctgaggactcttgaggacagacagcaccaacgtgcatggcctctgcatgttcgcggaatgaatgaattagggaacgaatgaatgaatgcggaatgtggctccgctagctcagtcacgcagaaaggggtgcagctgccaaggcccccggagggctgatggaggattggtcaaatttaggaagaggccggtcagcggggaaggcacagctcgggaaattaacccggatcgtgccatggccagtgtccgcggggagagtggcctctggggttgggactaggttggtacctgagtcactgagagggctcccaagaccccagggctggggtgggccttgcaatacacagagccttcggatgaggagggcccatctccttttcagctggctctctcttcaggagctgcagggctgaggaagtggctgcccgtcctccaccatctggcctgagccaagagagggaagggggtcctcctgccccgctctccctggcaccacacgcacccctcctctgaccggccagagtccttccttcacacactgcctaactaggagtggggaagcagagcttgcagacggattttccagaagttacatagagctaggattggctccaaaagccccggggctggctgattccctctacctgggtcctgccaggtgtacctcacagggtcctcgctctgccctgttctgcctcatggggtctcgatgccttcctgctgggccctgggctagtggtctctccaagtactgccctcatcctgcagggtccctgccacggcgctgcattccttgcagaggctgcacaccgcgtgcccacccctgggacatccttttggacacatgcctgggaaacctcctcacccctcagcgcccccagtttgaaggtctcttcccccatctctggtgcccccatctctgtcagcaccagactggggcacagcctaaccaaccactcagccctcatagaacctcagggaccattgagccctgcctgcagagggccttagagctgggcagggccctggtggccagagaaatgcacatcgggctccatctgcagtggcagccccagagcctggctgacagctggggtggctggggattggggacagggtgcagactgacacattccgtggcagccccgtgacgcaggcacacccgcgtccctgccacttggcacgtggcacagcggcagagctcctctcccgcccccagtttgagatgcttctgggggtgcaccaggggctctgaggaggggcaccatggcgcagcaggcacgtggcctcaagagaaacccgtgttgctgccccagcagactgagggcccatggtcaagcccagggcagctcagccttgaaagctggacaccctggggagtgggtgctgggatccaggcctcatctcagcccctgctcggaagagcatgagcaccctcagaggcgaggcctgggcccctagtgcctactgctccaggcagctgccactaaccatcacccctctttcctgcccagtgaaggaatgaggcctgaacccacacattgcagccagtttggccgttgactcctcctgcaccactggtggggaaggctcagtcacctgctcacccacagagctcccttcactgccaatccagtcatgggaggcacagcagtgggtgcccacatgcaaggagatggggtcttcgggtggctgaacagtgccacctgggtgggagatccctaactctcagcaacacaaggcttcctgggtccatgtccagctggttcaagggccccgtgcctcccacacaggaagctgtttgtgtccttctcatcagtgggaggtaggactcgtccagccgccccggaagtgggtgtgagctggaggcagtgagtctgtcgatggaggggctgaactcaagggtctggccccagatgaggggcagttggggtggcagggggcagggagtggggcaagtgagtcctagggttcccccacacagcgatgtttgcagctgggccttgaatttccctcccctccaggcggctccaggtccagccctgtgtccacctctggccagaccagccaggttccactaggcctctgccctggtccgggagacagaaaacccttcagtctcctggcctgacccaggcctatctgctccaaggctgctgtccagcaccccacagagggggtgggctgggagacggccctgtgtccagggaggcctgagctgcccctggccattgggccctcggatgcacgggtgtgggggaagggcctgaaggaagaggcaggtgaggtggcctccgccatctgctcctcctgcggagggcaggctgcccgaacagagcctggagcctgggaagggcctggagtggccgctgggccgtcagttcctgaagctgccaccgcagccctctctcctgaggtgatgggtggggaacgctctccacccacctaatccccaggaggacaccggacccctcccgagcaggtctgaaggtgccgtttcccttctgaggccctccaaccttggccaaggcccggtcccgcctccagaaccaggaaggtgccagcctccccccaccctcctcctcccgcgggcagtagctcagcgcaggccccgggtccagaagccgcccgcccggggagggccgcccctcaggccgcacatccacgcgacccccatgcagtttaacggtctctggcctgtcacttcggtccgggggcgccctctgagccgaccaggcgcccggggtggaggccgggggcctacaattcctcctttcggcgtcccaggaggcacggacccccagccccggccgagtggccagtggggagcggccctcttccgggccaggggccggggcgcggggctgcgggaaggccaggcagggaccgaggcccagcggccgcgggggaggtggggaaggggctgccgttacgtaagcccttcccgggcggcggcggcgcggcccccacccccaccccgccccctcctcattgtggccgccgcggaggtgcggcctggccccctcccggccccgcagcccggccgcacgcgcaccttacctcggcccgggctcctggctcatgccacgctgtccgccgggcgacctcccgtcatggggagcccggcatgggcgtcggcgcgcgggggccgccggggtgctggactggccggcagggcccggccgcgccctgcgccccgcgtcccgtcctggccgggccccctcggcagcgcacggaaaggagctccccggtgggagaggatcggccgccccaagcctcccaccggggaggctgaggctgtgcccagataaataaggccgctttgcagggaaccaggcgggcgcctcctcctcccctcgccctccccgcgctcctccgtggccgccgccggcgccgcgcgcgccccccgcccggcaccaaacgccgcgccctcgcgcgctcccggcgtggcgagccaatccgggttcgcgagcccgggcgggggcgccgagaatgccgagccccgcccccgccccgccccggcccccgcgcgcggcgcgctcccggcacggcgtccacgagcacgcgccaggcccggcacgcgcccccgccccgctcgccgcgggcacccgcacaataacaaaccccggcgcgcggcgggcggggagggcgcgggaggcagaagggagggcgaggggaggcgggagagcaggcgccggcgggtggcccaggggtccggggtcctatggggaccggggcggcaccgcgcgtcccggcccttggccaccacttggggaggcgaggaaggcgagacccggcccagaggagacagggtggtcagacccccgtctctggaccctcccgcccagcccacggcaaggacccttcacagccctcacaccccccgcgcacctgctgcgtgcccggccggaagcccctcattggagaccctggcacacccgcagagcgcgaaaacaagtgactgcacggatcagttcagacagtgacagtgaaagcacccgagggcttgcggtggtgacttctggcgggggcttcctgagggtgccccactggagctgagacccccccacggcgcgagggagggatggctcgggaatgggggtgcaaagatccgaggagcctggcaagttccctcgggaataaactggaggctggaggcggcggcggctgctgcagcccggggcaggggtggggcgtgctaggttaggtggaggactcggtggggaccgctggagaccccagacgccccagcaggctcagggcaggagaatggaggccaatggcgccctatcctggggtctcctgggagcagggccgggggagggagcaggtgtggggagagcagaggggttctttgcaccgggaaagagctacagggctgaatggggctcctgagagtatctcaataggagtgaaaccagctgctgttcccagcgtcctgatgggaagcctggccgaaggggccggtgtgaggcctggggtcagcgggaaggagggtcagactgacggcaccctggctgggtcccggggtggggtggttctgtgcttgctgtgggggcgccactgggtctacctggggtgagcgcagcagctcttctgcgtaagtcttgcccggtacctggatactgaccaaagaaggtgcccggagtggggcagacaggacgagccccgtgaagacagttggggcaacaggggagcggcggtccaacctatctgggtgtctccggtgcatggtctggcaggctggccctctggcagcagcttccaccccaggcgtggactgctcccggtaggagggtttcacctcgtgcctggggctctcaccacagcaggtgccagggcctcaggcagagaacaagctgtgcttgtgttgagtcccagctggggctggagccggacacaccccaagcgcacagggcaggctggacacaccccaagtgcatagggtgggctggacacaccccaagtgcatagggtgagcgtgggagtcaggcatttgggtcatgcaaccctggcgaggcccaagaagctagccctgcctgtggggaatctgagcagggaagagtgtgtggaagatcatcacagaaaggccaaccgtgctcctccaaagcggtgacccacctgccctccacctctgtgaccagctgtgacccacctaccccccacctctgtcaccagctgtgacccacctaccctccacctctgtcaccagctgtgacccacctaccctccacctctgtcaccagctgtgacccacctaccctccacctctgtcaccagctgtgacccacctaccctccacctctgtcaccagctgtgacccacctaccctccacctctgtcaccagctgtgacccacctaccctccacctctgtgaccccacctgtgccgggcaactttgtctgtctccaccatggctggtggcagctacttccccattggtctctccacccctctcccatctccttttctccccagggtgcagcggggccattttgccgtgcagacatggtcctgttcttcccagggccctgttcattctttgctgaagactgcacagccctgagtgcctggcacggctggcccacagcctcgctctatacctggccccttgaggatgaagcttcagccacactggccttcttctggggccaggagagtgccccatccctaacctggtgtgcccctcccttcacctggagcacccttcacctggggcacccctcacctggagcacccctcccttcacctggagctcccctgcagcacccctcccctggagcaccccttcctggagcatttcctcatgtggagcacccctcccttagagcacctctcgcctggagcactcctctcctggccccttgcctggagcactcccttgccacctgtacctgggtgactacttgcctttcagaccttggctaatgtattctcccctaggtgccctccctcaggaggacagggccacagacccgtgtcctcacctccccagcaccaaggaccttcttttctcagcctgtgtctgcctggtgtctgatggtgcatttgatgagctattggctgactgtgcctgctgagggccagggtgcggtcttcttccccaccaccctgtccctgggcactgagcctccatctcagtacgtcacaggtgcatggcaaatttggcgaatgagggagacagcgatgcgtcagcagcatgaaaggtgactggcaccagcagtttggatcgcctcctgtggcgggaggcccttgtagaggatacctttggagaacagctcacaccccagagggaagtggcttggacaaagggggctgctcagcagacttcgatctcctctgggggatgtggataccgctcaggcccgcacccctccattggtcctggagactgatatgggaggcggtatgtgccttggctccggagggcacctggagcacccctcacctggagaaccctcatccagagcactcctttcctggagcacccctcacctgaagcaccctcagttggagcatcctctcacctagagaaccctcacctggagcaccctgttacccggggcaccctcacctggaaaaccctcatctggagcaccttctcacctggagaaccgtcacctggagcaccctgttacctggagcaccctgttacccggagcaccctcatctggagcaccccctcacctggagcacccctcacctggagcacccctcacctggagagcccctctcctgcagaacccctaccaggagcatacttcaccgggaccaccccttgccttgatgcctcagcactgaggagtctcccatctaggtggctgggagggcactctggagccatggggatgaggaccagaggctgctggtacatcttgccctgagactttggaggactgcaaggggacccacattcacttcagctctgcacctgtggtgatatccccacactggagagcaaagtgattgctccgggggccagatggccacgccaccatccccccacacactgcccctgccccctgcctggagcacagcccgagagcacccaggatcatccatgtgaagcagcaggctgtgggtatgtttggccgtcccgacccctccacagccagaatgggcacccataggcatgagaacctcacagccattaggggtgccctgagtgccatgggcggtgggatttctctgatgccccccagctctgctccctgcctggctcgccccctatcaaggctaaggatgactcagggcccagccatcaccatagcaacacgcgtcgcctagcaatggcggtctcccggcaacggttgtctcctagcaatgggatattttcctgggccctggctggagcccggcagttatttttagctccacagcaaatcagtcggcagctgcattttcggctccttgaagagaggcaaggtgtgggggggtgggtctctcggcaaagggaggaaagcatccccaagataggaatcttgctgccgtgggcccggaggtgcaggcctgtgggtgggcgaggccggatcctgcctgtgcaggggggcaggtggccggtggaggggagccaggggttgtgcaggctgcctggatgagtcggcagctaggactatgtccttgatgggcccccaagcaccctgagcctcataggtcggctgggtagaggggacgcaggccagtgctcacagctgcactatcagagcatgtttctgggtggcccagggtctggcaggctcttggcacccagtgcccctcagctgtgggagccatcttcactgtcccagaccccagctccacccagggagggggcagcagggcggccgcagagcagcacatttggccaatcccgtgcagggctcagctggggacacaggaggcgctggcttcaggtcagcccacacctctctcctcgctccgctgccagtgaacagagacacaggcgggggtcttggcctacgatctggcccttctctctaggcttcctccccatttcctgggggatcctgttcaccggtgcgtccaaactccccaactccctcagggcagatgggctgggtggggccggccttacccgcctcccctttgcagcaggtcaaaggctctgaggcagatggagcttcaagcaaacaaggagcccccagggctcaccctctgtggttcctggtttactcgaagttctgtctgcctcagggcctttgcccctcttctccccagggttggggctcccttcctgcccccccatcaactcccctcgtccttgatgttgctcccccagggccccagccagccagctcctgccctggccgtgacagctgctattctgtgcccggcactgtggtgtccccagcgggttgttcggcactccgtggcgcagccacctgtccgcagccgctcccctgcgggacgtgggctgcctgtgccacgcactgctggggcccagctcatggcaaatgcagcactggtgtcctccacgggccggaacctgtgtctggggggagaacgcagtggccgaaggtgggaaccatgtggcagtgaccagggtctcgaccgcccccaccccagcaccccctcaggctgcagctccaagggccctctgggcaagacaggaacagaaaccaagtctcaggcttcgggacaagctgtgaggctggccgccctgccttgggctgaggggccttgtgatatggcgtctgtgtttggccacggccaggctgacccgcaggcgggagagatgattgtcccagactctgcactctccaggggtggcctcacgcgctaggcccaaggtttctgaaacaaagcctcagggaagttcttccttttgtctgacttgagtatgtcttgctgctgtcgcgttctgacttgggtggaaatggagagaggccccttctggggtttcagggcactcaagggtctggggcttggggcacttgagggggcccccaaacagcacagacagccacggcatcacctaagcttggggatgccttccaggcactcctccgcccagccaccccccacttagtctgctggtatttactgagcaccagcaccctggcaagtcgggtcctgtacccatagcaactgaggacagactcggccttccaggcccctcctgtaggcagcacagcactcactgatgccaggtgctttcctgggtggggccgggggctgtgaggaaaaggggtgtgtgtccagggcttctcctgtgggtggctgcattggcaccggatccccggagatgaggctggggaggaggcagggacgcccggggttgaggcgtcaactcggggccaggcatgtgccattccagaccaggtcaccccaggaacccctccctccaaccacagacactggcccctctctggaggaggcctggggagaagtccggggcccaggctgtcaggagggtgtctggggctgaccctcacgccgccaccagagggcgcctggagcccaccgtgctgacccggggaccgccaagcggcagcagccctggacggctgggtggctgcagcggccgacccgtgtgcctctccccacctctgcgagcacctcatgtgctcagccccaggccgagtctaccctttaacctttacgatttttatattttatttatttattttttaatttttattgagacagggtctcttctgtcgccctggttggagtgcagtggtgcaatcacagctcactgcagcctcaccctcctgggcttaagcaatcctcctgccacagcctcccaaagtgctaagactacatgcatgagctgctgcacccagctaatttttgtagttttagtggagttggggtttcaacatgttggccaggctggtcttgaactcctgatgtcaagcgatcatcctgcctcagcctcccaaagtgctgagattacaggcaggagctgccacacccggccttaatttttatgtaattaattaattaatttttatgagacagactctcactctgtcacccaggctggagtgcagtggcctgatctcagctcactgcaacctccacctcccgggttcaagcggttctcctgtctcagcctcccaagtagctaggactgcaggcgtgcgccaccacgtccagctaatttttgtatttttagtagagatggggtttcaccatgttggccaggctggtctcgaactcccgaccttgtgatctccctgccttggcctcccaaactgctgaaattacaggtgggagccgctgcgccttgacaatttttatttttaattgtaagatatacatcataacatctaccattttacccattttaaagtgtgcagttccgtactgttgagtacatttgtgttgtgtaatcaagctcctgaattctgtccccattaagctccaatccctcattcccctccccagcccctgctccactttctgtcctcatgaccgtgactactctaaggtgactcacagaagtggaatccaacagtgtttgtccttttgtctctggcttattttgctcagcgcataagcctccaggctcatccaggctgtagcgggtgtcaagggaccagaacttcattcctttttatggcttaataatggacccaccgccagggggtgccgtggctcatgcctgtaatcccaacactttgggaggctgaggtgggcggatcacctgaggtcgggagttcaagaccagcctgaccagcatggagaaacctcgtctctactaaaaatacaaaattagccggcatgatggcacatgcctgtaatcccagctgctcgggaggctgacgcaggagaatcgcttgaacccaggaggtggaggttgcagtgagccaagatcgcgccattgcactccagactgggcaaagagcgaaactccatctcaaaaaaaaaaaaaaaaaaaaaaaaaaaaaagaggccgggcgcggtggctcacatctgtaatcccagcactttgggaggccaaggcgggcagatcacgaggtcaggagatcgagaccatcctggctaacacggtgaaacaccctctctactaaaaaaagaaaaaatacaaaaatttagccgggtgtggtggcgggcgcctgtagtctcagctgctcgggaggctgaggcaggagaatggcatgaacccaggaggcagaggttgcagtgagccgagatcgagccactgcactccagcctgggcgacagaacgagattccgtctcaaaaaaaaaaaaaaaaatggacccactgcacttgcttgtccactcagctgcagacaggcctttgggagtcttccaccttttggggattgtgatggctacttctgacctgcacctcgcccagagcaaggggctggccgagcccagtaggcgccttgttcctgtttggcctgggagggccctggggttgagggagggcctggtcagtgggatccagcctcccactgccactgagccatctggcctcatctgtccgactgccactggtgaactcatctgtccaccatgagtttcgagcgccgggtggcaggaggtttgggggcaggggacggaatgttcacatcttcaggctgcacagtctatgctggtccttgcagtccccggctaaagcttctgtcgtccgtaaggggttcagtatgtagtgggacccctttgcttgtgccttaggccttctgtgatctgacctgtcgtccccacccaccacccatgccctggggtttcactgggctgccaagagctccttcctcaggcccttgacccaggctgtctgctctcccccattctcttcctgtccacctggccagccactgcccacttcctcccatcaggccaactcagcagtcccggatgctgggaatcccacactgctccagcctgaggctacagtgtgtttgcgaatcgcctgtttctgcttgtttcatcttggtgggggctgctcctgtggcccaggggtgtcctcccagctcctgtgtctccacgtgctgcaggcctgcaggggtgcccgtggctgctccattcacgcccctccaggagccccgtctggcccggggtcggtcatccggcaactatggggtgccgctaggtctgaggaaaggggcctaagcctgcgggctgcgcgctcttcagcaggaccccctcctgcagacggccttaccaaaacccgaggcctggccccgctccaaggcgcagcccccaggccaggccttccccgcctctggagtcatgacccctctcctctggggctccaccggcctctggtcagcaggaccggacctggttgggagggatgtggccaacaggcccaggtcccagtgttaggaaggagcaggcccggccgcccgcgaggcggaaccaccaggtgggccaccttccctaccgccaccccgaggttccagtggacatcaaaacctcggctccatcagaggctccaggactccgatcgggacagcgcggggggcgaggccagggtgagggcgcggcgaaggagagacgcacagcgcggggcgggcaaggagcctcccttccgcgccaaggccccccccaaccctcgaggcgcttggaccgtgggatagtcctccggcggcgcccgagctccggccccgcccccgctccgccccgcgcctgctattggcggaaagttccgggccgcgccgcgactggccgacacgccgcaggccccgcccccttcccgacccgctccaaggcggccccggcgctggggctgcgcggcaggcggagcggccgcgggcttgggggcttcgccggggccgggcggccggcgcccccggctgctcccgccgccgcccggacccgcgccccgccggggcagcggtggtgagagccccgactccccggacgccgcccgccgtgccatggggttcccggccgcggcgctgctctgcgcgctgtgctgcggcctcctggccccggctgcccgcgccggctactccgaggagcgctgcagctggaggggcaggtacggtccggggggctgtccccgcacttaggacggggtgcgctgcggctaggaccccccaggcgcccctcggagcgcgcagagcgctgggccggtttccccatccgcgaggcggcctcgggagggagcgggggctgcgccgggcggggacccgcccccgtctcagcgccccgtcccgtcctgtccccagcggcctcacccaggagcccggcagcgtggggcagctggccctggcctgtgcggagggcgcggttgagtggctgtacccggctggggcgctgcgcctgaccctgggcggccccgatcccagagcgcggcccggcatcgcctgtctgcggccggtgcggcccttcgcgggcgcccaggtcttcgcggagcgcgcagggggcgccctggagctgctgctggccgagggcccgggcccggcagggggccgctgcgtgcgctggggtccccgcgagcgccgggccctcttcctgcaggccacgccgcaccaggacatcagccgccgcgtggccgccttccgctttgagctgcgcgaggacgggcgccccgagctgcccccgcaggcccacggtctcggcgtagacggtgagtggcggtctggttgggacagggtgggagtcccgaagtcttaccctgcctgggcttggcgggaatgtgccttgtcggccccactgcagaaggaaaaagtgagctacaagggttggatgggcttgtcaggccacacagcctgggactgctggggagggatggcctccccgccctcccttcccgattcatctctggaaagagctggcaggggcagagtggagggaaggggaggccgggcccagcaatcctgggcctctggtccctgaacggttgggggaagagatggtggggacagaatcgaagcctccggccaaagctgtccggggctccctggcccagcggtgacctctctcccctcccccagcccaaccaacaaaagtccagtgtgcagcccggtcaccatggagacgccgctcgcctccctgcagggcaccaggcccagctcttgcttggctctcctggagcttggcgcctgaccctgaaagggatgggctctcgctattctgccccctggccctgggccagggaccccagaccacccttcctctgcccccacttcctatcaccctagctgggctgctgctcttcagacctcagatccgggaaactagaggggtcccagatgctggggtgcatatgtcagatgggagtgcaggagggcggcccaggacagctgatcgctaggcatggcccccaggcccacgtctgtgtgcattcctgccttggaggtacgcgcctgcaagtgtgtttcctgagtacaggtgtcgccgagggcgtgcacatctgctgtgtagctctctgggacccccaggtgccatcaggccctgagcgtgggctctgctcatttgcctgctgcctcctgccgcttgtgcggacaagggacggggcctggggtgatgccgggagagggcagggcctctcctcaccaccccctctgcatgccaggtgcctgcaggccctgcagcgacgctgagctgctcctggccgcatgcaccagcgacttcggtgagtgtccccgccatggggggagcctggagcctgccttcccctgaatgcctaccgcagccacatgcctccccacagtaattcacgggatcatccatggggtcacccatgacgtggagctgcaggagtctgtcatcactgtggtggccgcccgtgtcctccgccagacaccgccgctgttccaggcggggcgatccggggaccaggggctgacctccattcgtaccccactgcgctgtggcgtccacccgggcccaggcaccttcctcttcatgggctggagccgctttggggaggcccggctgggctgtgccccacgattccaggagttccgccgtgcctacgaggctgcccgtgctgcccacctccacccctgcgaggtggcgctgcactgaggggctgggtgctggggaggggctggtaggagggagggtggg

SEQ ID NO: 368 - DNA, 30474 bp, Homo sapiens
ttctgtgtgagcaacaaggctgtttatttcacctgggtgcaggtgggctgagtccaaaaagagtcagtgaatggagataggggtggggccgttttataggatttgggtaggtagtgggaaattacagtcaaaggggattgttctctgttaggcaggagtgggggtcacaaggtgctcagtgggggagcttttgagccaggatgagccaggagaaggaatttcacaaggtaatgtcatcagttaaggcaggcacgcgccattttcacttcttttgtgattcttcagttacttcaggccatctggatgcatacatgcaggtcacaggggatatgatggcttagcttgggctcagagacctgatattcctgtcttcttatattaataagaaaaataaaacaaaatagtggtaaagtgttgggatggtaaaaatttttcggggggtggtatggaaagataatggatgatgtttctcagggttgcttctagcgggattaggggtggcatgggaacctagagtgggagagattaagctgaaggaagattttgtggtaaggggtgatattgtggggttgtgagaagaaacagttgtcatatagaatgattggtgatggcctggatacagttttgttatgaattgagaaactaaacagaagacacaaggtccaaataagagaaggagaaaaacaggtattaaatgactaagaattgggaggacctaggacatccaattagagagtgctcaagggggttcagcatagccctgccagcaaagattatttatttactttaagagttaagagtggcggtttggggatagcaccaggagatatcagctgtgatggcttggagaaacagtgtaaaccggcagtgtaaagaagagcagggcatttatgagtagttgataatggtgaataggagtatgactagacagaagacagtagggatgacaagtttttggggtgcagtccaagttggtctgatgtctggaatgagactggggcctaataaaaggagcatctatacaggagctcaaatgggctgtaccctgtaacattttgaggacaagcccgaattctgagaagggaaagtggtaaaagtatccagtcctttttaagttggtggctgagcttggtgaagtgtgttttaaaaagaccgttagttcactgaacaccaagagcctgagaaactgcttgggtgatttgactaataaaggcctgtccgttatcggactgtatagaggtggaaaagccaaacgaggaattatgtctgacagaagggaagaaatgaccacagtggctttctcataccctgtgggaaaggcctccacccatccagtgaaagtgtctacccagaccaagaggtattttagtttcctgactcggggcatatgagtaaagtcaatttgccagttctggacgggggcccgagcttcatgtgtagggaagggagggggcctgaacaatccctgaggagtagtagaatagcagctggaacactgagaagtgatttccttgaagatagatttccacaatggaaaggaaatgagaggttctaaggggtgggctagtggcttgtaacctacatggaagaggttatgaaatgatgacagaatagaatgggcctgtgaggctggaaggagatatttcccttggtctgagaaccatttgccttgtgtgggaagagattgacaggtggaagttttagtgggggagtaggtgggagtggccagatgagaaggagaaaaactgccctgagggatagaagttggaacactagctgtttttttagctaccttatcagcataagaattgtcctcagtgaggggatctgatgccttttgatggcccttgcagtgaatgactccagcttcctttggaagtagagcagctttgagaagagtttttattaaagaggcattaatgatggaggacccttgtgtagtgaggaaatttctttcaacccatataacagcatggtggtgcagtatatggaaggcatatttagagtcagtataaatattgacgcgtagtccttttgcaagagtgagggctcgagttaaggtaatgagtttggcttgctgagaggtagtggggtgggggcagaaagtatatgcatcaggtgtgaggaagaaaatcgattttggaagttatgagaactgtagagagtgaattgagcatagtttgtgatttttagggcctctaaaagtattaaagcagtggcagccgctgcatgcagacacgatggccagcctaaaacagtaaggtcaagttgtctggacagaaaggctacagggcacggtctggctcttgtgtaagaatttcaaccacacagccctgcacttcggttgtgtgtaatgaaaagggagtgatgagttagggagagctagtgtgggagctgttttttaaggaatggaaaggaaagtagggaaaggatataggatctatggggtcagctaggtttatctagaacagaataatgggttgtagagggaggtattgaggataggagagtatatgggtttggcaccacggggtggataggcaaaacaatttggttttggttgataagactcagatcctgaactaaactgtaaggcttgtccagttttaggacaggtaaaatggggaaattgtaaggagagtttacaggctttaaaaggccgtgctgtaacaggtgagtgataacaggctttaatccttttaacacgtgctgtgggatgggatattggcattgagtggggtaagggtgattaggtttcaatgggatggtaaggggtgcatgatcagttgccaaggagggagtagaggtgtcccatacctgtggattgaggtggggagatacaaggggaggatgtgaaggaggctttgaactggggaaaagggcagcaatgaggtgtggctgtggcctaggaatagtcagggaagcagataatttagttaaaatgtctcgacctaataagggagctgggcaggtgaggataactaaaaaggagtgcataaaagaatattgtccaagttggcaccagagttggggagttttaagaggtttagaaacctggccatcggccgggcacggtggctcatgcctgtaatcccagcactttgggaggccgaggcgggtggatcacgaggtcaggagattgagaccatcctggctaacacggtgaaaccccgtctctactaaaaatataaaaaattagctgggcgtagtggcgggggcctgtagtcccagctactcgggaggctgaggcaggagaatggcgtgaaccccggaggtggagcttgcagcgagccgagattgcaccactgcattccagcctgggcgacagagccagactccatctcaaaaaaaaaaaaaaaaaaaaaaaagaaacctggccatcaatacccacaacagttatggagtcaagggaaacaggcccttgaaagaaggtaatgtggagttgggtagcctctgtattgattaagaagaggacggacttaccctccactgtaagagttatccaaagctgggcatctgtgatggtccagggggcttccaaagtcatctggcagcatcagtcttcagccgctaagctgagaagatctgggaaggagtaagagagccttgagccagagttccaggggctctgagagtggctgccaggtaaattgaacagtccaattttcagtgggatcctgcacagatgggacatggcttaggaggaatcccaggctgcaggaattccttggcccagtggccagatttctagcactcatagcaagctcctggggaaggaggttctggatgaacccctggcagctgcggttcatccagaacctcatccaggtgtttggatttcttgtgtgctggagatgtggctggggtttgtctcacagtggaggcaaagaattgcaactcagaaatacattgctacttggctgcctctactctattattgtacaccttgaaggcaaggttaactaagtcctgttgtggggcttgagggccagaatttaatttttggagctttatttaatgtcgggagcagattgggtgataaaataaaatgcatattgagaataagatggccttctgacttttcagggtctagggctgtaaagcatctcagggttgctgccaaacgggccacgaactaggctgggtttttatatttgatgaaaaagagcctaaacattaactgatttgggagagatcggataaagaaaaaggaggattaaccttcactatgcctttagctacagccacctttttaagaggaaattgctgggcaggttggggagggctagtcacagaacgaaactggaaactgtaagccagaccaggtgtaaggaggggaggtgataaaaggattatagggtgggggaccggaggctgaggaaaaattgggacctagctcggcctggtgaggagcagcctggggaggaggggagaggtcagatgggtctgtagaaaaggaagattggaaagactcagcgatgcttggggttgggactgaggggacaaggcgggagggaaagaagcaagatttgggacaagttgcattgagaacagagactagggagggaccgatatgtaaaagaatgcctggacgtcaggcacctcagaccatttgcccattttacaacaagaattatttagatcttgtaggatggaaaaatcaaaagtgccatttgctggctatttggaaccactgtggagtttgtactggggtcaagtggcatggcagaagaaaataatgcatttaggttttaggtcaggtgtgagttgaagaggttttaagttcttgagaacacaggctaagggagaagaaggaggaatggagggtggaaggttgcctatagtgaaggaggcaagtccagagaaaagacagggtagagacatggagagaaggggtgggggggtgcttgccccccaggaaagtggagagaagagagggtagagacatggcgggaaggggttgggtgagcagccctgggctgcaatgtgggtgagcagccaaagcaggcatccctgcaattgacttgccagcaagggaatgtgggtgaatgaccaaggcaggcgtccctgcggtgatcagacactgatgaaatgtgggtgaataatcaggcaggtatccccacgtgattaaacatcaaaggaagactgtcttcctgagtccgtgactggcaccggagttttgggtccatggataaaacatgtctcctttgtctctaccagaaaaggaaaggaactgaaattaagagaagggagagattgaaagatggcaccaagattgaaaggagaaagaggttgagggatagtgagagaggttggagaagagagtaaagaggggccgcttacccgatttaaaattggtgagatgttccttgggctggttggtctgaggagcagagatcgtaggtggatctttctcatggagcaaagagcaggaggacaggggattgatctcccaagggaggtcccctgatccgagtgatggcaccaaatttcattcgcgttgctgtgaagagaccaccaaacaggttttgtgtgagcaacaaggctgcttatttcacctgggtgcaggtgggctgagtccgaaaggagagtcagcaaagggagataggggtggggccgttttataggatttgggtaggtagtgggaaattacagtcaaaggaggttgttctctggtaggcaggggcgggggtcacaaggtgctcagtgggggagcttttgagccaggatgagctaggagaaggaatttcacaaggtaatgtcatcagttaaggcaggaacaggccattttcacttcttttgtgattcttcagttacttcaggccacctggatgcatacatgcaggtcacaggggatatgatggcttgggctcagaggcctgacactaaaccatggatcagcttttcccctaacatcctttttaagttccagaatcaatcctagaatactgttactgaaagaggtcccaatccagaccccaagagagttcttggatctcctgaaagacagtaagggaggagaccatccctcatattgttttatgcccaatttctgcctccaaagaaagaagtaaaaactaaaaggcagaaatgaaatccacaggcagacagcccggtgccgtgccctaggcctggtagttaaagatcgacccctgacttaaccggttatcttatctacagattccagacattgtatggaaaagcattgtgaaaatccctgtcctgttccattctgattatcggtgctgcacccccagtcacgtacccactgcttgcttgattgatcacaaccctctcatgcagacccccttagatgtgtaagcccttagaagggacaggaattgctctctcaggaagttcaacttttgagaagcaagcctgctgaagttcctggctgaataaagctctttccttctttaacctggtgtctgaggagttttgtctgtggcttgtcctgctacatttcttggttccctgatggggaagcaaggtgattggcagacggtcgaggcagccccttaggtgacttaggcctgtcttgtggagcatccctacggggtactccgaccagcctgagtgacgcagatccaaacagcactcccgggtaggcaattgccccagtgggatgcctcgccagagcagcgtgtggcaggcccctgcagaggatcaacacagtggatgaacaccgggaaggaactggcacttggagtctggacatctgaaacttgctaagactggtctttggaacttgtgcactccatttgagtggaagcgtggcctgatcacccatggcgtgcctctaccagcactttggtttttgttttttacttgacttggattacttgatactttggttttggttttggcctggcttggatttcctgatactctgattttggttttgattctggtttggtgtaaactgtaaaagtgtgtgtgtgccctttttacttgttctttgttttgtggggtgcgagtggtgtgagtgtggtgttttgtctcgaggaagcatggatcaggcacaaactaagcccaccccactaggaactatgctgaacaatttcaagaaaggatttaagggagattacagtgttactatgacaccaggaaaacttagaactttgtgtgaaatagactggccagcattagaggtgggttggccatcagaaggaagcctggacaggtcctttgtttcaaaggtatggcacaaggtaagccagggcacccagaccagttcctgtacatagacacttggttacagctggttttagatgccccccacagtggttgagagaacagcagcataagcagctggcagaggcaaggaaagaccagcagagagagagaaaggaaagagacagagacattaaccactgaaaattcccttaacccagcaggtttcctaacgggatctaaatcttaattaccataccaaggttgaccagacctagtaggaactccctgtaggataggacaatagatggttcctcccaggtaattgaaggaaaaaaaaagaaaaaagccatctataccaattataagttaatttggactaaacaaggtcttattaatagcaaagaataattgaaatcccaaacttacaaggttttcaacaaaagtaaagtttgctaaatgtaaacagtgtaacatgtattatactaacttctaatcttgtgtccttagacagtctagtccacagatataaaggaagcttgctttggaaaagaatggttatcgtcttcaaaaaaaaggggggaaaaaagaaggggcagaatttatctaaaaaaaaaaatgttatatggtaaattcttgtcctaaaataaattaactggttgtttaaagaaagaaatgtttgtaataagtcagaaagttgaggcatgtcgaagaattgtctgcaaaagtcatgaaaaaaagttataaaaaaagaatttatgcaagaaatgttgtacaatttaaaagtaattaggcctcctgaatgtaaaactattggagaaaaagtttatgtgcaaggtgtataagaaaagtaaactatacctctggtaaaaggattaaaaggaagcataaggatgtggatttttacctacattaaaaggtttaaaaaaatttgctttgaaggtttaagcaagttttaaaatgttaattgtaaaggaaattctgtgtgtaaacatattggctaaagttaaaggggtatcattttttttctgtgaactgaacattaaaaaaaaacacaacgggtttttcttaaagtgctaacctgctctttaacaaaaattataaaaggttaaaaagagtctataaaaatcttaccttatggtctgacattaaaaattgaataaatatgtctacaaagaaaacaaagtttaacattaataacacactcaaataaaggtgacatttagcttatctggtataaacatacaggaagcgttgtcaaatataaaatggtgtttagctttctttggtctaaaaacaaataaaaataggtgaaaacaaataaaaataggtgctaaaggaaatttctcagtaaaaaggcaccaaggactataaagtccactgctgatgtccccacatttaaaacaaaaggtcaatttcttaaaaattatatacttggtttagcacatgtaccacccctagaatttccagtaaaacagcaccagcctgaagatcatgttcttaccaaagggtggaaagaaggaaaactcgagtcagcctgggaatgaccctatcttgtgctgttaaccaccaagactactgttcatacagcggaaaggggatggactcatcacacctgagtcaagaaagtgccacccctccagagtcatgggccagagtcccaggggaaaaccctaccaaactaaagctaagaaaaatttaacttcttcatctattctattactctttcttctttcctctctctattgctgaccatctagttattaacataaccaagtcaatttcatctcaaactattgcatttaatgcttgccttgttacaccctgtggggacttgccaagtcaaagacagctctctacttcagaaaagtacctctgtccctcctgactctcctcagactgggcattaataaattgggaccatttaatccagggagatttcgataaagaccccagtgacaaccaggagtcttgccccccaatttagagcttttatgccgtagttggtccaacgttctgtggaccactaaacagcaaggatggactgccccaaccagtttttgtaatttcctaaaaccatacattcattttactagaggatcatagaagttaaagacttaaaatgaactttggcaattaagacaggatatcaagatgcaaatgcctggttggaatggatcaaatattctgtccacacattaaacaaaagtgattgttatgcttgtgcatgtggcaggccagaggccctgattgtccgctttccactaaggtggtcctccagtagaccaggcatgggctgcatggtagctcttttccaggattctacagcctggagtaataagtcatgccaagctctctctgctatatcctgaagtccggcaccctgtgggtcagccaccaagggccatccagcttccctctcccaaaactaagttcgcttcatgtctctcatgacagggaggaaacttagtgttccttggagacctgaagggatgcagtgagcttaagaattttcaagagcttatgtatcaatcagcccttgttcatccccaagcggatgtgtggtggtattgtggtggacctttactaggcactctgccaaataactggagtggcacttatgctttagtccagttggctatccctttcaccctggcatttcatcaaccagagggaggaaaaataagacatcataaagtgagagaagccccttatgggtctttctactctcacatctattaagactcaattggagtcccatggggaataccagaacaatttaaagcccaaaatcaaatagctgcaggatttgagtcaatattttggtgagtgacagttaataaaaatgtagattagataaactacatctattataaccaacagcgacgatattttcatgagttaaaagaaaaacgcatgtcggccccagccctggggctacctgacctgacaaaaccttttacacaatatgtattagagagagaggaaaaaaaatggcggttagagttttgacccagactgtggggccctggccgagaccggtggcctacatctctaaacaactagaaggggtttctaagagttggcccccatgtttgagggccttggcagcaacacccctgctagcacaagaagtggataagctaactcttaggcaaaacctaaacataaagtctcccccatgctttaataaataccaaaagacatcattggctaacgaatgctagactaactagataccaaagcttgctctgtgaaaattcccgcataatcattgaagtttgcaacaccctgaaccccgccaccttgctcccggtatcagagagcccagttgaacataactgtgtaaaaggtgttggactcagtttatttctgcaggcccaacctccgagaccatccttgaacatcagtagactgggagctgtatgtggacaggagcagcttcgccaaccctcgcaaagtgactctgaagaagaccacaagccctgctccagtcacacccagaagctgactggtccacgcatggccgaagcatgaggaaactcatcgcaggactcattttccttaaaatttggacttgtacagtaaggacttcgactggccttcctcagactgagcactgttcccagtatatacatcaagtcactgaggtaggacaaaaggttgctatagtcccattattttatggttattataagtgtacggggactctaaaaggaactgatttatataatgctatacaaggtatgtagcccaggaactgaccagcctgatgtgtgctataatccatctgagctccctatgactaccatttttaaaataagttaaagactggcaacttctgggttctgaaaaacctcaattattagacaatactgtatagcaagggtgaggacggacttcacccttcctatgggaagactcagctgccttgggcaaaaactgtataatagtactacaaaaacagccacttagtggagttcaaaccacactgaaaaaaatctgtttagtaaatttccaaagttgcaaaccatgtggacccacctggcatcccaccgggactggacagcccccactggattataccggatatgtgggcatagagcctatgccaagttacctgaccaatgggcaggtagttgtgttattgacaccattaaaccatcctttttcctactgcccataaaaacaggtgagctcctgggcttccctgtctatgcttcccgagaaaaaaaaaagcatagctataggcaactggaaagatgacaagtggccccctgaaagaatcatacagtatcatggacctgccacttgggcacaggatggcttgtggggataccaaacctccatttatatgctcaaccaaatcatacagttacaaactgccttacaaataatcactaataaaactggcagagctccaactgttttagcctggcaagaaacccagaagagaaatgctattcataaaaatagactagccctagactacttgctagcagctgaaggaggggtctgtggaaagtttaacctgaccaattgctgtctgcacatagatgaccaagggcaagtagttgaagatatagttaaagatataacaaagctggcacatgtgcctgtgcaggtgtggcatgggtttaatcctaggtccatgtttggaaaatggtttccagcactaggaggatttaaaactcctatataggaattataatagtaacaggaacctgcttgttgcttccctgtgtgctgcctttgctccttcaagtaatgaaaagttttgtcactaccttagtccatcaaaatacttcagcacaattgtactatatgaatcactattaatctatcttgcaagaagacatgggtagtgaggatgaaagtgaaaactcccattaatgagtgaggttctcaaagcgggggaataagggaggagaccacacctcacattgtcttatgcccaatttctgcctccaaagaaaggagaagtaaaaactaaaaggcagaaacgaaatccacaggcagacagcccgttgccgcaccctgggcctggttaaagatcgacccctgacctaaccggttatgttatctatagattccagacattgtatggaaaagcattgtgaaaatccctgtcctgttctgttccattctaattatcggtgcatgcaacccccagtcccgtacccactgcttgctcaatcaatcacaaccctctcacatggaccttcccccttaaagttgtaagcccttaaaaaggacaggaattcctcacttggggagctcggcttttgagacacaagtctgccaaagttcccagctgaataaagctccttccttctttaacccagtgtctgaggagttttgtctgcggctcatcctgctacaaaagaatctgggggtagtccacagagtatagtgaaagcaagtttattaagaaagcaaaggaatgaaagaatggctactcaatgggcagagcagggagttcccagaagcaagaggaggaaggtgcccaccttaggtccaatgcttgtttatatatgaaataacaaagcaaataatcatgggggagatgtgctctactacgcaggcttttgacaaaggattgtgtaactactttgtataactactgtcttccacaagaacctatattattatctttatttattaatttttgagacggagtctccctctgttgcccagaccggacagtgcagtgacatgatcttggcccactgcaatctgcaactcccaggttcaagtgattctcctgcctcagcctcccaagaagccaggattacaggcatgtgccaccacgccaggctaatttttgtacttttagtggagacagggtttcaccatgttagccaggctggtttcaaactcctgacctcaggtgatgcacccgcctcggcctcccaaagtgttgggattacaggcatgagccactgtgcctggcctaatatggcatttcttttctttttcttttttgagatggagtcttgctcttgtcgcccagactggagtgcaatggcacgatcttggctcactgcaacctctgcctccgggttcatgcgattttcctgcctcagcctcccgagtagctgggattacaggcacccaccaccacgcccggctaatttttgtatttttaatagagacagggtttcgccatgttggccaggctggtctcgaactcctgagaagctgcaggtgttaggaacttgtttgttcactgttacttctctcctatccagaagtgaggcatatagaacttgttccaaaaaatagtttggatgaatgaatgaataaaaggttaatcctatatctattgcttcaatcagaaaacttatttccttataatttactgttgtgtctttccttactagaaggtaaaatctatgaaatacagacagctgggttttgctccttgctgaatcctcaatgcctagaacagtgcttagcactggcacatgctgtcataatatccactgaatgactatgtggaaaggtaggctttctcttttggccaacatcagcatcttttttgtgacatcaatgtatttcagatgtttagctcagtaagataatggttgagaataaccacaatactgtgagtggctgacagctgaacactctggctccctgaggtaaatactcacttgcagctgaatggtgatcagaagggaaccacaggaatgctgtctccaagagcactgcctgcaagaaggaggcactggtggccggcacaggtggcctgtggatgctacacttcacagctttggtccagcaccagcaaaatagtgaggcaagaccattgtgttcttgagttccgtgttatactcacctctctttcaccagaatgcaactcttggagaagcagaaaaagtaatgtgcttgtaataaccattcacgtctttataggagtcaagtgtctctagctagaacccttttatttcacatctattcacttttcttcttttattattagtgacaaggtaacaatcatattcacatcaaggaaaactagaatatggaaaaaaatcatctcaagtatgtttagaattttgtgtgtatttccatcgccctttatttctgaaagtatattatatatacagaattcacctagtttgtagtttgtgttctgcatttttttttcttttttctttttttttttttttttttcagatggagtctcgctctgccgcccaggctggagagcagtggtgtgatctcgcttcactgcaacctccgcctcccaggttcaatcgattctcctgcctcagcctctcgagtagctgggattacaggcacgtgccaccatgcccagctaattttttgtatttttagtagagacggggtttcaccatgttagccaggatggtctcgatctcctaatatcatgatccacccatctcggcctcccaaagtgctgggattacaggcgtgagccaccgtgcctggcagatgttctgcttttttcatttaacattgttttatgcttacaagtatctttccagctgggcatggtggctcacacctgtaatcccaacactttgggaggccaaggccggcagatcacctgaggtcaggcatttgagaccagcctggccaacatggcaaaactccgtctctattaaaaatacaaaaattagcagggcatggtggtgcacacctgtaatcccagctacttgagaggctgaggcaggagaatcgcttgaacccaggaggtggaggttgcagtgagctgagatcgcaccactcactgcaccccagcctggatgacagggcgagactctgtctcaaaaaaagaaaaaaaaaagtatctttccatgcaattagacttcataaccacttatttaaatgcactgccatgcatttaaggatttgattttttttttttctttttctttgaaacggagtttcgctcttgctgcccaggctggagtgcaatggtgcaatctcagctcaccacaaccttcacctccggagttcaagtgattctcctgccttagcctcccgagtagctggcatgcaccaccacgcccggctaattttgtatttttagtagaggcggggtttctccatgttggtcaggctggtcttgaacccctgacctcaggtaatccacctgcctcgacctcccaagtcctgggattacaggtgtgagccaccgcacctggcctattttttatttttttgagacagggtctcgctctgtcacccaggctggagtgcagtggcacaatcttggctcactgaagcctcgatctcctgggctcaagctatcctcctgccttagcctcccatgtagttgtgcctataggtctgtgccacctcacccgactaatttttgtattttttgtagagatggggttttgccacattgcccaggctggtctcaaactcctgggctcccttggcctccgaaactgctgggattacaggtgtgagccactgcgcctgacctacgattttcaactatattattcatttcactgtcagataagcccgaaaaagtcactcaaagagtttgaaagacaaaaactcaaggtacttaatatctttaagaccttgttaaatatcaggtttgaaaaacgaaagttcacaaaattatacagatgacaagtacatgaaaaaatgatcaacatcattagtcatcagggaaatgtaaattaaaaccacactgccaactgactaaaatgataaagttaaaaagactgacaatatcaggccgggcacagtggctcatgcctgtaatcccaggactttgggaggccgagcgggtggatcacccaaggtccggagttcatgaccagcctgaccaacatggtgaaaccccgtctctactaaaaatacaaaaatcagctgggcatggtggtgcgcgcctgtaatcccagctacttgggaggctgaggcaggagaatcacatgaacccgggaggtggaggttgcagtgagccgagatcacgccattgcactccagcctgggcaacaaacagcgaaactccatctaaaaaaaaaaaaaaaaaaaaaaatgactgacaatataaactgctgacaaggatgcagaatacctagaattctcacacattgctaatggaattacaaaattatagccacttaaagaatagtttggtagtttcatataaagttaaacatgcatttgccatatgaccagcaatcccgatcctagccatttacacaagagaaatgaaaccatatgtctataaaaagatctctatgtgaatgtttatagcagctttattcatgataaacaaaagatgagataactcaaatgttcatcaacaggtgactggatatacaaattacaattcatccatacaaaggaatacaattcagtaataaaaagcaatgaactgctgataaatgcaaccacacagatgaatcctaaaacatgatgctatgtgaaagcagccagacacagagggctactctgaactgtttttactcacaacacttctgacaaccggttctccagctctccaaacaccaagtgggtgtcactacaattcagttcagttctgccactaacgacccagagttcgtgtcagactgcaaagccttaaaggctcagtcccacaagactactttcactgtagatggtattttcaagtaccaggctgccacttgtgcttctaaggtcaactggctataaattgggggttcctgtgaccctgatccagtgattgtgctacttgtcaagttcaataatttgctaaaacagctcataaaactcagaaaaacactttacatttactggtgggtttgttgttgttgttgttgttgttgttgttgttgtttgagacagagtcttgccctgtctcccaagccggagtgcagtggcatgatcacagctcactgtaaccttgaatgcctgggctcaagagatcttgcctcagccccctcagtaggctggctaatttattacaaacatttttttgtagagaagggacatgtactcgtttattatacagcatacaactcaggaacagccagatgaagagatgcatagggcaaggtatggggaaggagcatccgtgctctctctgggcatactaccctcctggtacctcgatgtgttcaccaacccagaagctctccaattcttattgttcaggggttggtttgtttgttcgtttttgagacggagtcttgttctgttgcccagactagaatgcagtggtccccccatcttggctgattgcaacttccacctcctgggttcaagcaattctcctgcctcagtcccctgagcagctgggattacaggcgtgggccaacatgcctggctaatttttgtatttttagtacagatggggtttcaccatgttggccaggctggtctcaaactcctggcgtcaagtgacctgcctgcctcggcctcccaagtgctgggattacaggtgtgagctactgtacccagacttttcaggggtttttgtttgtttgctttttgaggcagagtttcactctattgcccaggctggagtgcagtggcatgatttcaggtcactgcaacctccgcctcccgggttcaagtggttctcctgcctcagtctcccaagcagctgggactacaggcacgcaccacgatgctgggctatttttttatttttagtagaaacagggtttcgtcatgttagccaggctggtctcgaactcctgggctcaggtgatccgcccgcctcgccctcccaaagtgctgggattacaggcactgcgcctggcccctgttcaggggttttaatggaggttttattacatgggcaaaattgattaaaacattggccttggtgattgacctcaacatccagcccctttcccctccccagggttcaggaggtgaagctgaacattcccattccactcctgggtctttctggaaaccagccccctctgcctcctgggttcaagagattctcctgcctcaccctcccaagtagctgggattacaagcgcctgacaccacgtccggctaatttttgtatttttagtagagacggggtttcgccatgttggccaggatgtctcaaattcctgacctgaggtgattcacctgcctcagcctcccaaagtgctgggattacaggcatgagccaccacgcctagccttttttttttttttttttttttttttttttttgttgagatggagtttcactcttgtctcccaggctggagtgcagtggtgcaatctcggctcactgcaccctccgcttcctgggttcaagcgattctcctgcctcagtctcccgagtagctgggattacaggcacccgccactgtgcctggctaactcttgtatttttagtagagatgaggtttcactgtgttggccaggctggtctcaaactccttgacctcaggtgatccacgcacttcagcctcccaaagtgctgggattacaggtgtgagccactgcgcccagccaattttttgtttttttaattggcaaataaaaattgtatatattggccaggcgcagtggctcacatttataatcccagcactttgggaggccgaggcaggcggatcacgaggtcaggagtttgagaccagcctggccaacaaagtgaaccctgtctctactaaaaatacaaaaattagccaggcatggtggcgcgtgcctgtagtcccagctacttgggaggctgcagcaggagaatcgcttgaacctgggagacggaggttgcggtgagccgaaatcataccactgcactccagcctgggtgacagagtgagactccatctcaaaaataaaaacaaaaaaaaactgtacgtatttatggggtatgttttgatatacgtatacatggtggaatggctaaatcaagctaataaacatatgcattacctcacatacttttattactttggggtgagaacatttataatctattctcttggcaattctcaagtatatgtttttattaactatagtcgccatgttatacaacagatcacttaaacttattcttcctagccgaaatgtatcctggctgggcgcggtggctcacgcctgtaatcccagcactttatgaggccgaggcgggtggatcacgaggtcaggagttcaagaccagcctggccaagatggtaaaaccccatctctactaaaactacaaaaattagccaggtgtggtggcaggtgcatgtaatcccagctactcaggaggctgaggcaggagaatcacttgaacccaggtggcagaggttgcagtgagctgagatcacgccactgcactccagagcaacagagtgagaatccaactcaaaaaaaaaaaaaaaatgaaatgtatcctttgaccaacatctccccattctccccttcttcaccctcagtgcttgatcatcactattctctatttctatgagttgtacttttgtagattctacatataagtgagatcatgtagtatttgtgtttctttgcctggcttattttacttcacacaatgtcctccaggttcatccacgttgtcacaaatgacaggatttccttttttttttttttttgaggcacagtctcagtctgtcgcccaggctggagtgcagtggggtgatctcagcttactgcaacctccgcctcccaggttcacgccattctcctacctcagcttcccgagtagctgggattgcaggtgcctgtctatgccaccatacctgtctaatttttgtatttttagtagagatggggtttcatcgtgttagccaggatggtctagatctcctgacctggtgatccacccgccttggcctcccaaagtgcaggatttccattttttaaggcaaaatagtattccactgtgtatacatatcactagatacgatttttgatctgttttgtgctgaatacttccataagcttcttgtgtccttactttaacattccttcatcattcattcagtgttcaaattattgaaaatgcattattgaatgctttctgtccttgacttttttctggattttcttcctgtcatgcaggccaattactcctttctattttgattcagtgactccatttcttctgcctcctctgtcttaacaaaggttggcaagtgaccaaaaacataacttgacctgacttgaataaaaagaaaatgtaggccaggtacagtggctcatacctgtaatcccagcactttaggaggccaaagcaggagaatcatttgagaccaggagttcaagaccagcctgggcaacacagtcagatactgcttctacaaaaaaaaaaaaaaatcaaaaaattagccaggtatggtggcatgcctgcagtgccagctgctcaggaggctgagatgggagggtggcttaagcttaggaagttgaggtgggagggtggcttgagctcaggaagttgaggtgggagggtggcttgagctcaggaagttgtggctgcagtaagctgtgatcatgccacagcattccagcctgggcaacagagtgagaccttgtctcaaaaggaaaaagaaaatgcttttggctcatgtgactgagaaatctaaagtggggttctggttttaggcacagttgaatgcaagaaccaaataatattggttctactttcttctgtgttggttccgctttcagacatgccctcaattcactggtgcaagaattgctagtaacttcaactttacacactctcctataacaattctagcttctttccaggcaacagaattccaagaatgaacatgctgggaatataattagctttgagtaagtacttggttcactcaaggctaatcactgtgtaagctttgattggcgggatctaatttgcatgcttactcctgaagcctggggtctagtggatagaatgtaaagccaacgttttaaagtgctacaaagggtctacataatttgccctgacttcatctcctacatttatccctcctggatcatactattccaactacaatggccttcttactattgttagaggatgtcaagtgtgttctttagggtttctcaaccctaaaggagttaggtgtgcctggagtgtttgtttactcaggtatcacttcaaatcaaatgtttacattatcagggaggcttttcagggccatcctggatcaaatgtcaacctctgacttcgcactccttaccttgctttatctttctccctagcgcctatctaaaagattatctaaataagagtaaacactcatatagtgctttctatgaggcaggaattagattaagcactttagttgattaacgaatttaatactttcaacaaccgtataaaaaaagtactattattttttttaagagtaggggaggctgggcgcggtggctcacgcctgtaatctcagcactttgggaggctgaggcgggcagatcataaggtcaggagtttgagaccagcctggccaacatggtaaaaccctgtctctactaaaactacaaaaattagctgggcgtggtggcaggcgcctgtaatcccagctactcgggaggctgaggcaggagaatcgcttgaacccaggaggcggaggttgcagtgagctgagatcacgccactgcactccagcctgggggagaggacgagacgtcgtctcaaaaaaaaaaaaaaaaggggtaggggaaattgaggaacagaaaggctaagcagcttgctcaggatgtggtggagcagaaattcaaacctaatcagaatgtctcccaagtctgtgctctttagcactaggctatgtttcctcttattctcagtctccctccacaaaaaaaaatatggtgcattaaaggaggaactttttttttttgagatggagtttcgctcttgttgcctaagctggagtacaacggtgcgaactcagctcactgcaacctctgcctcagccccccgagtagctgggattacaggtgtgtgccaccattccaggctaattttttgtatttttagtagaaacgggttttcaccatgttagctaggctggtcttgaactcctgacctcaggtgatccacctgcctcagcctcccaaagtgctgggattacaggcgtgaaccactgtgcctggcctaaagcagaaaccttttttttttgtttgtttgagacggagtctctgttgcccaggctggagtgcagtggcacaatctcggctcactgcaagctctgcctcccggtttcacaccattctcctgcctcagcctcctaggtagctgggactacaggtgcccgccaccacacctggcttattttttatatttttagtagagatggggtttcaccgtgttagccaggatggtctcgatctcctgacctcgtgatctgcccacctcagcttcccaaagtgctgggattacaggcatgagtcaccgtgtccggccctttttttttttccccccagcacttaggaaggctgaggtgggtaaatcacctgaggtcaggagtttgagaccagcctagccaacatggggaaaccccgtctctactaaaaatacaaaaattagccgggcgtggtggcgcatgtctgtagtcccagctactcaggaagctgaggcaggagaatcacttgaacccaggaggtggagattgcagtgagcccagatcgtgccattgcaccccagcctggtgacagagtgagactccgtctcaaaacaaaaacaaaaacatgcatctcacacatgaccttctaaatcaatactctacacccagatcacatctgtttcagtggcatcattaccatttatgtgatgattcgatcaccagctcaaatcactggccaaacaagaagctgggagccatccttctctcatttgccttcatgccccatatctgaccaacatgaatagctcttgaacctatcctcctctccactctcacaaccactacacctgagatcaggtcgccatttcctatagtttaatgtaacagcttcctagttcatttccctgtcttccacctttctgtcttcccctgattattttgattattcatcagaatgagtaagattacgccatgaagttcttagaaatacaattttccacccattgccactcactcattgatggagcagacaaacagaggtaatcaaaagtccttgagagaataagcatcttccatttcccctgcaagagttatgatccgtgtagaagccatttcaaagtttccccaatctggggccgggcgcggtagctcacacctgtaatcctagcactttgggagaccgaggcaggcgagtcacttgaggccaggagttgagacccgtctggccaacatagcaaaaccccgtctctactacaaatacaaaaaagtagctgggtgtggtggcatgcgcctgtaatcctggctacttgggaggctgaagcaggagaatcccttgaacccgggaggcggaggttttagtgagccgagatcatgctgttatacttcaacctgagcaacagagtgagacactgtctcaaaaaaaaaaaccaaaaaaaattaaaaaaaataaaagcatatgaaactgacagtagctgggtacagtggctcacacctgtaattccagcactttgagagaccgagacgggcagattacctgaggtcaggaattggagaccagcctggccaacatggtgaaaccctgtctctactaaaaatacaaaaattagcggggtatggtggcgggcagctgtaatcccagcactttgggaggccgaggcaggtggatcacaaggtcaggagattgagactatcctggctaacacggtgaaacctcgtctttactaaaaatacaaaaaattagccaggcgtggtggcggtcccctgtagtcccagctactccggaggctgaggcaggagaatggcgtgaacccgggagggcggagcttgcagtgagccaagatcgcgccactgcactacagcctgggcaacagagcgagactttgtctccaaaaaaaaataaaagagtgaaactccatcccccgcccaaaaaaaattattacgtaattgttgcgcctcctcactgtgttctagagtgcctgatttattgaaataattttaaaacccgttgctgggcgctgtggctcacgcctgtaatcccagcactttgggaggcccaggtgggtggatcatgaggtgaggagatccagaccattctggctaacacggtgaaaccccatctctactaaaaatacaaaaaattagccgggtgttggtggtgggcgcctgtagtaccagctactcgggaggctgagggctgaggcaggagaatggcgtgaacccgggaggcggagcttgcagtgagccgagatcaggccactgcactccagcctgggtgacaaagcaagaaagactccgtctcaaaaaaaaaaaaaaaaaaaaaaaaactattatagatttaaatctattttattattattattattttttgagaccaagtctcgctctgtcgcccaagctgcagtgcagtggcctgatctccgctcactgcaacctctgcctcccgggttcaagcgattctcctgtctcgccctcccgagtagctgggaccacaggcgcgtgccatcacacctggctgatgttttttatttttagtagagacagggtttcaccatgttagccaggatggtctcgatcgcctgacctcgtgatctgcctgcctcagcctcccaaagtgctgggattacaggcgtgagccaccgcgcccggcagatttaaatctattttaaaaccaaatttataatgtatcctgaatatctagagagacatttataactaaagattaaaaatcaacttatttttcaggaatcaaaaagtggattacataaagtcctaatttatactactcttttttttttttttttttttgagatggagtctgactctgttgcccagctggagtgcagtggtgtgatctcggctcactgcaacctttgcatcccaggttcaagtgattctcctgcctcaggttcccgagtagctgggattgcaggcactggccactatgcccaactaattttttgtatttttagtaaagatggggtttcacgatgttggccaggctggtctcaaactccttacctcaggctatccacccacctcggcctcccaaagtgctgagattacaggtatgagtcaccacacctagccatagtattctattgtcttttaacataacatctcagatttacattcaagagaactaaatgtgtgttaaagtgactcccaagtctgtggtcttaaactgttttgtcccaaaagaactttggaatatatatatatccccttacacattgcttactaaatgtgctgtttaacagttgcaaagatataatttctggcatattgtatgttgtgttataagtgctttaaatatatcttcatcaaaaccttggtgctttgctcacttgatttatggaaaagtgccacttactggccagtcttcaaaaggtctgaactcatttgcattcaaagcagtgagttgataaacatttgttataaccatcactctttcaaattctaagcatgatagaaggcagtcacatacataaaaggcagaagtttgatgcttaggtgaaattagtttgtctccttcaatatttttctctccagagctatctattttctccccaaaggttttgaactggaatgagtgagttagcctttcttttgtaccgagagataagatttgtgtaatagagttgggaaagaagtcctgaagcacccattgtttttttttttttttttttttttttgttgttgttgttgttgtttgagacgagtctcactctgtcaccaggttggagtgcagtgctgcagtctcggctcactgcaacctccgcctcccgggttcaagcaattctcctgcctcagccttctgagtagctgagactacaggcaagtgccaccacggccagctaattttgtatttttagtagagaccaggtttcaccatgttggccaggatggtctcgatctcttgacttcgtgatctgcccacctcggcctcccaaagtgctgggattacaggcgtgagccaccgcgcccggcccggcgctcttatttcaggagagatcattttaaattcaggttacatatgaaactgaggatttgcaaaataacttttgaaaacgatagcaacgtttgaaactaaaagttacttatgctagcatttctaaatgttccatttgaattatagaagcataatatcagtttaaaggaaacaatctgagttctagaattaaatagaaatccccagggcatgcatgttacatttttctctaaattaagagtaaaaaaaaaattaaagtttattcatcttagactatttacatgaatgcttaaatgctgacaatataaaccctagaatatagtcattaaaataaaaatcacttcctttacagtacacttacaataactgcaacgatcaatttctctttccaaagattgtcagtaagttgttaatctacttctctgttctctgttttttgttttgttttgttttgtttttttgagacagagtcttgctctgtcacccaggctggagtgcagtggcgtgatctcagctcactgcagcctctgtctcacgggttccagtgattcttctgcctcagcctcctgggtagctgggactacaggtgcatgccaccatgactcgctaatttttgtatttttagtagagacgtggtttcaccatgttggccaggctggtctcgaactcctgacctcaagtgatccacctgcctcagcctcccaaagtgctgggattacaggcgtgagccaccatgcctggccctgttctctgttttctttcttattttatttattttttgagacggagtcgcccaggctggagtccgtggcgccatcttggctcactgcaacctccaccccgccgggttcaagtaattcacctgcctcagcctcccgagtagctgggatagctgggattaaaggcgtgcaccaccacgccgggctaatttttgtatttttagtagagacggagtttcgccatgttggccaagctggtctcaaactcctgacctgaagtaatccacctgcctcggcctcccaaagtgctgggattacaggcatgagccaccacgccgggcctattgagttttctacaggacaaaccacaagtagcaacacagtgcaatcacaaaagaggaaggtaagcttttaaatttctaatttgcagagcgggtgttccaaatctgaaattcatcgacctctacacgggttgctgaaattgatgcgacaaaagcctgcatcttttttttttttttttttttttttttttttttttttttttttgagagggagtctggctctgtcgcccaggctggaatgcagtggcgtgatctcggctcaccgcaacctccgcctcctgggttcacgccattctcctgcctcagcctcccaagtagctgggactacaggcgcccgccaccacgcctggctatttttttgtatttttagtagagacggggtttcaccgtgttagccaggatgatctctatctcttgacctcgtgatctgcccacctccgcctcccaaagtgctgggattacaggcgtgagccaccgcgcctggccaaaggcctgcatcttttttttttttttttttttttttgagatggagtcttgctctgtggcccaggttggagtgcagtggcatgatctcggctcactgcaagctctgcctcccgggttcacgccattctcctgcctcagcctcctgagtagctgggactacaggcgcccaccaccgcacccagctaatgttttgtatttttagtggagacgggatttcaccatgttagccaggatggtctcgatctcctgacctcgtgatccgcccgcctcagcctccgaaagtgctgggattacagacgtgagctaccgcacccagccaggcctgcatcttgaagtgagttactgaagacaaagtttggcgctaatttaaataatgtgactgatgcgactgattgcgaccacaacggaagggtaccccacaggtcacaataattatcccaaaattaactgaagatgcccactgttacttctgtttaaccatgtgttaaccatgtagttatgggaactacaatgacgttcactaccttagagaaacttacaatcttgggccaggtgccgcacttcacaactataatcctagcactttgggaggccgaggaggctgaatcacctgaggtcaggagctcgagaccagcctggctaacatggtgaaaccccatctctactaaaactacaaaaaattagctgcgtgtggtggcaggcacttgtaatcccagctactcgggagcctgaggcaggagaatcacttgaacccgggaggcggaggttgaggtgagccaagatcgcgccactgcactgcagcctgggcaataagagcgaaactctgtctaaaaaaaaaaaaaaagaaagaaaaacagaaacttacaatctgttacaggagacagcaaacaaaaataatacaaggttcggctgggcgcggtggctcacgcctgtaatcccagcactttgggaggccgaggcgggtggatctgaggtcaggagttcaagaccagcctggccaagatggtgaaaccccgtctctactaaaaatacaaaaaaattagccgggcatggtggtggtcacctgtaatcccagccactcgggaggctgaggcagagaattgcttgaacccgggagatggaggttgcgatgagccgagatcgcgccactgcactccagcctgggcgacagagcgagactcgtctcaataataataataataataataataataataataataataataataataataaggttcacgtactacaaagcagagaacagggaggggaaggaattagaagagaatttctatgggcagagcaaagtcatgggtcacgggaatcacgaactggggaaaattatttgtcaggtttaattaaaggaagaggaacaaatagagtttaaagattagaaggttacaggtggcaccccacaatccccaaaacaaaccccacctcggctcagccccagtcacctcccaagggggtatatcttgcccagagagcctgaaggcaggggcatttgtttttacagcccagtcactattcttccagacaaaaaaagcatttcctgtgaggatgaagtgattaccccaggtcacctggccacattcctctccgggagctggtggccacaccacctggccgcccctccactagcgccgcgctccgaggtcacgcagctgcctgcgaagccctcagtgaggccgcctcccaccccctggagacgtggtctcccctcccgcgagggtccctccgaccccacccgggcaactagggcaccgcgggctgttacccaactaaccattaagcgcggagccgagcgcgtgcgtggcacggagaggcggggcgggtctggtctgcgctctcggcaccatgcggcccccaagacgtagagcttccctgcctcggtttgaagggaccgctgggctgcctgattacgcgcccccggccgagcctgcgcactggggacgcagtcggccctcgcgtcctctgctgcccgaaacaagcgcgtggaaagcttggtcggggcttctcacagccgcgcgcacagactggttctccccccgcgtctcccgggagcgtcgccgccacctgcacgcgtccggcacacaaacgtcggtctcaccccttagtttctggaagagaaaaaggaaaagccaccgagaggcctgaccctgaggggtcggggggagatgcgggcgcgtagtagagggaagcgactgaggagcggggactgggcagcatttgaatggatgcgggtgccgctggcacccgggaagacgcctgggagccggcgctggggagccgggcatgggctgggatgtgtttggattccaatctgggcctgacaccagttcagtgacctcgggaagttccccaaccctgcgggcctgtttcctccctctgaagtggcgacagtaatagaaccgacctcgtaggctcatcgggaggtcctgatgggagaacccatgcaacttgccaccacagagccaggcccgcggcgactggctcctggtgggtattaaagacgagtcgggaaagaagagcaggtaagagggcggggagactggcccagtgggttggggtgtgcacctcggccacgtggaaaagcgagaatgcaggggccggacgcttatggacgatgcatatgtggggccggatagaattgtggcaggcggcgctggggctgatgcgcctcacccagattatcctctgtaatcctcacagccctgtgaagtgggccctgccatgaacattttgtaaat

SEQ ID NO: 369 - DNA, 5476 bp, Homo sapiens
tttgtgtgagaaataaagctgtttatttcacctgggtgcaggtgggctgagtcccaaaagagagtcagcgaagggagataggggtggggccattttataggatttgggaaggtaatggaaaattacagccaaagggggttgttctctggtgggcaggtgcgggggtcacaaggtgctcagtgggggagcttctgagccaggagaaggaaattcacagggttaatcactcagttaaggtggggcaagaacaaatcacagtggtggaatgtcatcagttaaggcggggcagggccttttcacttcttttgtgattcttcagttacttcaggccatctgggcctatatgtgcaagtcacaggggatgcgatggcttggcttgggctcagaggcctgacattcctgccttcttatattaataagaaaaataaaacaaaatagtgttgaagtgttggggcggcgaaaatttttggggggtggtgcggagagagaatgggcgatgtttctcagggctgcttcaagcgggattaggggcggcgtgggaacctagagtgggagagattaagctgaagggaggtcttgtggtaaggggtgatattgtggggttgttagaagaaacatttgtcgtatagaatgattggtgatggcctggatacggttttgtatgaattgaaaaactaaatggaataagagaaggagaaaaacaggtataaaaggtctaagaattgggaggacctaggacatctgattagagagtgcttaggagattcagcatagtcctgccagcaaagattatttatttacttcaagagtttacagtggcagtttggggatagcaccaggagatatcagctgtgatggcttggagaaacagtgtaaaccggcagtgtaaacaagagtagggcatgtatgagtagttgagaacggtgaataggagtatgactagacaaaagatagtagggatgacaagtttttttggggcacagtctaagttggtctggtgtcgaatgagactggggcctaataaaaaggagcgtctatacaggagcttaaatgggttgtaccttgtagcattctgcggacaggcctgaattctgagaagcgaaagtggtaaaagtattgtctagtcctttttaagttggtggctgagcttggtaaggtgtgtttttaaaagacctttagtccgttctacttttcttgaagacggaggaccgtaagggatataaaggtttcactgaatactaagagcctgaaaaactgcttggctgatttgactaataaaggctggtctgttatcagactgtatagaggtgggaaggctaaactgaggaattatgtctgacaggagggaagaaatgactgtggtggccttctcagaccctgtaggaaaggcctttacgtattcagtgaaagtgtctatttagactaagaggtattttagtttcctgactcaggacatgttgagtaaagctaatttgccagtcctgggttggggcaaatcctcgagcttgatgtgtagggaaggtagggggcctgaataatccctgaggagtagtagaatagcagatggaacactgagaagttatttccttgaggatagatttccactatggaaaggaaatgagaggttctgagaggcaggctagtggcttgtactatagcatagcctgcctttgctggtgtgtggcgattaggcctggtggaaccgccatcaataaatcaagcgtgatcagggtgaggaacaggaaagaaggaaatatggggaaatgggatgaatatcaggtggatcagagagatacagtcatgggggtcaggtgtggtatcaggaataatgtgagaggccagattgaagtccaggccaggaacaatggtaattgtgggacttaaagagtgagtacagctgaaggagccggggagcagaaagtgtatgcgtcaggtatgaggaagaaaatagattttggaagttatgagaaatgtagagagtgagttgagcatagtttgtgatttttagggcctctaacagtattaaagcagcggcagccgctgcacgcagacatgagggctaggctaaaacagtaaggtcaagttgtttggacagaaaggctacagggtgcggtcctggctcttgtgtaagaattctgaccgcactaaccatgtctaggaaggaaaggagttgttcttttgtaagggattgaggtttgggagattaatcggacacgatcagcagggagagcacgtgtgcttttatgagaattatgccgagataggtaacagatgaggatgaaatttgggcttgactgaagtaatgggggctgtctgtgaagccttgcggcagtacagcccaggtaatttgctgagcctaatgggtgtcagggtcagtctaagtgaaagcaaagagaggctgggatgaagggtgcaaaggaatagtaaagaaagcatgtttgagatctagaacagaataacgggtagtagagggaggtattgaggataggagagtatatgggtttggcactgcggggtggataggcaaaacaatttggttgataaggcgcagatcctgaactaacttgtaagacttgtctggttttaggacaggtaaaataggggaattgtaaggagagtttataggttttagaagcccgtgctgtagcaggtgagtgataacaggctttaatccttttaaagcgtgctgtgggatgggatattggtgttgagcggggtaagggtgattaggttttaatgagatggtaaggggtgcatgatcggtcgccaagaagggagtagaggtatcttatacttgcgggttaaggtgggggaatacaagaggaggacgcaaaggaggctttggattgggaagaagggcagcaatgagatgcggctatagtccgggaatagtcagggaagcagataatttggttaaaatatctcggcctaataagggaactgggcaggcggggataactcaaaaggagtgcttaaaagagtattgtctaagttggcaccagagttggggagttttaagaggtttagaagcctggccatcaatacccacaacagttatggaggcaagggaaacaggcccttgaaaagaaggtaatgtggagtgggtagcctccgtattgattaagaaggggacaggcttaccttccactgtgagagttacccgaagctcggcgtctgtgatggtctagggggcttccgagacgattgggcagtgtcaatcttcagccgctaagccgagaagatctgggaaggagtcagtcagagagcctcgggccagagttccaggggatctgggagtggctgccaggtgagttgaacagtccgattttcagtggggtcccacacagatgggacgtggcttaggaggaatcccgggctgcgggcattccttggcccagtggccagatttccagcatatgtagcaagctcctgtgggaggaggttctggaggaatgcctggccgctgcggttcaggcgtttggaagttcttgtgtgctggagatgtggctggggtttgtctcacagtggaggcaaggaattgcaacttttttctattattgtacaccttgaaggcgaggttaattaaatcctgttgtggggtttgagggccggatttaatttttggagttttatttaatgttgggagcagattgggtaataaaatgcatattgagaataagacggccttttgaccttttagggtctagggctgtaaagcgtctcagggttgctgccaaacgagccatgaactgggctgggtttttatatttgatgaaaaagagcctaaacgctatctgacttgggataaagagaaaggagcattcaccttgactatgcctttagctccagccacctttttaagagtaaattgctgggcaggagggggagggctagtcacggaacgaaactataagccggaccaggtgtgaggaggggagatgataaaaagataatagggtggaggagcagaggctgaggaagaattgggacctagctcggcctggcgaggagcagcctggggaggaagggagaggtcagatgggtctgtagaaaaggaagattagaaagactcagcaacacttgggtttggtactgaggggacaggcgggagggaaagaaggaagatttgggatgagttgcactgggcacagagactaggaagggactgatgtgtaaaagaacgcctggacgtcaggcacctcagaccatttgcctattttacgacaagaattatttagaacttgcaggatggaaaaattcaaagtgccgttttctggctatttggaactactgtcgagtttgtattggggtcaagcggcattgcagaagaaaataaggcatttaagttttaggtcaggtgtgagttgaagaggttttaagtttttgagaacacaggctaagggagaagaaggaggaatgggaggtgaaaacttacccatagtgaaggaggcaagcccagagaaaagagtagagacacggagaaggggtggggggttcttgccctccagaaaagcagagaaggggttggggcacggaaataagggattggggcacagagataagaggtcagggtgcagaaataagggattggggcacagagataagaggttggggtatggaaataagtgattggggggttcttgccccctaggaaagcgggacttgccgctaagggtgaaggagaaggggttgaggggtacttgcccctgccccaggaaagcagagaaggggtagagacaaggagagaaggggttggggtacttgccccttccccagaaaagcaaagaaggggtagaaacaaggagagaaggggttggggtacttgccccttccccagaaaagcgggacttgccgctaagggtgaaggaccaaggcaggcgtccctgcgtggtctgacacctttgaaacgtgggtgaataatcagaggcgtccctgcatgattaaacaccaagggaaggctgccttcccagtccgtgaccggcgccagagttttcggtccatggataaaacgtgtctcctttgtctctcccagaaaatgaaaggaattgaaattaagagaagggagagattgaagagtggaaaggagaaagtggttgagggacagtgagagaggttggagaagacagtaagaagaggccgcttacctgatttaaaattggtgagatgttccttgggctggtcggtctgaggacctgaggtcataggtggatctttctcatggagcaaagaacaggagtacaggggattgatctcccaagggaggtcccccgatccaagtcacggcaccaaatttcatgagcatccatgtgaagagaccaccaaacaggctttgtgtgagcaataaagctgtttatttcacctgggtgcaggtgggctgagtccgaaaagagagtcagcgaagggagataggggtggggccgttttataggatttgggaaggtaatggaaaattacagtcaaagggggttgttctctg

SEQ ID NO: 370 - DNA, 5261 bp, Homo sapiens
acctctagccagggacgcgcgctcggtcccccgccgtgcgcccccggtcccgcgcccaggctcccgcccctggcctccttaccagccacttgtcgcccagctgcgaactggagcgggaggcggcggccggagggcccaggacagccccgggagggcggcgaggcggagcaggagcgccccggctccggccacattctcagagtcaggaaaaggggcgagaggccacatgtctccctctcgcccaactgaaaacgaaacggcgctccagcagattgggtggaaagagctgggtctcttttctctgtttttcacgctagaaagggcttgtaaacattgttccttttaaaatgacctaccccaggcatttgtttgggcacacttctgtcctggggtcatcgttcctaggtggcttcggacctgggacttttcctgtatctgcacattgtcgttttatacacaattgccaaggtgggactgctttcaactttactgtgcttgaagctgcaaaggtaatgttgccgccgtgcgtgtcattttaggactttttatgccttgcgggtaatactaatgatggtcacagggaggataaacggggtggtttctttttctatactccatgtaactaatttctcattcaggttagaaaattatatgtctggttactaatattcttactgaatggtttccttgcaatgatgacaccaaataattaaaacgtacttgattaagacttttgttgctgtagtgtactaagatcagattaatctgagaagtaaaatagtaattttttgtccttttttcttttcttgttttgagagagacattaaaaacgattaaaacaaaacaaaacaggccaggtgcggtggctcatgcctgtaatgccagcactttgggaggctgaggcgggtggatcgcttgaggctgggagtttgagaccagcctggccaacatggcaaaatcgtgtctctcctaaaaatacaaaaattagctgggtgttgtggcacgtgccagtaatcccagctactcagaaggctgaggcaggagaatcgtttgaacctgggaggaggaggttgcagtgagctgagatctcaccactgcactgcagtctgggtgacagcaaaactctgcctcaaaaaaaaaaaaggtttaacaaaagccaaaagttgaattagcagccttctgatcatgggaatgtaggatgtcaactaaaaagaacctcagaggttgggaaggcagatgaaaaactgaggccccgaagtgtttcaagacttgattaaatcactcaggtctgcactaggaagcgagttatgatgatgcccctaatctatatgaacccaaataaagccaaaacacacacaccttttaaggataaaactatattccattaaaattagccccgcatttgtcaatatctaacagcattggactgaccctcaggccagaggctgtagctcttggaagatcctagccaggaggtttgagagtggccagtacctcggaagtgctggctcactctgacatcatcagaacctggcatacagtaggcgctcattgggtatttgctatggaaattaggcaggaaagtgcgtctgtgtctggaaacaaagaggcaaagcttaagcagtgatccccatgcagattctttctgcaaactacaaaacagaagcttccctagttcagactgccatccatctggctctttctccaattgtttttcagcggatcctgttacagtgcaaagaagaaatggcaaacggataacagctactgtgcctagaagatggtagattcctcacgctccatatctgggtttctcattgacaattaggcactgaaaggaagctcatatgtcctgttaatttaatcagtagttagtggctttagaaaaagtttcatatatacaccaggtatgataaggacttttttttttctttttgagacagagtcttgctgtgttgcccaggatggagtgcagcggcgtgatcatagctcactgcagttttgatcccccaggactcaagttatcctctcacctcagcctcccaaatagctgggactacaggcacacatcaccatgaccaagctaatatttaaaaagatttttttgtagagacggggtctcactatgttgcccaggctggtttaaaactcctgggctcaagtgatgctcctacctcagcttcccaaaatgctgggattatcggggtgagccaccatgcccagcctgtgatgactttagacgcactactcatataatattcataatctgatgtgatatgtatcatcatcattatcatctctctttaacagaagagactaacaaggcttagaaaggttatgtacctcgctcaagatcccacaattactaaagtaccagaaccaagattcaaacccaggtcaggctggagccaccatctcaagagctgctgaataattaattctccttttttttttttttttttgagatggagtcttgttctgtcacccaggctggagtgcagtggcacaatcttggctcactgcaacctctgccttctggattcaagtgattcttcctgcctcagcctcctgagtagctgggattacaggcatgtgcctgccaccatgctcagttaatttttgtattgttagtagagacgggtttcaccatgttggccagggtggtctcgaactcctgacatcaggtgatccgcccacctcagcctccgaaagtgctgggattacaggcataagccactgcgcccagccaattctccattcttacatcgtacactcagttttctctttctttctcttttggacaactgatctttgaggactcttggctactcaattgtcctataatcgtatagtcctacaacaggaaacccgttaacctgaagatcagatcttttaaaacaacatccatcatatatctacaaaattgggatttttttatcgtaaaatttcatctaaaacaaaaaattcacatctgttcttggtatccattaggtgtagtggacacctctagatattcttgatgccagcatcctgtagacccgccatctcctttcccaggccatggggtgtttctgttttctattagacactgtctcttagttatataaacgtggctgctctcagaagttctccacacctttgtttcctggaagaggaaatggcatttcctggaggggatgacacgtgggcggtgaggttccactcactacgttaaacacaccctaactttcagctgtgtacttcttttcctctttcaggttctgccctgatgtttcctggaataatgctgaggactgcctttcgggtagccgccctattcagttcacttcatctcggaaatacctgacccctgccttggatccagcggccctcctgagagctgaggaaggaggaaatcctatgtgtctgctcccggagctgccacaacccatcttcccacaactcggaacttggaaaaaggaacccaggacacgactttgcttttcttttggacctagttggtgattatactctgtctcccatggagaccacgtcttgcatccttccttctatatgggatttaggatagaaattaaaaagaaaacatattattttgagtcttgatttggagaaaggtagtattcaggaggaagtaggctatgatacacatagaaaatttgaggacagtgttacttaacaaggacatttctgtctctgcagaagtcacagcttggaggaaaccagtttgcactatttgatgaggaatttggccaccaaaccactgatactttcccaaaggtttggcagaaattgttttttgagtggctcaccagagtacccagaagaatcagtatggaattagaggacagtggcctaccctaaataaagacatgagtgatgtataaagtctagtgtcaatttattcagaaaatatcaaaattattctgggagctatgggtcaaagttgataggcacaaacaaacaaaaacgaaaggtattttaaattcacagcttggataagtaaaagggagatgttgtcatttctcttcttcaatccaactttagattttcaagccggaaaaagggtaattagaagttagaaattgttattgccagaaaatagctctaaaccctgaaaaaaaaaaaaaaaaaaaaaaaaactgaccctcctcttggggagtgataaacctcaattactgttgatagtaaaactgatatcaactcttcgaaaccagtgaaaggtgaatggaaaccttaccctaggttaaggtttaaaaaatgttcataatatatatttgaaagttccattatttaaaatattcattagacatgctttgtaatgttaagttacttcaaaaaatcttacacaagggaagggaagtatgtattattccttcatttaagagaaagataatgtgtgaatattagttaatatttatcgtacatttactacctgtgtcgaagcgtagtgttacacacttaatttcaattatttaatttgattctaacaatgaatcccctgagatggataatatcctcttcattttacagatgagacaattgagacttaaaggttaaacaaatgatttcctaagctcattcagctaataaacggtaggggactgcttgacaccagtccagttgaccctcaaatccatgatttctgccaccatattcacagaaacaagacaagagctgaaaatatagcctgactcttgaaacagtcaaagaattgtgtatgtttatgaaagttctgattaataagatattctgaggacaaaagacaaggcatgggtagaggggcaatgtgtagattagaatgtatcacaatgcccactaaatagtaaaaccatagaaaatgaaatttaatccttactgtgtagaatatttagagtagattgttttttcctcggtgtcaattactattacaactatcaaagaatgaaattaaacaagaaacggttcctttggtttttttttttaaaggtgggagttataaaaacagtatttgccatctggttttagttatggctgtggaaattctatgggtacaatttgttgtcattgttgttaccactaccaatacagagatgctaattgtaacatcagtttctaaatcagatagtgaataattacattttcaatgttttcttaacatagatacaagttaacaggatatgcttctggcctgtttctggattctaagggtagaaccagcataaaactagtcagtccaagtatttctaaagatccacagacacagttctcctggatttgggaag

SEQ ID NO: 371 - DNA, 1596 bp, Homo sapiens
cttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctc

SEQ ID NO: 372 - DNA, 1055 bp, Homo sapiens
gctctcctctcctgctaagctttgtttcctaattaaaatcttctgccactgacacagctactgctgctgctggaaccgccatagccaccttggtttcgtggttttgcaaagtactggcctccaccgccataggggccagagtttctgcctccaaaatttcctcccttcatgggtccaaaatttgaagactgattgttgtaattgccaaaatcattgtagcttccaccacctccaaaattgcttccatcattaccaaatccattagagccatccccactgccaccatatctaccaccagcacggctgccaccaaagccaccacgaccactgaagtttcctccatgaccgaagttgtcattcccaccgaaaccacctccacgaccaccaccaaagtttccagaaccacttcgacctctttggctggatgaagcactagccatctcttgctttgacagggcttttctaacttcacagttgtggccattcacagtatggtatttctgaatgacaatcttatccacggagtcatggtcgtcaaaggttacaaaggcaaagccccttttcttgccactgcctcggtcagtcatgatttcaatcacttcaatttttccatactgttcaaaataatctcttaggtgatgttcttcagtgtcttctttaatgccaccaacaaatatctttttcacagttaagtgggcacctggtctttgagaatcttctctggagacagctctctttggttccacaactcttccatccaccttgtgtggccttgcattcatagctgcatccacctcctccacagtggcatatgtgacaaacccaaagcccctggagcgcttggtgtttggatctctcattaccacacagtccgtgagcgttccccattgctcaaaatggctcctcaggctctcatcagttgtttcaaagctcaaccctccaatgaagagcttcctcagctgttcgggctctttaggagactctgacttagacatgacggcagggtgaagagagactttaacgatgcttcttcggcggcgtccacgggcagaaag

SEQ ID NO: 373 - DNA, 229507 bp, Homo sapiens
ctccacaccgccttgcaagctgagggagccggctccggcctctgccagcccaggaaggggctcccacagtgcagcggcgggctgaaggactcctcaagtgccaccaaagtgggagcccaggcagaggaggcgccgagagcgagcgagggctgcctgccagcacgctgtcacgtctcagcaatagactgctcttgaggtaagcagtaagaataaaaaatgaaatcaagtcattttgcttagtgtactacaacaatagagaatattttctttttaatacaaaggttatttaattttccagagtaactctattgcatccagtggtgtaattctcaattcataaggatgaagagaagttacctgtgacctattacgtaatttataaacctcttcttacagagaatgatgtgtcttagaggaataaaagtgaggcattttattttcttcaaaattaaatattaacaattgtcttatactgatcatgggaaaagtaagctgctaccaccaattccaatctgtatgaggtacttttatttaagaattataactaatgattcaagaactaacttaagtcctattttatttacaatgattcctgaatgtaagaacacctactgcatttgctctgtatccatgtaggacctaattagaaagctgggctccatatagaaaaaccaatgaatattttttgattgataactagccaaaatgacagagttttccgtctgtaagcatacaaacatgcattttattttgaactttcattttgttataattctttatgattttatcggcaaaaccaacaaaataatacattgttcttaaaggaacacatgctaaaacagaggtacattatacatgtttaccaaaagtactgtagggttgtttttacattgaaaaatgcatttgtctgtatcctttggaaaatcaaactgatctaatataatttcattaagtctttaaacaaaaaatactttagaaatgtatgcaactaacaaagggaagaacattttatgctcatggataggaagaatcaatatcatgaaaatggccatattgcccaaggtaatttatagattcaatgccatccccatcaagctactgatgacttttttcacagaatgggaaaaaactactttaaagttcaaaaaagagcccacattgccaagacaatcctaagccaaaagagcaaagctggaggcatcacgctacctgacttcaaactatactgcaaggctacagtaagcaaaacacagatatagaccaatggaacagaacagagccctcagaaataataccacacatctacaaccatctgatctttgacaaacctgacaaaaacaagaaatggggaaacgattccctatttaataaatggtgcttggaaaactgcctagccatatgtagaaagctgaaactggatcccttccttacatcttatacaaaaattaattcaagatggattaaagacttaaatgttagaactaaaaccataaaaaccctagaagaaaacctaggcaataccattcaggacataggcttgggcaaggacttcatgtctaaaacaccaaaagcaatggcaacagaagccaaaattgacaaatgggatctaattaaactaaagagcttctgcatagcaaaagaaactaccatcagaatgaacaggcaacctacagaatgggagaaaattttggcaatctgtccatctgacaaaaggctaatatccagaatctacgaagaacttaaacaaatttacaagaaaaagtcaaccccattaaaaagtgggcaaagtatatgaacagacacttctcaaaagaatacatttatgcagccaacagacacatgaaaaaaatgctcatcatcactggccatcagagaaatgcaaatcaaaaccacaatgaggtaccatctcatgccagttagaatggtgatcattaaaaagtcaggaaacaacaggtgctggagaggatgtggagaaataggaacacttttacactgttggtgggactgtaaactagttcaacccttgtggaaggcagtgtggcgattcctcaaggatctagaactagaaataccatttgacccagccgtcccattactgagtatatacccaaactattacaaatcatgctgctataaagaaacatgcacaggtatgtttattgcggcactattcacaatagcaaagacttggaaccaatccaaatgtccatcaatgatagactggattaggaaaatgtggcacatatacaccatggaatactatgcagccataaaaaaggatgagttcatgtcctttgtaggggacatggatgaagctggaaaccatcattctgagcaaactatagcaaggacagaaaaccaaacaccacatgttctcactcataggtgggagttgaacaatgagaacacttggacacagggtggggaacatcacacactggggcctgtcatggggtgggaggaggggggagggatagcattaggaaaaatacctaatgtaaatgatgagttgatgggtgtagcacaccaacatggcacatgtatacatatgtaacaaacctgcacattgggcatatgtaccctagaacttaaactataatttaaaaaaaaagaaatgtatgcaacttcaaataaaacaagaacatttaattctgagttcatgtaacgatgttaatgctcaatgttttcacattttagtgaataaaaattttccttcaaaactgtaaaacaatttaaatttacatacacctctaacatttgtgaggctcagggaatgagtgtaagtgaagacatctacactatatgccaaaaatttaaggttataaatcaagctaagaaacaattaaataaaatatgcttgtcctcctaccttaacaaatgagacttcagtgttgaaattgaaaaatgtatgtaaagttatctgtgtatattacttctagacaactatcaaaaataattgaatgtaaatattaatgtccatagttgtactgatagccaagaatgtggtgaaggatgtaatttataagtcattttatatttatagtaagcataatttttctttgcctttccacataagcaataattaggttattaaatctaggctgttttcacatgttttcttctatctatatagcacatatataagtgcttagattacaatcgtattagaggtgtacaatattttcccaaaaaatataaatggaatgaaatatttttaaaaatataagaaacaatgtacgttattataaaagtcaatattcttataaaatacctaaattaatattaaaatgtaataaaataaaactaattttaaccattttaactaaatatcattgaatacttttgtaaaataaaactacaatttcacccccaaatgtctctctaattttcaacataagttattagcatcaagctttatgcattttacatataaaattatatatacatagatttcagagagtaataaattgttgaaaagtatgtatgttccttactccaattcttacacatgatgcattaatttttgaatagtgctacaactaaaattatagtaataaagagattcaagatacccatgttagcatttttagatgatactacttaaggaaatatatatttcattggtgcaatttcagtggaaggaaatgacaattattattatttttttcttccttcctaattgcttctgccactaatagcctcctcacactttgaatcaatatccatctctaaagtctatcggggcacaaaccacacaaattcacagaatctagacgagatcacaattttttttttgttttgaagacacaggacttcaaggacatgtaggaggagaaaaaaaaatactgtggggctgggacagtgtgaaacatgactgtttttcctttctttctttctttttttttttgagacagagtcttgctctgttgcccaggctggagtgcagtggtgtgatcttggctcactgcaacctccgcctctcggattcaagcgatactcctgcctaagcctcccaagtagctgggactacaggtgcgtgccaccacacctggctaattttttgttttttatatatttagtggagacgggagtttcaccatgttagccaggatgatctcgatcttctgacctcgtgatccgcccacctcagcctcccgtagtgctgggattacaggcgtgagccacggcgcctggccatgacatgtgtttttagggctaaagtcactctgcgtcagtgttgtatgttagacacctagtgagagactatgcttgataaatgcatttttttgagtttgtgatatattgaacccttgaaatcatgaaacccaaggcagaggtacctcttgcataggtttaagtaagtattaattacacgcatgttattgagcaaacgttgaacggagggacactggatttttactcaggtttctataggtgattaagattcactaacaaggtaaacaaagtataaagatatattagaaattttcttagtgtcttcaaaactagctttaatgggataagaactcactccagaaaacatagcattggcaagtcaagtttcaaaaatatgacactaaaaacattcaagctgagatccaaataagaaatgcaatctcatttacaataaccacaactagaataaaatacctaagaatacaactaaccaacggggtgaaatgtctctatgaggagaattacacacagcacaactgaaggaaataacaggtgacacaaataaattgaaaaacataccatgcttatggattggaagaatcaacgtcattaaaatggccatattgcccaaagcattttaaagattcagtgctattcctatgaaactaccaatgccattttttacagaattagagaaacaattctaaaattcacaaagaattgaataccccaaaatgaaaacatgagtacaaggaaattttctgtgtggaacagtggcatcaccagcagtaggaatttgagacccatctcaatcttggtcatgaaatcaaccagaacatgccaatatcaagggaaatgttctattcttagaaatgtttccactgacctgtttgcaaatatcttcttttttttcacaaatatgtttattgcagcattatatatatgtaatagtataaaaatgaaaaagtataaatatgtatcctatatgggtgacataatattttcctctacagatttccatacagaggttgcaaaccaaaaaatgtaacttgtataataaaatttttaatctttggaagtacctagatgttcccttggaagattccatgcccatctgacaaataattaaacagtttaatttttatcaattgtttaaatttttattttatttatacttgcaacactatttgaggatggtggcaatagcagtagaagtaacagctctgttttcaattctaagtggctttattctacattgttttctaaaacattctttcatctactaaatcatgaacatattctcatgtaaatacacacatacaaacaccgtttcctcctacatattaatatcccttttcactctctattctatcatgtatttgtgtgtgtgtgtctgtgtgtgttggtatgggtgtaattttcagtatccaaatgttttacatatgtataccttctgatgtgtgcttttgatggattgggggtgttaagttgtgtttttattctctttttggagtctttctgtttttagaatgccggctttttactccatattcttttatttgttttattagtaaattagtacatttgtgctggtacctagtgagaagaatctcttgaatgcatttagtttaattttatctttggaataacatggatttcccttttgcagcttaataaataacttgaattatgaagaatgttcttttacacatactagatgcaactactgctccatgagtggttttacagaagcatttcattatgtctgcaaacatctttacaattattgagacaccatctcccaaaaagcgctcttctgcctttgagtgtaagaagattggtagttttgcacactttgcaccatattttttatgtatatgccttttgtttgggggggatgataccatttttatgtgactcttaattagatacattatatgtagaaaattgtgtgtatattgctggccactttgtgtttctgacaaaccatagtaacttggaattgaatcatgaaagttttcagaagtctctaagtttttaacctgaaaaatctgtatgtaattctctcaaccataagcttccaaaaaatttaggttgtgttatcttctaaatttatgaaagcttgttcttcagtaacatttttgtctatgttattatccattactctttatttttctcgttttagtttgtgagtagaacagccgtgacatttattttcaatcctagtgtgaaattcctcgggcctctcaattagtactaactaaaaatgtgttttacttatcctctcaaaagttacagtaatggctaagaagctaaaccaacccatgttctccttggagtttgatgctaaaccagcaaagctgatattttcttgaacccccctttttttgacactattgactattcaagaccattccagtgaccaagatttcttgtttgtttttagatgacatttttataggtatgtttaaaatgagaatgtaaaatgtgtagatggaagattctctcttcctctcgttgattagccttcactttcttgtaaatattctttttctcaaaagcctgtgggaaatcacaggagatattttttattgcacatgtcacatgtgcatggtttaactcacaaatgtttgaggcatattatgacagcaaagttatatggcagaggacaagcaagtatatacaaaaattgagaaagtaaggatttttaacatgccacattgtgaaaatttacgtataggaggctagcgatgaccagtgatacactccaataggtagatttcaaatttatgagactattttgaacacattgttccaaggttgttcataagtacagcacatttgttcttctggaaggtaaatcttttgttatttaattcatggattagaaaaattgtttgaaaattctattactttttaaaattaaaaaatcaatcataattttatattccaatcctatctgaaattgagttagatcatttctgtattggttgctttttatgcatctattttttaaagtattttggaggcaatgaccttaacaacagattctagattactttgccattgttttccaattctcaaatcctaatcagtcaattgagagcaggagtcatacttcatctgcatttgtaacttgaacatataacaaaatggcctataaatatagaataggtaaaaagcaagtaagacaagcaatacttttgcttaattagaaatgttttttaaaaactttaagatatcctggaatggttcaaatactgattcactaatatattgcaatctagaaagataaaactcctagtgtgtttattctgtttcagttactaagacacatggtaaagaaattagttttagtaaattatcttttacaggggatattaagattgtgtgattatagagtgttttttttaagaagtaccaaatataactaaactttaaatatttaatcatattttgttcaatatcaatgtaaaatttatttaaatcttacattaaagttaaaagccatgttaaataaaatattatttatgaaaaacaattataatatactatgaaacatttgcttttaattcagctatgctaattattttttccattttaaaataaatataaatcattgtcatcataaaatagttttcagccaggtgtggtggctcacacctgttatcccagcactttgggaggcagaggtgaacagatgacttgagatcaggagttggagatcagtctggttaacatgatgaaaccccatctctactagcaatacaaatattagccaggtgcagtagcacacctctgtagtcccagttactcgggaggctggggtgggaggatcacttgggcctgggaggcagaggttgcagtgagctaagtaagattgcaccactatactccagcctggctgacataggagacattgtctaaaaaaaaaaaaatttttctcttaaaagttttatattatatataattaacataactattttttatatttatgggatacagtgtgatgtttctcttttttttcatttttactttttgtggggacatagttgatgtatatatgtatggggcacatgagatgtttttatataggcatgcaatgcacaataattacattatggaaaatgaggtaaccatcccatcaagtatgtatcttttgtcttacaagtaacccaattatactcttccagttattttttaaatgtacaattaaatgattgttgactatagtcaccctgttgtgctattaaatatacattctttctaacaatatttttttgtagccattaaccatcaccaccttcccaccaccccacacactacctttcccagattctggtaaccatcgttctactctctatatccatgagttcaattgtttggaattttaaatttcacaaataagtaagaacgtactatttctgtccttctgtgcctggcttattttacttaacataatgactttttgtcatatccacactgttgcaaatgacaggatctcattaattttatggctgaatagtactccaccgtgtgtaagtaccacattttctttatccattcatctgctgatggacactcaggttgcttccaaatcttagctattgtaaacaatgctgcaacaaacataggagtgaagatatcccttcaacatatggattttctttcttttggcttatatgctgagcagtgggattgctggatcatatgatagctctatttttattgttttgaagaacctccagactattctccatagtgattatactaatttacattcccaccagcagtgtacaagggttccttttctccacatactcaccaacatttgtgttattacctgtcttttggatataggccattttaactggggtgagataatatctcattgtagttttgatttgcatttttctgatgatcagtgatgttgatcaccttttcatatgcctgtttgccatttgtatgtcttttaataaatgtctattcaaatattttgcttatttttaaatcagatttttagattttttttctactcagttgtttgagctcctaatatgttctagttaagaatcctttgtcagatgagtaggttgcaaatattttataccattctgtgagttgtctttttactttgttaactgctttgtttgctatgcagaagcttttgtacttgatgtaatctcacttgtccatttttgctttggttcctgtacttgtggggtattactcagggcatttttgtccagattaatgtcctagagattttccccaatgttttcttcttgcagttgtatagtttgaggtcttagattcattttgatttgagggtttttttatattgcaaaagattctgtaggtatgctgcattatggtttatgcttttttcttttgtctactctgtgtattttcaaaaatagcctgtcttcaatctcactaattatttcttctgcttggtcaattctgttgttaaaagactctaattcattctttagtatgtctattgtactttttagcttgagaatttctgcttaattcttttaaattatttcaatctctttgttaaatttatctaatagaattctgaattttttctctgttttaccttgaattcctgtgagtttcctcaaaacagctattttgaattctctgcctgaaaggtcacatatctctgtctccaggattgatccctagtgccttttgttttttttttttttgacagagtctcgctctgttgcccaggctggagtgcagtggcgcaatcttggctcactgcaagcttcgcctcccaggttcacgccattctcctgccttagtctcccgagtagctgggactacaggtgcctgccaccatgcccggctaattttttgtatttttagtagagacagggtttcgccatgtaagccaggaaggtatcgatctcctgacctcgtgatctgccccctcggcctcccaaagtgctgggattataggcgtgagtgactgcgcccggcccctagtgccttttttagttcattttgtgatattatgctttcctggattgtcttgagacttgtagatattcctatgtgtctggacattgaagagttagatatttattgtagacttcgcagtctggttttttacctgtccttcttgggaagaatttccagatattcttaagaacttgagtgttgtagtctaagctgtatctttttttatggggaccccaagtccagtaattctgtggttcttgcagactcctggaatctaccatcatgatagtctttgataagatcaagaagaattctctgtattaccaggcagagactcttgttctcttcccttcctttctcccaaacaaacacagtaccactctctgttctgagctacctgaagctaagggtcaagtgacacaagtgcccctgtggccaccactattagggctgtgctgtgtcagactcgatgccaacacagcactgggtgtcactgaaggcctgctgtaaccactccttggctaccacctatactcactcaaggccctgggcttctacaatcagcaggtgacaaagacagctgggcccgtgtccttgcattcagggtggtgagtttccccagaacctgggtagatccagaggtgctttttgggagccaggagatagactcaaaaccatagaagtctgctttttcaaaggtacatggttgagctggcactcaaaccacaggatgcaatccttcatactctttattcccctttccaaaggcagaggagcctcacttcatggccactgccaccacagacccacagggagtactgccagactactggcaatgctcctgtaaggcccgtgggctcttcagtcatcctgtggtgaatgctgcctgcatggtctaggactcactctttagggaagtggtctcctctgtggcccagggctggatcagaaatgctgtcaaagagtgaaatcctggaactggggacccaatgagcttgcttggtgttctacacctctgtggctgagctggtacctgaggtgcaaatcaaagtccccttcacttttcctccacttttcgcaagcacaaagagtctcaccccatagtcactacagctgggaatgtgctgagtctcacctgaagtcagaaagtctcagagtctcactcaaggccttcaacatagtatctggttatcaccattcttcacacaattagaaaaaagctatttaaaaattcatgtggaaccgaaaaagggcccaaatagcccaggcagtcttaagcaaaaagaataaacctgggggcattatgctaccaaagttcaaaccataccacatggctacagtaaccaaaacagcatggcaatgttatgaaaacatgcacatagactaatgaaacggaataaagaacccagaaataagaccacccacctacatctgaacttcaacaaatctgacaaaaacaatcaatggggaaagaattccctattcaataaatggtgctgtgataactggttagccacatgcagaatattaatactggacccattatcttcttatactactccaagaaattatatgaattaatttaaaaaatctctatgtcatcatttttcataaatattatttattaggattattttcccctgttggaggattgtgatagcattaatacaattcaattgtttgtgatggatatctgcattttatcttaatggcataccttatcataattttaatgacatactttgttttttaaatttaatttgtgtcaatttttcatcattacacattatgaatgtgcttatgtttttaatctcttttttcctcaacttaatttctaaacaaaatcaatttagtaaacataaaacaaatttataaaacatttgaatataagcaaaaatgaaaataacatcacaattgctcattgaaaaagatttgtttaatctagaaataaaaatgatgtgctaacatttttgggaatatctatgtcattattatcaatgtctgtatcttacagcatcttgtttgtacatctatgtattaaagagcccaataatgcctatatatgtattaagtaatcatatttatgcatatgacaataatttgttttatgcaaacacacacaaacatatacacactcaaataaaatacaacataaaccacccttcaaaatgacaacaacctggttttcagtttgttttcaataatctttgaagagaaaatatattgcgatatatccatgcttagtaacttttattttgaaaccttttattgatagctttttaggacattttagagaacctggggaagatttcttttcagtacttcggaatcactcaataaaaattaatcaactgtgattaaatgataatgccattctgagcttagtgactgcaaaatagatgtgtaattaatgaggacaaacttctaatagacatcacaaaggtaagcagctatagaaaaagtctagacaccaggatattttagatttccttctaccctcagtcctgacactcaactttttatcccaatttctctactcccccttattttttactctcttcttcccttccctgttagttttttgtcagtctcatccagctcaacacccttgctaaatttttgaaaagtctatttcagctctttattgcctacatccccaacttaggatttcttctaatcatgatttagatctccattaatccccatttatcttgatttccaatgggcagagaattttacctttaaattattgagtgtaaacaaataaattatattactgagagatgtttggttggagatacatctggaatttttttttctgaatgtataaaagagaagaatagtttagaattataaacagagttaagagtaatttattcaattgaaacaatactgatacatcaacttttatttactttctgctgttatatttccagctatacatgttacaaatataacatacaattcctccccagagtgctaatagggaaataatatatacatatacaaaggcagctaataatattattggattatccaaatatgtatcaaattgacttgtgactttaaatgctataaaagtttagaatagggtaagagactactatacatttttttccttttcaatcacagttaaattggaacatattttagattatcataataccacctagagaggcataataaaaattatttcaagctctcaggtttgataaataatttgtatttcatcttccacagtttctcagaaactctgtcaaatagtgtttgaaaatcttgaaatgtcctataatcctagtactttgggaggccaaggcaggaggatcgctgggctcaggagttcaagactaacctgggcaacatagcaagatcctgtgtctactaaaaattaaaaaatttagtcacacatgatggtgcacacctgttgcctcacttacttgggaggctgaagttggaagatcgcttgagcccatgaggtcaaggctgcagtgagttcatgttgttgagcttattattagcctgcatatacactcccatggcagcatttttcatgaaattcttgtgcaagcgccatggtagctcaaaacagaatggttcactatctttggtataagtcatcctgtccactgtgagtcaatgcttctcctgcagtagatgctctttggtgaaaattaacatgtgttataaagattcttatatattttgccaactctcatgtgcccactcattcaccatagccaaaatttcctttagattaagatcccttggcatttttttctggcctctcttcccattgttccaaatcctgggattaagttactccatttaccagctgctattctggatttctacgatctccattgtcactaggatctataataacatcccctacatgagctgcagatagctgtcacctgaagaggatagttaggcactagtgagcatgtctatgctaccattgcctttttggtaacatatttcttactatattaattctatgaatgtcttctggatcctttcaagaaacagaagcatctgttgccttctccattattgtacacttaatttgtttgagcatgctgaattttttattctttcttcagaatcctgcaaagacattttggtatttccaacttgtttaatatgggacataatttttcccaaggttccaacagccagcccagtggcatgttagtattgctcccactggtaacacattttatcatggctaaaggaaatttcccaacgtcaaagagctctccattacttaacattaaattttacctcttggtctattgccctcaaggtctcctctcaagtatgctctctcagttcccgtaggtatgcatctatgaggtcctgaagctcccttggagaataattcccttcttagtgtggtcagaacattcctgattactacttgttctaattaactaaccctagatattggtattagctgagagctaaggtagggaaagtcttgaggagggcaaatacagtcttgtaagtcatctgccccggttgatgcctccaagaaaagcttcttggtagtccagctataattctctaacaaaggaaggagctcactcctatttgcccaaatttttcaggaaaatgtgatgtgttcattgctataggtttgacaaaatacagagatccacatcccaatttcagtgtcatactcttgtaaagaagactggctaaagataaaagtccacatttacctgaagctcttctactcatagaattagctatgataggtatgaggtctggttttcaacatgattgcaaacctggctagtggagatgattgtctctttaaatgttaatgtggaagcctactgacttttccaacatgccttataatggattatgctggcaatatcttttttatgttttaatggagctcagtaactattagcccatttcatagaccttatagtgtcaatttgcctgttttctccaggccatatccactgcagaagccagtgcatctccttcccctctactgcaccctgattccctcaggcaatctgttggtaatcagtatgctacggtatgccaggggcttccaactatctatttatcaacagcccccgtttatttgttgccatgttactggcaagcaatatacctcagaatctcatcctttttttgttttcgtttttttttgagacggagtttcgctctcgttgcccaggctggagtgcaatggcgcgatctcggctcaccgcaacctccgccccgtgggttcgagcaattctcctgcctcagcctctcaagtagctgggattacagtcatgcaccaccacgcccagctcattttgtattttttttagtagagtcgggctttctccatgtcgatcaggctagtcccgaactcccgacctcaggtgatccgcccaccttggcctcacaaagtgctgggattacaggcgtgagccaccacgcccggcagaatctcaatcttaattcttacaagatatgagttgtctaatgagacacctgcaaaagagttataaattaaaaattcatgttcaggagattaattaactgctcccaggagatactggtaaagtcctgaggaagggaggccaggggaggagtggaagccgagcaaggatgaaagttcaggcaaacacccacagaagcttcagctcgactacatgaaggaagtctggcatcaaaattacattcagaattataatgacacaaggcattctctaatgtgcaatgttcataaaattatatgcctccttaaatataaatattactatttattttatattacatgcaatttgatattttaaattgcatgacaatatgagtcttttcataaatgacacaatctaatagtattcaataattatattttaaaatatattaagcatttttcacattgtgcttattttttcttttaaaataaaatcattttttacaacacctctttgctttgaggatttctttattgttctttttaaggtgcaacaatttattattagaagagtgatacatttatagaaaatgggtctatttaatccaaggatcactagttcccctttaaatatcacattatatgcacatggacagagctaaagaaagatggaataaacaatgttagagttaacttgtagttacatttcattcaaaatgcattatttctgaatgtatggatttcccttcttttcacgtctctaacacttccttacttttataagatgttttcaaaacagcctcagaaaaataagagacagttgtacaaagatttttttaaaaaaaaaaaaaccctcaatttatgttattgtgcattgagactaaatgaagtgatatttcaaggaccaattactcgccttaataacaaccaagttttatttactgttaaagcaaaacaaaacacaaaaacacttagctcatatacttcatggctactatgataaaagacaataaggcatatggttccatctaaatctggaagttgtatactttccatagaaacttatataaaataatgcaataaattaataaggaaagtaacctattagtaatttggaaaataagtaaaatttgggatttattattattattattttgagatggagtcttgctcagttgcccagactggaatgcagtggcacagtctcagttcattgcaaccttaacctcccagtttcaagtgattcgcctgcctcagcctcctgagtagctgggattacaggtgcccaccaccacacctgtctcatttttgtatttttagtagagacagggtttcactatattggccaggctggtctctaattcctgacctcgtgatccgccctcctcagcctctcctcaaaatttgggaatttgtctgagcaagtagtactttagaattgttttttttctcatctaatgggtttctagtttatgaaattcaattcaaccttaaatgtcaaatatttaaattcttacttgttatattacataatgtatgcatcttgatattgtttgtacactagagactatgcaggcaaacttcattaatttgtagatgaggaaatttaagcacaaataatttaagtgacaatcatttgtgataattataaacaatgcctaagacaaaagccaattgaatgttagccccgtgatatcttcttgctgcttcacagtcacactagagcagcaggaagctctgtagcttgtacctctgatttgttaaagttataaaatgttagaaaatgtgttgttgcacaataagtaagacagatctcctaagaaaatttactctggctactaaaatatgaactatgatcttgcttcacgagaacgcttctgacagaattcttgaaagtattgctctcctgaagacaagtgctttagaaacacataattgtccccttcatgaaagtcaaaaccttcccttctatgaaccaacatacgtctctctctatctctttttcaagagagtgagtcactgtatgaaaacttaatctatacaagattcttacaaactggagtatttttaacctaactaaaattcagttttactttcatggtcagcctttccagagagcaacatgtatataaaaactgaactcacaattagaatgggcaactattatatggttaatagtctaaaaaggaaaagtattagaaaagtttttttttctttttatttagaggagacagcaaaatatttcttacataatccttcagagacaatgaaaagtaaaccaagaactcttaaatactaaagagatacaaaaaaaattaattcctctgggcaatatatcacatgtagtagattgtaacacaaaaatcaatgagacataaatgaatgtaaattccccatgagatttagaatattacgtcaaaatgcatgtatagatcatcatccacatgttacagaagcaccagcaccctaatttgtctttcaaaatatcataacaaaattataagtcaacatgtactacattttagatgcttaaatatttcaagacaaaattaacatttaatacatataacaaatgttagcaatttttaaccaggtagacaatgataaggtcatatatcaaatttaatgtaatggaaagtccattttataaagaatgaaatttgcaagtgtacagaaaaattattctctttttgaccattttagttgataaaaaggcactagaatataattttctaggaatacagtagaaagtaagatgaggtttcattatctaaaaaccatagaggctatgacaagcagtttaacaaaatcaataattgagatttttgttgaaatacattagagacttagaaaaaggaaaatgtaagatatatatgtataatcataatgtattcactttcttcacttagaaattcaatattttgcaaagaataatatatgctctcaacttcaattacatttattttgtaatgtctcagtacaatattatatatcttaaatgtactatggctttcaaaatatagcaaaagggatataagtttaatgagttaggaaaatgagctataaaaaagtgatgactaaatagaagaatttacaaggattgtaactatgagtgagaaggcttacacaataagatccatcaattacttcttccaggaaaactaagctttaattatggaatggcagaatacatcttcatttaaacttatttctcacatcagtgtttggttgggagaatgtttctgcatggatttttgtggcttctttattcctaaactagaaactagtgtaagcgcgtgtgtttttgtgtgtgtgtgttttaatcaagattatttgaagaaaagaatagtattacatctaaggagaaaactatgtcaaggagaggaaaattattaacaaaaacattggacacagaagaaaaaacaaaagaggaaagccatgtgtcaaaatttcacaagagcctattacaaaatataaagagactcagagtttcaagattatatgataattttcaaaactccattaaagacataggaaaatctattttctacagatggagtcaacttactctttaaatgaagtaaacatggaatagcaatttctgaaggcaggtcatagcaacttgagaatgaaattatgtgaactattacaaataattaattacatacattttatttctttttgttaaattgtatgagatttacaggttatatgaaacaactagctctatcaaattgatataaacaaaagttattcatgtaaaaacagttcaatgattttagcttttaatgtttaataatttttaactttgtaaaggaaacatttacattagaattttaaataggattcaaattatgtgaccactagtaattgctttatttctcagatgatctaaaattaattgaggggggtaagcccatacaatgtatatggatatgaggtaaaacattttgtattagttaccaatctaaaaaacattgccaaatgctaacaaacttttgcagtttagaatccacaaatataaaatctgaataataattctaaatacttgggtaacattgggagctctttattattcaaataaaataaaaactctttagagtgaatattgaatgagttcatttttgtaaaattggagtattcccaatgtattagttttcacattgctataaagaactacctgagactggataatttatgaagaaaagaggtttaattgactcacagttctgcaggattagcaggaagcatgactggaagacttcaggaaactgacaaggcagaaggtgaaggggaagcaaggccccttcttcacatggtggcaggagagagacagagagcaagtggggaagtgccacaaacttttaaaccatcagatctcctgagaactctatcacaagaacagcaagggggaagtttaccctcatgattcagtcacctcccatcacgaccctcctctaattttacatgagatttgggtgggtactgaaatctaaaccatatcacccaacatgcagtaagtgttttgataattcttttgctactgttataatactgggatatgagaaaagacatgtacatcatgaattccttgacttgtgtacagtgtccctagtttaataatcctgggaactggtaagtaaagcaaattcaactggtctctttgctcaagcttccttcagatatccatatttaattgttaatatccactgtaaatctttgaatggtatatgttatacatgtgcaatgcttatttcaatctagctatactttctttaaacatccaaaagccttttgatataggcacaacttaccttccacattgcacacagagtaaattcttaactatccaaatgctggttattagtctcagcaatggctttaaaagctttgaaacaaatgattagttaagaactctatgttcattattttagcaaaggtaaaaataatctaagtcatagccctgatgtaatctctgttattcttaaccagtgtaaagtagtagttatatatactttgttattttaatttgaaagacaatgatttatgatagcctcttcagtttgtgggatctcagtttacttcaaatctaaaccaagattgaaccaaatagcaaatggattttcataaataatgagagatttaaaaggtgtgatctagcaatggatacagaaaatagagtaatctagatgttgttcctgttctttttttattttttattttgttaaagacagcgtcttgctctgtcccccaggctggagtgcaatgttgttatcatagctcactgcaacctggaacccctagtctcaagagatcctccagcctcagcctccctggtaagtagaactacaagcaagtgccaccatacctaatttttctatttttttgtaaagatggagtcttgctatgttgtctaggctagcctgtaaatcctggccttaagggatcctcctgcctaggcctcccaaagtgctgagattacaggcatgccaccatgccaggcctgttcttgtccttaagtaggtccactgtaagtgattctgggcagacatttatctcactatagctgtcagctttagaaaaagtcacttaggtaactttgggctgtgaaaaattatataatcagttcaggaacccctttggttttctatcttgatttatttgtccatagcacttggattagaattgggtacttaaatcaattcaagaaaaatattaagaaagccattatctcattatacaacaaattaagccaggattgttggcatgtgcctacagtcccagctactcaggatgctgaagtgggaagactgtttgagcccaggagttcaaggctgtcgtgctcatgatcatgcctgtgaatagtcattgcactctagcctgggcagcatagtgagactctgcctctaaaaatataataataataataacataaattacttctataaaaatatatgataaaatgtgaatattgaattatgttttatatcagggatgtgtagggttcatttgctgtatcttcttcactttcaaaaccaatctcctatctttataatacaataatatatctttatgttaaatacaattggatatttttctaataaaggattaagcaaattaacagtaggaactttaaaaaaaagttaattctatgtgtgactcattttcatcaatacctgtctgtaattcaaaattattttaaaaacaacacaatattgtgttgattatattaataattgagcattcaattgagatgttccatattacttgttcctaaattgccaaaatctaatcaggaaaatgcaaacaatttgctttgtgttctgtttgtagatgttcgttgtttactggaaatatttggaatgtgggacaattcttattctaccttccttgatatttcttccccactcatttcttgtgattctattttcaataatcatctttctaacatatataagtctataacagtaagttttagagaaatgtagtaactatattgcatcatatgaagagagtctgtattctttttattatttatttaggaacctctagcccagagtgtaatcgatattaaattttttggtgagtgtataagtgagagcattaatcaatgaaacatataattttttatctaatggaatcacctagtgcttttttgttattcatttacatttctagttaaagccagtttatgtgtacatctttatactaaataccatcaattttttttctgtcattacacaatcagcatataaattgtatgaggattaaaaagtatttgattgactaaaaatgcaatcatatttaattgtgacttccctcaaaaggagtatgggtacctcacaaaactatgtatcaacccataatattctgttagtaaaaccacttattttaaaaaagaagtgctttgtcgtcaaaaacactgaaggctttcaacgacaatgaaaaaccatagattgtttacactttttgtcttaaagaacaaagtatgagaagccttttacattttgtttcttttaatacttgttttgaatgagcagatgaagtaatcaaaattatagagcagctctaccctgctacgctgctaagctgctatgctagctctacgctagcccctattactacaagtaacagctagacagacaatgtaataaattctgttgtcttactgtccttatacagacctgacctgagaaaatatcactctagtttcacacacatgtttcatctttttctatgtttgagaattgctctcactttgataagattcatggccatgaattgggactatagttggaacccccacagtgtcaagtgatctttttatttctcccttgcaagagttctatatgcccaaagttttcactttaaaacttcactaacttatctccaaagaataaaatcttgcttttcacttgatataaatggctctaccactcagatcacatataaaaggaataaaaagttttgtgctatctgtttgtctctattgtgataccatattggtttgcatggaggtcatgaaactctctgtgaccagaagaattctcaggttgagtgtggaagtgtgggcaaagagaggttttgccctcaaatccacaactttggcgtctagtccacctgtgttctccaggtcagcttcaccactgagatctgtactttgcaaggcacaggacttctcttaatataactgaatccttgattcccatttcatatgctacttctgttatccgtggttggaacttttaggaagagaaaggtatgattattagacaccctatctataagtgaccatgtcccttttattaaatgcaataagggcccaaagttaacatcatcttgttaaattaacaaaaacattccaataaataaagattgtgaatcccttttattgctgtcaaatgtataaatatttattactttaaatggaatataaatgacactagacattgactatcattcagaaaggtttccttgtgtttttgtttgttatttttacctttcctttaaggttttctagctcacagttgggagggggaaacatattacttgtgagactgcttgaggcacattaaagcattaagcagccattgggcaatcgagtcttagaaagctcccttgtgaacaaatgtgtataaaaaggggacaaagaattctgaatgatttcatgctgaaaaacatacagagtataagaaaataacttataaatctggggttttctacgacttatgactttttctcagaaaagagataactcatctggaattatttctgatttaattacttggacaaaaacaaggtacattttgtttcccattttaagggttcattagggtcctaccttgcaaaccccatgcagacagagagcaccctcttctgtcacttaattttagagccagtatacatttttctctgataccaatttaacaggattttgaaaagttcttggttatgaggcatcatgactaaaagtacttaactgacaaaatggccctgaatgaaaaccatggagtcctcaggagagtagggctgttttgggaaggtgtttttatcatcttagagattccgtttgatgttcaaaatggcttgtaaataccaccatggggtaagtgactgtaagtttctgcgtataaaaaagcccattcgtgacaactactgcttctacattaaatatatcactggctgtcgtatgaactgtgtcctcactgcagcaaatacagtagattctgcttctagtgtcaggaaattagaactctgagcattgatggtcatgcatttttatcttggatctatccataatacactggaaactgattttctcataacattgaatctacttatgtaggatccatcagtgactttttttctcatttgagaatttgcacttttgaaataatatctggttataagtactatgatgtgaatttatccagggaaattctaaaactagatttagagtatttgcacattggatcccctgttttttttctgatttaataagaattctactttagaatacatgaaaatatgtgtgtgtgtatatatgtatatatgtaaatatgtatatatctccgtgtgtatatatatgcatgtgtaaacatgtgtatgagtatacacatgtatatacttataagcatacgcatatatacttatacatatttacacatgcatatatatttacatgtttctatatgtgtaaatatgtatataagtatacatatatacttacatatacatacacacatatacttatatacatatttacatatatatgtttacatatttgtgtatatatgtaaatacgtatataattatacatacatattatatatacatacacatatacacacacatatatatttacacacatatatatacacacgcagattctcccaataaactactaaggatattttgtatttatctgtgtattcatttatctggcatttccctaaaatgggcttactggatgataataaaatgacacagaatttcaagtatacattttaaaatatatgcacaatacagcataatagagttaattcttcttgaattgaaagtttcaatgattgcttctcagactacaaatatttcttatatttcttacttttcatacttctgcattctcttgcttctcttctcattcatttacttttttatttgaatcattcttttttttacaatactcttttcctgacccaaaatatattatagaaaatatgtaggactgaactcaggtctactatttgtaccctgttattcaaaaatctcatttactcccatggctttgtcctatcactttacatttttctatctacatgtggcctttctcctgagttccattagttcagactgcttgcatgtaggatgtcttcatgttggatacccttcaatcaacttgaatccatctttgctccaaaagccatgatttctctggacttttcaattttaattttttttttttttgagacagggtctcactctatcacccaggctggagtgcagtggcatgatcatggcttactgcagccttgacctcccacactctagcgatcttcccaccttagcctcctaagtagctgggactacaggcatgcaccaccactcaattttcatttttgaaagggtaattttcccatatcccaagtttaaatttttatggctacctttgtctccctcctagctctcatttttctacctactcacatttctacttactaagttctttttattccctctgaaactagttcaatgcaggcccttaggacttggcaccaggaatttctattattcttctaaagccctctctgcctctttctttatttctgcaaagaaatttcaaaaacacattactggaactttactctacacgtttcgtttcctaagttctcactaccaaagctttcaagaacaacttccttcttgaaggtcccgcatcctgctgtgcttagaacagattagttcaatacttacactgttatacttctgccaggcttccaggtccctcaggcacctgtgtgactgaatccctggctcatctgaaagttgaccagagtactttataataggttaaatgcccatgttagcatgttttttcctcttatggagtcatgcttaattttggaaattcgttggtcactaaaaaaaaaaatagtaatatttattgtattttagtctatcattaaatgttgtttgttttattaggacttttctgatacctaacacatattcccatagtacatttcctaatacttctcattctcattcaaattatctgtttagccctggtctggactttctgtagaggtcagcgggatccatgtgacctttgcaatatatgtgattaggtaattgattttttttaaacaaatactcgtgcttagtacaatgctctgtattaggaatagaaaaattcataaatacagaattggtgctttctccatattttcaaactcttttttggcattatatatttcttatcttaccataagatattcttattctcttctctatttattttacaataaaatttcttctcattttattctttctttaactactgatttataaattagattttctctaatttaatgcatttgtttactcatacatcagtgaccgctgagtacagtatcacagtatcatattctaacattaagcttgattgatatcactatctcagattgtttttacaagcattactcattttaccttgaatacaatcttggaggtaaatgacataatactattataaccattttacatatggataaaatgaatagcacagtttcaaagcaaactgatgatttgacacacatggctggtattcttatcactcacattctgatttcttctgtgtgtatatgtgtgtaatgacttgctcattggtataaaatgttaactcttattatgatgatttttcctgtagtttgatcaaacaaactctttttgtcccccagagaataaaaacaagtcaataaccacacaaagattttcgttctcaagggcagcatatttcatttgcatgattcagaaaatgtttagtcttggcaggattttcttaacatcttgaacatgagatatgtgaataaaattttctgatattgttttaaaagtacacattttaaaattggtgctgagttgagatgaaaattgaatgcattgtgaattacccaaaaataataataactttggttaaagatacaatgtctaacactttgcctaattgaaatttaattcatctttaaatcaatcactaattagcctttatgttgcctagaaaataaaaagtgtttaaaaaaatattttcttcctgctaaggtgtagtatttcttaaagaatgtgtggtatttctcaaaacactcaactcactgaattttatttgtactctacatagaaaaacaaaattgaacactagtctgtatagaaaggtgttgcagacacccattcctgatgtggatatacaacatcaactgtttttcttccacctctgagtgatcattttatccagttctagacaataagatagatgtggaaatctgctgtgttttctccaatttttcatctttttctgcctcgtatatagacatgtttaaagccattggagctatgaattaacaagcatgtgggaaaaaacaaataaattgctctgcatccatcctgctaccacctctcaccatgtatttacataaaataagttcttatttaagttgctattaactgctttttaaaaaatgtatgcaacaataagcatttatagcagatattgaagggtaccactatatacagaaaaaatgttgttgtacatcaaaaatatggattcaacaaggaatattattataatgaataatctaaaaataagattgatgcctaattttagatatatacttacattttgtatcaaatgaaattgcaatgtaaagtaagatgtacgttttcagtggcatgagtttgaagtatttttgtttaacttttgaatattttttcttttttttaattatacttcaagttttagggtacatgtgcacaacgtgcaggtttgttacatatatatacatgtgccatgttggtgtgctgcacccattagctcgtcatttaacattaggtatatctcctaatgctaggaaagctcagaaaataactcagtatctctataagttttaacttaaaatattatagaagtgggacaaaatcctggtaaactatctctaggtaatgtagtaacatatggctagctatttaattgggtctaaactttatataaaattacagtctttgcagaaagttttggtataaattacataaaggcatcacctctgatttgctccaattggttttatatggtgtcttgacagcaaagagaaattatccatgattgatagaaactgggagataaagcatctacttgaaacattagaaagaacgaatataatcagtgtggcagaggaaaagctgaaagggagaaatgtttctcagtgactttattttcaatgttaaaaaatgcatgccactgtaatcccagcactttggaaggtcgaggcgggcggatcacgaggtcaacagattgagatcatcctggctaacctggtgaaatgcggtctctactaaaaatacaaaaaattagctgggcgtggtggcggatgcctgtagtcccagctacttgggaggctgaggcaggagaatggcgtgaacctgggaggcagagcttgcagtgagcagagatggcaccactgcactccagcctgggcaacagagcgagactccatctcaaaaaaaaaaaaaaagtatgccaaactttaagaagtaataatagtaaggtgtggaaggaaacataaatttaaaagtcagtagaaagttttggtgggaaaaagtttgcaagacatggaagtttgttataaacaaaaagagaaaattgacccacatatactttttttacttttttggttttacttaagcttttattttaggttcagggttacatgtgcatgtttgctatataggtaaatttcatatcgcaggggtttgttgtacatattatttcatcacccaggtaataagcatagtacctgacagatactatgatcctcactctccttcctcccttcactctcaaatagtctctagtgtctattgttcctttctttgtgtacagatgtactcagtgtttagctccctcctataagtaagaacatgagggatttggttttctgttcttgcataagtttgcttaggataatggcttccaacttcagccatgttgctgcaaatgtcatgatgttgttctttttatgactgtgtagcattccatggtgtaaatgtaccacatttttttctttaatccagtctaccactgatgggcatttaggttgattccatgtctttgcttttgtgaacagtgctgcaatgaacctacatgtgcatgtgtctttttggcagaatgatttatattcctttgagtatatacccaatattgggattgttgggtctagtgaaaactctgctttgagttctttgacaaatcaccacactgttatcacaatggctgagctaatttacatcccttcagccatgtataagctttctcttttctctgcaacctcaccagcatctgttactttttgatttttaatcatagccattctgactgttatgagatggtatctcactgtggttttgatttgcatttctctaatgatttagaatatgtgataatatttgaatatgtaacattagtttacatattataaatattacatgttatgtaaaattagaatatgcaatgtcagtaatgtttagaatatgtgataaccttttctagttacatatttctctgtcaacataaaaattaagaaaaatcatatttatattttgtggaagcatctttcccatttgaataagattttacaaaataaagtagatatataggcacacattttctgaattatatttactaagacttaactgaacaaactaatttcaatattacagcataaacctggaaaatatataaagtatgtgaatgctttaatttgtacattattggaagtatgtgaatatcatcaatattataggatttcaaaaaagagctgtggaatgtatacttttttcccagtacaattatagaagtttgataaaataccaaaaaacaaagccatttgaaggcattgaaaataaaagatcaacagatgttcaaaattccggaaagaagacaagcaaatgatgattatacccacatcagtcttctgttttcccccttgaggtatttgtcaattcacagaaggaataatttaggattagtagaaagtggatactttggtttgctggcaattgtgtaggtctgaggaggcaaaggttagggtttgaggctgccaaggagctgggttaaatgtgctgagagaaagaaaatcacagggagtgagcctcaaattccaagcgtaatttatcctgagtcactctgtggattccaaatctgaaacttttggaaaccagacataaacaacagagtctaaggtgctgagcagagatttcagcagttacatagtgctaagagacaggtctgaatttaaatgcatgccaatgatgtgagactgttacacatgttctgtttaacagtgtgtttctgatgagaacacagaaggtttaaactgttggagcaagagcatacctaaaatagacgagccttaacgatgtttgtataatttttcatacacaatgtctggtatacaagtaaaatttttataaaaagcaggaaaagaaacagtatcagaagacactgaatcacagagatgtgatgaaataatgaacaaattctggagatggttggtggtgatggttgcataacaatgagagaatgtatacttaatacttctgaactgtacacttaagggacattggatttctaacattgagtctgaaagaagagagaaaggagatagaagcaattttttctaattactacctgataattttctaaaactgataaaggatattaagctctgagcaaaaatcaaggttaaaaacatccccaccacaaaacaatcacaaaaacaacataaaccttagaaaatcagagttaagcttttgaaaaaagaagtaagaaacagaaatatagttacaaagacagagacacaattcagattaccttttagggatcaatgtaaggacagactgaaattctgaagagagttccaagaagcttgttgatagaatatagtggaatgatgtctttaaagtgctaaaagatagcaaatatcagtgtataatttaatatccagctaatatctttcaaaaatgggataaaaattaataggtgttcataaaaaacgttgtgatatttaatttttaatagtcctatactaaggggaaatactaaagagagttctttaaagtgaaaatatgtcatcgcagatggaattgtggaagaaaaaatcaaaccttctgagggcacataaatgtaaacaaatattaactagtgatgtacttgggagactgtatgtagaattaacgtacattataatgatatgtaatcaaatcaaaatcacaagataaaacttcgtatcaattaggctattaagaaaaaattaaaaataacaagtattggtgaggaaataacaaaattggaatccttgtgcattgttagtggggatgtaagatagtgcaactactgtaaaaaatagtacagcaattcctccaaaattaaacatgaaattaaaacatgatacaccaactccacttctgggcatatacccagaataaccaaaagcagggaatagaataaagatttgtacaccaatattcataggaacattatttataataggcaaaagatggaaacaactcccaagtgtccattcacagctaaataggtgaacaaagtgtggtatgtgcgtgcaatggactataatcaaatttgataggaattacattttgacacatgctaccacatgaatgaaccttgaagacatcatgctaagtgaaataagccagacagtcagaaaaggacaaatgttgtatgattccacttatatgaagtacatagactagtcaaattcatagggacaaaaagtagaagggagcttaccaggggtaaggggaactgggaatgggggattattttttaatgggtaaagagtttctgcttggtatgataaacggattctggaggtgatggtgatgatggttacaccacagttagactacttaatttttctgaactgtttacttaaaatagttaaaatgataaattttatgttatatgtatagtttatcttaattaaaaatagtatacaagaatggatttgggctattaaaatgttataagtttttttcagccaataagtggtgaaaatatgactttaaagaggatatcagcaagtcaaggttgtgtgtttaagttcagggtaaacactaaaataataataataatctataccataatcaagaaagtagaaggtacatttggctactgaaaataagtttgaactttgggaggccaaggcaggtggatcacttgagctcaggcatttgagatcagcctagacaacatggcaagacctgtctctactaaaaatacaaaaaatagccagatatggtgctttcttgttgtcccagctactcaggaggctgagggggaaggattgcttgagccccaggggcagaggttgcagtaagttgaggttgtgccactgcattacagcctgggtgacaaagtgagaacctgtctaaaaaaaaattagaaatccaaaattggttatgaatattaaagaaagaaagaagaaacaactagaaaacagaaaaagttgctgcacatatcatcccgtcatgcaggtattaagcccagcacccattaactgttctttctggtgctctccctctccctataccctggacaggccccagcgtgtgctgttttcccccatgtgtctgtgtgttcttattgttcagttcccacttataagtgagaacatgtggtgtttggttttctgttcctgcattagtttgctgcagattacctcttccagctccatccatgtccctgcaaaggacatgatctccttcctttttatggctgcatagtattccatggtgtataggtaacacatttttttatctagtctactgttgatggacatttgagtttattccatgtctttgctattgtgtgtagtgctgcagtaaacatatctgtgcatgtatctttataatagaatcatttacattactttgggtacagaccaagtgatgggatcgctgggtcaaatgatatttctgcctctatgtctttgtgcaatcatcacactgtcttccacaatgattgaattaatttacattcccatcaacagtgtaaaagtgttcttatttctccacaatcctgccagcatctgttgtttcttgactttttaataattgtcattctgactggcgtgagatagtatctcattgtggttttgatttgcatttctctaattatcagtgatgttgagctttttaaaaatatgtttgttgggtgcatgtatgtcttcttttgagaaatgtctgtttgtgacctttgcccacattttattgattttttttttctgcaagttccttgtaggctctggatattagacgtttgtctgatggatagcttgcaaaaccgttctccaattctgtaggttgcctattcactctgatgctagtttcttttgctatgcagaagttctttagtttaattagatcccatttctctagttttgcttttgttgcaattgcttttggcattttttgtcataaaatctttgcccctgcttatgtcttgaatggtattgcatagattttcttctagagtttttatagttttgggttatacatttaggtctttaatccatcttgagttaatttttgtataatgtgtaaggaagaggtccaagttcagttttctgcttatggctagccagttctcccggcaccatttattaaataggaaatcctttccccattgcttgtttttgtcagatttgtcaaagatcaggtggctgtatttgtgtggttttatttcgaagttctctgttctgttctactggtctatgtgcctgtcttcataccagtaccgtgctgttttagttactgtagcctcgtaatatagtttgaagttggttagcatgacaccttcagctgtgttctttttgcttaggattgtcttggcaattggggtcttttttggttttatataaattttaaaatagtttttttctaattttgtgaagaatgtcagtggcagtttaataggaatagcatttaatctataaattactttgagcagtatggctattttcacaacattgattctccctatccatgagaatggaatgtttttccatttgtttgtgtcctctctgatttccttgagcagtgatttgtagttcttgaagaggtccttctcttcccttgttagcggtattcttaggtattttattttctttttagcaattgtgaatgggagttcattcatgatttagctctctgtatacctgttgttggtgtatagaaatcttagcaatttttgcacattgattttgcatcttgagactttgctgaagttgtttatcaccttaagaagcttttgggctgaggtgtttgggctgtctagatatgggatcctgtcttctgcaaacaaaaataatttgacttctcctcttcctatttgaataccctttctttctttcttttacctgattgctctggccagaactttcaatattatgttaaatgagagtggtgagagagggcatccttgtcttgtgggggttttcaaggggaatgtttctagcttttgcccattcaatatgatgttggctgtgggtttgtcacatatggctcttattattttgaggtatgttccttcagtatctaatttattgagagattttaacataaatgggtgttgaattttattgaaggtcttctttgcatttattgtgataatcatgtagatttttgtttttatttctgtttacctgataaattacatttattgatttgcatatgttgaaccagccttgcatcctggggatgaagccaacttgatcatggtgaataagctttatgatgtgcctcttgatttggtttgacagtatttattgaggatttttgcataaatgttcatcagggatattggcctgaagtattctttttttgttgtatctctgccagatttcaatatcaggaagatgctggcctcataaggagagttagggaggagtcccttcttttcaattgtttggaatagtttcagaagaaatggtaatagcttctctttgtacctctcatagaatttagctgtaaatgtgtctggtcttgggcttttttggttagtaggctatttattaccacctcaatttcagaactcattattggtctatttagggattcattttctgattcagacttgggtgggcatatgtgtccagaaatttattcatttttttttagattttctagtttatgtgcataccggtgtttatagtattgtctgatggttgtttttatttctgtgaggtttgtggtgatattcctgtcatcatatctgattgtgtctatttcattctttccttttttttctttaaagtctagccagtggtatatttattttattaattttttttcaaaagaccacctcctggacttgtttttttaaagggtttttcgtgtctctatcttctttaattccactatcatcttagttatttcttgtcttctgctagttttgggatttgtttactcatgattctccagtttatttagttgtgatgttaggttgtcaatttgagatcattctacctttctgatgtgggcatttagtgctataaatttccctcctaacactgcttaggtgcatctgagaaattctggtatgatgtatgtttgttcttctatttttttttttttttttttgagacagagtctcgttctttcgcccaggctggactgcaatggcctatctcggctcactgcaagctccgcctcccgggttcacaccgttctcctgcctcagcctcccgagtagctgggactacaggcacccgccactgcgctcggctaattttttgtatttttagtagagacgggttttcaccgtgttagccaggatggtctcaatctcctgacctcatgatctgcccacctcagcctcccaaagcggtatctttgttctttttactttcaaaaaactttttatttctgtcttaatttcattatttccccaggagtcattcaggagcaggttgttcaatctccatatagttgtgtggttttgagtgtgtttctcaatcttgagttctaatttgattgtgctgtgatctgaaagactgcttgttatgattgttattttgcatttgctgaggagtgttttacttcctatgatgtaatcaattttacagtaagtgtcatatgacaatgagaagaatgtatattctgttgttttggagtggagagttttgtagatatctatcaggtccacttgatccagaactgagtttaggtcctgaatatctttgttaattttctgtctcaatgatttgtctaatactttcagttatgtgttaaagtctcccactattattttgtcagagtctaagtctctttatatgtctctacaaacttgctttatgaatgcaggtgctcctgtattgggtgcatatatatttaggatagatagatttgctttgtgaattgaaacctttaccattatgtaatgcccttctttgtcttttttgatctttgttggtttaaagtccactttgtcataaactaggattgcaaccctccctttttttgttttccatttgcttggtaaattttctaattgtctaattttctttgttttgagcctatgtgtgtctttgcatgtgagatgtgtctcttgaaggcagcatactgatggggcttgagtttttatctagcttgctattctgtgtcttttaattggggcatttagtccacttacattgaaagttaatattgttatgtatggatttgatcctgtcatcatgatgttagctagtcattttgcagacttgtttatgtagtcacctgatagtgttgctggtttgtatactttggtgtgtttttatagtggctggtaacagtttttcctttccatatttagaacttcgttaaggagctctttcaaggcaggcctggtgatgataaattttctcagcatttgcttgtctgaatagaatcttatttctcatttgcttatgaagtttagtttggccagatatgaaattctgggttggaaaatgttttctttaagaatattgaatattggccctcagtctcttctggcttttaggatttccactgagaagtccactggtagtctgatgggcttccctttgtaagtgacatggcctttctctctggctgctctaacatttttcctttcatttcgaccttggagaatctgacggttatgtgccttggggttgattttcttgtggagtatcttaatggagttctctgcgtttcctgaatttgattattggacggtgttgccaggttggagaagttctcctggatgatatcctgcagtatgtttttcaacttggttccattctccccatctttttcaggtaccctaataagtcataggttttgtcttttttacataattttatattttttggaggttttgttcattgctttttattcttttacctctattcttatctgcctgtcttatttccaaaatacagtcttcaagctctgagattcatttccctacttggtctatttatctattgatgcttgtgattgcattatgaagttcttgtgttgtgtttttcagctccatcaggttatttatgtttctctataaactgactattttggttatcagcacctgtaatgttttatcatgattcttagtttctttgcattgggttagaacgtgctgctttagctcagcaaagtttgttattactcatcttctgaagcctacttctgtcaattcgttcatctcagcctcagctgttctgtacccttgctagacaggtattgcaatcatttggagaagaagagacagtctggctttttgggttttcaacatttttgcattgattctttctcatctttgtggatttattgacctttgatctttgaggttgctgacctttgagtggagttttttgggggtcttttatgttgttgttattttttgtttttcttttaaatgtcaggctcctcttctttagggctgctacattttggtaggtgtccactctagaccctgtcaccttggatcctcctgcacgagaagttatcatcagtgaaggctccaaaacagcaaatatagcagcctgctccttcctctgggagctccatctaatagggggcactgacctcattccagctgagatgctcctgtagcaggtttttggacatccctattgggaggtctcacccagtgaggaggaacaggatcagggtcccacttaatgaagtagtcaggctgccccttggcagagcaggtgcgctgcactgcagggaagtccccttgtccagattgcccaaactttccagagccagcaggaaggaaagtctgtcagctgagctgcagatatggtggctgcccatccccatggtggctccatcccagggggagatcagagttctgtttataaaaccgtggctggagttgctgaaattcctgcagggagacccttctgggtaaggagggatggatcagggtcctacttaaagaagcagtctggctacaatctgccacagcagctgtgttgcactgtggggaattcctccctgtctggaccacccagtttccctggatctggcaggtcaaaaccaaggtttttaatattgcttttgatgtagacttttcgttttccaccgaccagtcttgattattataaaaatagttacttgctgtaatatattgtgccattgttaacatgaaatggttgatgattccccttttaccccctttatccccttggtgttgattagacaacattagaaatagtgacaaataagcaacttttacaaaatatcctgttttgttatagtgatgaatgtgagttagtttgacccaatagggaagctttgaagcacgtataggctgcagcttaatattttaccaatatttcaaactccaaacttttattttactccttgggtgtttctggaaatatgaaattacatatttgaatacctttgaaactttaacttacgatatatttagatactcagaatcttgagaatcgtctttctactcattgtaaggattaccatttgattttaactgcactcagtattgaaatgtgtagtgtgataacactgacaaaacaataggcaaaaataaaaatgcaacatggaggttcttctattttactttgatgttatgattaactgttgtatcttatgacaacgtactgtatgtgtaacagtggagaactattgtgaaaagtcaaattgtaaattgtactcatagtattgcttctatgagaatgaaactcacataaatgaattgcagtctttgcagttacaaccagtctaggagaggtgtttgaggagagtcttttagacagaaaaagcatcagcttatgtttatcaggagcctaagtatcagctactaagtgattcaactgcagtattgataagtcttaaatcaattaaaattatcatctctagtgttttggcttaaaggattacattttggaaacaggaagtgagtagattaaaaagaaataaacaaggttttctggcaaatatatttccatgaaagaaaattaagaatttgtgaaacacaaactaccaaccactgtatctctaaatctccatgaagagatgttggccaaaatccagactttgagtatacttctggtgaacattcaaaaggaagagaagaacatgctattggacactagagaaaggggtatcttcgctatgtgctggaagaaatcttagcaaaattgtttcccttagagccagttaatgtggaaagaagaaatttgttgtctacttaaggagatttccaaaataagggttgaagctatgggcctatgtatttttgttgcttataacaaaatttgagaggaaaaagagaaattgagggaagaacttgtaaagcaaaaaaaaaaaggaagggcttgaccattttggatattctcagcctctccagacagcaaagaatgctaacattttgaaaaggtttccaaataacttcaggaaaataaggtcaagaacaaaagccaggagtgtgactgaataaacttctgttaacatttcagaaagacagaaacatggacatggtactcagttacacaaaggactgttttaagagattaagagtgtgccttgcagacttctcaaccaaaccgcagaatttctaggaagcctatagactacgtccccagccttgtcagcagaagcccaagaaagaagagcttatcttaaaagcagtctgtgggtatggcttttttatgactgagtgagccacagggatatttttcatgagactcacaaagtatttgagagttatttcagcagacattaccagcttggatcaaaaaagacagagagagtacaaaatgaaagaatattgttttgtacccccaattctgctgacaaacagaaggcaagcaaaactactcagctgcaaatacttgtcagctttcatgaaaaagaaagagggcagaaccaacagcacagagagttgaacccagagtaactgagaactatatgcagcccttaaatcccaaccaagcaactctggacatttacccagctggatttcagcacggctattgattagtgactattttgtgccttcactttctccatttttgaataagaatgtctataactattatgctatgactgtgccaccattgtactccaagtttgaagggcaaataacttgttgggtttgctttccagattgtcagataaagattgttatatgcaaggagtctcatccacatgtggaagtaatttagattatgacttttggggttttgatcacatgttataataggattacagacttggggacttgaaagggaatgaatgtattttgcatataggaggaatgtgaattgagactctggagtgcaccccatgatgctcaacttaatagtgttcttactctttcttgattccctccctttaagtggaaatggaacctgtgacctgcttgtaacaaacagatcacaggaaaggtggtctgtgcaattacctcaacctgactgtattatgtaagattatagtggatcttgcaaggagatttttgtctttcccttggaggttttaagaagcaagctcttatactgtaagctgccacacaggaaggagccaaggacagcctgtggctgacagaaacgaacccaaaacttcaattcagcagctggcatggtctgatatttgcatcctcccgacatttatacgttaaaatcctaaactccaaagtgatagtgttaggaggtggggccttcgaggggttattatgtcataggagtaaagtagaattagtgcccttacaagagagacttcagacagatccctttctccttacatcacgtgagaacacagtgagaaggtgtcatctgtgaacgagaaagtgtgtccacaccagacaccaaatctattggcaagttgatcttgaccttcccagcctccagaattataagaaataaacttctattctttataagctacccagtttgtagtactatattatagcagcggaaagagactacgaaagcagcccatggaaactgagttctgtcaaaaaccatgtgagtttggaaatgtccccgtctctagtcaaacctcagatgagatcacaaccctaggcagtatctttattgcagctttgagagacctgaaacagaatacgcagataaattgttccaggactcctgattcactgaaactatgagataataagtgtattattttattatttagaaattatttttatagttttagtggcacaatttttttattgttattgttgttgttacatggatgaattgtatagtggcgaagcctgggatgttagtgcactcattattattcaagtagtgtacgttgtgcccaatacatagtttttcatccctcatccaagtcccaccctcctttgttttgagtcttcgatgtccattctatcactccgtatgtctttgtgtacccatagcttagctctcacttagaagtgagaacatgcagtatttgttttttgattcctgagctacttcacgtagagtaatggcttcaagttccatccaagttgctggaaaagacattatttcattctttgttatggctgaatagtattccatggtatgtaagtgtgtgtgtgtgtgtgagtgtatacatacatacatacataccatggaatactactcagccataacaaagaacgtatgtcacattttctttatccactcattactttttctttatcctctcattggtggtttgggcatttaggttgattacatttctttgcaattgtgaatcatgctgtaataaacttatggatgcacacttctttttgatatagtgacttttcctttgggtagatactcagtaatgggattactcaattgaaaggtagatctatttctagttctttgagaaattgccatactgatttccatagaggttgtactaactgtatgtgcaccagtagtgtataagcattcccttttcatcacttccatgtgaatatctattgttttttggctttttgataatggccattctggctggggtaagatggcatctcactgtgggtttaatttgcatttatctggtgttaacgatgttgagcattttttcatagtttttttgcccagttgtatatgttttttgagaaatttctattcatgtcatttgcccacattttaatgggattatttggtttttttcttgctgatttgtatgagttccttatagattctacatattagttgttggaggcataattttcaaatattttctcccattctataggttattaactctgatgattacttattttgctgtgcagaagctttttagtttaattaggtcccatttatttatttttatttttgttgcatttgcttttggagtcttagtcgtaaattctttgcttgggccagtctccagaacagatttcctaagttttcttctagacttgttatggtttcagaaattagatgtaagtacttaatctattttgagtcaacttctgtatatgatgagaggcagagatccagtttcagttcttctacaggtggtgatccaattttccagcaccatttattgaatagagtgtcctttacccaatttatgttttgtatgctctgttgaagatgagttggttgtaagtatttggctttatttctgggctcttctattttgttttgttggtctatgtttctacttttttattaataccatgctgttttgtttagtatagccttttaatataatttgaagtcaggtcatgtaatgcctccaactttgttctttttgcatagaattgctttggctatttggcctttgctttccataggaattttaggattctaattctgtgaaaagatgatgttgatacattgatagaaattgcattaaatttacagattgctttgggcaacgctgtcatttttacagtattgatccttacaatccatgaatatgtggtatatttccattcgtttctgtcacctataatttctttcagcagtgttttgtagttctctttgtagacgtgttttacctccttggttaagtattttcctaggtaatttttactttttgtagctattataaaagaaattgagttctttatttgattctcagcttggttgttgtcagtgtatagcaatgctactgatttgtgtatataaagattttgtaaactgaaactttatttatttatctgatctaggagtgtttgggaggattctttaggattttctagggttaagattttatcattggcaaacagcaatagtttaaattcctcttttccaatttggatgcctttactttctttctcttgcctgattgctctggctaagattttaatactatgttgaacagaagtggtaacagtggacttctttgtcttgttccagttaatagtggaaatggttttaacttttctccattcagtatgttggctgtgggtttgtcatatatgacttttagtattttgaggtatgtttttcatacttagtttgttgaaggtaaaaatcttcataaaaatcataaagagatgctggattttatgaactaatttttctatgtctattgagatgatcatatggtttttatttttaattttatttatgtggtgaatcagttttattgacatgagtatgttgaaccatccctgcatccatgggatgaaacccagttgatcatggtaaattcttttttgatgtgctgttggatttgctctgctagtatgttaatgagaacttttacacctatattcagcagagatattggtctgtaattttctttttgtttgtttgtttgttatatccccttctggctttggtatccagataataccagcttcatagaatgagttacggagaatcctctccttctcagttttttagaaaaatttcagtggaatcggtcctaattttactttgtgtataaacctcaaattttgcattctaaaattcaaattttagaatttggctgtgggtgcatctggccctgagattgttttgttggcaagtctttttttttttaattactggtttaatctcactacttgttattagtctgtaaagggtttctatttcttcctgattcaagctagagagtagaatgttttgaggacttttttcattcagtttagatattctactttgtgtgcataaaaatgttcatggtagtctcaaatgatcttttgtgtttctacagtgttggttgcaatgactccattttcatttcaaattgagcttatttgagtcttctctttcttttcttagataatttagctagtgatctatcaattttgtttatgttaaaaaaaacactaacttttgtttcagtgttcttttgtatttttgtttcaattttatttgattctgctgtgatccttgttatttcctttctttggttagctttgattttggttcattcctgtttctctagttctttgaggtgtgatcttacattgccagtttgtgatctttcagactttttgatataggtatgtagtgctataaactttccttttagtgttataagctttccttttagcactgcttttgctgtatctcagaggttttgataacttgtgtcacttttattatttattttttaaaattaaatttctttcttgatttcattgttcactcaaaaatcatttagaagcagtttgcttaattttcatgtatttgtttagttttgagggtattttatggaattgatttctagttttattccactgtggtctgagaagatgcttgatgtgatttaaatttttaaaaatttattgagacttgttttgtggcctattatgtggtctgttttggagtatgttccatgagcaaaatgtatattctgaagttttggtgtagaatgttctgcaaatatctgttaggtccatttgttctacagtgaagtttaagtccagtgtttatttgtagactttctgtctcaataatctgtctagttctatcagtggagtattaaagttcccactattactcggctgctatctctttttttagctctagtagtcattgttttatgaatttgggagctccgatgcatatatatttaacattatatatgttatatgttcttgctcaattgatccatcattatataaggaccttctttgtcttttttgtaaacgttgttgctttaatggatgttttacttgatagaaaaatagctactcctgctcacttttggtttccatttgcatgaactttgttttccactcctttaccttgagtctataagaatccttatgtgctaggtggtgcatctcctgaagatagcagatatttggtctgtaatttttatcctttctgccaatctgtattttttagtggagcatttagagcatttatattccacattaatattgagatatggggtattgtttctgtcatcataatgattgttatctagtgactttgttttcctcactgtgttgttattttataagccttgtgaattttatgctttcaggaggttctattctgctgcatgctggtaatttgtttcaagatttagaactccttttagcatttcctgtagggttggtctagtagtgacaaattcagtcagcctttatttgagacatactttatttctgtctcatttataaaatttgttttcttgaatacaaaattcttggctgacagtttttgtctttaaggagaatacagaaaagaccccaataccttctggcttgtagttttagctccctcagttctctgctgagaagtctgggttaatacgatacattttcctgtacaggttgccttgttcttttgtctcactcttaggattctttccttcacattgactttagatagcctgatgattataagccttagtaatattttttttcaatgattctcctaggagttctttgagcctcttatattttaatttctaaatttctagcaaggccaggcttataacatagcaacataatgaggaaaacaaagtcactaggtaataatcattattccagcaaggtcaggaagtattcttcaactattcccttaaatacgtttttcaaattttttcagtttttcttttccctcgggaacacctatgattcttaggtttggtttggccattttacataatcccatatttcttgaataatttgttcattaattcttttttctctatttttctgttactgggttaattcaaaagccttgtcatcaagctctgataatcttccttttacttggtctagcgtattgttaacactttccactgcattttgtagctttctaaatgtatcttttatttccagaaattctgattttttttttgaaatatctctttagcaaatttctctttcatattttgaattgatattttaactttatgttggttgtcacctttctattgtatttcattgagtaagtgaataatcaatcttttgaattcttcatgtgttatttcaaagatttcatcttggtttggattcaacagttagtgagaattagtgtgatctttggggatgttttaggacactattttttttaatattgccagaaatatttttctgatttctcctccatttgtgtagaatatttcttctaattatttttgaatttatttttaattcaacagtgtttttttaacttctttagttttttccccttaaggatgtgattttacttttattatttattgtcacttagcttggctcagggtgctttaagtggtgataattataccatttccatgattatagagaatcttagtgtgatgatttttcagatgctggttgtagtagcagtgtgctaggtgtgtgagcattgtctcctttgagactggaatggcagaatctcatgaatcttatctcgtcccccagtggtgtgcactttaaaaacattttccccaatattttattctctgtgttgaacagtttaggctttagccagtagaaagtacccatggatgaaaaaacagctgtggctataacaggttggtaaatgcaatacccaatggtggacaacagtcccagcattgacaaaggcagctggggaagcgctcattgaaatgcactgaggtattttcaggggtaagaaggggccatgacagctctccttccatgccagaaggaaagcagtatgcctccaagtcacactggcccagtcttccagctattcagatcagacaaatacctcttttcatttgccagaatgctgatgtaccctgtagaatgggattgtgactctcccccttgtgcaaatctgaacctaaaaggcactcgtcttgtgggaatgtagtcaccctgagtattccagaaaggctgtctatagatacacccctgcagagctcacatgggagaagccccagcagtgtcttcagtggtgggtgaggtggagaataaatctcattctccgaggtccttcataacctttagggctgcctgactgttgtgtgagagccacaaactttccctactgagcccagaactgcacctgtgcctctgttgaaagaaaatttccacaagaggaaagaaagttcagagacacagggcctgcagtctagtttcttttgtcctatggggtggtcccttaatgtcgtgcacttccccttctcctaagagtagcagcccctgagggctaggcaactgtgaattctcctgctccttagtgtctagccacccagtagggctgccatgttccagtgtggtgctatagaatatctgcatgggattcagctatgtgatttgttctctagtctcccagcatcaggtaccagcatcagttctgatgggggtaggagaaatacagattcttcaagattttttggttataaatagccttattgtgttggttatctcaaatgcaagctgttgtagtaatgtgcagattcaggacctcctggttatccaggatgatgcaggcaatgctaatagctacagtcatgcaaaagttttctcctaagtaagcactgttattgtgtctgcagatgttgtaatgggctgtgccagttggcttccagctgggaggtgatgctttccaaagagcaccagctgtgatggtaacagtgaaatttctgcttgtcttattttacacagtggaagtattctcgtgcctctggcaataagcaggtccatggagctctcaaaagtccctgtgtgttatattatgctaccagcgcaagtagaggagcaaagctgggtgggggtttagtcatgcaattctggctccccacatgtgggttggggaatgtgtgtttccagtcaaatcttatattgaaatgtaatcccaagtgttgaaggtggggcctggtgggagatgattggatcatgagggcaggtttctcatgaatggcttagtgctacctctgctggtactgtccttgcaatagtgtgtgagttcttgtgaaatctagtcatttaagtgtgtagcacctttcccctcactctcttgcttctgcttttatcatgtaacgtggctgcttcccctttgccttccaccatgattagaagttccctgaggccttcccagaaacagatgctgttatgcttcctgtatggcctgaaaaaccatgatcccactaaaccccttatctttataaattattcagtctcagtattttttttactgcaatgcaagaatggcccaatacagaaaattggtatcaggaatgtggcatttctgtaaagatacctgaaaatgtggaagcagttttggaactgggtaatgggaagaggctggaagagtttgcaagactcagaagaagagagaaaaatcagagaaactttggaacttcttagagactggttaaatggttgtaaccaaaattctgatagtgatacggacagtaaagcccaggctgatgaagtctcagatggaaatgagaaacttcttgtgaactagagcaaaagtcatacatgttataccttagcaaataacttggctgggttgtgctcatgtcctagggatacgtgaaagttttaacttgagaatgatgacctagagtatctaacaaagaacattgctaagcagtaaagtgttcaagaagtagtgtggctatttctaacagcctagctcagatgcaggagcaaataaatgtgttggaacttatatttaaaagggaagcagagtatctaagtttgaaaaatttgcagaatggccacatggtagaaaagaaaagcccattttcagtggaggaattcaagcaggctgcagaaatttgcataagcaaaaaggagccaagtgctaataatcaagacaatgggaaaaaggcctcaaaggcatttcagagaacttcccagcagccccttccatcacaagcccaaaatctaggagaactgaatggttttgtgggccaggcccaggactctgctgccctgcacaccctggggacactgctccctgtatcccagccactgtagctcaagctgtggttcaaaagggcccaggtacagcttggtgactgcttcagaggatgcaagccataaacatggtgagctccacatggtgttaagcctgtggctgcatagagtacaagagttaagaattgggtgcctccgcctagattccagaggaagtatggaaaagcctgagtgtttcaggcagaagcctgctgtaggggcagattcctcactctactagggcagtgaagaggaataatatggggttggagcccccacagagtccacaccggggcactgcctagtggagctgtgagaagagctccaccatcctccagactgtagaatgggagacccatcagcagcttgcaggcagtatgtggaaaagccaaatggattcagctataacctgtgaaggcagctgcaggggctgaaccctgccaagccacagaagcggagttgttcaaggccttgggagtccaccccttccatcagtgtggcctggatgcgagacatggaatcaaaggagattattttggagttttaagatttaatgactgccctgctgggtttcagactttcagagggcctgtagcccctctcgtgtggcccatgtctcccttttggaagaggagtattttcccacctatattcccattgtatcttgtaagtaactaacttgtttttgatattacaggctcataggcagaagagactagccttgtctcagatgagacttcggactttggtcttttgagttaatgctacaatgagttaacactttggagataattgggaaggcatgattgtattttgaaatgtgagacgagcacgacgcgtgggaggggacaagagtgggatgatatagtttggatgtgtgttcctgctcaaatttcatactgaaatgtaattcccaatgttataagtgaggcctggtgggaggtgattggatcatgggggcaggtttctcatgaatggtttagcaccatctcccttggtactgtcctcacaacagtgagcgagttcttgtgagatctggtcatttaaaactgtgtagcccctcctcactttgccctgttgctcctgatctcaccttgcgatgggcctgccccctcttcgccttccaccatgatgtttcctgaggcttccccagaagcagatgctgctgttatttctgtacaccctgcagaaccatgagccaattaaacctgttttctttataaattattccctctcaggtatttctttataacaatgctagaacagactaatacataggggcaagcagtgggactggtgggaatcagagggcagatctctggctgctcaggtcatgttcagggaggagtgcagctgcctgtcttacataaaacaacacacatgggagctgggtgcggtggctcacacctatagtctcagcactttgggaggctgaggcgggcagaacacttgaggtcaggagttcgataccagcctgaccaacatggtgaaacccagtctctactaaaattacagaaaattagccaggcatggtggcacatgcctgtatccctgttactcaggagactaaggcaggagaatcacttcaacatgggaggcagagattacagtgaaccgagatcacgccgctgcactccagcctgggtgacagagtgaaactccgtctctaaacaaatgagtaagaccagaaaagaatacacatggggagcaggcggcagtcagccccactcagctctcatgctcttgccaaggcaggtctcacacccacagtgttttgctagcagcagctagctagtttccaggtagtctgcacttggtactccaaactgccacctaccataagccctcccaactaagagaaaaacagtggctttcaggctgtgatcctcctggtccaccctcaaaggaggggtgcccggctgaggttatataggtggctatagcacacttcccgctcctctcttggttctggcccagggggttcatccccacttgagattattttgcaaacctcagttaggaacctctggaaacctgtaacaaccacctgagtgagctggcacacttccgtgaggtgtcctgtgaagtaggattaggatgattttcctacatctctgctggagtctgagagtacacacaaatgctgctccttcccacattctccctactgctcactaagtcagctccagcgctgaacagagtgaaggcatttccctgtggcctgggttgtcctgctgctcagtgggagtgtgtgtcatggaggcaatctctcccctctcacattctgaagactcacagttttctgcctcactcatggtgtaggttgctgcctgctgcttctttcataaagtctgtagttattttcagtttttctgttaagttcttctgttgtttcttgggaaaaaaaaatactcacagcatgaaactctgcacgatattttgtccttcgaagtggcggagccatgctaacaatgcccccaacccgccatctcggaaacagaattaaacaaacaaagaaaaaacaaatacgttgttgtaatctgaaatgttggtgggaatatgcatcaaagataaaattacaacaaatttaaagatcttaactggtttatatttttaattctagaattgttctaataggctgagcaaaggatgttattttatagacaataaagggctgagaaaagtaaatatagagaacaaaaagtgaattggttgattcaaagttacttttcttataaagattaaagcagaggaaactttcttatcacaccgactaaaactggcctgtttgcggatttggctagtatttatctttcttctaatttcctggacagtcagaagaatatcttttggtttggaggtgtacttcagcatgagtaattttgtactttttgggctgttggacctaacacaggagctcagtccaaaccaatggcctcctataaatgttatctaacataagttggctgggtgtggtggctgaagcctgtaatcccagcactttgggaggctgaggtgggcaaatcactcgaggtcaggagttcgagaccagtctggccaacatgatgaaaccctgtctctactaaaacaaacaaagaaaataaaaaaaaaaaaaaaaaaaaaaaagctgggcatggtggcacacacctgtaatcccagctactcaggaggctgaggcaggagaatctcttgaacccgggaagcagaggttgcagtgagccgagaattctccactgcactccagcctcggtgacagagtgaaacactgtctcaaaaaaaaatgttatttaacataaattatgcagcgatacataagtcacacacagatgctagtataactatacaatgacattatacttataagctatatggatgtggccactaattgttgttgtttactaacagccttaagcatcttaaatctctgagaaaatcatgctgatgataatgataatgtttatataacactgaatgtgttccagttattgttataacttttgtattaattattatgtcttatgtattaatttttgttttaattattgtaaagtctccattctataaacaaaaatattgagatgcaaagaagttgagaaatttccccaaagtcacatgacttgtgaattttgtgtcacttttttctacataatatttatccaatactttatctagtttagtggactgctcctattttttttacagtttttgcttcatcctgtcacatattctaagggataggttgagacatcatgagcaaatacctttaacgttaaatctgtgagtatgtgaatatttcagcctgaagttataggaggaaaagcaagaattattataccaaagcattgcagaaactcagaaaaggtggagaggaaattccagatatgtagtaattggttacagtaaatcccacgtatttgtctgttagtattggcagaattgttaaagccttgagtttgttcaacacaaaaggtacagaaggatattagatttgattgttagagtggagtggaagtgataacacaattaattgttaaaaattagccttttttgcattataaattctgcaagaatataaactatctcacagttggacaaaaaaagaaaaggttgcagaaagcacaccaaatgcactcttttgaagagcataatttgggctatatgttttgctttacccatgaagaaacagcacgtaagaaatacattatcctggaccaaccaggctttcggggatcacagatgtttgtctccatcacaattaaattttcagtgaataaaatacctgctggaatgtgtatttttcctgcctaggcttatgctaaccgtttatgattaataagcttcagaaaccgacgattgtggaatgaatatgacatttaacataacataagcctgaacgggagtcagtgacccagataacatcaatatgctgacactacatgccaatattttgctataaaactctttctttgacacatctaggttggtatgagatatcatctgtcctctacaggtggcctctaggcaaactgagaagaaaaatgtgtgcatatatacaggacatagtttcaccttctcattaatcatctaggaattgggtgaaacatttttgtaatggcagcgtgataaatggactgatttagattttagttaaaataataagtacaacacatttcagatgtatagaatatttttaaaggatacttccagaactacaaaccaactgtcacagatattaacgtgtttgacataaacttaatgtttttaatgaaaattttacacattcagtggactattgatgtcttccattctctctctctctccctcttaagaggtaattatgactttaaatctgtatgtgttctccttatccatatttttatacatttgatgtatttattggtatcaataaatacatttgcatttttatgacattataaaaatgatataatacatgaattgtttcatacttcctttattgactctatgctcttgttaattatctaaaatacatgtaaatatgtccatgtatttctagtttgtacttatgtctactttatcatttgtatggtatttctttccttattgtgatatgtatttcaatattcccctttcgaagatcacttatgcagtttctttttttgcctattaaaatatatctctgaaaaaaacccatcaacagttgtgtattctagtgataggtcttcagaactgaaattagtatacaagggagatgcgtatcttctattgtaccagataatataataataatattctaagtggttataacagatgacatggttagcagaaaactaatatcatttcattttctacatttagacaaaaactaaaaaaaaaaaccaaaaatttgaattgagccaatagaaattgtgaaatatatgttatatttgttccataatttcttttgatttattacaagtgacattaaacattttttcctatgtttattgtctgatttaggttaactttgagttaaccatccatctaattttccctttctgttgtgctgtctaaatgtatttatggatttaaaatatttatatatcttggatatataccactgatgattacatgtctgcaaatatagcttcatacgctctcacttatcttttaacttcatgcagttgtattttaccatgcaaaatttgaaagcattcattttatcaaaattctttattatttattaggttgggttgtctgtaacttgtgttattattctactgcaaataaaataactacattactgttatttatcctagatttttttctatttatttttatgtctttttatctatctggaatatatatattttttgtgcatggtgtatcattgaaatctaactgtatctctctatatatgtatacatgtgtgtacatatatacatatatatttatacactcacatatatacacatatgtctttttctaaaaaatggagatgtcttgctctagaattacatatcgtttagcttattatttattccattgattttataatgtcacttctattgcatggcaatatttatataatcattagcctgtagcttgtatctctatgctattccagttttcttttgtcaccttcagataataagccattaacatgacttactgtagtacaggtgcatttcttttagtattttctttcttcaacttttaaaatttagtttttataaaactctgttttgtatgagttttaaaaagaatgtaacaagtttatttacaaaatgtgtatatttactagtaatccacttagaaatagataaattgatagttttacctattccttatatatttcaaaaattaaatttagtttaatgtaataccttaatagaagaaaatatatcaaaatatgtttataaattcaaggtaaggatgaatccctagagcaagtcccaataagcaaaatctataaaattaaacttctaataagtttgattgtaacaaaaattaaataaaaagcaacaagcaactgcagtatgcttaaatattcttataacaaagtacaattttatacgtgattctgaaagaatccattttcaaatagatataatagacaaaggataagttgtcaaaaaatattgaaaaatgcctctaattgattagatcaggtcaaaaaagttgattaaaatattggaacaatatagacatgaaactgaaaataaatgaatatttgaaaagatactctaactcactaatcagggtagtgaagatttacccaaccaaaataccattcgttttggcaacctagaaaaatacattcattttgggctgggcctggtggctcacgtctgtaatgccagcactttgggaggacgaggcaggcgaatcacgaggtcaggagattgagaccatcctggctaacatggtgaaacgccgtctttactaaaaatacaaaaattagccgggcgtggtggcgcacgcctgtagtcccagctactcaggaggctgaggcaggagaaccgtttgaactcgggaggcaacggttccagtgagccgagattgtgccactgcactccagcctggtgacacagcgagactccatctcaaaaaaaaaaaaaaaaagcattttgtttggagttcagcttgtgtagctattttaagaagaaattagatatttgtaatgaattaaaaatctacatgactatttcctattaacttcacttcttgacaagtatcaaagagaaagatgtgcacataagcacaagtgacatacacaaggaaaacatatccaactttgttttcctagtggaaaataaaaacatttttattattcatctcaactatataacactttgcaagaatataatacagattggtttcctcttagcttttccctaagtcaacttttgcaaagaaacctcccagtcaggttacaaacccattcccttacctgctcctcttcctgagaaaaaacttcaaccatcatgacccaacattatcataaatgtctttccttcatttttttgcttctctttttttactgctgctaggtcagtgaggctggctgcattctcacatgtagtatacagaaaatatttctgagtgcttcctttgaaggtatgaacttttccacaaaagggagtcaaggcatacattttatcagatatccaaaccacgtcctcccaatttgctaaagaattgttgaccagcctgaccaacatggagaaaccccatctctactaaaaatacaaaattagccgggcatggtgacgcatgcctgcaatcccagctactcgggaggctgaggcaggagaatcgcttgaacctgggaggcggaggttgcggtgagcccagattgcaccattccactcctgggcaacaagagtgaactctgtctcaaaacaaacaaacaaacaaaacaaaaaacaaaacaaaacaaaacaaaaaacgaagtgtttactgtgttcttgatttcttgagcatgtgagccttagtaggcgcgaatgctttgcttgccctttaattatcagtttcctgtctttatacacaattagatccacaagaatatattccaaatatatatgtctaaattcagtttgatttactcacacacttttgaaaatagaattgaaagtagttgtcattgtatcacttaggtatcaactgcaggcagcaattctccataattcatcctggccaaaggcaagatcccctttcctcaacatgcccttatttattctgtggaggaatattcctgtgctcctccttttcagcaccattatcatttcacaatattttatctcttcttgattgtgagagtggcacagaaggcaagatacagcagggtattttttcagtattctggttctcccataatatttcaggcaatggcataattgtacttctggttctctttgagattggttttggctatgttgctagttttggctgatgggctggaagggaaagagagaaatgcaccacttctgggatgatgtatataatgctgaagtaagatcctctagaaatctctttgcctccgctatgtttcgtgaacaatgttctagattgttggctgatccataagcctgggtcctagaatgaggtcaaccacaatgtgagagcagagcctcagattacctttcaaaattatgatgtgagtgagaaataaacctctgatgtttaaagccactttagttgggtttagtttgttcatgtgtataaccctagcctatatattcttactgatacacagactatgcttttagttcacaatctcttgcttttaagttaaaacatactttaaaaattgtcacctcctttgaatgttttgtgacagtcttccaaatttctagattttgagacaatttgaaatcaaggtttctctagtaatttttctagttctggagtttaatttcacaacacttttgaacacactagattctatatgagttcattaagctctctccacaatttaaatgagtaaaaaaatcaattttgttgcttcaagaaccaggcatgaaaataaataaagggagaacaagtgacatcttgataggactttctacctgccaaatttctatcttgtaagtcatgcaaatgttccctttttttcaatcttcaaacttatcttgttgagctattattaacaacacctgtgtatgcattctcacacaaacattcatacacacacacacatacgcactcatagcttaacttattaagaagatttaggtaggacatgtcagcatctcagcaaactttgtcactaatgctcccttttaatccaggaagtcatggtttctgctaagtttaaaaactgactgtataactcattaatactcttccaaatatatctgcatatttacatttctgaaacttaaaagcaaataatttatcccttagtttaggcttgcattctccatcagcttttcattgagaaaataagttctgattttggaattggaaatgcaggttaggacattaaaggcaacaagtcaatgatgacagcattaaggaaagtgaggttttattcctttttaatctgcagttaacacattgagcactaactctgtgaatgggcctaaaatatgctgtcttttctaaaactctctcaccatttaccccaggaggtaggtattgtcaacccatctcacagatgagggacttgagacttggagcttaagaagtctcaggatcaatgaggtggccaatccaggtctcgaatacaagacgtgctcactgtagggcccaccctctgtcccttatactatgctgcacacattgttctctttttgttgacactctttatgggcttttctggtggtctaggtcatgagacctaatcaagaccaacatagacaacaacaaaaaacttagatcgtcatctcccaagagaacaaagtgtcaatttttgagtccttccaataaaatggtgaacagaaaaaaaataaaaacacagaagagaatcactacacctgctacataattgaagattttaagtactgagggtttttgttccctgctatgaaataattagtttatttaaacacaaagatacagaatacttatctggaaataaaaaaataaaatactttgataataacctggagtgaatcctttcttgagtgattcccctgaaatctagcaattacagtttgagttttctgttaattttctcaatgggacaagacaagagttcaatagaaataaaatttctaatcttaggcagttctttgtgacttatgagatatcatgatccccaaagtttttaaaggaaaacaaatacctatgattgagcaaaaactatttttaaagccttcaaggcaaaaccaatacgtgttcatggttacatggtagagagcctgtcagagagtgtttaatgaagagctaaagagttctgtgtcttggttagagggcatgcgatcttttcttacatgattatgatctcatgtgctgtgactttattttgttttgtggatatcctaatcataaaatatatagccatttgttatttttctggagtcatgtagtgcattacaaatcataggatctcaacaaggagaagttgagataccaatagcctgaaatatttacagtatgtataaaaaacacattttagaagttgaggtataaagtattgtccatataataatgaaagtatatggataaaaggagtcatgcaatactttcaagtgctaaacaccttctagactaaatagtagaaactaaatagattctacaaagtgagttctgaactggatgcattttctgaacttgcagcacatggagcaaatataagggaatttagcaaagtaagtaagaatttcacaatgcagggccttagaaggtagagcaaaaggttaaaattttactctgacatttttgggaaatcatcaccatagtgtcaacatctaattgcctctgcttgtatgtggtaacaagagaagaaggagggaaataaattaagttcaataaattatggttaaattttaaaataaaaactttggacaaattcaatttaatagagtttatttgagcaaggaaaagaaaaacgattcaggaatcaggtagctcttagaatcacagtagattcagatagactctggagcaactgtgcagctggaaaaaatttataaactgaaaaagataagtgatgacggaaagtggaagcgaagtacagaaactgccggactggttacatctttgcatttgccttatttgaacatggtttgaagagttgaccgtggatgagtggttgacatctgactactgggataggcttaaacacagctattgttatcaaagcataccattaagctctgttttcagattgcctacctactaagttagaatacaggttatccataatgactcacgtatttaagtacagaggctctctcaggccaggtttaattcgatttaccataaggtgcagtgagtcagacagtgtgatgacacattgggttagtggtaatgggagtgaagtaaagtgatcagataaacttaggatatagttttgactttaaaatggcgtgatttgctggttgcatgaatgtgaaatattgagaaatacagaggaatcgaattgtctcctatattttagtgtaaactattgagcaatgtagttttatgcagaatgacaaggaaagcagagggggagaatacatactacgggcagagagcaggaagtcaagtatttggttttggaaatgatacttttgagatgactatgacatatttaagtgctaatgtccatgagtttgtttaatgtttaaatcagggatgcagaacaggaacaagataccagcgttattgacaaaaggcctaggaaggagggaatagacattgaattagaaaagcagagggctcaggactaaaaacgccaatactgagaggtcatttataaagagaaaagtcaataatttaaagaagagaagattccaaggaggaaaagcagaacactttttctttgttaggaagttagagaaggagattgcttcaagaaagcaacagggaactggtccaaattatgtcacattttataaatacattatttataaaaacaagtaaacagaatcattttcactctgcactttcttaaagttttactgtatgtattagtccattttcatgctgctgataaagacatacccaagactggataatttataaagaaaacaaaggttaatggactcacagttccacatggctggggaggcctcacaatcatggcggaagagcaagggatgtcatcttacatggcggcaggcaagacagcatgagagccaagtgaaagaagaaacctcttataaaactatcagatctcgtgagacttattcactaccgagagaacagtatggaggaaaccgcccctatgattctgttgtctcctaccgggtcccacacaacacatgggaattatgggagctaaattcaagctgagatttgggtggggatgcagccaaaccatatcagtgtattaataaaaggtatactaatatatgtatgttaatatactgttttactattttctaaataaaaatttagaatgtagcttcaaaatttttcaacatgttgtacagtagaggaattctatatcttggccatatatgcttcattctgaaggaagtgtttgttagcataaagaaattcataaagatatatttattttaggttggagaataaagtgatgcaatcatgttgataagtaccaaaatgcacttaagaaaagttggaatacatttctgattttaggagaaaaaaactactaaccaataagaaatagacactttaaaaccataatgtagggtaactatgttcatacaatatatacaacaatataggtatgtatatttataatatagtgaactatattctcaaaaaaagttgagaaactaatgggggaaagatatatctattggttaacaattagaagactcaatcaaggagaatacctgaattctgtattactgcagtattcgttatatattcaatcaacactttaaatccaaaagaaaacttcaatcaatttacttatatctgtctaaactgtatttattactcagtctgcatcctaacatgtcactcagagaacacagcaatagtatactaactggcaattttcttcagccttgctcctccccaatttattagctgtacttcaggtagaattatgtaaaaacacaaattggatcatgccatttctacatgcttcacctttcattgaaggtagaattcatacttagtattcgaatttacaaagccctaggtgatatctaccctgtctactcataaaacctcatcttgcatcatcttgctttcttcttggtactcagtctcttctctacatcttttaagtcatttcaacttctcaaatttttaaatacaattttcgcttttatgcataccacttattctgcaagcaggtcctccattctttgcacacacagacattttgcctgagtgtatgctacctgcctgtcatgcctatgtttgtttttattgtttctggaaaggtacttaagaactgttaattatgagttatatttgcctttttatattctgcttcacatataactttgtgcttcccctatcattacataaccatggcttgtcattattacctgctaatttttccatatctcaatgaaactacaaagtttattggaagagataccatgatagcattcttccttgaatgcttgagtttagtggaggacttttctcatatgatgattaaataaagaaataaataagtaaaacacattgtctatggaattataaaaaataatactaagtatgcattttgtgaataaaatattgaagaatagactttaatatccttatttgaaataagtgcgattgtcaacacaagtctcagagctctcaaatctattagggaataataaaaaaatgaaaatatgatttttcaatgaaagaacacatgatataaagaacagtaattaaataaagaatataaataaatcaagattgttagggtaatggatacactaaatttagaaaaaataaaattgaatggattttctggagcagagacaagagcaattcaagaaaagcagccataaatctaagaaaagaccgtgcagatttcgttcaaggagcacaaacaagtgagtctctaaaaaattccaagaaaaaatgaagaagaaaaataaagcaagatgtggaggggggagatcaagtggtcccttgttgatgtggtcagggttgacatttcatttgagtttaactgaaagttactacctactcgtgagcaggtcggaatcatgatgtaatttttatttttaaaaagatcacttgggatgatgtgagaagataacacagagcaaagagttggaccaattaggaccaacctgtcattactaaaatgttgatagtttgctgagcatgttttcatgagaaaggacgtttgatttaaaaaaacaaacaaaaaaccatactgcactaaaagattaaatttggcatgctttaaactttacacctgagggaagtacttcaccctaaatctggccctgataaaacgcagcagttttaatgatagaccacataatctaagctgattaaaaaggaacttgaggatgttagtgtatgagtgacagtgagaatgcggtaggacctttctctctgtctgcccttaacattttttccttcatttcaaccttggtgaatctgacgattatgtgtcttggggttgctcttctcgaggagtatctttgtggtgttccctgtatttcctgaatttgagtgtttgcctgttttgttaggttggggaggttctcctggataatatcctgaagagtgttttccaacttggttccattctctccatcactttcaggtacaccaatcaaatgtaggtttggtcttttcacatagtcccatatttcttggaggctttgttcctttctttcttttttctctaatcttcatgctttatttcattaagctgatcttcagtctctgatatcctttcttccacttgatcgattcagctattgatacttatgtatgcttcatgaagttctgctgtttttcagctcaatcagttcatttatgttcttctgtaaactggttattctagctacgcagccacaaaaaaggatgagttcatgtcctttgcagcaaactaacacaggaacagaaaaccaaacaccgcatgttctcacgcataagtgggagttgaacaatgagaacacacagacacagggaggggaacatcatacactggggcctgtcgggaggtggggggctgggggaaggatagcattaggagaaatacctaatgtagatgacgtgttgatgggtgcagcaaaccgccatggcacgtgtatacctatgtaacaaacctgcgtgttctgcatgtgtgtcccagaacttaaagtataatttttaaaaaattaaaaataaataaataaataaaatttaaagagtgaaaaaaatagattgaatctaaatgatgtggttgtgattatttaacatctttcttcctcttaaatttttgcaatgacatgtattatttatataaacaaatttttcagtgtactagtaaattaatttacttgattcattaaaaatgcatttttttctaaaaattaatataatcatttaacaataccagggtaatgacaaattgaataattctttcagtatattttttcataagttgttcactagaggtgaattaattcagagatcgatatcttagttccagatctatttccacttatttagccatctaggtgtcatataaaacaatgaaagtaaaattgacaaagatcccacctgaatgagtgctttcctaaacttaataagtttacaagtcacctgaggatcttatcaaaatgaaaaactgatttattagatctgggaatgggcctgaaattctacacttcttacagccaaccttgacccaatgctgttggcttatgaaccacacttttattaccatgtcgcaagataaaaattcttctgagatcctactctggatttggagacaatgtgtttagttctaaaggaacaggtgaaagttaacagataaatttgaccaaacaaattatatcaaacattcatctgctaagctgaaagtagtctaaattttgctataattttatgcacaggagatagtgctatgtcctggacaccccttctgcatcacttataaataattggcctcaattttctcttttattccaagcagtccagtgactagtttcatacaccttcctttcatctccaacgtgaattatggcagcactttgccacaggaggattttgtgctctttgcttccatattaaaggattctctgttaatgcagtgtgagcttctgagggagactgttctgcaccatacttatgaatcaacagagttaaagctctagagggtgaagttttctagacaataaggaacaagagccagtaaacaaatagttttcccattctgtcttgcggtcatggatccaaccaatagtcacccatagcagtgggtcaaattgaagatgcatcctttattgtattctctttcgttcttgcttctttcctccaattcttattcccacctctgggcccacagttgtcaataaaaagacttgtaaacaaggctttgcctctgtactgctttccgttgagcccaggctaagaggttaaatgatttagtttgtccaggataaaaagattacttatctagattacttccctacatgaacagggaagatcaatatttctaaggaaattgtgtccagattaaagagtattgctttatatagtaaatccttttaaacacatgccacctttagttagttacaaaataaaaaaaaaagttgattagaattacactatttccttagacttttggttttggtggcattttaaatttaaagctccttactacttgtgactcttaaccgccctgactttgagaaaaaatttctctacctaacatctttgaacattttagtttgcatttgctttgaggtttattttatattttctggcatcaaactatcccattttcttattatgctgagtcccattagcatttcactttaatttattatgtttgatagcattaatattctttttttcattgacttgttttgattgtaaatttagttatactgtaggtgtaataaaagaaacaaatacaaaaacgaagaaaaaataacattactgaataatgtttatatctagttagtatacactgataggcatctcctttatattgatacctgtgcaaaatgaaaccttttatattttcttgataaaatagctagaatcttcttcagagttatttcctgcttttgttttatttttatatgcttccattacccttgtatacaaattatttcctggattgccagttccttgttaacaattttccagatgactgattaagaagtttctacaggtttgaagttgcatcagacttttcatgcaattggctaccaccttgtgatttccatgtactgctgacacaagatatttcttgccattagtctgtttttccccttagttgtataccagactttgcataggtcatctgtttaaatctataaaataaaatgtgaaatgtagcatctcaataacttttcccagctttcattaagtagcatcattcatcatctataatggcatcattttaagtactaaaacgcaacatattcaaacaatgaacacatgaataaaaacaagaaatgatttatttgaaaataaactctattaaaagcatgcagttaaaatgtttagcataaacattatgaccactgcataatcataaacttttactgaaataagtaactataggtactaaactaaattaaattcagtttactcatatatactcactctgatatttttaaatattattctggacttggttatatattctgtccttaatgttgagaatggcacaaacctaggcatcaacaattatctttagctaccctatgtttttatagggtatttaaaaactctatccatatttatcttctaagtgatttaattcaggatctgaacttagttgcctgatgaccaagaaactaatttatcatacccttaatattattgtaggattggtgatctgaattcctcataacagctagaaagtctcacctaaaattagcgtattaacaaaattctcaatacgaggaaatatcaagaaaattaagaaaatcacagaattagggcatgcattttacatatgtcaaaagaaaatgaagagatgggattacatgaaagaataagaaagtaaagaaccatatatgtggaagtttaacaataatgtgtagatagaaaaagggataaaattgattaagtgaaacaatatttattacaattaaaataattgtagatggaataagttctagtcttgaaaaatataagagaaagtttaaattatttagagaattctcaaaaaacacaattcaaataccgaagtgtttaaaatatgttaaaaatgttaaatgaaatagaaagcacatttaacagcttgagaaaacatctaacaggattcctagaatgagacactagaggaaattgtgaagaaactggcatttgaagggataataaaaggaggtactttcttagtgataattattcaggtgtgaagaaaataatgaatcctcagaaacaatgagttctgaatacaaagagaaaatataaaaataaatccatatctagagggcaggaaaatgtggaatactaaaaatgaagaaaacttggttaaaaatactgaaggaaaacatggtgttgtcctccaaaatgaataacagactaacagttcacttggtattagggaaaatacagtacaaaatagaagtataagtgctgaagggaaactgtgctatattacgtatccctactcagctaagccatcagaaaaacccttctagacattggcttagacaaagagtccatgggcaagaacccaaaagcaaatgcaaccaaaacaaagataaatagatgggatttaattgaactaaaatgcttctgcatagcagaagaaataatcagcagagaaaataaacaacccccagagtgggagaaaatattaccaactatgcattccacaaaaaactaatatccagattctgcaaggaacttgaacaaatcagcaagaaaaaaaataatcccatcaaaaagtgggctaagctcacacgtgggggtagcttactgcctggggtactacccttgcccatgcctctagctacaaaacaattcaattgttgtttttgtaaataaaatctcagctagctctgccaactgccaaaagaaaaaaagaaaaagtgggctaaggacatgaatagacagaccattctcaaaagatatacaaatggccaagaaacttgctcagcatcacctgttattagagaaatgcaaatcaaaaccacagtttgatacccccttactcctgcaagaatggccatgataaaaaaaaatagatgttggcatgaatgtggtgaaaaacgaacactttgacactgctggtgggaatgtaaaccagtacaaccactatggaaagtagtatgaatactccttaagaaactaatagtataactaccatttgactcagcaatcccactactgagtatctacccagaggaaaataagtcgttatatgaaaagggcacttgtacacacacttatagcagtacaatttgcattgcaaaaatatggaaccagcctaaatgcccattgataaataagtggttacatacatacatagtgaatgtgacatcaagaagacacaaaaggaaaatgtcaatatcaattatatattggttaggaaggattcatagacatataaaaaagaaagactaatggaatattttaacattaactatatatatatttataaattttattgaggtataatattcataaactaaaactttcttaaagatacaccccattacaagatatatagtatttatagaatcataaaaattcctcttgttttccttccagtaaatatttccccaaaatataaccactctgacttctacaaacacagagtaggcttgcctgtgtttgaaattaatatcataatatggtagattatactatttttatctgaattctcttgtagatcattgtaactgtcagattcattcatgtgttgcagtactgtggtagcacattcatattcattcttttgtagtaatgcacaatataaaaagcacaaattacttcctataatgttgagaaatatttgggtaattcatgtgttcattgtgaataaaactgttgttcttttaccattttagccatcatttgtgattttcaaaatttttaatgaagtttaaataatcaaatcttttagcatgtcaatacttttgttaactgctaataaatatttgtcttcttgaaagttgaagagatattcttctccattttcttctcaaaactttatcattgtactcaacattttggtctactattcattttaaattgataactctgtgtagtgtaaggtagtaatttagataattttttcccaaagtaggaatctaatttaagcattttttaaagcatttactcactgcaccactaaatttcaggagcaaatctgtcataatcaggtgatattatttgtgtggtatgattgtgtttctagattctccactaaattttattgatatttatacttgtttgtatcaatagcatttttaaattgtactgttattttatatgagttcttatctgatactatattctgcaacattgttatccttcaggactgctttcagtttttaagtcccttgcatttttattgcatcatcttatcaataactgccaaaaggaaaaaaaatcagttaagattttaatggagttttgcaccaaaagcaatggcaacaaaagccaaatttgacaaatgggatctaattaaactaaagagattctgcacagcaaaagaaaccaccatcagagtgaacattcaaaaatgacttcatcagatgaagtgtttcctcaatatgccagcagtcaacattataattaataataatattgtaagctttgaccctgttagttcaaggacataatgaagacttacatttctgagttataataaacattgtattaaatgtcctaaccagttcaataagaagtgaatagaaataaaaggcaatcatttttggaaagaacaacataaaattttcgtcgtttgcagactattagttttctaccaagaaaatgcaaaagaaagcactaattatcatttagatttaataagtgaatttgttaaaagtctttggatacaagacaattatataaaagtcaagttcgtacctagtaacaaccaataaaaattagaaagtttaaattattccaatttaaatagcatgcaatatatttaagaaaacagtaataaacagaataagttgtacaagtcttctcagaaaactggaagtattacttttgtacatattagttatactgatttttaaatactgtctatgataactctaaaatatggatcatcctatggcctcttctttacttgtactaaaaggaagaagtccttctcagatatgaagcagaagtctcaaaaattaaaagatttttctaagaaattccaacataaaatgggtagggaaaaaatgttcaaatcttttgatataaagcaaaacaaacgaaatagataattatcaataagataaaagtttaaattggcagcatacttcttatcaaaaaccctggctgtctgtagaaacacaagccaaactttcaacatctttattacacatacaattctatttatagcaaaaatgcactttcaatacatgtctgcatgtgtgtttgtgtatgtgtgtgagacagagagaaagccagagggatagagagagagaaggaaacagattagcatattatccaaagttttgtggatccagtcaaatttggacttgtcaaaattaaacacacactctctcagacacagaaacacacacattaaataacagtgcataaagatggaaattgtagttgttaatatatttggttaacaaaatttaaacacatcataatattctatgttgataagggtgtgttgaactcaggaaatctcaacttgataagcatttgagaaatacaagttgttaaatatatatttataaatataaataaatatatatttttatatatatataataaatatatatatgtttgattacacctttcttttacccaagttccatttgcttagaaattaatcttattgaaatagtcatatgttctaatcatttgatcaactctcttcattcatagctatccatcaaaaacatgccatccatatctgattcaatggtcaaaatacagacatggttttggatggtgtattgtgtatattttactaataagtatagggagaataaaagcaaatctgtaatattaagtagtagtaaacaagaagaaactaatctaactaggaagtagtagagatttagctaaagtgacagtcttaggtggagacctaaattaaagagtcattttggccatgtaataatagcatgttaacatgtggtgacggggtgggagaaagaaggcatgagtggcttatctcaggtccagaagaagcagggtggctgggtgtgaggggctatgagagagaatgatatggtttggctatgtccccacccaaatctcatcttgaattgtagctcccacaattcccatgtgttatgagagaaacctggtgggagattattgaatcatggggcagtttgtcccacattgttctcatgggagtgaataagtctcaccccatctgatagtttcccctttcgcttggctctcattctctcttgcctgctaccatgtaagacatggctttcaccttccgccatgattgtgaggcctccccagccacgtggaacatgaacacgagtccattaaacctctctttcttttcttttctcttttctttctctctctgtctctgtctctctctctttctttctttctctttctctctttctttctttctttctctttctttctctctctctctctctctctccctctccctctctctccctctctctctctctctctctttctttctttctgacggagtctcgctctgtcacctaagctggagcgcagtggcaccatctaggctcactgcaacctctgcctcccgggttcaagtgattctcttgcctcagtctcccaagtaactgggactacaggtgcccgccaccacacctggctaattttttgtatttttagtagagataggtttcaccgtgttagccaggatggtctccatctcctgacttcgtgatccacccgtcttggcctcctgaagtgctaagattacaggcgtgagccaccgtgcccggccgaaacctctttttctttaaaaattacccagtctgaggtatatctttataaacagcgtcaaaactggctaatacagagaataatggaagctgacgctagacagcaggcatggaaaggaaagtaatgcctggtcaccatcacaaagagttctattagtttcccagggctgctaaagcaaaattctacaaactggctagcttgcataagcagaaatagttctatgtgctagatttctgaaattaagctgcttgcagggtttgtttctactggaaactttgaggaaaatctattctatgtcctgccctttgcttctggagattgcagtcaatccttggcacgtagatgcatggctcaaaattctgtctctctcttcacatggcctctctgtgtgtccctttgtgcctctctttccaaatttatctcttataaggacatcagtcattggattaagacacatattgcacataaccaatacatgattacaactatacaaacccaaattccaacatacccttttgggagacaacattcaatgggatatcctgcatgagttttaagtcagaaagtaattttcaaatatttatattatttatttagagctgaattgtattgagctggaacagaaaagcaagactgaaagaaaaaaggccaactagattacttctgaggtaaatgatagaattggagaaaataaaataaggtagataagtagaagtgtagaaaagaagaaaaagttaagatatatttggagatgaaattcaaaggactttctttaaagagattaagagagtaaggaaattaaggaataataacatatgtatctatgtatatataactatgttgtttactgcacagtctttagcataatgtgattactattaatatagatgtctatccacagaagaatagttaaatttattagtatatagtccaactagagaatactgcgcactctctgaaaagaacaaaatgtcctacagataatggcataaacatagcatatcttccatattagttactagctgataaaagaaaaataaaatggacataaaatataatatttatatacatgtgtattttaattaaaggacatcattagaaaatcttaacaatgctttcttttgagtatggaactggattaagaaaaaaagagaaggctttgaaatttctatttacattatttctttattttgtcggcatgttaaatgatgtatacgtgtattatgcttggaataacaaacagatgctgcttttgttatttttataacatgatcatttacccaactttatggtttaaccctaaagagttcaattcagtatatttcttaattccataaaattataccatgtgattcattttacttgatttaacaaataaaaatataaatacattgtaattcatttttggtaaaccatttcacaaaagtgtggggaaattaatttgggaattactctcctcattgaaaaatatctcatttgctaaaataagacagtaaaacagtacagtttaaatatttataaaaataggaaagtttggcaaaaagagaggagtacacacctgtgactactgagttgctgtgaaaatttcatttcctgatacaaaattgtctaaagcacttggcttttgttcagtcacaatccaaagaacaaaaccagccaagttttatataacgaacatctagttccctagagccttgtatcagaaaacctacacaactttttgaattttctagttaaatttgcaataaagttgttaaatgtttttgggtatatagccctcaaattcttaatttgcttcatacattgcattggggttaaaattcatagtgtcaaaatcagctcctttcttacatgtggtataaaattctgtctgatgtttgtctgtctagctcctatcctatctaacacctatcttacttgactagatcctttataggtaccaataattacattatatttttaaggaaattttaaattcactgaaaagagctgaaagaaggacaaaagcagaaagggagaaatatattattttacattgaggacatattttgaaatgctttaattagtatgcagcaggaaggtataataacagctgtaacttccttgattggtgaaatgtcactccataatacaagtttatttacttttcaattattaattgaagagtcttatcattatttcatcctattactgatgaaaccaattactaaacctattactaaaaccaatactaatctaacatcaaactgatggtgaattctataaccttatttgtggttccaaatcttcaccttttaaaattttattttgcatcgtggccacttcctttctccttatacccaggacagtcatggaaattatttcatttctaggcctatgataggaaacataaattttattaaacaagaatgtccaaaagtacttagaaagtttcatgttattgatctcagtgatgattacatggttgttatcatgttgtgaaaaatttctgctgcaatatatttatgatttaagctttatttttcatatgtgttgtgtatcaataaaatctttacagaacgttatcatccaattaaacaccttatgaaattagaaaatcacacaagactgatggattaagatttaagggtgaaaatcacaggaaggcttgatgatttgaagctttcttttccctattgtatttgttatctgagacactgagaattgagacttagccaaggcagttggtctatgctggaatagaagaatgagcagagtatatggctttctgtcttccaaaaattcactaatatttttctctagataggaaaccattttatctttacaactttcttgtgaatttattatcttgatatatcattcttgatatttcaatgatgtttctagatcattgtaattgctgcatatctactaagttttctatttctttaggttcatttgtatcttattcttgaaaattttctattagaattgtgtattttactccttagagtgttttctcttaaacttaaaaaaggtgttctttagttctttagcttatctttcagggccttttcattttacccacttaccaatttctatgcttatttttcttgttggttattatattaatacaatttaattccacaaattagacactaatattttatcatttgtaacaaacaatacttttccaccataaaatcacagtttttcttatgattcatagtctgtctaataaatggcataatgtgaagacaaacattcccctaagtccttttgggtccttaaaataatttatataaatgtcatatcgttatagaaaatatgacatcagattttttcaaagtctttaaatatcttcttatatgttacttttctcatttttatacttgattctacatgagttattggaaattaccaaatatcttgtgtactgcaagttcatcatctaggattgaaacaaatgttggggcttatagatatactgtttacaagagtgtgtgtgtttgcatgtgtgcacgcttgtatgtgagtgtgtgtttaagcctcattttcatcggcaattatagaaacatttttcagtgagaggcttaaggtgtttttctgcatttaatccacagaaatgtttttcttcttacttggtaacttatagaattgctagtatttctgtctaaggggaggatggaaaataaacatagaatcatcagtgtgttctacatgattgtactgctggtatgtctaccttataaaaatgagagacaaatttagcttctggctctgagtgtgcgtagagttcagaataacatttctattaaaatatcttcaaaattgaacaaaatattggaaacatttttcttatatcagacaataggcagtgtagggctacgattcttaagagacaggaagctaacaaagtaagctcaacattttccccagacattttggccaaggacagttctacacagtagctaaaggaggagggactggaataaaaaccagcaatcttgctgagtggagcagacagaacacaaagttaagggaaaagaagaaaatgcggagaagaagtgttccaaaaatcttcgtaagtttggccttgagcctttggcatgcatagagtgaaattctacaagggaagactaagaaaatgttcctggaaaataattatgagggagttataattcagacaattcccagagctcatggatggcaacaaacctttgcgccctcactagctggagaatagaaggtggactaaatacaagcaatattgagtagagaccactatgcttgaaaaaataaattaatataaaataaaatattatctcttaaaaaataagacatttaaaatttattgtctttcctatggcctttgccagtttttgaaattaacgtgccagctttcataaagttggagaaatatttgtttattattgagaacatttttccaaaaataatttttatttctggaatttttaaattattcatacacaaaattttctgcaactgtacattttaaagccatatttttttcttcaacttttattttaaacaaatttacttttaaaattcttggctggccatggtggctcacgaatgtaatctcagcactttgaaatgccaaggtgggagtattgcttgaacttaggagttcataaccagcctgggcaacagaatgagacctcatctcttacaaaaattaaaaaataaaataaaattctagtatgtggcttcaatatgttcactctaattacattaagtaaaagatgagaatatgcccacatttatgctttcttctttaaaagtttccctttctaaataaccacacaagagatcattttccccacatgttaacatgctctaagatataagtctaaactgttatagtctaaattgcatttgtataatctctctctgaaaatattgactgatttctgctttaaaattattatcataattatcatgtcatgtattatcaccaaattcatttgatggtatcaccaaattcatttggtgataatcattctttttaaatagttaaaccattcttttagtcgtaattcaaaaaagatacttgcacacacatgtttatagcagcacaattcacaatagcaaaatcgtggaaccaactccaatgcccattgatcaacaagtggataaaaaaactgtgatatatatatatgatggaatactactcagccataaaaaggtatgaactaacagcatttacaatgacctggatgagattagagactattattctaagtgaaataactcagtaatggaaaagcaaacattgtatgttctctctaacatatgagacttaagctatgaggacccaaaggcataagaatgatacaatatactttggggaagagtgggagggggggcgaggcataaaagtcaacaagtatggttcagtgtataccggtcaggtgatgggtgcaccaggatctcacagatctccactaaagaagttactcatgtaaccaaatatcacctgtataccaataacttaaggaaaaataaaattttaaaaagaattttatataccaagtaaacccaggaaaaaaaggtaatagtactttttttttttgggcagaaaaaaaacccgaaaacactcttttaaaataactaaaccattcttcttaaatagttgttacattgtgagaaagaggtgatgaataattatagcatatctcattctgtgcacatttgcaaagctgttgcttttgatcctaaggatgataccttacttttatctttagttttttttctgattctgctgagatgtgtgcatttgttctttttcatgttaatttgagaaaagttttaattccccgtagtgagggtgaaattataacaaacactcatgtatattctaactagaattaaaaataacattaaaatttaacatgtttaactaaatctgctttaataaaaattacaaattttacagacacagtcaaaatagttttaaaaattcttcccacattctgttccactccctttcacactctcccaagcatcactattcttaacttaggctgtttatttctaaatgttgttaatattaaattctattccttatatattcattaataatagatacgtatatcttatatacaagtgtttttattaaatttacattgaacctgtggtatttaaagtataatctggtgacttgtttcttgatcaacacttgacattgaaaatctatccatataaaattgccagttcattaatttcaactgttgtatgacattaatgataatgcgatttattcattcattctcctagggatggctatttttgttacttctgaattctactacaaaagagtgctgcaataaaaatctttgaacaagttctaatgccgttcaactggaattgaagttttcaatcgttggatatgtcaaaatttaatcagattgtatattgctcaattactttcaaattatgtacaccaagtcattcttgctctggcaaaataagaatattttcattaatatatcattcaacttgaaattgcccagcttttccttctcatttccccccagtcaaatgagttgaattaatactgtctaaaaatatatattcatttgcttacctgttagtatttgttccatgtattaagaagctttgctagtatatgaaaatatatgtattaccatgtcttgtgaattagtacttttatcattttgaaatgtttgttttcatttctgctgaccgttctaacctgggtatctattttgactggtttttaatgtaactactaacatctttttatgttcagcactttttcacaattttactttcaatgtctttatttttaaaatgtatcttctgtagacagtgtacaggtggtcttgttttattgtaaatcaagtgacaatctctatttcataattgacatatttaatccatatatatttaatttaattgttgttattttgagacttaatatccagttttactattttggcccatttatttttggtttattttagatgtcttgccttatcttagattgattgatatttttagtatttaattacatttcttttataaatgtaatttcttgaatatttgtttttattttagcaattgctctgggaatataaaaatcatctttaaaatctatttagagttaatggtactactttatgcagtaggtaaaaacatttcactagcacaatttcatttgcaggcacctaaccttctgtgatagtattgtcttatattgttatatttatgagatacaatcactacagtaaaatactattttctattcattgtgccatcttataaataaacagatgaataaacagatatttttgaacaacctttgcttgccaagataaagtaacgggccagaatttcctttccaatagaaatcaaaaaacaaaagtttgaataacataaatgtcaacgttttcaacatccacaagacaccaggcatagaggggcagtgattcctgatagatggagaacaagcaagatgaatctgaaagggtttcttcaacttattgcctttcagcaagtttctagaccgcagcattgggaagagaacttagagagagccctgaagactcctgggttgaagagatggagctaagattccaggaagaccatggcaactagatctagtatagagtatccataacttttgggatatactgtctcccctcccatgggcatttgaaagattactgattgatatattcatgtgataaaagcacctggaagaattaaaggtaacaaaagcacctggaagaattaaaggtaacaacacccagggctatacaggatatggaatacttcttgtttccaatatcaagtctagaaaacctctttaattatgtaccgttggtagaatatttagaagattccgattgcagttgtgagcaacaagtaagccttagacgaagcacagatcaaatcacacctaaaaattttaaaagcaggatgaacagtgatcaagtaacttaacttcatgccagagaaaagcaaaagtatctatcatttatctatatctatctatctaatgtatatatctacacacacacgtatatatgcacacaaacatatttattactcaacaagataaaattcaccacctgtgacaagcaatcaaactttacaaggcaggcaaagaagctggaaaatatgatccatgccaatgaatcaataacaatctgttgaaacagtccttcaaatgacacagatgtgagaagtggaaaacaaagaatttaaaagttattataattcattttttatgtcctcaaattaaagagtcattttcattagaaataaacaagaataaaactaggaaaaaattacaatatttgaaataaataaactgcatagggcaaatgcagattcaacattgcaaaaaaaaaagattaatgaatatgaacacatagcagaagacaaggggaaacaatacaaaacaaaaaagtagagaatcaggggaaaacattattaaatataatgaaaaataattggcatatccaaagggagaataagaaaaaacaattggagaaatgacaactgaaaatttccccgatttgaagaatattgtaaatgcttagatccaagcagtttaatgaaccgtaagcacagaaggaggaggaagaggaggaggaggacagtgaaaaggacagggtgacaattacaccaagagggatgatataatttttcaaatccagtgataaaaaaatcttaaagaaaattgatgatggaagacacatttgtaagatactgtgaaataaaaaaagaatgttagcagattatgcatcaaaagcaatggaagtgagaagaaggtagagcaacactttcaactcatagaaaaaagggaaagaaaaagtctattttagatatctgtatccaggaaatattatattttaaaataagaattaaaaaaaggatttgttcagatttacaaaactttgttctgacgacaacaaaaaggattcaccacccgcagacccacagtgtgggaaatgtcaacggaagctcttcaggtggaaggcaaatgatataagattaattcagatttccataaagaaatgaagagcacaggaaaagagaacagtgtagatacatgcataagaatgttttccaaacatttaaatatctttatgacttaacttactttttaagcaaaagtaatattatcgattaactatactcattatagccttagaaaaacaagacctacaaatgtaaacatagacatacacaacttagtacagtaactgtttgtaaagagatacctcactttgcaaatacgtactaaaaattcctttaaataaattattttattttattattacctttaatacttttctacaaataagaatacttaaagattagaatctcaaaataataatctctcttgctgtcagtaataagcaacatatgtaatctcctaaattatccttaaagtcaaagtggaaaatatagtttttgtaaatttttgctaaacactagactattcagtaatttaactcatttaccaaaatattatgtttatagttatctttgattttactatagagtatttatttttttaaaattttattttaggttcagggcaatatgtgcaggtgtgttatataggtaaactcgtgcatgggggtttgttctacagattattttgtcaccctcgtactaagcctagtacccaatagttaattttttggatcccctctctcctcccacactctagcctcaagcacgccccattgtctgttattcccctctttgtggccatctgttattattgagctcccacttgtaagtgagaacatgcagtatttggttttctgttcctgagttagtttgctaagaataatggtctccagctctatccatgttgctgcaaaggacatggtcttgttcctttttatgactgcatagtattccatggtatatatgtaccacattttatttatccagtgtaccattgatgggcatttaggttgatttcatatctttgctattgttaatattgctgctgatcattagagaaatgcaaatgaaaaccacaatgagataccatctcacatcagttagaatggctattattaaaaagtcgaaaaacaacagatgctggtgaggctgcagagaaaagggaacacttatatcctgttggttggaatgcaaattaaatcaactattgtggaaagtagtgtgactgttcctcaaataagcattcttatttgtagaaaagatctagaagcagaaatagcatttgacccaataatcccattactgagtatataaccaaaggaatataaatcattttgtcataaagatacatgcatgtgtatgttcattgcaacactgtaaggcattttaattttcattctgacttgtctcttgatctcctctatattaagtcattttttccttcactaattaaaaatttcataagtcaactgtgttaacagtgatttacagtttttttctttgaggcacacattgcccatatttctcacacttattcttttctcaacactatcactaatattatttttcctaaaatgaatttttttacatcacttttccccatcaaaggttttttggagtctttttctaagaaagtattataatctggtcccaactcaatgagttgtcatacaaagtgcattgagcgaatctaaccacaataggtgcttaatacatccacttaaacaactttattccctgccactccacctcatatgtcatttattccaaacatggtgagctcttcataattatccgagtataactcaaggtcatcccttctaacagtttcatgctttttcacctattattttctgtcttcactcctactttgatcttttcaatagcatcagaagaagtgctcatggccttcctaattaggcatagttatcaccatctctcgactccctagtcctttgcttgaacaaaaccaaaactgtggtttattggaccttgctagttgcattttcaaccctaaaatcattgtacatgcttaggaataagtcatttctgaaattatggcatgagaataacaaagaatgttatttacggaactcagtagatcctggttagcctttagaagtgatcccagtgggctcctttataaaatatatttttatccattaaatattgacatccctacatctggcattgcaaactacacaactgcaagagaaatatggtcctgtcagtgaaaacaaaaaatgactttaagatgtaattttgataggttttggtacacgaaggtgtcatgtggcaggcatttagaaagtcttttcattgatattttactaaaaatttgaatagcttataaacgactttagatagtgtttttcctaagacattttttagagcatgttttagaaagagcggatggataatcctccaacccaggtgacgcacaagggcccaggagatcacaagagttacaggaaaacaggatgtgaagagatgcctcaggtgtgtttgaattgtaaacacttcagcattatttaggagcactctaatccacccttctcagagaattgctgacacacttcaggttaaccctaaatcctatttttagcttattgagaaatgtaacttccagatgtgcttttggttatgccaaaattttgcagtgaacatattttcaggcggtaaaattgcagaaacgtgactaacattttaaatgtcaaacaaagttctgtcatgagtgcattgattttttaaaagtctcatagtactaaaagtcttatatcaaaaccaagtcccttttgaaacccatattctcaggccacactctgttccccagttagtgactttcactgctttatttttacctgtatattttaaacaatatgtttataatttaattccttatggtacccactttagacgatatgcatttatttattggcctttagtggttgaaggatccatcttgtttacacagccatttctcacctttactttcctcatccatctaaaattcagccctatcacaatatttggtttcacgttattattgcatgcataattgttaccgggggtccttgctcccagagatcccaagatggcagcgggccgcttccaaaatggtggcaggccgcttccaagtggtggcaagcctcgtatactctgacctggggttcttggcctcacggattccaaggaatggaatcttgggccatgcagtgagtgttatagctctattagaagctgtgggtcatggaagagaaccgtggaacccagtgactagtgttcagctcgattaggacgaacccaggcacttagccgtgcaggaacaatggcaagcctttagcccgatcaggagcggcaattggcgccttgctggatcatgagcacagtggacaccctggtggatccggagggatggaactcagcagcgggtctgcgacggcggaaaacagcagtggtggacagccagcaaaactcagcttgagctgtaacaagcacagaccagaagagagcgcagttgcaagatttaatagagtgaaaaaagagctcccatacaaagggagggaacccaaagagggtagccgttgctggctccaatgcctgggtttatatcccgatcattgtccctcctgctgtgctctcaggcaataaatgattggctatttctttacctcctgtttttgcctaattagctttttagtgagctctctttactacctaattggttgggtgtgagctaagttgcaagcccgtgtttaaaggtagatgcggtcaccttcccagctaggcttagggcttcttagtcggcctagaaaatccacctagtcctgtctctcattatcatgttctgtttgaccatgtggtctgctatgattgttcctttattttacaacttatattttttacttaaattaataataactttgatttttgatgtttcttttgttagtttaacatttatctgctgctaaaatactttgcaagaattgataaccacttagaaattactgtccaaatgaaacagctccgttgtttggggtatattcactcgttcttggtttgggtagagaaagaattcaggacatggacacacatgaggatttaggagcagacgaggagtggatttaggagtggaaagtttaatggaaaataataggagagagagaaaaagcttccctgtgctgagaaagagggttgcccaaaagagggcctccagtttgcggaggaaggcagactgttttgtatagagactagaggaggaggtaattggtttacatagggtccaggggattggtttgacccagtgttccatctacatagcaagcgaaaagattggccctctaaccctaatcttttattatgcaaatgtggcctccattcagccgcggccctgatgcctgtatatgtggttttgagagctgacaacatgctagcagccctcgctcgctcttggtgcctcctcggcctcggcgtccactctggctgcgcttgagaagcccttcagcccaccgctgcactgtgggagccttctctgggctggctgaggctggagccggctccctctgcttgcagggaggtgtggagggagaggtgcgggcgggaaccgggggtgtgtgcggtgctcatggtccagtgtgagttcccagtgggcccaggcttggcaggccctgcacttggagtgggcggccagcgccgccagccctgggcagtgaggggcttagcacccaggccagcagctgcagaaggtgcaccgggtcccccagcactgctggcctgcccatgccatgctcgaattctcgctgggcctcagttgcatccccgtgtggcagggctcaggacctgcagcccgccatgcccaagccccccactgtggtgggctcctgcgtggcctgagcctccctgatgggcgccgccccctgctccgtggcacccggtcccatctaccacccaagagctgaggagtgcaggtgcgtggtgtgggactggcgggccgctctgcccacagccctggcacaggatccactaggcgaagccagctggcgtcctgagttgggtggggacttggagaacttttatgtctaggtagaggattgtaaatgcaccaatcagcactctgtgtctagctcaaggtttgtaaatgcaccaatcagtgctctgtgtctagctaatctagtggggacttggagaacttttgtgtctagctaaaggattgtaaatgcaccaatcagcactctgtgtctagctcaaggtttgtaaatgcaccaatcagcaccctgtcaaaacggaccaatcagctcttggtaaaatggaccaatcagctctctgtaaaatggaccaattagatctctgtaaaatgggccaatcagcaggatgtgggtggagtcagataagggaataaaagcaggctgccagctccagcagcggcaacctgctcgggtcctcttgtactgtgtagaaaccttgttctttcggtcttttgcaataaatcttgcggctgctcactctttgggtccgcactgcgtttgtgagctgtaacatttaccgcgaaggtctgcagcttcactcctgaagccagtgagatcacggacccaccagaaggaagaaactccaaacgcggccgaacatcagaaggaacaaactctggacacaccatctttaagaactgtaacactcaccgcacgtgtccgcggcttcattcttgaagtcagtgagaccaagaacccaccaattccggacagttttacctggaggctgccatgatactggtaagtgttgtgacaagaaagagagggcggaagatgccatattgaatgtacctggcttccaggtatagctgccagcatttacatataaaggctcctagtttgcatatctatgcctgtcttctcaggctgctttctgttagggaagaaacggtttgggggctgatttttattaaaggaaaattccacaagaactttcaccctttctagctgcctaagaattatttcttaactcctgtattacaagtatttaaacattttaaatgatctgtcagtgctggttggttttgtttcatgatttgtggcaagtctttcaccacagtcacacccttttcaatataacgtgctcaccagagctggcatttgctgttatgatccttggctggatgttctgtttcatggattgcatatcttttttatttacaaccttatttcactggtgcatattctctggtagcttcctgctggctgtggttgtgcataaaaggaagaactgaatactagctatcatgggccaagttatgtctatacagcagcttaaatgggctgtaccctgtagcattccgaggacaggcctgaattctgagaagggaaagtggtaaaagtattgtccagtcctttttaagttggtggctgagcttggtaaggtgtgtttttaaaagacctttagtccattctacttttcttgaagatggaggaccgtaagggatataaaggtttcactgaatactaagagcctgaaaaactgcttggctgatttgactaataaaggctcgtctgttatcagactgtattgaggtgggaaggctaaattgaggaattatatctgacagaacagaagaaatgactgcggtggccttctcagaccctgtaggaaaggcctctacctatccagtgaaagtatctacctagactaagaggtattttagttatctgactcagggcatgttgagtaaagctaatttgctagtcctgggtggggcaaatcctcgagcttgatgtgtagggaagggagggggcctgaataatccctgaggagtagtagaatagcagatggaacactgagaagttatttccttgaggatagagttccacgatggaaaggaaatgagatgttctaagaggtgggctagtggcttgtactatagcataacctgcctttgctggtgtgtggctattaggcctggtggaaccgccatcaataaatcaagcgtgatcagggtgaggaacaggaaagagggaaatttggggaaatggggtgaatgtcaggtggatcagagagatacagtcatgggggtcaggtgtggtatcaggaataacgtgggaggccggattgaagtctgggccaggaacaacggtaattgtcggggactcaacaaaagagtgagtatagctgaaggagccgggaagcggaaagtgtatgcgtcaggtatgaggaagaaaatagattttggaagttatgagaactgtagagagtgagttgagcatagtttgtgattttgagggcctctaaaagtattaaagcagtggcagccgctgcacgcagacatgagggctaggctaaaacagtaaggtcaagttgtttggacagaaaggctacagggtgtggtcctggctcttgtgtaagaattctgaccacgctaaccatgcctaggaaggaaaggagttgttgttttgtagaaggtgcttgggtttgagagatcggtcaggcgcgattggcagggagagcacgtgtgtttttatgagaattataccgagataggtaacagatgaggaagaaatttgggcttgattgaagtaatgggggctgtctgtgaagctttgtggcagtacagcctaggtaatttgctgagcttgatgggtgtcagggtcagtccaagtgaaagtgaacagaggctgggattaagggtgcaaaggaatagtaaagaaagcatgtttgagatctagaacagaataatgggttgtagaggcaggtattgaggataggagagtatatgggtttggcaccatggggtggataggcaaaacaatttggttgataaggcgcagatcctgaactaacttgtaagacttgtctggttttaggacgggtaaaatgggggaattgtaaggagagtttatagactttaaaaggccctgctgtagcaggcgagtgataacaggctttaatctttttaaagcgtgctgtgggatgggatattggcgttgagtggggtaagggtgattaggttttaatgagatggtaaggggtgcatgatcggtcgccaaggagggagtagaggtatcttatacttgtgggttaaggtggggggatacaagaggaggacgcaaaggaggctttggataggaaagaagggcggcaatgagatatagctgtagtccgggaatagtcagggaagcagataatttagttaaagtgtctcagcctaataagggaactgggcaggtggggataactaaaaaggagtgcttaaaagagtattgtctaagttggcacagagttggggagttttaagaggtttagaagcctggccgtcaatacccacaacagttatggaggcaagggaaacaggcccttgaaaagaaggtaatgtggagtgggtagcctccgtattgattaagaaggggatgggctcaccttccactgtgagagttacccgaagctcggcgtccgtgatggtctagggggcttccgaggcgatcgggcagtgtcagtcttcagccgctaagccgagaagatctgggaaggagtcagtcagagagccttgggccagagttccaggggctctgggagtggctaccaggtgagttgaacagtccaattttcagtggggtctcacacagatgggacgcggcttaggaggaatcctgtgctgtgggcattccttggcccagtggccagatttccggcaggtgtagcaagctcctgtgggaggaggttctggaggaatgcctggccgctgcggttcaggcgtttggaagttcttgtgtgctggagatgtggctggggtttgtctcacagtggaggcaaggaattgcaacttttttctattgtcgtacaccttgaaggcgaggttaattaaatcctgttgcggggtttgaaggccggaatttaatttttggagttttatttaatgtcgggagcagattgggtaataaaatgtattttgagaataagactgccttttgaccttttagggtctagggctgtaaagtgtctcagggttgctgccaaacaagtcatgaactgggctggatttttatatttgatgaaaaagagcctaaatgctatctgatttcggataaagaaaaaggagcattaaccttgactatgcctttagctccagccacctttttaagagtaaattgctgggcaggagggggagggctagtcacggaacgaaactgtaagccggaccaggtgtgaggaggggaggcgataaaaagattatagggtggaggagcagaggctgaggaagaattgggacctagctcggcctggcgagaagcagcctgggaggaagggagaggtcagatgggtctgtagaaaaggaagattagaaagactcagggacgcttggggttggtactgaggggacaggtgggaggtaaagaaggaagatttgggacgagttgcactgggcacagagactaggaagggactgatgtgtaaaaggatgcctggacgtcaggcacctcagaccatttgcctattttacgacaagaattatttagatcttgcaggatggaaaaattcaaagtgccattttctggctatttggaactactgttgagtttgtattggggtcaagaggcactgcagaagaaaataaggcatttaggttttaggtcaggtaagagttgatgaggttttaagtttttgagaacacaggccaagggagtagaaggaggaatagagggtggaaggttgcctatagtgaaggaagcaagcctagagaaaaaagaacccccgaacccctcccctccgtttctctactctctcaccttccagaaaagtgggaaaaggggttggggcacagagataagaggttggggcacagaaataaggggtaggggcacggaaataaggggttggggtgcagagataagaggttggggtgtggaaataagggattggggcacagagatataagaggttggggcgcagaaataagggattggggcgcagagatacgaggttggggtacttgcccctctagaaaagcgggacttgccgctaagagtgaaggagaaggggttgaggggtacttgcccctcccccagaaaagcagagaaggggtagagacaaggagagaaggggttggggtacttgccccttccccagaaaagcgggacttgccactaagggcgaaggaccaaggcaggcatccctgcgtggcctgacacctttgaaacgtggatgaataatcaggcgtccctgcaatgattaaacaccaagggaaggctgccttcccagtccgtgaccggcgctggagttttgggtccacggataaaatgtgtctcctttgtctctcccagaaaacgaaaggaattgaaattaagagaagggagagactgaagagtggaaaggagaaagtggttgaggtacagtgagagaggttggagaagacagtaagaagaggccgcttacctgatttaaaattggtgagatgttccttgggctggtcggtctgaggacctgaggtcgtaggtggatctttctcacagagcaaagaacaggaggacgggattgatctcccaagggaggtcccccgatccgagtcacggcaccaaatttcatgcgtgtccgtgtgaagagaccaccaaacaggcttcgtgtgagcaacatggctgtttattccacctgggtgcaggcaggctgagtccgaaaagagagtcagcaaaggaagatggggtggggccgtttgataggatttgggtaggtaaaggaaaattacagtcaaaggggggttgttctttggcgggcaggagtgggggtcgaaaggtgctcagtgggagtctttttgagccaggatgagccaggaaaaggactttcacaaggtaatgtcatcacttaaggcaaggaccggccatttacacttcttttgtggtggaatgtcatcagttaaggtggggcagggcgtattcacttcttttgtgattcttcagttacttcaggccatctgggcatatacgtgcaagtcacaggggatgcgatggcttggcttgggctcagaggcctgacaataagtatgattcactaaaatatattaataagctggactttattaaaattgaaattttctgctctgtaaaagaaactgtaaagagaataaaaaggcacgtcacagagtaggagaaaatatttgcaaaagaaatatctgacaaatgacagttcttaaaaatatacaaagaactcataaaacccaacagtaagaaaaggagtcatccaagtataaaatggggtagaaatctttacaaacatctcatcagaaagatatacagatggaaaatgagcatatgacaaaatagttaacatcatatattattggaaaagccaatatcggtagggcgtggtagggtcagatgttggtctttgaatctcacaggcttaacaaagaagagaccctttttaacttaggctgcctttacaacagagatcaggggcttctgctaattgcagccaaccagaggcccaggctgctttttcaacaggcttccacttctctagagcagtagaaatgggaagagggtatggccaacttcacattggcttttaaagccctgataaaaacgtagcacaccttattttcatgcacatttctttgaacaacgtgaagcaagggaaatatttggggaaactgtaatacagataaaagctatactccacctcagtgaagttcatttgacaccaccagcgtcatgacactaatcagaccgccaaagacagaacttttattttgatgatttcctttccctatttcctttcatgcatcgccctccttcttcaatgccatatgcagagaatgacattagctcgtctccctgatcatgaggacatccagtctttcatgggcaacagacagcacataccacactcagtttatttcatctctcttttctaataccagagtttagtttatttcatctcttttctaataccagagtttaacaaccgaggacattttcccttgcacataccgcatcagtgataatctgttactacttccctatttttatgagctttaataacaaatacaatcatgatcacattaaaagatcattgatatgcagtaagatgacatgtgttgatcagaccttgcctttcatgatgaacatgtctctaaattgccggaactgttcctgtaatcacttgttccaccaaagcgtctttcctgggatctgaatgggaatgtgggtgggcatcagctctcctagtgaatagctccacaccactaatgggcctaatttacagactttattcaggctgctgagtgtgtctccaggaatttccccagaatcctggaatgtcatgtgcccctctaaaaactagtggaagtcatgtccttattgaagaaagcattcaattctattatcaagctatgtataaaaatgccaaaagtcttttatgtggcatttataactcctcattagcatgatctttctaatatttggaaatcctcaaagctgcatcagagcttacctaattttaaacttgatgggtgagtagattattttagacagagtcaaaaaccttttttactgtcaatttcactatcatttattgattattctcagtaatatggaacttgctaaaaatgttcacaatttagtggatacttttcacaatgaataatgcaaatccattctaagaatcatgatcaagttatccaatgttagacattttgaaacattccttcatatagtctggaaaaacatctagtacatgtaagaagatgaggatatcattttctttaatatttagtacgtttgaaatgtgcttgaaattcaaaagcaaaaatgaaccaatatctcactccagtgagagcctagatttaaaataacacatacagatttttaataacataagtattgtataatcttaaaatgtctagcaacgtgatacttgcagaacttcctgtttttcaaaagaacagggctgagcttttctattgatacttaaggctgcatgatagcccttcagagtgtagagtagtatagaagattgctgaaacctgtagcttactccattttaacataagcctctttgaagttaacatttccttttattttcattacatatgattgagatattaattttgatttattttaaaactagtttctttaataaattctcagcccctactgtatggtcatgatgagaaagactttgagtgtccataggcaatattcagtcattacattatatgacagtatttcccagaacacaccgtattttgtgtaataatgaaatagaagtggagtttagttatttttattgtgatcacattttctgtaggaaccatttgtctttgtttagataggagtcttctgccttccaatttgtgaacgtttttcatagatggttcaaaatccctgggattttgccaatctagaacttgtagtgtatttatgccacacatatgaatttaggcaccacattgaaatgtaccagagctttatcaactccatttataatatttatttccatccatttgttcatttacttgaagatcatttttcccaacccagtgctttgggtgacagagaagtaaactttctttgtacttccctagatcagagaatagtgtttcttagtcatctttaagaaaaaggaccacttccttctaaacttctattttgcaaaagctaaggttaattctccttatcgtctttactttctgccccatgcctctgaggagagactcttccctattctctgccctgctctctgaactccaaaaattcacctgtttggatgacatccaggctctttcttaccttctgtcttctttttgtgtctgggcagtatgaagccctatcacactgaaaggagagagaagcgaggtcagtgtggttggttggagcctggggtcccctctgcttggtcacctacctcctggtggctgcatctgctgcagagtagctcagctcccataaggtgggcctcccgacggccctctgtatttccagttcagatagcacagcctttcttctgcccatcgggcatagggttactatcagcccatcttatagcccaggaatcacccccatctcatgtgatttcccagtcaccttcctgtatctataaaatctgcctttttagtaaaatcttctcacagtgtcttaatctgactatgctgttttctgcttgactgtgactgattatcagtcacagaataaagtttagaatcctgttaattcctcatgtctgtagtttatcaatacagaagtgcatttgttccttatttggttttatctggccaagcatttctctatctcttcctctccctcctccacccttgtgtatatatgtgtgggggatgggatgggggtgtatgtctatgtgtatatgtttctgtgtgtggtgttgtgggagaatgaggccaattcctaccatcatactgacagaaatttactaccattatatacaatctaaacttggattctacttctggaaacataactctgggacagtgcctgaaatgtgactttacaattttcttcagagacttaaataatgcaggaaagcagaaatactggaaagaagcaaagaggtatctctggatgagttccattataccaatagtgattcaatagtaggaagatttactttgtggtttactaatcaaatttacaatgcaaaatgatccctcacattaatagtcattaacatataagctaggcatttttttttgtctgaagctttgtttttttaattaaatacatgttgaactgtgcttgcaactaaaaaaaaaaaaaatcagagaaagacaaccacatcagctggattcctgagtgccagtggcaacatgagaggctggagcttagaaaaagaggctgtctcatatttttcctgaccaagagcacatagagcacaatcagagtccatgtgtcaagggctactttagataagtaataagaacaagttaagtggccaaggcaggcagatgcttgagcccaggagttggagaccatcctgggcaacacgatgaaaccgcatctctacaaaaatgtagtcaggcttggtgattcacagctgtagctccagctacttaggaggctgcggtgggagggtcacttgagcctgggagtttgaggcagcagtgagctgtgatcacatcactgtgctccagcctgggagaaagagtgagatcctgtctccaaattataaaaataaaaataaaagatcatggccaaatctatcttaaaatttgagaattgaccaattccaaggtgggaaatgagattactcagaacacttattaaaattgttaaatattagccaccactgtcttctggcttgtagggtttctgcagagagatccactgttagtctgatgggctttcctttgtgggtaacccgacatttctctctgtctgcccttaacattttttccttcatttcaaccttagtgaatctgataattattatgtgtcttggggttgcttttctcaaggagtatctttgtggtgttctctgtatttcctgaatttgaatgttggcctgtcttgttaggctggggaagttcttctggataatattctgaagagttttttccaacttggttccattcttcctgtcactttcaggtatagcaatcaaatgtaggtttgggcttttcccgtagtcccatatttcttggagtctttgttcattcctttttattctttattctctaatcttgtcttcatgctttatttcattaagttgatcttcaatctctgatagcctttcttccgcttgattgattcagctattgatacttgtgtattctttacaaagttctcatgttgtgtttttcagctccatcacgtcatttatgttcttctctaaactggttattctagttagcagttcctctaagctttcttgaaggttcttagcttccttgcattgggttagaacaggatcctttagctcagaagagtttattacccaccctctgaagcctacttttgtcaattcttcaaattcattctccatccagctttgttcttttactggagaggagttgcgatcctttggaggaggagaggcattctggttattgcaattttcagcccgtttgtattggtttttcctcatcttgtggatttatctacctttggtctttgatgttggtgtcctttggatggggtttgtgtgtggacatcctttttgttaatgttgatgctattcctttctgtttgttagttttccttctaacgtttaggcccctctgctgcaggtgtgctggtaattgctagaagttcactccagaccctgttttcctgggtatcgccagcagaggctacagaacagcaaagattgctgcccgttccttcctctgaaagcttagtcacagagggccatctgccagatgccagccagagctctcctgtatgaggtatctgtcaacccctgctgggaggtgtctcaaggtcaggaggcacaggggtcagggacacacttgaggcagtctgtctcttagcagagctctagaactgtgctgggagatccgctgctctcttcagagccaacaggcaggaacatttaagtctgctgaaactgcacccacagccggcccttccctcaggtgctctgtcccagggagacggggcgttttatctataagcccctgactggaactcctgcctttctttcagagatgctctgcccagagaggagaaatctagagaggcagtctggctacagtggctttgcggagctggagtgggctctgccaagttcaaacttcccagttgctttgtttacagttgaggggaaaactgcctactcaagcctcagtaatggtggacgcccctcccctcaccaagctcgagcgtcccagttcaacctcacactgctgtgttggccgcaaaaatttcaagccagtagatcttagcttgctgggctccatgggggtgggacccactgagctagaccacttggctccctggcttcagccccctttccaggggagtgaaaggttctgtcttgctggcatttcaggtaccaccagggtaagaaaaaaaaactcctgcagctagcttggtgtctttccaaatgaccatccagttttgtgcttgaaaccctgggccctggtggcataggcaccctagggaatctcctggtctgtagattgtaaagaatgtgggaaaagcctagtatctgagccggagtgcactgttcctcactgcacagtctctcacggcttcccttggctaggggagggagctccccaactccttgggcttcctgggtaaggccacgccccaccctgcttaggctctccctccgtgggctgcacccactgtctaaccagtcccagtgagacgagctgggcacctcagttggaaatgcagaagtcacctgccttgtgcattgatctcgctgggagctgcagaatggagcttttcttatttggccatctttggtcacctccaatattaatgattatgattcaacatgggattttggtggggacacacatccgaactatttcagaaagcaaatcaaattataaaaagaaatatatgtaagatcaacttgttaaataatataaattgaaatacataacatatttgtaaaaataattttaaaatagcagactcaggattcgtgtggcatttaaaataattaaaacattgtaggactagacatgtttatagcctgtgtttaaaaagtaagtcatccaacaaagaaaaaaataaaaaaacttaatgaagtcctttagtatttgtgctagatggtgtaaaattatatataatctgtagtcatcatcattattctgaagatggcatgcaaaaatcgatatgaagatttccatttgataagaaaaatatattctaaaataatcaagagaatagatacaactttttgtcgtgagaataagattctgaattttttacagttgtagaggttgtaatgtacaaaaagtctgtgcttcatatccctcaggtatgacaagttaaaaattatgtgagaatggaagatacactttataaactagcaagctcataattgttagagtactcatgcagagcttaaattcttgtggacttgtactgttggggaaatgagtcctaaaaatgtctgaactctcatttgaagatataattttgtgattttatgcctatgctaatgacttctcattaggtagtatacatataatttttatttaaaatataatgaagtgtgattttatatcagttaaatagttaatatataagcagtaagtagtttggaattgtgtaacagaaaagtcaactgaaacttttgcaagcataattgattggttcattaaatgaattttttatataaaatagatattagaaagattgaaaagtggccaaagggcctttgtgattctactttgtaatataaaggatggtttcttactacggttggtgtccttgcaggagtgggaatatcattgtaatattcaacccaacatgcttcctcagaaagtccagctagattttaatgatgctttctgaagttcttccaaaaacaaaaaataataaggaaccttctttcccaaaagatacaaacatgcctatcctcatatatcactgacctgaatggaccacagtcttttctagtaaaagactgcagcaagagttatgaaactgttataagaccaacaggtttgtaggactgctgcacagcaacagatcaatacgctgagacagcagaacttgcagcagagaaagagtttaatgatcacagggcactgagcgagggatggaaggagatcctcaaatccatcccgtcttctggttttgggattttgaggggatcgtggagggcaaggaactggaaatttggggtcattgattggtatggctattgggatgcggaaactgcattttatgttgagtcagctatttgtaggatctttcagacccgctagcattagtagtttcactggtatgcagaacctaaaagaatatctcaaaaggaaaagttaatatttcttaatattcaagttgttatctatagagcagttaaggcaattataatcttgtaacagggtctatgtgattctgaggcaataagcaagcaactatgagggagtaagtcagagagtgtattagtctgttctcacactgccataaaaaactacctgagactgggtgatttatgatgaaaagaggtttaattgactcacaattctataggctgtacagaaaccatgggtaagaggcctcaggaaacttacaatcagggaagaaggcaaaggggaagcaagcatgtcttaccatagcaaagcaggaggggagagcagggagggaattgccacacacctctacaccatcagatctcacaagaactcactattatgactgataacaggaagggggaagggatccctcatgatccaatcacctcccaccagttccctctcccaacacatggggattacaattcaagatgagatttgggtggggacacacagccaaaccatatcagagagcaagatgacccaatgattaatgcttaatatgctgcaagtttggtttattttcatttctcccctcttttttcctgattaatttcataaagtttatagggatggttttgaattttttccaattagtttcatcacactttagtcatgaaatgaatgtggaatcatgtgatcctacaactcatgtagtgcatgaggaaatagtggacatttgaataaaccagggttctgtttcaagggatgaaagagaaaggaagagttgattttggaaaagttacaaaaaaaattacacggtgtaaaacaaaaaatattagcttgtttaaataatgcatctgacataaaacattttgctgcacttatgagatactgttactgttagaaattttaatgtgaaatattataatagagtatcattgatactaatataaaatacttcaaaaattataaaaataattacatttttggacagccaaattagtggtagtcacctcattgtgaagttctccataaatcttgtcaaatcttctgacacattttgtagatcatattaaactatgccaaaagtcatggcttcagaaaaacttcaaggaagggaaccctacatactttaataaactggtgaattgaaaaatctatttctagcagagaaaacagttgagatcatgctgcaagtcttcgtggggagcaagaagatgaaaacaaagtaccaaaacaaaagaagcaaacaagtaaaacaacacagaaacaaaaaccaaaacaaaacatgtatggaagagagaacgtgacattgagggcatagagtgcacagacacaagtgaggtagtcttgggcaaaagatgcttctgaaggagaagcaagtgaaagggaagctggtggaggtgaactttgaaagcagctggcaaaggaaaaagaaacagaaaaggagagcacaggattctgagaaacaagacttgggccaagggaatagagtgagccttaaatatacttcattctagatctaagattccagtaaaacaggaaaaagggtgaaaactaagatataaatattgaacatactgtcgcaatagaaataatgcaactaaaaccacgggagggaaacaaagtggggaagagaaacagcacattaatggtagaagcagtagatggaaatcaaaaacatcattgccactaacacaaggataataaaagggtaaatacagaaacagggggttaagtgttccaaaaaacatataagcacaaaggtaaccactagaacaaaaatataaacatttttagattccaaaagaatttacaaagaacaaaagacagcacccagtacaaaaaataaagcagggcgaacataatatattacacatagtaataattataacagaataataagacagagaatacatcaaactgacctatcccatcaataaaaaaattataaaattagccagttatttacaaaaaatatttttaatttaacttacaaagatttgtttactgtatataagacacaatgcattaacacaaggtaattcaggtggctaaaaataaagagattgacaaaagaataccagataaatgaaaataaaaagaaagcagaatttgtgtttttaataataaacatcttaaaatgcatgccaaaataactgaaggagccaagggaagactgcgtttcagtgttaaataatgaatcacagtaaagatgtaaaccagtatacacaagcagcagataagacagaaactttgtaaagcagaaacaatagtagattcaaggaaccatagatagaaataaacttataaaagtaaaataaataaaaagtcaccactgtcagcataatactgataaaactgacaatatgcaagacctaactgcatcatgaataaagtcattggtaaatacagatatcaaactatataccctaataatagagaatataaattatttttatgcacttagaacatttatttttttaattttatgaagagaacagcaataaatgccatagagtagaaatattttttaaagtttccaataataatacattaaaaccagatatctgatagtaactgcaaagccaaaggccattttaactgaaaattaaatagaaatattatattcaatacctcttgcttaaaattggtatataaaaaatgtaatgaaagaatcataatcataccatattactacatgttgtgtatctaaaacagtgaaatgcctaggtttatgcctgaagcacatataatcaaaaatttaaaaaattaaatccaatctcaacacagcaaaaaagtacaaggacagaaatcatataaaatcagaaattataagaacaaaaacagatgaaattactaattataagtcctctttttgattaaataataaaacaacctactatctaacataataaagatggaataaaaatctagaaaaattaagatgtgacaaagaaataactattgcaacaaattacattagcaaacaacagattttgcaatctttatctaaataaattgaaaacaaaaaatagaagtatataatttatcaaatttgagcccatataaagtctaaaacttcaaatatatcgatttctatagatgaagagaaatagttattaacagattatactgtataaaagcaataattctggctagtttaatcttcaaaaaccacataggcttagtactcaatgaattattccagagcatatagaatgaagaaaaatgtccaaattatttttatgactaaagggtaacatttatacctaattttgaaattttagcttcctagagccgctttcataaaattccataacctgaggaacgtaaagaacagacatttattgtcttacagttctggaaactggaagtcccaatttaaggactcagcagagccatgctccctctgaaaccttaggggaatttttcctagcatcataagaaaagcagtcatggttttctttgcactaaagtgcgagatacaaataaagacaatttgcactcatcaattaaagttaattcaaaagaacattctgaatcattttatataatacatatttataattataaattattttaaatatataaaatatgtattttatataatacatatttataattaaataattaaacaatttataattaacttattcaaataaatttaaataattaatttatttaaataatttatttaaattaaataaatttaaataattgaatgatttatttaaattaaataattcaaaaatatttaaagagtattgatataaaataaaacatatttgaaagttctatcaggattctaacagtctctgcttagttataaatcaatcaagcattttgaaaatattcaatatataattcaagtaccaagaagatataagaaaaaatatttctatggttgtagacttatgatcaaatttgtggcaaactgtacatctactaaatgagaaaataaattagaggacataaatttgaaaactgataaatatttcagtatgtcaaataaaactatctttctgatttacctaaaatgtagaattcaaagcttaggatatggtgtattgggttttgtttatcttgaagttttggaaaaagcagcatctgaaataatatatcaaaatttattatcagtgtgcaatggattaaatattgtattcatgtatagagagtgaccataagatgtgaggtacaaagtctagagttgtggtcaaatacttagaaaaattatggaaagttatatttacctctgtgttagtctatttatctgtacgtaattaaaagatataaattaattatcgcattatcttattgttatattggatattttgtaatcttcatcaaagaagataaagattttaataacacatttgaaaagttgggacttaaaattataaaacatagacagtatctgtagcttgaatggaattgtgtctggatggatacataaatcaagctgacattttagcaagtctcagatattcattgttacagaaatagagattcgaaactatttggatatttgacaaaaaagccatacgttttatcttaatatattacattatgacagagatgcaaatagtcatttaatggtacaataaatatttgattaatccaaactggcaaatttattggagcaaaagagtgattccataatttagattgagatattgaataaaaaatatatatatataatgaatcagtataataggctagtatgcataaagagttaaatttcttctgatttgaagtatgtataaagcacctagttagcctatttttagagtagctgtaaggtgttcaggcattactaactttgcagagatgacattagaagacagaaaaaaagagctggtatgattttcacttaataagaagcttaattattccttgtagctcaagcttgaacaaatggttgtattagttctgcatagcatatgatgaattttgattgtgaccttacttacaagtgaatacttttctctaatagagaatataacttattttatctaaacattgtatatttattattcactgtaaacttttgtgataatggaaatgcaaacaaaacaccccctgtagaagttattgatgttgtacttagaaaagtatagtatgatatgtactatttgattggccgtgtgattttataatatatagtataagcatatatatcttgaattcttaatatttttgttctatcatcatacacggacagtactatgctttattttaaaaaacaatatttatgtgtatttaagtattacatttacaataactattcgttatcccctataaatataagactttgcatttataagatctatattgcatcatataataacaaaataaataaaatgtatatactaatgcatatataaaaatatatacatatacataagctaacatataaacatatcctcatgactagatacactctattggaagattttaaaatggaaattaagtttttaaaaattattttgaactgaatctttcggggcagaggagtctgtaccctctaagcacaatttatcctttgtgttacaacaattcaattacactcttataattattttaaaaggcacaattaaattattattgactatattcattcattgtgatatcaaatattaggtcattctttctttctatttttttaacctattaatcatcccattaatcatgagtttgagtttttgacattgtgttgtaagcccttctcacccaaaggcttaagtgtattacatatgtattccccaacttttaaattaccaaacatagatagatttcctccatagacaaagccattattctgacttttctggtaataatttctttgctttattcagaatttcataacctgtcatatatttatagtttggggaaaatgaccacaaatttagtggcttaaaataacaccccttcattatttcacagttctattgacaagaagcagggcaagatgtgcctgaattagctgttcatggtatatcacaaagttgaaatcaaggtgctggccaggttgagttctggttcagaagctctaggataaagtctgcttccaagatcctgtagattattggtattatctagttccttgctggttgtcagctggaagtagatctcagctctgagaagctgttctcaggtccttttcaggcaacctcctccatcttcaagccagcaactgcttgtggaattctacttatgtttcacatttttctgccttccttccctgcaacaaatcctttaaaataaactatgctattaaagagataaatccctttaaaagaaactatgctataaaagagataatgttattagattaggattatgcaaataatcttcctattttagggtcaactctgccctttagcataatctaatcacaaaagtgttatacatcatattcagagttccagggaatatgcagaatggtgtataccaagtggggaggaaaatcttgtgggcagtcataaaattttgcctatcacattgcttatgtattattcttccctaaatattgcataaagttttctggtcttgagttttacataaattgtatcaaactgaatttatgctggtacttatacatttttcctgcagtcttaggtttgtgagaattctttttgatactgaaattgcactagtttattagctattgttgcaatataatactcaatggtataaaaatatgaaaaactaatttgtcctttctcctagtgataaaaatctggtttgattccaatttggagcaattaagtataaagctaacataagtattcatgtatgcatatcttgacatatatatataccagagttctttaagaatatacatttagaaacagtttttggaccccattttgtcaccttttcaaatttcttcataataacaaaccattttcaaaagtgtttcagccaattaatacatcaaaaatcagtttatgaatttctgtgtttttacaactctgccaacacgtggttgtggtggcccttcaaaaacaaaaatgtgtttgctaattaggtgaatatgtaaatgtatctgtaatggtcaatatcaagtgtcaacttgattggattgaaagaggaaaagtgttgttcctgggtgtgtctgtgagggtgttgctagaagagattaacatttgagtcagtggactgggagaggcagacccaccctcaatgtgggcgggcgtgatccaattggttacaggtacagctagcagcaggtggaagaaggtggtataagctggctggctgagtcttctggctttcatctttccctggtgatggatgcttcctgcccttgagcattagacttcaggttctttagcttttaactattggacttagaccagtggcttgccatgggccacaagctgaaggctacactatcggcttccctacttttgaggttttgggacttggactgagccactactggtttccttgctcctcagcttgcagatggcctatcgtgggacttcacctcctgatgatgtgagtcagttccccctaataaactccctttcatatatatgtgtgtgtgtgtgtttgtatatatatttatgtgtgtgtatatatacacacacacacacacacatacatacatatgtatatgtattctattggttttgtccctctcgagaaccctgactcatacagtatctcattatggtttgaattcactgttctattattaataatgagattttaagtatctttaatttttttggttatctgtctttactaattttgaagttcttatattttacttactgatttctaaaatctttcacctcccctactgcacccttatcccacttattcaaaatgcacattgcaaaaatttactcaggcttgtctttaatgtttttcctttttaagtcctaaatttgcatggaatatatggatagagatagtaatagaaattcaatttcatgatgttttccacataggataccagttttactcaaatagcaacatgaaaggaaagagagaaaaatataaaagcatcttaaataatttctatgacaaaaataacaataatcaaaactaaataaaccttagtaatgaagtgtcatccatattattgcaaatgagataaaaatgagagagacatgtaaatattggggtcagaaaattcatgttacatgtatttcaagtgtgtaaagcaaggattagcaaactgtggcctctgtgtcaaatgtttctgtacgtaagattttattggaacatagtcacatccatctactctcctgttgtgtatagttacttttatgttgcaatgacagagttaggtagttgtaacagagaatgcgtggtttccaaaatctaaaatattttctatctgccactttacaaaagaagtttgccaatcccttgtctaaagaataatgtagagtgctatgaataagcactactttttgtgtatgaaatgtaaaataaaagatattttatataaaagttatataaaagttattttgaaacattttatagccataggataactactgagccttttacagaatatgtattacaaagcctgatttatatacttctgccattttttattgttatgtaataaagttactctttagtacccactaattaagctttagggtcaaaatccatccctattaggtctatatggtgttccacaagctcacagggtgagtccctcctttacttgcttatgcgtttgcctgttacacctatttttattcattctaaaggatagatcctctccttaaaagaccagaaaccatgatacttgatgtataaaatcttttctttttaaccgtcctttaattatgtcatttcccaagtaatacactttttatgttcattccactaattttttcttgtaaaaggttcatcttgaattgttcacattttcatcacttatgtgcctgtggattaaacatcatctcaatagattatgttaggcaactgattactaagcagttattcaataaacatctttgttaaaggcattatgtgaataactggtcaccctttgttaaaagcattatgtgaataactggttaagcaaaaaatagactgttacctttgttaaagtcatctttgttaagggcattatgccaataaccagttaagcaaaaaaaaaaaaaaaaaatagactactctaatactggtttcaaaacagcctgaatttgctcatgagtgttaacagtttcttcgtagttttccctgggtaaagacaggaacaattgaatgtaatttggattccctaaacccagcttggcttaacaactttttattttatgcttttaattgacatataataattttacatatttatggggtacatagtgatgttttaaaaaaataatatattatgatcagattatagaaattagcatatccattttctcaaatatttaccatgtttttgtattaggaacattcaatatcttccttgtaactttttaaaaaaggattagatctattattacatatattgtgtgatggttaattttatgtgtcaacttgcctgggctaaaggatgtccagaaagctggtaaaacattatttctgggtctgtctgtggaggtgtttccagaagactatatacaatgtattacatggtttatagttcaagcgttttatcccttccaatgttgagatgcatatagctttttccttctggaattaattccaaaaaaattaaggaatagtatacatatctttgggtacactaggttttgcaacaaccttcttttcccctgctgtctttcaaagttatcttcataataaatcaaatgtctgcacacatgtagacttaaaaaaagttttttttttgctggctctatcctgaaatgttctattcttttgctgataccccactgtgtcaaatattgtagtttataatatccttggtatttgatagagtaaacacctgcatttttcttcttcagtattgtgttgattaatcttagttctttgcatttcattatatttaaaatcagcctgatgatttacacaaaaacgaaaactattttattgatattttattgtttcaacagtttgaagagaatttacatctttaaaatatatcctataagttctatcaatatacttttgtagttgtgcattgcttaatatccaaatgtttgaatatacacaaattgtctttgtattatttattcttagcttgattttgctgtgttctggtaatatgatctaaatgtctaataactataaaatgactaatttatttgcctttaaactacttttctgtctattcgacccaatcatggtttgtatgttgtgctttcttcatttcttgatcttttattagattattagagtacctttatcattttattttccctattactatttgtttaattattgggggagggtgctatcctagagattgtagaatgtaagcctgacttaataaagtctaaaattaatctgtgctttaacagcttatcaggcagttctttttccatcttttacactcaacatgccatattacagtcatggtcatatatttttattttgtatgcattttaaacttaacaatgtattttaattatgtttactacatcaatgtctatttacatatataaacatatttatcttttatattgttctttttacctatctgagttttcatttttctacctgggatacattttatcagtctgaatattcccatttttttagctctactctgacaaattatgttattatttatcctaatttatctttatgttgtcttcatttttaatgtatatttttcctgtgaacagacttctcagctggcagtcaatttagctcaacagtttaaatatattgcctccttgtcttcttttatataaaatttttatatactctgtaataaataagctatctgtgaagttgcttttttgcattatgatatcacttttttatgaattaaatattttttgtctcttttttccagcattttaacatttgatatgcctagatggttttttactttactttttaaaaaaagctttgctttaggtttatattgctttctgcatttgtgatttagatgattttatcacatgaaaataatcgtcagaattcttgcttggttagttctcaacaactcctcttatttcataatcagcaaaacctgtggcaaagtggatcttaataattttaatcttaaagcctctggcatttctttcatagataaaagctctgctgtccttctctaacttgattttcttccacatttatgttcagatttttaaatttattctgaggttgagagataatccaaaacaatgaaagctgttatttctagaacaataatacaaataaagttttagagataatcaatagtaatttttttctaaaatatcctagaatctcaaaaagttcaatacataagttactaaagcataattattctgaataattgttgtaaagtaacacctggctttaaaagaaaatctgcttacaaatatgcctattattttcttaaatatagaattatggcgagaattacggttaccaattcgactatgagaagcttcataatatagtatcttcataaaaacgcacacacaaaaatgtttggaatgtaaggaattccctttatagttattagcctaatatagtttgcatctattgtgtattagtgtatactagataaggtagcatagtatatataaatatacagttaatagcatatataatttgaaggatgaatttgtgataaaatatatagctatttactctttcatatatatttcaagtaacttcatcgggatcctaaaacaaattgcagttgttaacatttgagaaggatgacgttgctcttactgatcaattttgtgagactaatattatttaataaaatttgttccgttgaggaatgttaatgtgcgtgccctcaatgtagaagcattaagaactttcttgtggtggtgcttttttttttttgagacagggtctcgccctgttgcccaggctggagtgcaatgatgtgatctcagctcacggcaacctccgcctcccaggttcaagcgattctcctgcctcagcctcctgaatagctgggactacaggcacccgccaccacgcctgactatcacggtgcttttaatcaataaaggactgtagttgatgaacatattttttagttcctttacaccttgggtgggataacctaaggtgtaagggaactaaagacatgcggtacatgtcttaaactgtcttccgatggcaccttcagaatatctctctaggaacttgttttgcttcactttctcatttcctcacttccctgttaaagtttccacggatcccattccaaacgaaacacacgtgaagtccaaccctgttttcagagtctacccaaattgacagaacggcctttcttgttccctttgtttattcagcattatcttcctaatcctcaggcactggcttcccgaatgtgtcattcctctcaatatgcctttcacttgggtcattctttatgtcgtcccatcctgtgccatgactttatcccttttctgttgagactctaatttacatcttccgtctcttcccctctctcggaaccctagacacacgcatctactgctcactcaccatttccatttgcaaacctaaaaaaattattcaacttactgtgtccaaatttaagccttacttcctctatcacccacttatccttctgggtcctaatttttttcttttctgggtaatgtcaactacatttttgtggcttattcattacaaattatttagagccattatttactcctgtctttcaaaaaaatgtttggctgagctgatagggtcatctctgcttttgaaatgcagatgaaatctgaccacttattttatacttctgcccttgtcaaaactaccatatttagattccaatatatttttcttatttcctgccttgccactctaggacagatacagtcatcttgtaaaaattatgtcagaccatggtacttttctgttcaaacctccatggactctttgtcactcatgttaagatataaatatcctactttggtttatatttcttgacatgatctggcctctccacccactttgaacatcttctgtcactggcctcgtcactcactccatgcaagcctgtggccttcccatggtgtctgcagcacatcaatactgctctttcctctaagcaattgcttttgcttttctctacacctggaagactattccaaaaaatggctccatgatttcttctctactttattttcttgctctctgtaaatgtctatctgagagttgccggaaaactctatggtaaaatgatgttcctgtatcattcgttatttccataccctgcttactttgcttcataaaattgattccaatctgatattgttttatgtgtgtgtagtgtgtctgtacttctgtgttgttttatttttttctcctccattagagtataagtactatggtggcagcaatattgtctgttgtgtcaggtattgtatcaccagtgcctggtttatagcatttgtttaataaatacctgtctaacaaatgagaatgtggatggatgattttgctgcagtataagttaaaagacagtggaacaatttttataggctaccaaaagcaaaaaaaatttagtactaagttgaacaagtagaaggactctgaaatggttttgttcttatacaattgaagaaatcaaaaagttcttttatgatattttctataatatttctaattaattcatacatctcctctagcacattgtaaaataattaaaatgcaagaacaaaagggaaatacatacgttgtccaaaagatcaccaggatggttaagtattaatagtaaaatggagagctttattggtgatgttggtttgcaaaatgggaagagacaacaatctctggtgtgtgccaaaggtgctctctctcagaaaaggggaaaggcaggtagttttatgcctcacagggtctgtttcacacaacagagtcatacatattcaccaagtttggggagaaatttatagatatttatgagatagttgagcacatgagcagtgggttaaatgtatatgtaatatacaacccatgctcactttggggtaagatttcaacattaaaattaggtagaatttggctctttaggtcaaaaggtgaacaataggacacaaagacagttcgtgtgcagtctatataagctggctgaaactgacttaaagtctgcagttccttattaggaaagaatatttgtaaagcccttcctctgtccagtcagagttgtagtggtctgggttgtaaatcagtgttaagaggtgtctttacatttgcttgaaagctctttttcttacagagtttagcaagaatgagatttttcttacagccaaaggaatttagagctttgccatgccagccaattcctgaaccgtcaactcatagcaaactttttttccttaaccttggggtccattttagttgataaagttatgtctattttgttctttcagatcacacatacatatccaaatttatgacatgaattattattcacctcctatcgttattagcttgtgtatatcctttacttatgaccctggactgagagccaagtattcatccataattactagattggtagtagctagatgagttataatttgttttggttatttttttctgtgattattttatgtaaatttgcatatgttatacaaaaatgtgtatgtgtgtgtgcatgtgtaggtgtgtgtgtacatgcctatctgaatttcttttgggaaaaaatgtttctagtttttagaaaaaatttagaagtcaatgtataaaaacccttaagaaaacctatggatatctgattcgaagcacatacttgttctgtagatatacagcttgtaaaacataattaaaagcaagatgaacatatggatatatatttatgtatatatatattatgtatatatatttatgggactggaaaaaggcctgatgtgcaatgggtaagaaaggactgagacagtgaatcttttggttctgggtctggaagaaagcaaggaaggtgagttgtttcctgttcaagagtctgagactaagtttgctccatggaaaacgtgaaacttcagctaaggtaaacacaggaacagatggttgtctcgttcatgtagaatctgacaacactgttttcctctgctacctgaggacatagctccgttgaagtgtattgcctaaggaagataaaaggcagagacaaagtcttcaaaacaggaattgagtaagcacacacgggcagagtgattggatttgtgacgtcaggcgctgactcaacgatacggcctttgggctcccagtgaatagaatcctcaggatatcagacaagagttgggaaaagacgacaagataaaagagactaaaaacatatacagaaatgcacacaagataaaactttaaaccagaattacatgaagaaatataagaatcagaagttggattcactgtcggcaaaataaaaacattctcacatttacagagacacagagagcatagctatccacagtcatacactcaccaaaaatattattaatttatttcattaggcagaatatgcaagcaagtgtaaagaacaataatgggcaaatcaattcattaatgcgtataataagtcacggactttaaaaacattaacaaattttctttgtaattttaaaaacaaatgaacaatgtggactctataaaaagaaatatgtacagagctcagggttttttggtgctaaagtatactaagatatataaagaacagggtagagattctgagacattttaaacttctagaaaatatagcaaaatataaattttaaagagacatatagacactattggaagaaactatgcttcacagcttctaaaccatcagaaataatgcgtcagagggaagtgtatttaaaaaattgccttgagctaggcacagtggctcacacctgtaatcccagcactttgggaggccaaggcaggcggatcatgaggtcaggagttcaaaaccagcatggctaacatggtgaaaccctgtctaaaaatacaaaaattagctgagcatggtagcacacacctgtaatcctagctactcaggaagctgaggcaggagaattgcttgaacctgggagacagaggttgcaatgagccgagattgcgcccctgcactccagcctgggcaacagagcgagattccgtctcagaaaaaataaataaataaaaagttgcttttgggaaattacataatagaagaaataagaacatggaaatttagattcctgcaagacaaaagaaaataaggaagaacacacagctattcctccttgctaccctccacacaaacaacaaacaaaccatagaaaaaatcacatacttcatcacactgacaggtcaataaaaagaagaatcttataaatcagtacagaatagctccttacaaacatcttagtaactacaaaagaaaagacagtaatttacagtggagaaagctggcagacacttttctagcgagtgatcatggttaaaatcacagctaatgagacacgtcaataccacgtgccagctgatctaaggcaccgcaaagaacacagcatcaactctgtgatgttcctgcaaatattatgtgacttaaattaaatcatgagggatgattagaaagacctaattgaatggacattccagaagatagcatcctcctatctgcaactcactgccaaatgattctagagaagaaaaaaagagagagaagggaagatacgtagaggacataaaaatgacagagggggagagagacagagagaaaggaatagagaaacagaaaaaataagagtttgagagatattaaaaaatggtaaaatactttgcatatgcaagaagtgggggaaaggtatacagaaaaattacaagaatttgtaaatttttgtaatttttgtaatttgtaaaaattacaaattcttgtaatttttctgtaagtgtaaaattaaataaaaataaaaaattttaatcataaaacattagagattaataatgttttacttttctattttaattcataaataataattgtatatatttgtggggtacactataaaaataagtatttgaggtgatggatttgttagtaattattaattttttaaaactcatttagtaacatacttagactaggagtttcgtgtttgttttaatgagctggttttggggaaatatagcataaaatgagaagaaattcgataatgtataaatgagaagaaattagataatttataaaatggaaaatacaaaaaacaaaaccactaatatttcaacaagaatgtaaaataatgagggacttctaggcattaatatatgctcaaaatgtaaaatcataattcacagtagaacaagaataattttataaataacatattattgatagaatttaacctgtttaaatgtttttcaaccaaatggaaaatgaatgggaaggaagccaatacataacataaaaaggcaaagttaaaaacataaaagaggaattttgaaagattcctgagatagggaagaatccagaatccaatgtggagcagcttgtcactatgaaaattaaagaggaatcctgggactgataatccagatgatatggatgtctgtgtgcgatcttcaatatgcctattttgagataatggcatttggacttgccaatagaagattttgagttgagagtcctctccatgcagttggtagttgaaaccaatggaaaaaaaaaaaaaaaaacaacacagagaatgtgcatcagatttggccaagagtgagtccaggacagaatacatgagagtaccattatttaaaagaaagccagagaataaccactctgaaagtgggacagagtgggaattggcagacacttgtgtgagggatcctggaaagaacagaaagcaatggactgttttaacactgggcacagtggctcacgcctgtaatcccagcactttgggaggctgaagcaggtggatcacttgaggtcaggagttcaagacccttggccaacatggcaaaactctgtctctattaaaaatacaaaaactagctgggtgtggtgataggtgcttgtaatcccagctactcgggaggatgaggcaaggagaattgcttgaacccaggaggtagagcttgcaatgggcctagatcatgccactgaacttcagcctgggcaacagagccagactctgtcccctccctaccacacacacacaaaaataaaaaataaattaaaaaaaagaaagcaatggactgttttaagaagatactgatttagatttaaaatgcatttgataatgttctaatgttatctgttgaggcttgctaccattacaaggccaaagctcattgacttgtgaaggcaaaagccagattgactactattctagtaaatgcatggaatgagataagttttcatgcttctctgcatgtgggccatatacatatatgtgtgtgtgcatgtgtgtacatttgtggtacctaaacagaaactatacaatagtgttggaatgtaaatagagtatgtaatgttaaaaacaattagattggtttatttttagtttaaatttattttttctctatataaaacctgttataatatagaacctggcacatacaataacaagtaactgaaattagtcgctttgtgaaaatgtgttattattcagtgactttttacattattaaataactgacgttgctaagacatatatatgtatatatgtatataaatacatatatgtgtatatgtatataaatacatgtatgtgtatatgtatataaatacatgtatgtgtatatgtatataaatacatgtatgtgtatatgtatataaatacatgtatgtgtatatgtatataaatacatgtatgtgtatatgtatataaatacatgtatgtgtatatgtatataaatacatgtatgtatatacatgtatgtatatatatgtattatatatatgtatataaaattaactttgtggccttctggctctaatttttacattaaaagtaaattcatataattatgttacagcccccagagttttttgtcgtgcactcatagataactaatgggctttatccagcttacagttattttagcatgttttcaagagagcaggcttattatctatctttacttttattccacgtaggcatgcttttgcaatctctacagttactccaatattttagacttatagggaaaatgtaaacaaaccaaagcttaatttttcctcaacttgaaattacactgccaccaaaccttgttattctaccctcaagagaattactagatcatatcccttcaatttatatattctaggaaaaataaacatatgtctactttagcctatctttcctgaatttctctacatctctttgccaagatttcatacaaaatagttttctctatcttttgttttattacttcttgcctccaaaagaaacagcaatcacaaacactatgcctagagagtattaaaaagtgtcaaatcatcagctttccattgtcctatttttacaaagcagaactccatgtggaaagagagcatgtcaagcacactacattaccatgtgatttaacatgacaaattgaatagatctgatatgggtaatggaaacattgatggacctttaaatacagtgctcaggttatgtttctattcataaaactcatgctctccggatgcatcctgaaacactctagtggcttaagatgctagagttaagaaatagtaaatgccattttaaggagagagaaacttttcacccatttaaataatgggaaggtgaaaggtttgtttcatcagtcacagttcagtaatgtccgtcttcattgttgagtcaatatgtacttcacgtccagtccctgaaggaaagagaaacaaatcaaaacactactctgacatcagaacatatttatgaagaactctttctataaacttttgtcaattttccatattaaccataatgctgccagatgattacatctttcattgaaacataacaaaaactttacatttgggattcagggtggtattatttatttttggagggctttgtagagtcaggctatcaggtgccagttgacgttttttattaatctggatagcatgatattagttcagaaggcaatttccatttttaaggttatgtctcagaaaactgtaaaagggattttagcatgatgaaaactttgactattttctcatgagagtctatcaaactgtaatttcaggttgaattttaagataatatcagatgtgtggattgtgctttaacaatcagtaaagtgccacaggatctcaggtgtattttatgaagaactttgaacctgacaagccacaagttaccctagtcagaaatattccctctaaagaatccccagggatattatactctaggagtataaaaatataaagctgggcttggcatatatttagctagagaagaagtttgaagtctttctgaatctactcaaactcctgtcacatggccatgtcattcactttttgtgattatctcacatctctgacttctgtctttgatgctgtttattttgatcttgtcttttgtcttctggtgagtgtccccacactgtgtcatggcttccttatgttagttcttgtcaagaagataggaaatgatatttcagtgcaaggcactgaggatatgtgtaatgtatttggaaagttttgacatcaaaatagtacttttagaatcacattaaataattcaattaaaaaagaaaagttaagccaataagataaaactggtgactatgacaatcatcagtgtggcaaatttggcactcattataattagcaataatattcactaaattttaaatgccatttcttaaatttcaattttgataataaataattatagtaaaaacagcatggaatttctgggatactcttgctaatcagtcaacgttcaacttcaagaaatgctaactaaatttaaaaagaaaaaaatttaattcatctccttcatggtgatcttcctaatttatatatgttttccttctgttcatctttatttttgaacaattaatatttaatctctccattattgtctccaagaacctttctgactgctcaactctttcagtggtattccttttatttagttccttggaccctctttaaattttatttcttttattcattctttcttatcaattcgtttgctaaatatgctaaggtaattcaatggggaaatggcattaatttcaagaagtttatagaaagtactaaatgtcaatatgaggaaaaaatgaacctaaaaactcagtttatgccataaacaaagattaaagtggatcatagacttaaccattcaaacttatacataaaagtcctagaaaacaatatagaagaaaatttctataatttggggagaaagtaaagatttcttaaatagaagagctaaagcaggaacaaataaagatacaataaatgaatcaatatattgtcttcaccctataggcatcattaagagaataaaaagataatacacaaattgggaagttattttatattccatgtatctgttaaaaacgggtatatagactatatacagaactatttaaatcaaacacaaattattacaaataagacataaaagcaaaatggacaaactatttgagcagacatttcactaaagaatgtttatgaatggctaacaaatacataatcccattagtcatcagataaatgcaaatttaaactgctactggatactaatgcatactccttataatgactataagtaaataataaaaatatcaagagttgccaaggatgtggagcaaccaattttatatggctggtgggaaaaatatttcaactacgttgacaagcaatttggcaatttttaaaaatgaagttaatgcagctgggcgtggtggctcacgcctgtaatcccagcactttgggaggtcgaggtgggcagatccatgaggtcagcagatcgagaccatcctggctaacacagtgaaaccccgtttctactaaaaatacaaaaaatgagcctggcgaggtggcaggcgcctgtagtcccagctactcgggaggcggaggcaggagaatggcgtgaacctgcgaggcggagcttgcagtgagcctagatcacgccactgcactccagcctggtgacagagcgagactccatctcaaaaaaaaaaaaaaaaaaaaaaaaagaagttaatgctggtttcacttccaggtatttgcccaagagaaattaaaatttagtttatacaaattgtttcaaatgaatattcgtagtaattgtattcctaaatacaaaaatttggaaacagctcacatgtcaattaacaggtaaatagaaaaacaaatttggatatattttgtaaagtgtaatacttctcatgcatataaatgaataaaatgttgatacgcacatgatatgtccacctcaaaacactttgttgagcaaaaacaagccagtcaaaagtgtgcatgctgtgtgactccatttgactcctcctcaccacaagatcggatatgtcccacagaaagacttcaccttcatctctgatctcaaaatgagaaggcacgtggatgagatccaagcaaagctaagcagactcaaccacagtgggaagagcacagctgccgctgcagacggggcataagaagcaaatcttttgaagaagttactgagattgagatttttgttatcgcagcaaacctgataagcacaggaaaatacaaaagacccagaagaaaatggatacaatttcaagagtgatttctttaagtttatgggaaaaggtatgatctcatacacaatgcctatgtctgtgtagaatataatccaatgtaaactggaacacatggaaaaaaaataaattacataaaataattgtatttataaatatgtatggacatgcagtaagaaaccctgacatgtacatttacacctttcaaaaaatgggctggaaagtttatttaaattacttgaaacatccatccttcagtaatggagaaatcacaatgacaaattccttctatgtgtctcttttgaaaatttaattacctttttgttaatatattatttgattatctagaaaacttgattaaatttcttaatataaagttacactcttctctatgatagtagatgttattttaatttgtattttgtgtagtaaacagattcctaagaaatatatttaagaccaatctcttaaaatcatactacagatagatatttgagggtggtttggagatcactataattagccttaacatatatctacaattaaactccatcctcttacactatgcatatcctcaatctccaagttatgcccatctcttaaataagtcccagaatttctatttttcatgttgactaactcttaaatttattcagttcttctaatttatagcatacagctttatgtattttttctttatttcatttccttgtgatctgttttctcactactataaaaatagtgcttgtaaaataagaatcaggatatatctttaacataatcagtaatgtcctataaattccaaaatacctactttagtgtttaagtaattcatgatctggttcctgtctaaatttgcagaagaacctttaattttacttcagtacatgttctataatctgaccatatatactaacatgtactgaattgttatttgagccaaactgtcttctaagaactttgcagatattagtacatttaagaatctcaacaattctatgggatagaaagtctgggagcagtctgtctccgaaaccaccatgatctaacaagacttgagggtcactgcaaacacggtcttacaactttttactaactttataaatttggtatttcccctatcttgaatgccccctctccctgtatataaatagaaattcatttttttcaaaatctattaaaatccttgcattttgttaaattgttaacattttaatttaattcttaaaaaaatgtaaaaccaaaatttagtgtttaattcactgcctccttccttcagtagagaatacattctttgagtattggcatgttttaccaaactttaatcttcactgaatatcacatagatgtgttttgtacatgctgactgaataaataaaccaaatttatgcattagtactgaaaatcataagccaaaacatttgacacagctttgtcaagaggacaattgggacagaaaggtctggagtttataaggaatcaacataatgtggctgtcttcattgagcactccatcccacaaaggatcgttctgaaggtcatgtcttacattataaatatttttcattcaatacatagagataagtatgtagctttgggaacatagggaggtttcatcctctctctctctctctccccctctctccctctctccctctctccctctcttcaaattaaaatatgtatctctccagtccattctccacttctgcagcatcatgtttttattattcatctgaatgggtttgactttatccagtattcagtaatccttgattgtcttctagtttgatcatagagaaactgtctgatgctgaattctatgcaatttcttaaaacaacttgataatcagtcataggttttaatttaaaagtctatgtaaatcttccctgctctgcaatgtttaaaaacatttagtaactacagagaaacatatatactatccaaacaacttcatgataatattgaaaggccatttacattgcgtttttatttttttcctttttctcaaaaccttaaaaactaaaacctggttaaagtgcaaatatccatttctctgtgagtatactggtatagtattataattagatatcaaaaaggtttagttatacttttgtcaaaatcctggtagttttttttttttttggaaaaggaatgtaaaatataattacctactcccaatacagataatatatgcacatctaaaacatacatgtgcacatacacccataatcatgcacagacatacctatgcacattaaaaggtaaatttaaattttaagctggtatagttctgcaaaaggttgtctaagtttttctctgtgcattctgttatctcaagcgaatatatccgtttaagttggccacttacgatggcatatttcttccattacatatcctgtgtagacaagtaaaaatgcaaatgcttcttctataattatgaatttcaatcaaatctccttttttaggtattaatttttctacagtgaattatgaagtcccaattactcatattgcccttactacatacattagtcccacattacacaaacataaataatattataataaactactaaacaaatttcattatagtaaaatccatgattaaatcaaataccagtaactacatattataaaaatagggcgtttatgtatcttgtagcccttcttgactatgagctgatcaaaagtggaaatttattttatttactttttttttcaaacccagtaccaattctttgccttccataaaagatgatagttacttaatgatgacttttgataaagtgtagtttagtaaatcgtacattcattagaattttgtgaaaattgcttaaggaatcaggaatcaaaaaagatttattatcaccttagaaaagctatttaatgattgaagcttcatgttcctcctctgtaaagaacaaaaataatattaactgtgattaaattacctaatgaatattgataggttttagagatgtgacataaaatttttgcatattattgatatcaataaaactatgatgctaaaaacattgctaactcacagctatagacaggaagggttctaaatttctctgtaggacatttgcaaatacaatttttgttattttaattcattgaaacagaagactagaaacctgtttgtttctggtttctttcaactctgtggattttgagttttaattttgtaaagcaaagtcaaagattacttactctgatttgattttcagttcatttgtagaaaatgcatttttcaatgaaaacaattattttgaaatattaaaattagtatatccaataaaatgaaaagaacagaatctaaaaatatttttaaaatatgtatcatctacctaaattgctatgagtactctaagttctatacaattttgcttagaaagctgtacttcaattttctttatcaccttttttttttttttttttttagacatggggtctttgctctgttgctcaggctggagtacagtgccacaatcatagctcatttcagcctcagactcctgggctcaagcattcctcccacctcagcctcccaagtggatgggactacaggcatgtgcctccacacctgtcttgtacttaaattttaagttaaattgagttaaatttaataactagataatttcaattatacaatcatcactacatttgcaaatacatcttttctacagtatttaaaattatctgttttaaataatacagacgattttttcttcttaatcctccagagtaatatattgcataatacatttaaatataattggcctgaaatttttaaatttcttctgatggaaaagatatgtaactaacttaaatatttccagcagaaatatgacaaagactattgcaataatcttatccagattttgcatagttatgttttaaaaatctgaggtaaatttaggaatattttgatttattttttcctttactttcaaatatatcagctttattttcatatgtaatcagagtgctttgagagctcatatcttcaggtgacgataataccttaattctgaggcttgctaaaatacaatatactttgctcactaggagaaaccactcttagtagcatcatattttttcttatggatactttcctccctttcaatatcttggaatatttaaatggctcttacgtctaccagtagtagtagtggaaatcagaagtgatcaaaattcttgttatattttgagggctgggtaaaagaatttgctaatgggctgaacatgggatatgtaaaaaagagaagtgttttgaatgaatctaaggccctattaaataaagagatgagatgtcaagtctttatatataaaaataatgcaagaagaacaatttaggaactgggaagaacaggatatgtataatcatgatgtcatctttcatagagaaaaatactttttcatgtctactagagatagaatgaaaatacttcatagaggattgtttaataattttataaaatgttcaagggatgtcaagtaagttatttttatggaactggaattcaggaaaaacatctggttggtctggtctatacattttgaaatcattagcagttaggtgatactgaaaattctgagactcgattagacaacttacaaagtgagtatagataaagaagagaagaatcattagagaaggtcctgtgagggtaaaaagatggggagaaaatggaaaagaagactaaaagggtagttataatctggagaataacaaaggagaatgtgttctgctgctatgcaaatgaaacgttgatttagaagagaaaaatccaactgtattaaatgaaattgaatagtcaaatacaaccttctcctacttccgatttcagctgctcacttctatggtcataccttagccttgtcattaataatacggaaatccttcaattatctaaatattatctccctttttcatgccaacttctcagtttccaccttattgcttctattatcccaatttaactttccttcaatgatactaggactcataagccattagttttatcacctatttaatgtatcacagtctcatattcctttatataacattgattatgtggttaatcttataattattcccctaccaataccaacttccctgtcctaccttgtgtattgctacattgtatctctggttgaattcaactatatgcctgtctcatgcttgtgccctcagtgctgaacatggctggagaggcacaaaggacagcagagacacttggctgtcactcctcactggtcagttacttcacaacatatgcagaccgcttagggcccagaatttgtgcattgccttaggaaattcactctcctttctcctgaagatatgtaacaagatctgtcatatgtcttaatcctacattgccttctcttcctacttaattgggaaataatgataagctttcttctgtgttcaatgagaaactaggaaacaagaaagccatagtattatccagtgtcaccaaagttaaacaggtttcttccagagtataagccactgaacttctcttttttatttttatttattttttttagagcattaactttagaaagcttgtactagtaaatcctttctctgcccatttgagatgtaaatcttttttaaaagcctctaaccagttccaaacccaggaatgtctttctcaaggacctgggatccatctcttggaaatgtaatcatcagggaagatagagcccctacctcccagcctctgtgggagaagagaagcctaatttcagcaggggtggcttgctccaagctgttaaactactccctgtcacgaggatagaagaaaatttacttatcttttttggcaaagctaatggagaaacgtgaggggcctggtgatggttattactacatctctgaagctaggaactattggaacgcagatgcccaagtcagaagctcaaattctctctccaggactgccaccacacatttctgaagggccactacaagtcagaaaaaatatataaaaaagagtaggaaaagtcattttctctcagattgggagtcagatctctcaatctgaaggtaagtcagttgaagagagaacctgagaaatgtgatcttcaggcttaccactgtggggcgcatagcatgctagaaaaaagtaagtatgaggtttagaagtggagaaatatacactttccaaaatagcctctggatatttagtatttaaccacatttaaatgtacccttctatgcataaataaacttctgtaccagaagagcaaaaacattatgcatctacgtaacaggaagcaactgtctttgtgaaaaaacaaggacacacttaacttgccctccaaagttgagacaaaatacctcaagagaccctgtgttcatttctggttatgttaaatacccctcctcttctagttcgttcctcatataacctgcatattctgtaacataaagggaaattacagaaatgatcacaatcgttgatatatacggcgcgattgtgtaatttgtctttgaacgcttttgagagtgaaaggatataataactactcctggataacaagcagtaactagcaattttctgggcaaacaggtatctgtactgcactctttatataaaatcattttaaaatgggaaagaaaaatttgattatatgtttaagtttattacaaatatgaaaggaaatttacatagaattgactatttttatataaatggccatatttgatctttatcacttttctcttccattatgttgtattattctcagcaagtacatcagtaaattgttacttacataatggggcaattcaaattttagttttgcaggatatgagacattgttgctattagatttataaggttactgtaatcctaagagtactaaagatccctcaagaggatgccctgagttccagacagattctttatgtgcatttctcctgataaacacatttaattataccagggtttacaggaatcccttaatttcctgttggctcagtatcaaaatggtcaaatattacattataaccgtaaagaatcattgtgagctttgaaataaatctttctttggaattaaaatatcaaaaccactaaaattcaaaatattagggaaagatttaaatgaaggtactgttacgtataataacataaggcattcccacttagattttaatttcatgtattctggctttgagaaaagccatgccaaatgttgctctctaacttaaataattgattatgttcttggggtaacaactgaaatttctgcatttcacatagctgcaaaatgattttcttgttagaaagcaatgttgtataggacaggataagagtgaattgcaggaattctgagaagatggtggcaatatagatggaaatgtttaatcttcccggacaaagcaactggaataataattaaaaaaaactacacggacaacatttgcaacaaacgaacaaacaactaggtctgtttcagttatatattgctgcaaaacaaatcaccttacatataaatgccttaaaacacactttgtattatccctcacaacttcacaggtcaaaaatttggggagggctcaagttagtaattccactgtatgttgcattgactgaggtctcttagtgatattcgactggcagctggtctgatctgaagggccaaacacatcatcccttacatacctgtgaccttaaaaggaagggctgaaatactgaggtcagcttgaactatcagttagttgacctactcaaggactgtccttcatattatcaaaagggagaaagatttcctatgtgatagctccaggcttacagatgagcattgcaagagaaagaaaataaaagctagtagtgtcttgaggaatggtatggtgtcatttgcaccatctgctgtttatttgtctgaacactcatgaggacctcccgagttcaaggtacagagcatagacctcatcttttgacagaaaaaaaaatgttaagaagtgacagccatatttaatctgccacactaggtgacaacacatgctaataaatgccaaaatatgagcaggtaagaataaaacaaaaccaagacaattattgcattgttacgttaaaagaaacaggaaaggcagaagtgcttgtgatgtcccagagaaagagaacccccaaagtgctgttgcagtgtcactggaaattttggaagcagaaattgggaaggcaaactgcagactggaacaaaactcctactcttctcccctaatttagctcctcttaagaaagaggagattcttctctctaaaaggcaccaccaccattcttgtttctctttctgcctcccatcaatcaactcgcacacatcccatttgttctaccttcaaagtacatccaaagtctgactgcctcccttcaccttccattatttcacacctctgatttcaatacatttcgtatttaccttcccagcttcttcctttgactttttattacagaccacactcaactcctaaagtgtttgtcaataatcctttcaaaacacaattcagatctggattttgtagtaagcaggattaatattcctttgaaaggcaaatcaggtatttcttcattaccctgctgaaaactcttccagtacctcccatcatccttagtaaatgcatctcttgaatatgaatggcctctaagccctatcaaatctggttcctttcagtcctccaggactcttcctgtactgttctctcctgagctcactgggataaaacatagagctcctgctgcttctagagcctgcctcacctgagcccatccaaggccactatgctttgctgttccagctggctggaatctcttctctcctatgtgcacctggttctttcctcaacattttcaagtattatctcaaatgttactttgtcagtatatgaatctttggctaccctaattacatttgtaatccccttctggcccagcaattcctaattttacttttaagtaatttagcatggtatgtattcaacttattttgtttattttctaacgtttcacactaaaatgtaaacaccatgaagtcagggctacaggaatttagtaatcttaagtaatttagcatggtatgtattcaacttattttgtttattttctaacatttcacactaaaatgtaaacaccatgaagtcagggctacaggaatttagtaatcttaagtaatttagcatggtatgtattcaacttattgtgtttattttctaacatttcacactaaagtgtaaacaccatgaagtcagggctacaggaatttttatgttttgctcatcactccaagtacagtgactggaatagcatctggtacatcagagataacgttgagtaaacttgtggagggatgaatcaattaatgaatggcaagaccccactgtaatcgtaataacattaggggatatctacttctcatttcatatatttccaagaatctgtttagaagtaaacagattctgtttagaagtaaaaattctaaacagattcttggaaatacatgaaatgagaagtagatatcccctaatgttattacgattacagtgggttcttctcattcattaattgattcattcctccacgccaggcacggtggctcatgcctgtaatcccagcactttgggaggcagaggcgggcggatcacgaggtcaggagatcgagaccatcctggctaacacggtgaaacccagtctctactaaaaatacaaaaaattagccaggcgtggtggcaggtgcctgtagtcccagctactcgggaagctgaggcaggagaatcgcttgaatcgggaggcgaatgttgcagtgagccgagatcacgccactgcactccagcctgggcgacagagcgagactccatctttttaaaaaaaaaaaaaaaaaaaaaaagaacttttagcaatagttgttctcagttttgaactttcatgataatgtagaattattttctaagaagaatgttttaatcattgtaattcatatctatagtctgcaaaattttcaactaacccttgtgagctcaaaatatctgagacaggtcttaaagatgtacccgtgacagtcctgatggcatgtgcccaaggcagtcagggtacagcttgcttttatacattttggggagacataatgcatcaatcaatacatgtaacatttacattggtttgatctggaagagagaaggaggatggcttccaggtcataggtacatttaaacgttttctgattagcaactggttgaaagagttattatcagtagaaagaaatatctgggttcaggagattgagaccatcctggccaacatggtgaaactctgtctctactaaaatacaaaaaattagctgggtgtggtggcacaagcctgtagtcccagctactcaggaggctgaaacagggaaatcccttgaacccgggaggcggaggttgcagtgagccgagatcgtgcaactgcactccagcctggtgacaaagcaagactccatctcaaaaaaaaaaagtctgggttataatgaggtgttgggggcacttaggttttgccatgcagatgaagcccccactagcaggctttagagagaaaagactgtcatgtttcttatcagacttaaggtctgtgttgatgttaatgctgtctgggtgtaatgaggcatgtctgaccctcacttcctgacatgacctgaaccagtctttcaggttaaattttagagtaccctggctgaggtccattcagatggctgcagggggctttcggtttttatttttggttttcaccttacatgaagcatagaatttgatgtatttagggatggtatgttacagatatgttactaatattactgatttttctgggttttatgaaaccatgatgaccagttgctgccattttaaaagcctaggaaagtgaccataattcagagagtttccaatttatgttatctccaaattttgctgatatattgttggttatacataggcaaagttaaaacattcgttcagaaataaccattgtcattatttattgagtgtttgttcactgaatagtctgacattttccttcatagaaaagtagtgatttgccatcttgctcaagcataactttgctttgtgattttgtgacaatttagcttaaaagttactgagttttaattaggctaatagcttaaaattattgttttgattactatataaatttattcaaaactactatagtatcctgattaaaaagaagagattctgattgaaaagattggaaaagaaagtcaaatatcaaaactttttgtaattttaattgtttttagtttttgtaggtactgattaaataccaaaacttgtagcaccaatactcatatttaaatttacatttatgcatgtaatacagtctaatttcttgcctagtccaggttcctaagttgattcttggtaatgaagtcaactttttctaggtatactctctaatggaaatcattaaatacccttaataggagtgtatgtatatgtgtgtgtgtgtgtgtgtgtgtgtgtgcccatgcatgtgtgtgtacatgtatttcatgtgaatgatttttcaaaatgtgcaatcagattttattaataagcacttcatattaaaacaatgtattttgataaaacaatgcatttaatcatgaataaaagtgttctttctacacctttaatacatgactgcacatactaacatttgcttcctaatttttataatatttgaaaccagaaagggttaccatttttaagaaaatgaaaactgtaaccctcaattgtctcttaatatttatgtatagcttcaaattaagaaactgaggattttcgtcatgctttcatggattttggaagctggtcattcttgctcagtttgccctttgatagttagtagaactgcaaatttaagtaagtcatttgcatttatgtatattgaggttttccattataaaaagggcataattgtaaaaagtgaaaaaatgtatatcaagaacttggcaaagtatgtggtaaaaataaacacacaataaatagtgacaacagttatttttgagtgaatgttttaacttctagttggagggtgtttatcaattgtatattctttttttttttttttgcattttacacctgtgtgacttttattttattttatttttagttccaggatacatgtgcaggatgtgcaagtttgctacatgggtaaatatgtgccatggcagtttgctgcatctattaacccattacctaggtattaagcccggtaagcattttttttttcctgatgctctccctccccatccccaccactgacagaccccagtgtgtgttgttcccctctctgtatccacgtattctcattgttcagctcccacctataagtgagaacatgtggtgtttggttttctgttcctgtgttagtttgctgaggataatggcttccagctccatctatgtccctgcaaaagttgaagtgtgcaataagaccatacattgtgctgtgaaatatattttatatttttaaatactttaatatatgcattgttttatatagtttcaaattatctaaatgcattccttgtttgatttgccaataattgagaacaagcaaatgaggcaaattaatatcttttgaagttgagtgaagtaatagaactccatagagacttaattctaatatgactataaaaatatattttactaagaattatttagttttcttacaatgatgtaaagaagaaaaacaattaagtttgatctaaaaacaaccattagtgctccaaacccaaaatagtagtaaaaataacagttattattgtattgttattataaaagaaatatcaaattcaggatgcactcaaattcgataaagtagagccccctatttatatgttctagagaagagtaaaatgttattaaactcaatggagcatttctgaaaggtgtagactaacaactatcaaccagataaaattttgcttgccacagggcatttggaaatatctaaagactttttcgattgtcaactaagagtgggagttctactgtgatctagcagatggagtccagggctgttgctcagcatcctacaattacaggataacctctcacaacaaagaattattctacaaaatttaatactgtcaaggttcctgatgtatagaaacttgaaaagaacatgaaattttaaaaaagaaacctgttgaactgctatgagaaggacatagccagtgctactcaagacctgaaatatccaaaagccaaagcaagccaatgttgtaggcagtgcatgggagaagttgctgttgttgatgttcctcttgtcctttttacacacgatctttgaaagcatccatagcatcctcaggtctggcattttctaaatggcgagactcctgaaagagaggacactttcccaatagagcaggtttcataggttaagcgaattctgaaccctgctgtggcctaaagtgaaaatgcctgattagaagagtgtgtcacagccatgcttaatctcactagatcatcccagtgtgagcattccatggttgatagaaaagatgacaattaagatgatgaaatatataaaataggaatgaaaagggattattttgagatatctcagacactaactcaaagtttagagtgcaaatagtttatgtggaagttaatcccaggattcactagaaggaaaatcgataaagtgtgactacaaagccagtaaccgcagaacacctgaagctaaattcttctacagaacactatcccacaagtaagagcatatgccatagagctatctctaaatagagaatcaaggcactgaagttttggtatatgaatactcataagtcaatggatgagggctgctctattgggaatattttgctgtacagggggaaatcttcctatagtcactttgccttattgatccttgtttcctttggaatcatgctggaaggtaaccactggtatgttgcagctggcctgtatggctgtgagggagggctaactgtgcatctcttcccagttcagtggtcaggggcatcatataggtggcttcaaataaatcctaaagaatttgcaccaaggaaaacaaggtaagaaaatcagatattggaaaattttttgcgatgtctttttctcagtgagttggttgttagacctttatcagcacagcacagctcccacttccacagtctttcctatagacagccaaattcactgcctggagaaaaggcacagcctggtcagcatacatttgctagatccattctcggttgcctctgactattttttctttaaacactatatttactgtatagcagtcttataatacaatacatgaaccaatattgtacaatattttatattgaaccagaatgaaccaataatacaataaatgaaccaattaatgagacaatattgctgtcaaacagcaccttttaccatgcatatcaaatctaataaatttcccttatggaatatcagaaagaaattaattgttgatctttctttgtatcagctgtttaataattcatcacaataataaaattacaagttaatgcttcagtataccatgaaggagaaaatactaatcaggaaataccattatcttttccagaatattataaaaacagttctaacattttttaactgtcatgtttaggtgaaataaagcttaagtagaagaaataatctattggtatgtaacataactgagtttgaaaatcgttcacctttaataagcaataagagccctgtggtgtcttctttaattcctttaaataatttatcatttgaatctcccctgcctggaagttatatagggtaagttactacatatttttttcttcatcatgccctttagcttataactacatcaaagatagttctgagctgctccgaaaaaatgcctcctcttcaacatgcatgccgttattttaaaagatgttatgaaacaacatggcttatttgaaaagaccacaggatttattttaagatgtcaaaatagcacattcaacattggctttgatttttatttctttatttaacatggttttgatatagtaagcatattaatttggtccacttaaaaatttataagtgtttttctatgcaaagcaatgaaataatcagaaaactgaatatcaaagtatggttgaaaatgcctgtgacagccaaacctcagtctcacaagtattcatgagtattattaatactcttcaatttgtgatatataaaaatgagatctttagtgaatgagaaaattttcattttggttttagtgtttcacttaacattgattaaaaagtaaataaaatatttcataggccaagtgcagatcttaaatgggagtataaatcaactatcattctagatgttatattactatttcattgtccttacccaattcattatgccttttcatcaaagcttaaataaaattaaactgacactttcagttgaataatgtggcatagaagttgaacgttagaatgatttcttttaacattttccctcttgtcatttattttaactactggcatttccccaatccaactctcttgaaaatttccagtgaatgcccatgtttgtgattaagttaatttacttagtaggcagaaattcttcctagaagataagcagagaatataacaaaatcaagaaaaataatttatgtattaataatctgataccttacaaatgttgtgataaatgtgcacatttttataatccttaattgtagtttatgtttgaacactccaaaatatcaaccactgtaacactgcaaagtattaggcactgaaatgagataaggaatttttcactaaaattgtatttaatttaaatacatataacttaacaaactttatatttaaaagtaacatttttatcttgtaaaatttgtcttcaaatattattttctttaaatatatgatcagtaatttagaaagcattttcatataatgatatgtctttatttacagatattaaaatagttgatgaccaataacattacaaaattatcttttgctatccaaattttcattatcaccatatttgctttttctctgaggatatgcaaaaaagtatgcaaaattcattgtctgaaaaattcatcctaactaattttcaagtgaatatgaatgaaaatgtttagttttgttcgagttcgagaaactataggagatagtgtgtcatatcccaactgtgtgtatgagaggagcacctcttgtgctcagtaaatgttgcttaaatgtgtttgttgtccctcttatcttcccttttcttactatgaccttgtttctgggtcctcaagtttactctactaggcatttggaacacaaccactctaaaaattttagattctgaattctatgataagtgaggaaagttgatgggcctccctccaagcctaatcctcctcgtgagagtaagcttggatgcacgtttcatccactctcccaagagactgcactctatatttaattcaatttaatatgaatggttatgttgtggcaaatttgtttaaaaattactttagtaaaataagcaataagcaacaattatcacttgctgacacatgcatcatctctgtgaatagaatagaaggagaataatttaataagccatacattaattggataaactgctaacggatcatgagaatataatcttaaattggcgtgaatattatactatgttctctattcctccagaaataccaacttgttaatatgaattcttgatcaaatgcctatatgactatactaaaatgaaaaatcccacttaactttcaaagttatctatttgatttatctataagaagtctggttgagggacaaaaaaaactaacactgtattattcttgcagtacttcttttacttttacttctgtgttatgtttcacaagctctcaactggtctagtggtttgtactgtatcaacttagccaagcttcaagattataccgtttagttaaacagcaggtagtcaatatgccaaaactttaggtatgtacaagaacaaattaaggtgtaccatgaactatctattaaaagagagagagagagcgattgttcagtaaatggttttcctgtatatttttctagctatgatatatttctgattcattagggataaaccaacttttctggagttgcatactgttaccaaaacaccaggggtttgatctgggtcctgctgttcactgcacagaaacccaatgactgagatgatgagtgttgccagagaagaaggctttaattgagtgctatagccaaggggggagctcagtctcaaatccatctccctgactgactaaagctaggggtttatatagtagggaagaaatgtaacaatatgtaagaaaccaggagctagggaggggcaaacaaatcatgatgaatgagtggtctggcatctcattttctggatacggtgatctgttgagtttcagcctttgctagtatttttgagcggcctaaaggaaagaactatgttaaaacaaacataaatttcaagctttaagaccagaagggttaatttatatgtttatttaaaaaaagaaaaactatctatgggactagtgggttggtttcagtactaagcttcaagacacccatttgcatatagaaatacacatatgtgcatacatgtatttctatacatatattcatttataagtctatatgtcaactttttaaatgaattatccaataaaataatttaatgagcattattgatggcagtggcagcccatctggagcagctgctgccatgatgcctcctgcagtgggagaggtgtggccagggccgaacgctccacagagccagcgggagctgggaacagttggaagccctgctcccttctgagtcggtagggtgggaacttcatgctacatggccacagctgtggttgcccagcgatggctttggacccaggcatccctgttctcttgtgggatgagagcaggcaggagccctgtgctcctgggcactgctgcagctgtgggcctgggagtctctttgctctcaggagccagggatacccctacaggcttacaactgcctgctcctgctgcctggcctctctttactctcagtgctcagtttgatcttggagaaaagttgaggccgagcctaggcactgttgcaacccacccaagtatgtgcactcagggcagtgctgacaagagagccccctcctgacttggtaccctccagaatttgggtcctaatgaacatgggaaggaggccaatgagggagctgtaggcagttgggtgctggcctacaggcacccctcagcacaaacaacctgggtgccatggatgaaggtaggaggcagacaggctcctgggtggaaagtggcaggtccctggtgaagtcacactcaggccagataccacctgaagcctggaggatgggctgattaaccagaataggaacttacggtgctttttctaggcccacccatgaaccaatcagcatgcacatccatccctctgaagcccataaaaaccttagactcagccagacttgaggagatgatgggacagccagctgcagagtggacctacccaatacagggtctcctctctgctaagagttgaacactcattgggacaccctggctgctgagaggagctacccactgtgagtctcctctgagcagttctattgcttgataaagctcctcttcatcttgctcaccctccacttgtccacccacttcattcttcctggaagtgggacaagaaatggggacccaccacatggtggagctgaaagagctgtaacacaaacaaagttcaaacaagcttcttgctcaccacattgccagagacaaggagagaagagagaaggagagaagtgctgtggcccttttgggatcccagacctaggagcttcccagacagggctatgataccctctttggggcttggcagttcctggcatctccaagcttctgggtaccaccgcattccctagtgctagctgtggaagctgtttgaggtatgcctggtccagctagtcttgaagggagctcacacctatgctagcacctggagctgaccaacccactgcagccaaaatgcctggctgtgtgtggtggctggacctcatgctcactcacacacaccactctctgcttgtctcacctttggtggcatgggatccagggtggcagtgtgagctgaatgcggcctaccaggctgagtgagtccagcaggcccaagcaaaactcaggcaaaggtgccacactgtccacagaggcttcctactggtgaagtgacatctcaaggatcctgtaacattatatttataagacttttctcaaaatattaacagtatttcaaataatattatttaaatatatgcctaaccatttaaaaataccatttaatctaacctcttaatggcgagagcccgggaggcagagcttgcagtgagctgagatcatgccactgccctccagcctgggtgacagagcgagactctgtctcaaaaaaaaaaaaaagaaaaaattctgaatgcagaggttatgattacccattttatagatatttataaatatttacagatatttaacaaattgaaagatttattcaaagtacagctcagtggtgtgccaaggtctatctctaatatgattttcattgatttttcacttgaattatagcttaaataaatactctttcttttcaatgcctagaattaaataaaatctatctagagattacgtatatgtatatataattgtaaaacaatattatacataattccatataaatatatgtaaatatatttatacaatgtatgtatagatagcattcagccacagtatcatttaaaagccttctgtattctgctctacaaattaatttattcttttaaatcttatgttatttaaatgaatcctaaggaccaacctagacctcagatttttaaggatacatctttatcttcaccagttctaatagttcctcagctgtagtcaaaatgatgatctttcctatatagaagattttaaatagatattaaattcttcaccccctactctcaacattattggtttctaaattaagtcagtgctacttgtgtacttcacgcaggacagcattatttggttatcagtcattcatacccttattgcttggagaaaacaaaaaacaataaataaaaccacagttttgagggtgataagaatatcccatgcttctttcccagatactcggtttctaagcatggtttgcaaacggatatggccatgaaacctggttatcacctttaaagtgaaatctggtggggttacaataaagttaagatcaacccaaagaaaaaccctttttgctcacccttcacactctttgaatttaggaatgagatacgaagttgaataaagaggctgtataatgaaactcaaggacaacacacaaaaaatggctaaaaagagctattgactgatgaatttgagggtatgctatttgactctctggcagtaggataaataaatctgtttctttagctaccattagttgaacattctggggttcaccattgatataattctaaagtgcataaacaaatattattacacctgtatgtgtgtgattgatgaaaccagtgctaattaatatagcattgtaattgtccacttaagaggaaaaagtcagtcagactgctcataacatatattatactcttaaatatgagagaagagcttgtaaatatatggaagaaataaagtatatgccattttcaatcataattttaaagaaaacaagtgtagtaacactgatatttgaagaaatagacttgaaaaaaatattactagaaataaggagaggtatttgatattaaaagtataaattcaagaaaaaagtatcacagcataaatgtgtatgcactgaataacatgggctaaaatatataaaacaacttagttataagatgaataagttctagcgacctaatctacagcataatgactatagttaatatattgtacattgaaatttactaaaaaagtaatcttaattattcttagtacatgcacacacaaaagtaactatgtgaggtgatggtttatgttaatttagcttgattgtggtaatcatttcatcatgtttatatttcaaaatatctcattatacaccttaaatatataaaattttaatttgccaattatacatcaataaagctaaaaatatgtaacaaacattcaagataaaaggagtaatatgtaaatttattatcatatttggcaattttgactcaccactctcagtgactgagagagcacaatggaaaggcaattagaatacagaagatttaaacaataagattattcactgtaacttaattgatattataggacatcacaaacaatagaaatcagttccagtaaaatatgacattacatcttggccatttaggattgtgcttgtcaatggataattaggcacatataaaatgattttgtgttgtttgggggtggctaatactgattattaaagagtaataatgttgctattacaaaataaatttcttcagtcatacttgttgttttcctaagaaaatgtctagatctttgaggaatttcctcctaaggatagatttgtagaagcatttattttttgcgtcctactacacaagttagagggtgcacacacactcatctctaggacagtggagataccctcttaactgctgtgtgacatggacttgacctatctgtaaattgacatttttttttcacactcacaaaagtttctcgttaaaattcagtgaacgaagtgcaacgtgggttggattctgcatcagagaaaggacactaattgaaaaacagataatatctgaaaaaatgtatttccttaataaaatcagttgagatgtttatctttggctattggttgttttagcatatgctatggtatgaatgattgtcccctccaaaactcatgttgaaacttaatgtggcagtgttgagaggtggagcctttaagagatgattgggtcatgagggctctgccatgattggatgaatgggttaattcattaatggattaatgggttatcacgggagtgggactgttgactttataggaagaggaaggaaatctgagctagcaggctcagtgccaccttaggactctgcagagagtctttaccaaacgagggaccaggtccagtctcttcactgtggacttcgcctccagaactgtaaacaattccttttgttttttgcaaattatccagttttaggtattctgttataagaaacaaaaatggactaagaatataatcatatatgaacctgtttcatttcttctaatagattgtgagtccttgaaggacaaatatcataacataaacatttatataattaactcactgattttaaaacttttgagtgtctaccatatccttgctacaaagattatgtattgataaacaaaacacatgctgcatgtattccatagtcttttgggtggggatacgtattaagaaaacataaataaatacattgttaaaatatacaaagaaggatgattacaagttttatgagaaagaaagttatagtacaattggggctcaaagagatactgtctgagtaaataaaatttaatcagagatttgaatattagtaatacttttccaagaaaacttcaattgagaaggttatgagaatgatggagatttttctgagaaaaagaataatatgcataaagtttcagatttgagaaagatgtcataacaaataactaaagtaaaaccaaagtggttagagagcagagctgaaggaagagactgatgtcaactgaagcaagataatttaataagggatacctcaaaatgcaggctttagattctatcctcagaaacaaggtgaaagaggttgacaataccaattgctttataacattacttatgatgcttttcttgtaaatacatatgataaactaagaaaaacagaagtggccgggtgtggtggctcacccctgtaatcccagtactttgggaggccgaggcaggtggatcacgaagtcaggagatagagaccatcctggctaacatggtgaaaccccgtctctactaaaaatacaaaaaattagcagggcgtggtggcgggcgcctatagtcccagctactagggaggctgagataggagaatggcatgaacccgggaggcagagtttgcagtgagccgagatcgcaccactgcactccagcttgggtgacagagcgagactctgtctcaaaacaataataataataaataaaataataataaaaaaaagaaaaacagaagtgaggagacaagtagtaggattttggaccaaaaaaaaaaaaaaagatgcccatttgaactagactgaaagagaaggaatttagaggtatgagaagaatttatatatatttggggaaaaattaacaggattcaggatttagtgattaattgaatggagatgttgaagaagtgtcaacaaaggattttaggtttctagaatagatcattttccttaaatggagcagtacatatttgaggtggggatcaaaaagtaaattttactaatgtttgctttatgatatttgttacatataaatgtaaccatcaacatacgagtacggtccacaaaagaaagtctagaattaaagatatacaactgaaagccaccataatataaaagttacttagtgtcataactcacttgctttactctctgtataacctcaacaaatagttcatgattgagtctctttctaacacacactcctgaatgccattatagcataaatcaatctgaatgtttatggttgttttgaaaaagcagtacatgaaatccctgataggagacaagatatgcatgagatatttttatataaactgcattgtcataaaagtccttagactttcatttgtgtaagcagcatttgaagaaggctgctttaagttgaatggtatttgggaataaatctgaattacattttaatacaaaccataaaaccaacaataggaaaaaagtactttgggcttcacagaaattatctgtaaagataaacggacaatgaaaggtttttaaaaaatcttaatgaagtactttttttcatattgtgatatgactaagagtgattgcaatgttttaacaaccaccaaatgaggttagatatgtatgattctaaagagaacaggagaaacatagggctttattgcatatataaatattacttttaagtgttctgtttgagattgcttgaatttttgagatgaaatgcaactcacatctctatatatgaagtgctatacaaaatagaaatgaagatatataaactgacagtaacctttattatattagaatatacattcccagctgaagtttgttgactactctcaattttttttttttttttttttttttttttttttgagaaggagtctctcactgttgcccaggctggagtgcagtgttgagatctagctcactgcaacctcctcctcctgggttcaagcgattctcctgcctcagcctcccgagtagctgggattacaggtgcctgccaccacacccggctaattttcttttctttcgttttttttgtttgttttttaatttttagtagagacggggtttcaccatgttggtcaggctggtcttgaactcctgacctcgtgatctggctgtgtcggcctcccaaagtgctgggattacaggtggctaccctcaatcttaagctatcacatttgcttagtaaatgtccacatgttaccaaatactttttttttttttttttttttttttttttgagacaggatctgttctgtcgcataggctggagtgcaacggcacgatcatgatggcatctacctcctgggatcaagtgattctcccatctcagccttccgattagctgggattatagacgcatgccaccatgctgagctaatttttaaattttttgtagagaccctggctggtctcaagctcctgggctcaagcaatcctttcaccttggcctcccaaagttctgagattcaggtgtgagtcaccatgcctgacatacctcatacttttattcggaaggtcataaaacatgcagatatattctttttcagtgatttaaaataatctaatattttaagaggcacaacagttaaaatgcatactttagagaattaacattaaagtcttaaatattaataatcaagttttagttatgtaaaactgattcttctttgtattttcatggttaatattaatttgagtgaagtacactttgagaaatagtaggtattttgagttgaaaagaggcaaagagttaatttactattgaatatttttaaatttttttttgatttttctttagaatgtttttttcctctgtataatcttactaaaactccaaaataaaattttcccaagctgagcggatctggttagtgagatgaaagagaagcatattaaggtcccactaaaaaaatagagatttgccaaaaagggctgaaaaaactctatattagtcttatcagtccatatttggatgagaaaagtaaatctagctaagttattcaagtttgcaggattatatttctgtccaggactccatataaaactatttctgtctaggactctataaaacttcctacaatggcaggtaataacttttattcataatgttgacaagatcatttctgtggcaagatttgtcatttatatttgcatagtatgtaatttatataacctgttatgaattgccaagtttaattgatatactttttgacatgacaaaaataatgaaaaatgataataatggacttttccccattctaacagagactattgggaagaagggatcaacttgctcaaatgtcctatagtaatattcccacccaggtcagcatgcttttggttctgcctagcagaaagactatggggagttcttatgcaggatgcactttatttgtctacatttcttattgaaaaacaaactgtaatttataaattatggagcatgaatgattagagagtggataccattctagtatatgatataaataacacaacactgaacagaaaagttctgaaacaaaaagatctctttttataggtgaacaaggtgtcccacatgtagttctcataagtcacctcatgtattaaacctgaaactaaaaattatcttaatgtgggaacaaatttataattttggagatctgcatttgatgaccttaagagagtatttcaataacaaaatattattttccctgagcctggtaccttcatatattctttgaattttttagtacagtttggattttaaatgtctgattcatctgagactgattgtacagttcaacactttatattttcatgagcattataatttgttatagtttccattttatcgctttttaaaatttactgtattaaatatgttttcttatatagaaatcagttttgataaatgaatttttgacttcatttttagctcttttggagttcatttttgtaactatcatgtttatgctatacaacttaagatagcatatgttggcacaccattatgtgcaatgatgaaattagtatattattttggagttatctttagagaggatcaatctcccttaacagttggtaaggagcccttccaaacatctctccagtaagttgtctccagctgaactgcaaacactgaataagataaaaataaaaattcatagtgatcacagcaagactctatcaatcattatatctttcctatgtaagttaaaaaaagtcgctgtttttagattttgctcagtgttttcttaatcaagcttccatgcaatatatcacaggctaattttatactcaaataatattcttaaagcaattaactttgaattttctccatatttttatgtttttaaatattatgatgtaaaattatttggaggatccaatacatatcattaagaattatgtttgtcaggcaataacaaagaatgttaccccaacaaataacagcagtttaaaaacttggattgttattttctcataaaaatcttgagtttggcagtctaagggctcattatgctgtctctgttccaagacattctcaaagattgaaactcttgctacctttctgctcaaatatatgcctcaaagatggtctccattctcaagatcaactcgtgttccagtaggtgcttcaggtctggtcatcataaatatattttgaccagcatggagaatgaaataacaaattaaaaaaagaaaactatactgcacttttttctatggaaaatgttagactctgacactttacatatttgcttacatctcattgattaaccaacaaaacatgagcccatggaaataacctaatacaagacagaactggaaaaatgagggattacacaacagtataccctagcaaggattctggaaacaggctctatttaaaacttggctttgccattactaactctgaattttggcaaattgagctgtccttaacttcctcaactattaaatggaaatataataatagtctcatctcctatttttgtgagcattaaatttagtaatatatttagcagacttagaacagtggttatacactatgaaatctttagcaatactattattattacttattctggaaaactaagtgatagctacaagttggggatcccattaaaatgaagaaggggaaatggaattaggaaactaattggtattctcttcacccagggtatgataaaattataaaagaaaagtaatctgtaacatttatagcagtgttttcatttatatcaaaatgaagtttgacaaaatatacaatttcacagatattaaacctgtttctgaatgacttttagaaaaagaatgaaattaaggcagaaatcaatattttttgatactaataaaacagatacagcataccagaatctctgggacacagctaaggcagggttaaggagaacgtttatagggctaaacacctatatcaagaagtgatataggtcaagtgatatagctcaagtgataacttgagttctttctagagctcaaattaacaacataatatcacacttagaggaactagaaaaataagagcaaagaacaaatcaagcccaaaacgagcagaagaaaaataatcaaaatcaatgctcagcataaaggacttgacatgcaaaaattcatacaaaaatcaactaaagcaaaagttagttttttgaaagaataacactggtaaactgctacttagaccaataaaaaagagaaggtcaaataaatacaatcagatagcacaaaggtgacattaccaccgaccccacagaaatataaaccaccccactacagactattacaaatgcctgtatgcaaacaaactagaaaacatagaagaaatggataaattcttggaaacatacaaccttccaagattgaatcaggaagaagttgaataatacctgaacagaccagtaaggagttctgcagttgaatcagtatttaaagacctgccaacgaggaaaagctctgtaccaggtgggttcacagcctaattttaccagatgcataaaaaagagctggcaccagttctactgaaactattccagaaaaattgaggagttactcctctctaactcattctgtgaggtcagcatcattctgacaccaaaatctggcagagacacagtgaaaaaagaaaattttaggccaatattcctgatgaaaacaaaagcaaattcctcaacaaaatattagcaaactgaatctggcagcacaaaaaacctaatacattatgatcatgtaggctttactcttgggacacaaatttggttaaccgtatacaaataaataaatgtgattaatcacagaaacggacctaaaaccaaaaccacatgatcatctcaacagatgcagaaaaggctttttataaaatccaacaatgcttcatgttataaaccctcaacaagctatattttaagggaacatacctcaaaataataagaaccatctatgaaaaacccaccgccaacattacactaagtggaaaagctggaatattcctcttgagaagtagaacaagacaaggatgcccactcttaccactcctattcaacagagtactggaagtcctagccagagtaatcaagcaagagaaaaaattaaaaggcatcctaatacaaagagtggaagtcaagttatctctctttccagacaatatgattctatacctagaaaaccccatagtctctgccctccaacattgataaataacttcagcaaagtcccagggaaaaaaaaaatcagtgtacaaaaatcagtagtatttttatacactaataacatccaaactgagagccaactcaagaacacagtcttattcctaatagccacaaaaagaatataatactgaggaatacagataaccagggaaggaaagatgtctataacaagaattgcaaaacactgctgagaaatcagagatgacacaaacaaatagaaaaacattccatgttcacttagaggaagaatcaatattattaaaatggtcatagtgcccaaaataatttacagatttaatgctatccttctcaaactaccaatgacatttttcacaagtttagattaaaaaaacttctaaaatgtatacagaataaaaaataaagagcaataagggacaaggcaattctaagcaaaaagagctaagctgggggcatcatgttacctaacttcaaactatactataaggctacagtaatcaaaacagcatggtatttgtacaagaacagacatatataccaatggaacaggtaagagaaaccagaaataaagttgcacacctacaaccatctgatattcaacaaagttaacaataaaaagcaatggggaaattactccctagtcaataagtggtgctaggataaccgctatctatatacagaagaataaaactgagccccttcctttcaccaaatatgaaaactaacttaagatggattaaagacttaaaagcaaaacttaaaactacaaaagtccccaaagaaaagctattaaataccattctaaacataggaactggcaaagatttcatgatgaaaagtccaaaagcaattgctaaaacaataaaagagccacccaattgagaagtgggacttaattaaactaaagagcttctgcacagtaaaagaaactatgaactgagcaaacagcctacctaagaatgggagaaaatatttgcaaaatatgcatctgacaaagtctgatatacaggatctataagtagcttaatcaacaagaaaacacactactaaaaaatgggcaaaggacattaacatacacttcagaaagaacatatgcatgcagtcaagaaggatataaaaaaactcaacatcactaatcatcagagaaatgccatcaaaatcacgatgagatgctttaaaaagtgctaaatgaaagtactaccactcagaatggctattattacaaactcaaaaaagaacagatgctagtgaggttgcagggtaaaaggaatgtatacacactgctaaaggaaaataaattagttcagccattgtggaaagcagtttgaaaatttctcaaagaactgaaaaactaccatttgacccagcaataccattactgggtatataccctagggatataaattgtccttccataaagacacatgcaattgtatcttcattgtagcacttttcacattagaaaaggcctggaatcaacctagatgcccatcagtggtggactgaatcaagaaaatgtggcacatatacaccatggaatactaggcagccataaaaatacttaaatcatgtcatttgtagcaacatggaggtagctggatggcatttatcctaagcaaagcaacacaacaacagaaaaccaaatactagaatgttcttccttttaagtgggagctaaatattgagtatacatggacacaaagatgggaacaacagacatggggtcctacttgagggtggaggctgggaggagagtgaggatcaaaaaactacctatcaggtactatgcctactacctaggtgatgaaatcatttgcacactaaactctagtgacatacaatttacccacataacaaacctgcacatgtatcccctgaacctaaactgaaagctggaagaggaaaagaaaatggagtttgagctcatgtgtctctttcctttgaatgtgccactccagttagaaatgaaggtagattattaaaatattatattaaaaatagctttggttataaatataagagaatttcagtaacgtgctatcaataaaattcaaaagaagaatcagtttttcatgttaaaattttaggtgttttaatttcaaaaactggaaacaagcagatgtatcaaaatattttacttttgagaggtaggagcagtgggagttagaagcagggccttgataaccacattcttgtatgaaagaagcagaaagagacaaactcttaaagctagtccattaaagtgtagagtcagcattcttgagaagccatgttctgagtcagtgatgctgagaaacataaggacacaaacctgcttggttgatgccatgagccagctcagtgactgcatctacaatatcttgatggcattacaggagtagcagcctgtctttgctagaagagaatttggtgacgcaaagagacccaatggctgtgtgcatctccaacaattggaattataattcaacatgagatttgaacaggaacacaaatttgaatcatattattctgcccctggcccctcccaaatctcatgtccttctcacattgcaaaatccaatcatgccttcccaatagtccccgaaactcttaactcattccaacattaactcaaaagtccaaagtctcatcagagacaaggctagtcttttccacctatgagtatgtaaaatcaaaaccaagttggttacttcaaagatacaatggggatacaggcatttgctaaatactctcattacaaaagggagaatttgggcaaaatgaaagggctatatgccccatgtaagtccaaaacttagcagggcagttgttaggtattaaagttccaaaaagtatcttttgacttcatgtcctacatccagtgcacgttggtgtgaggtgtgggtccccaaggcctcgggcagctctgccactatggctttgcagagttcagaccctgaagtgggtttgaaggactggcattgagtgcctgcagcttttccaggctcagggtccaagctatcagtggatctaccattctggggtgtggaggacagttcccctcttctcacagttccactaggcagtgccctagtggagatgttgtgtggcagcttcaaccccacatttcccctccatactgtcttaatagcggttctccataagggctccgcccctgcagcaggcttcttcttggacatccaggcttgtcaatacatcctcttaaatctaggcagaggctcccaagccttaactcttgcactctgagcacccacaggcataacaccatgtggaagttgccaaggcttatggcttgcatcctcaggagcagtggcccaagatatgtctctattgattttatccatgggtggagttggactggctgggatgcagggagtaggacagtgggtccctgggcctgacccatgaaaccattctgtcctactaggccttcagatctgtgatgggaaggctgccaggaaggtttctgaaatgccttcaaggccttccattgtcctggctattagcacctgccttccatttagttatgcaactttctgcagcctgaatgaattcctcctccaaaatgggcttttcttttctaccacatggccaggctgcaaactttataaacttttacactctgcttctctttgaaatataagttccaatatcaggtcatttctttgttcatgcatatgagatagacagaaacaaagtcatctcttgaagactttgctgcttaaaaatttcttccaccagatacactaaattatcacacacaagttaaaagttgcacagatccctagggcagagacacaatccaaccaagttcttcactaaggcattacaaaagtgacctttgctccagttcccaataggttcctcatctccatctgagatctcctcagcctggccatgtctgtccatatcactattaacattttggtcacaaccattcaacatgtctctaggaagttccaaagtttatctcacctttctgtcttcttctgagctctccacactgttccaagctttgcccattacctagtccctaagccacttccacattatcagatatttttatagcaatgtctcactccttggtaccaattttctttattagtctgtttttgcactgttataaagaaatatctgagactggctaatttataaagaaaagatgtttaattggctcatgattctgcaggctgtacaggaagcatagtggtttctccttccggggggacctcaggaaatttacaattatgacaaaaggcaaacagacaacagacatgtcttacatagccagaacagaagcaagagaaaaaaggaggaggtgccacacacttttaaattttatttatttatttatttatttattttttgaggcagagtctcactctattgcccagactggagtgcagtggtgcaatctcagctcattgcagcctctgcctcagcttcccaagtagttgagattagaggcactcaccaccacgcctggctgatttttgtatttttagtagagattgggtttcaccatgttgaccaggctggtcttgaactgttgacttcaggtgatccacccacctcggcctcccaaagtgttgggattacagatgtgagccactatgaccggtcgaggtgccacacacttttaaataaccagatctcaaaagtactcactcactatcacaagaccagcatgaaggagaaaatctgccctgatgatccaatcacttcccctcaggacccatctctaacactggggattacaagtcaacatgagtaatccccatgttggggggacacagatccaaaccatatcagtgtcctaaagtggattggaaaaagtttcagaaaacccagtgatggcgatcaatgatctatcttatagtgagccttgacgtgtgacaggctttttacaaaaatccttgtagtatataacaggatgatactaccatgagaataaatttagtaaaacatagtattattgatatataagatacaccatttaatattaaaattgtgatttcttatattttgtacaacattatcaatgttttaatcctcattaattagtatatttaaatttagtactaatgcaatgtttctgcatgttttagtggtttatcttaataatagttttatacacgatgaaacatcaattgtgacatactacctatgttagaagtcttagataggaggtagttctctgaaagtgttctttaaaatgttagtaaacttcctagaaaatcaagaattttttttttgtaatttcctttaaccagtgaaaaggcgattttggccttgtttacaaaatgcgtaaaacagatttcatacgttataacttatatttggattgattcagtttcctcacttttctttcaatttatttttaatcagtttatatttattttcagatagaagaacaatctcactgagcattagtttaataacctattaattaccttattaaaatacttgtatccgtagtcccagctactcaaaaggctgaggcagggggtttagttgagcccaggaatttgaggccaatgtggaaaatgtagcaagattctatcactaaaaataaataaatacacaagtaaatttcatcgtaacaattcttctgccatttatgtagcttgcctttagagtctttcaatgttcttctctgaaatgtatttctatgtgcttgactatatcttcccgtaataatgtcaacttctgatatggcacagattagataggctttgcgaaaaaggctggaatagtaaagtttatttacttttttgtgtgtagatttgtgttatccatctctttttaaattttatttaacttttattttaggttgaagggtacatgtgcaggcatctcttggtgcatttacagctgtgccattttaaagatgccattccttagtgcagctacataattcatatggacaaaaagatgtgatttttagaggaagagtgcttgcactccttattttttcctgtcttttcaaaaaaaagaccagatgtcccagagcaaaacacactagggaattattttttaccctctgctagcatggaaatatttagtgctagagtcaagagaactgacagttattttataatttgcaagaggagcaaagagcatacttcaagtagaaaatatatatgacacacataaataatgaattccctttatgcattttttcttttattaggttcttagcttcgaccaagtagcaggtgagtaaatcatgatggataggccccaaatctcatattccccagagtagtttaaggaggagaaattttcaaacatagagaagattcttcataagaatagtataaatcccttttctcagggagcttgttatacgtacagtgtcctgttagtcctgcaagtgggcttctggattgttggtggcacccttagtttctgtccaactctagaacattataggccatcgggagagttcaaggtactcttacttctcatccccaagtagtggtggggattggaattctcagcgtggtgcatgggtttttacatttcaggcttctacctgatgtctactgacttcctctgtatctttcaatcttatctagaaaggaggttcttctccacaaattaaggagaccccctcaggcccttcctctgcacgcagtacaagattccacccaggacctctccctagaagatgtacctctttgtcttttcaccttcggtcttcaaacatggagcagatgcaataagatttgaaaaaagaaacctggacctgtagctctgtgccttagcaaaatggtcctgtgttcaagagcaaaaatttctgtaagcaagacctatagaatgaagacttctgccctgtctgtggttagtgcaagtttcacaccaggaaaatgaagttacccttacaaagttacccttacgatgacaacatatgatccaggacaggttgactagagcagggagttttccatgggagaggttggagctagagttcagcatggtttctgtgtgaatgtgtgtttctatatgtgtgcaggggcagatgtacttgaaggtgcatctgaatctgtgttacaataatagataaattattgagaacttgaaatcttaggccattgtcaaaaattacttcaaaaatagcatcttaagaaagcaagattggtatacacaaggaagcagggaatgagatgaaagacaataattagcttaagagggcatatctttacatctggagaattctctaatttcaaaactgaaaatacaattgaaaccaaatactgtgagtagtgttctataggaaaattagcagaatcttcactatggtgataaaattcttcaggccaaggaagcagtcaccttaaaattggtagggtaaatctgagaggtctttgactttctgcgttgagctttttgtggctccacagcatccaagcatgaggtgcttttgctcatgccatgttgagatagtgtcaggtcaccatggaatagtgcattggaggaggtgggttccaggaagactctggaagacagatgtccagtaacattagtctgtctcatcttttgtgtgtgagaggatgaaactccaatcttatttaaccactttttaaccagtgaactttaacaaaaattcacaaaataattaggggagaaaaaaacatacatggtaaaggatacaaggagaagattcacaacaaattcacaacagcaagaagacagaagtagtagtataaactagtttcattttcaaattttctaacaagcaaataagtatatatagaagtgataagataaatcaaatgttaactacatagatactataagcacgtaaattagagcttgcaataaatattaaattgtaaggcgtttatatcatgtaatatacattatactattataatgatatacatgtgatagattttagcaattggattgtcaagctttataaaattttgttcaaaatctgtgttgactaacttattaggtcctcagcaattctataatttacttgcttttggaaagaaaactgaatagaccatctgaagtccaatttgatgataaaatcaaatcattgcaaaattatcgattcaacaattaagaaataatctaatacatttcaaaattatacttatatggctctacctaactggctgtacaaaaatatacagtcatatttagaaataatatccattataaaacataaattagggatctatgatcaagcaacaagcatataatctctgaatttaaaattgaaggcatattattgaggatagacagacttggtttttctggaatgggagtagataattttaatgtccaaatccctaccctatttctatgttgcaactgatgccacaaaaaggaaatcttgtcagtatatcataccaatggagccaacacagttgatactatgagtgcactgattaatagattttaatacttattgctatacatgaatttaaattttattcttaagaagagcatgaagatttagcctgacctaccatcacctaggaaggcattattgctaaaaagaaataatgtgaactttatattatggattttcaaacatgctaaaacattaccttaaattaatatgaacatctttctgtttttcaagatccaaaagcaaagtattttattatcaataaaatactttgtttttgtagtaaaaaataacattttattcttttagtcagcaattctcaagataaacattatatatttgattttgtttttcatttaaatatttgcaagctcacagaaaataaacctaatttctgggtaaatgtaaatttttcttcctcaaaaattacattatgtggagatagactcagtaatcagatagccgcaagcccctgaccatgaataatcatagcacctcacttttacctctcttgaaaattaaaaaaaaaataactccacctatgtatagttaccttattttgggggcttctacctctgttagtggcaatataatgaattatttggatagtgttgccttacatttcattttgtaaatgaaacactgatacaacattttatacagttttctgacagaggtaaattgcaattaaaaaatgaagcttttattacagtgacaatttttcacactgatggaattaagtgtgtgccaacattacaattaaatttcttattttcaggaatttcaaatcaatacattaaatatgacttattctagcacttggcaaataatattttaggcaataaagaaattaatcagaatagttttacaaagacattgaagaagtaggattagagactcaaataatggaatggaaaatgtgtacagcagttctaaagtaatttatatgtgcatataatttaaaatgaagtaacatgtgcttaataaaatcatcatgcacccttagacctatgtcctaaagctattcaaaagtgtaataaagcaaaagccaaagcaacatttcatgtataatagcctagaaaattaaaaatgtattcctttattaaataagcaagtaatgtagatatatttatacaaaataataatgatttcagttttattatctagagatttctgaatctgattcttgtccctaaaattccagtgaccacagatgtatctatatagagctaaaagtataatattatcttttaaaactattaaggaaaaatactttaaataaagataactatacagtctggagaaaaataaaaacaaaaacctgaatgtagtgtaggatgaagaaatgcagtcagattctaaaaggaagtgaacatttgcaagaacagaatggcagaagctaaatttcttgtctttagcatcttatagctggaaggcatgctgcagttcaccatatacagcagctaaaactctgatagaatgcccacaaaagaagccaaagggagagatagggacaaccacagatgctgcaaaatgtgtgtaagtatctaggagggctgtaccatgggaaagagagtcagagacagatagacatgtgttctactcataaaccctgcaacagcctctggctcatccctgagccacttatgcataggacaaagtcaaaggagctcagtataggataaaatgcctcaactctaagattctatccaagagatagcatttccagattaaacccagctgacttatttgttgctgaaacaagcaaacaaatgagaatctcaacactatctagtggactacaacagaattcaaatagcacatagcgtagcattcacaaagcataggatacaatttaaaattaccagacttggaagaaacagagaaatgtgtcactttctcaagagaaaggcagcagataataactctgaaataactgagatgttggatgtatcacactaagattttttttacgcatgaattttcattatgtttaatgtaaagaaagaatgtttgctataaatgaaaagttaaaagaatatccataggagattggaacaaataaacacaaatgaaaagaaaattctggaatagtggaaatatatctgaaataaaaaatgcattgatggatagcacagcgaggattgtaatagcttgctatggctgtcgtagtaaagtgtcacgatgttggtggcttacacaacagaaattttttttcttacagttctgaagcccagaaatccacgattaagggttgtcaggtatagttccttctgaagggtatgaggaagaatttgtttcatgcctcttccttagtgtcttagtcagcttgggctacattaacaaattaccatagactgggtggcttaaacaacacatgtatttctcacagtctggaagctgggaagtccaagatcaatgtgctggcatattgtatcctcacataatagtgagcagagagatgaagcaaactctctcaggcctttccttctaagagcactaatcctattcctagggcctcaccctcatgatctaattacctcccaaagtccctacctctaaatgctgtcacatggaggatagtctttaacatatgaattttagggggataaaaacatttggttcatagcaccttgcttctgggagttgctggcaatgcttgacattccttagcttgagaaaacattttcccaatctctgcttaattccatatgccattcttctcctgtgtgtctgtgtccaaaatctccctttatataagaacactaatcatattggagtaaagtccaagagaatgacctcattttacattaactaattacctctgcagtgaccctattcccaaataaggttcttagatgctagggtttagtacatataaatttcaggggaaacaattcaaaaagaacaaattaattaaaaaagaattaatttatctttatgttactcaataacaaaaagaaattaatgaaaattttctggaaaaatagacaaaatgatttaaaaaaagaatacacaaaagaacatcccctcatgaaatctttggggagtattcaaagatctaacaagaatgtaacaagaatccacaggagagaagagaaaaagcaaatgtggctttaaacaaaggatttgaagaaatcgtgactgataatttcacaaaaatggtgtggggcaagaatttacggttttatgaataagagtgcaccacaagaaaaataaagtcaaattaaggtaggcaagatgataaaaaacaaagatgtaaaattttgaaagtagccagattaaaagagcacattactgaagaacaagaaattgaataactgatgacttctaatcataaacagtaatgccattgaccaatatttttaacatgtgaaaagaaaaaaattaccaatagagaattctatatccaataaaaacacctttcaataataaaagtggaatgaaaatatatatcctcatatgtaatcatattataaaacataagaaaattctaatatacttccagaatgtgctataatattgtcatatttcatataggtagcaggaattacattactatgaacactaaagatccaaataaaataattaacaaactgttctttacaattgcacattaaacacttataaaaattgagattgagaaccatgttgaatacaaattgcaaaggatgatcataattcaatgttccccagccacattgaattaagctgtacattaataacacaggtttaactaaaagcatcattacatagacattataatatatttataaataatctatatgtcttaaaagaatgcaaaagagaaagaaaatatttcaaaatgaataaaaacataccacattttattgtgtttcactttactatgcttcacagatattacattttttacaaattcaaagtttgtggcaatcctgcatcaagcaagtctatcagtgccatttttttttcaacagcctgtgaaggtagctacactaaaaagcagattttcaatgtagacacaacagccttctattgggagaagataccatctagaaatttcatagcttgagagaagaaatgaatgcctggcttcaaaggacaggctaattctcttgttaggggctaatgcagctggtgactttaagttgaagtcaaatctcatttatcgttctgaaaattctaggacccttaacaagtatgctagttatctgcctgtgatttataaatggaacaacaaagtctgaatgagaggacatctgtacagcaatgcttactgaatattttaaaccgtgttgagacctactgttcagagaaaaaaagatttcttcactatattacttctcattgaaaatgcaactggtcatccaagagctctgatggagatttacgaagagaataatgtgttttcatgtctgttaacacaacatccattccgcagcccatgggtcaaggtgtcatttcaactttcaagtctcattatttaagatacacattttgtaaggctataggtgccatatatagtgattcttctgatggatctgtgcaaaggaaatggaaaatcttctgtaaaagattcaacattctagatgccattaagaacattcatgattcatgggaggtcaaatttcaacattaacaggagcttgcgaaaaattcactctaaccctcatgaatgattttgaggggtttaagactttagtggagaaagtaagttacagatgtggtgaaaatagcaagagaactagaattaaaaggggaacctaaggatgttactgaattgcttcagtctcatgataaaaattgtatggatgatgagttgtttctcatggatgagaaaagaaagagattttctgaggtaaagtccactcctgctgaagacgctttgtatgtttttgaaatgacaacagatgaattggaatattacataaacttgtttgataaaccagcaggatttgagagtattgactccaattttaaatgaggttctactgtgggtaaaatgctatcaaaccgcaatatatgctacacagaaacttttcatgaaaagagtcaatcaatgtggcaaattttattggcatcttattttaagaaatcgacacagcagaccgggcgtggtagctcacgcctgtaatcacagaactttgggaggccgaggctggaggatcacctgaggtcagggatttgagaccagcctggccaacgtggtgaaattccctctctactaaaaattcaaaaaagtagccgggcatggtggcgtgtgcctgtagtctcacctactgaggaggctgaggcacaagaatcccttgaacccaggaggtaacagttaaagtgagccaagattgtgacactgcactccagcgtgggtgacagagtgaaactccatctcaaaaaagaaaaaaataaatcgacacagctaccccaaccttcagcaatcaccaccccgattagtcagcagccatcaacattagacaagatcctctaccagcaaaaagattatgacttgctgaaggctcagatcattagcatttttagcaacaatgtatttttcaattaaggtacatacaggtttttaaatataatgctatcgtatgctaagtagactacagtatagtgtaaacttacctttcatatgaatggagaaataaaagttgtgtgactggctttatttcagtatttgctttgttgtggtagtctggactaaacctgcaatatctccgaggtttgcctgtaatagtgaaagtacaaccatatattaaaatttgtaggatatattaaaatctgttaagttatgcttgtagagaaattcataggcataatacatagaatctcatatgtatatataacacatttattttggacaaataggtaagaaaaaaataaaaatacaaatccaataatcttacattagtaaaatggaataataaaatcaaattcaaactatggtgctagaaaaagtaattactataaaaggaatactattaataaaaaataccaatttttggcttacttatttatcatcatttccttacccttttcattttcccctacccatgctcatcttccctttcacctctgttacctgccagaacagagatgttcaaggaggcagagcagtgagtaggtgagggtgccatgtacaggcattggcttgcctgggtgcctaggacataaagtggggacgggagacaacacggttatctcagacaaaggagatatctgagtaattgaagactccattgcagtgagcaaacaaattacgtgatttaagatgattatctatcaatcaagcaatcctctctctttctctctctattcacctatctacttatctatcatctatctattttcccacagtcctttcagagaaagcgtttacacatgaaaagtccaaagactggaaagtactctcagatgttctgttagaactgcagtaggtattatctttacaaatgtatcagtaataactgttaggtatttaaataattgtatataaataaagatgcagaaatatttatgcatataaaatacatacatataaaatacataatagttatacatcttcgtctctgtgtattttcatttctatgtgattatgcatacctccatacccctaggtctgtccacagggaaagccaggcagattgacgcctttaagcaataggtgcaacagagggtccatagcttgctctccaaattccaaattccttgggtccaaattatttgggtcaagggacccaaggcttcttgaaggaataggtgaatccaagactgaggcacatgaatcctagacatcaggtacataataagtggaaaacattacgttggaaagaaagcaaatgctctaaaaatgatgtaaataggtttttgaaaacgatacgaacaaacaaaaactcagaaaatagtttgacagggctctcactgcccaaatctagtacaaactgagcataaacaaaatgaatgaatataattaacaaaaagggagaggccgggcatggtggctcacacctgtaatcccagcactttggcagaccgaggtgggtggatcacaaagtcaggggttcgagatcagcctggccaacgtggcgaaaccgcgtctctacaaaaatacaaaaattgggtgcagtggcaggcacctataatcccagctactcaggaggctgaggcaggataattacttgaaccctggaggcagaggttgcagtgagccgaggtggcgcaattgcattccagcctgtgagaaagagtgaaactccatttcaaaaaaaaaaaaaaaaaaaaaaagggagaaattgcagaaaaaacttaatgaaattcaacaatgattcattaaaaaatcttctagcaagttagtaatttaaggaattcctttaatctgacagaatattaaaaatctgaagtttatatcaatctcaattacaaataacattgaatgttgtttaattatattttattataatcagagatcctcagtgtaccacagtagtatgaaaaaaaggctaatatagtaaaatcaaattatttttactgcatataacatcagaataaacggagtacagaaaggcgacatattcttgatacatatatctgagaaaggactcttatcctgaacatgcaagagtacctgcaactaaagaaaaaagagataacccgatgaaaaaattagaaaaattcatgaacagagatgttacaaaggagctacaccaaggaccaataacatgagaaaagtttcataaagttattgattggcagagaaatgcgatttaaaaccaaattatggcaccctgtggctaaaattattttttaattgagtatttgtgaaaatgtggagtaacaggaagtcttcaatacacattcagctgtcggaatgcagattgacaaaatcgatttttgcagtatttcctgaagttgtgcatatgcgttcattaccacacaggaattccactctgaattacaggttcttatatttccaccaaagatagttgttgttgttgttgttgttgttgttttgttttttgtttttgctttctttttttttttttttttttgagacggagtctcgctctgtagcctaggctggagtgcagtggcaccatctcagctcactgcaacctctgcctcccgggttcaagcaattctcctgcctcagcctcccaactagctgggactacaggcgcatgctgccatgtccagctaattttttgtattttagtatagacagggtttcactgtgttgctcaggctggtcttgaattcctgagctaaggcaatccacccattttggcctcccagtgctagaattacaggtgtgaaccaccacacccagcccagggatagtttttaacacatacttatataatgatatttacaagtccatatatatttttatgtgtatgagtgtgtgtgtatgggtgtgtgtgtgcatgtgtatgggtgtgtgtgtacacaaataagacaatttaaaatcagtcctctattatttctgatcttttgctgtcatatataatgctccaatcagtggtcttttattaaaatactatacctgtccttaaatgaaaaggttagagagatgcttctcaacttacaatggaactgcacctggataaacccattgtaaattaaagttaagtcaaaaatgcatttaatacacctaatctactaaacattacagcctagtttagcctatgttaaatgtgctcagaacacttacattagcctatggtatgggcaaaattatctggcaacactccactgtctggaagctggggcctactgaatgcgtatgactttcacaccattgcaaagctgaaaaactataattgagaactgactgtgtgtgtatacatatatgtacgtataatttttagattttgataaaaatacatttaaattttagtcttctgaaggatgaatagaatctgcttggattttattgtattaccagttttttaaaggagtttttttgttttttgtttttttgtttgtttgtttttagtgtgagtatagaaaaatattatactgtgatctcacagcaaactataatttcctgaagggtgaagatggtgctaggtcaaaaaatagacaaaacaggaaataaaatgtggtttaggtaaaccatattatacagtgaaataaaaccatatcacctggcttttaatcacactgtccccagtttacttgtgtgagtttctatttattcttggcctaattccccttttctctaaaattaaaggatggactcgtgaactgtgaaatgttccaataatagttcatccagaatggtttctattttctacctatcatcgcaacatgtagacaacactgaagaaaatctgctttgatagaaggcaatatgggccaaccacaaaacttgcagtgtttgctcccattgcatccccagtgtctgcagacccagctctttctagatgatctctggtaaacagctagagtttccaaggatgcagtttgaaaagccctgctctagaaagtatatcacgaatgttttgagatctaagaggctatgttattcttcccatagcaaaacaatttttaagatattctctaatagtttgtccttccacttctcaagataattatttgtgaccaccacaactaaagactgagtacataaatgcttgttttgaagcttatacccaacttagtttgctacatctgactttgagtggtttgagagttcaagaaggccttgggttcaattgcaatgacattttactatcaaatattcaaatgatggtgtttgcactaaaattttgtagtttcagctacaatcccatgcagtagtcagttttgcacgtttaattgaataccttgtatgagtcatttagatgcaacttcttgcaaataagctttgattttgagtaagagaagactaaaatatatgtaaagcaccatggtaatgcatggcagagagaaatcaagtggagacagctctgtgattgcacaccaatgttttgatttgtaggaaaataaatcaaaatataagaaagcatagtgtattaaattttctacctaccaccatatttcattattatacattgttttaatgtatcaaaatatcacatgtacctcctaaatacacacaactattatgtaccaataaaaataattgaacaaacaaacaaaaaagatatagtgtactataaatacttgtcattttattaaaaaccttttctggtcgcctaggatgctatttgaagtgctcttcactcggctataatacgaagaaagtgcacattgatttacattcttcctggctatgctctatgggtaataatttagatagttattatgttcttatattcatagagttttatgatttataattagtgcatttattatactctcttacttcatggaaggcagttagattcattagatcaaataaagttatccttgtgaatctaagggaagactaacttttccctacagatcaaaactgtatttgtaagttttaatccaaattgcatgtgattatggtacacattttacaattttaaattcactttatatggttaaaatatacatatggtaaaaattgaaatgttagtaaagaaaaatatatagagacaatagtgaaaacatttcctattcccctaaatatttatttacattattcatagttgatgaaatactgttacaacatttacccttaccatataaaatcttgagtcacattgaatagattataactcagatgaaatagaaatagtattttattatagtattctgttactaatagtattctattagtataactaatgattatactaacctagaagcaacaataaaattgaatggatcctatactaatttccagataattatatcaagtaaaatttataaataagacaaagagtatttaaaattcacaaaataacaaatgcaaggtatcaaggacacagttccaaataatcaggaattaaaattaatatttttaaatgaaattacttgatcaactttattttgaataaacaagagaaaactttttttgtactggtgaaattccttttctgtatcccaggccaatttctgtatttccttttttcctgagaagaaccactgttttgaattcacaatgtgccatcagagctattttatattttcacaagtgtagccaagattttggggaaaaagcaagctactattctgagcagttttctggttaagcattaatacattggcaatattaggttaaaataaaatattaaaattttatatttttattgcttgaatgtatgcatgcacacatgtatgtatataatgtatacacacatatgtacatatatgtatagcatatgttatgcattatgttgatcagtgtgcatagattttatgtctttatacatacatataatcacttaggtgcatggcacatagacatatacagagctcaatttattttagctagtattattttgtcacacatgtttaaatagtgtagcttttaaataaacatggcagatgttgatctgaaacttgatttattttctccctctcgctatttctctctctctctctctctctctctttgtttgtctctctctttctttgttaatcatgccattatgtctttcccattcatggaactttcacttttttataaagtttagaatcagtttaccttgttccatgaaaaggatcttttgtttaaatgtgattgcattgcatttatagattattttgttcaatatctgtgtgtatggtggaactttttttaacgtgttagtaacatttagctatttttctgtaaatagcttacatatcttcagagaaaaatattatgaaataccttcagtacaaatgttttataatatttgccattcctattaatatatgaaacttgaaccctcagattgtgaattgtacacatataacataaactgttaggataattactccagtaaaatattttttcccaaaaaagacctctctttgcatagtgatctgtctcattattacagaactgacactgtctttacagattctttccacactagaataaaatggtacctttcctagttttctgttatttcagaaaatgaggaaatgaatcctggatgaaaacggccttcacattttgctcaattcttcctctgcagaggtgacacttgatagttcactttctgacttgactcacaactaacagtctgtattatagcactgacacctacaaatttacaatggcctttcttacatgttttgaaaataagagcagaataatgctagtaaaaatatgtaggaaaatctaagttccaggttgttccataccaaacactttaatgcatatttaaagtatcaaatatccaattatttctacaagttaagatttgttttggtgtcttggcttcaggcatgccctaagcaggtgcttgggtttgctatcagtggattcatcagtactggcaaagctaggcaagtgtgacattatgtgactaatatgaggctgatagatcccctgtcacaaggagatgttcacaaaggattggtcttgaactggatggctcatcagatgttgattaagattatgaatgttctgttacattctgaagagtctaatgagagtcatcgaatgcagttgcattcatttagagtagttgagcagatgaatatcatctaattattatatatctttctgatcacatggcttgctggggttgaaaaagagaaagacgtggcttgaggatttctttgatatgttttattattatttttctgcaagcaattttaatatatttaattcacatatgtattatatgtacattattgcataaaatattttgtatggcccacacaattgttgattgaccactgacattttggctatttcagaaaaattactactgaaactgtgattccaactcagtgtaattgttaaagtagaaaagattttttcttgaccatgttcttcttcagttactaataaactaggtatgacttgcccttggcaagatttgctctgtctgattggacatagtcgctatacgtgatttttaatttcttttatgaaggacatggcagggattctgaaagattaatgttgtcaaattgaagtctgaatgcccccaggaaaatatgccaagcaaaacatatgcatggcaagtttcctgaaatcactggtttttaaaaatgtatattttagttataatccaaacagatatgatacagtgaaaactttaattagtattaatgtaaacaccagacagcaaaaaaaaaaaaaaaaaaaaaaaatcacacataagactgttctctgcaacttacacttcagagtaagtaaggatatctgcacagcttcttcacagagaagcagtgaacatgcttctctggaaacatttgaggaacactttttttttttttttttttttggagacggagtcttgctctgtcgcccaggctggagtgcagcggtgcgatctcggctcactgcaagctccgcctcccgggttcacgccattctcctgcctcagcctaccgagtagctgggactacaggcgcccgccaccacgcctggctaattttttttgtatttttagtagagagggggttttaccgtgttagccagtctggtgtcgatctcctgacctcgtgatctgcctgccttggcctcccaaagtgctgggattacaggcatgaggaacacttttctaaaatgcaaaaatacgtacagtaaaagtatcagttctactctttaagatgttatttacaaagggtaaaattcataaatcttaaggggacaacttaataaatgtttacacccaagtaatcacccaaaacaagctgtagaacataaatgtgtacttcgtctcattatctcaacaaaatatttagagatatatccatgctgttgcatattttatttgatatgtctactaaataatcaggaggatttttattgcttacacaatatcccattgtatgaagatgccacatttcttttccattgtctttttcctaggtaggaggttgtttgtaacttttagttggcatgaataaatctattgtggacatttttgtgaacatattcactaatttttcttaagaatatacctaaaagtgggatttcagtgtgataaggtaactttaaatgtagcacttaattcaaagattaaaaatggttttctgaaatgttttaaaaattttacacttacacaagctatttgtgagattaatattttcctcgatttctctgcgtgttgccattctatttcttaataaaatccttgcaattaatataagatgaaaggtactcattttaataaatagttttattaaattatgacaaaactagacaattgtgtaactacaaacacgatcaagagaatactaacactacccattctagctttatggtaaactatcagttactacaagtataacaactttgtatttttctattttgtagtaatggttgttgcattttgtcacaagtgttgaaataattggttgttttccttttttagtctgttgatatagtaaattacaaccctgctaaaattaactacatttttataagaaaataagaattgactcattttatgtaataaaaatgaaggactataattctaaatagtaataaagtgaagatagcaaaatatttcagagtgaattaaagtatgctgaattatttgtcttgttattgaagacactatggtgactacagacatttagatattaatataagtcaaggttaaataaatttaataaaagcagaatattcaaaaagtaaattaaaaatataccttcaaattacataagaatgaatgataaacaagataatttaacaatttaacacaaaaattacaattttacaagataatttaacaatttaacagaaaaattaaaatttgataaagtttaaaattaaaattttaagagcattaagattttaaggaaattttgaagtaatttcagttatttattttgtgccttttatgtttattcaaaccttggagcattttatttccactgaaagtatcagatttttataaaactgtcagagtgaaattattgattttctgagataagaaatagtgtcacaaaatttgagcttattttagttacccttttatcttttgaaaagacattattatttttatgtacatgtatatctaattcattgcacaaatccttacctcttaaataatacaattaatgatggctttttctataagtgttagcaatctttctatgtccttagtgacaatatttaaatatatttcattcgtattaattttcatattttactagttttgaatttcatttgtttcacatgcacatatttttatataaagtgcaaaatgcagataatttgcaaatattcaactaatatgattatatatattataaaaaacaaagcagcataaaaggcatgattgatgaccacaatgacataacaaaagttgtatgacttggatgtcatgagagaccccaacatagctcttaactgatttactctacctctttaacagtttatcagtagcataaggagttagaaatctaaagaaaatgaatgaacattaaaactgaaggatagaaaatagaaaaaaattttatttgaatctttgaataattattgaagagtaaaaatatgatctagacagtattttatgtaattaacatgacagtgattatatctaaattctcacatcacttttagctaatatattagagaatttagagacttgaataaatgtactttctttttaatatctaaacagttttgaaagatcttcccaaaagttctctttttacttaacaaatagttaaaatgtattttaaatgctttgagtcaatattttctttttaaatattatattaaaattaatgtacaataaattctaccaagtgtaaaatgtgatgagtttgacatacacatatgtccctgtatatgtatatgcccatatatgtatatatccatgaaaccatcaccacaattgaattaataaaatagaaagtatcctgttgaccctctgtaatctatcccttccttatatccctaccattctcagacaaacaggaatttgctctctgtcgctatagatgacgataatttcctgtttttagctattataaacaaagctgctatcaacattagtgtttaagtctgtgagaactcattttgatatctcataggtaaacacttaggtgataaacttgataaaggtaaatacttaggctgaactgtatgacaagtatatgattgactttttaagtaattgacaaggtgcttttcatgataattgtatcattttacattttcaccagcagtgtttgagtgtccattttttaatcatattcactaataactgttataattactctttttaaatttttagccattctaatggtatataaaagtacctaaaggtgcttttcattttcattttttcctaaagatttgttgatttgagcctctttccatgtgcttgttttccatacatacagttgttgaagtgtctattcatattctttgcgcattttttgttgagttgattatttctaattagtaaataataaaactctaaaactctttataaaacaatattttggaggatccatattttacaatttttttctccgtctgtaatttgctcttttattttttaaatgatgtcttcttataaagagcaaaattgttgactttaatgtggatgaactttaatttctttttttatttagtaattaatgagttttggattctatttaagatattgttgacaaattcaaggttgtctgcaggctgaggagcaaggaagcccgtagtgactcagtccagagtcccaaaacctcaaaagtagggaagctaacagggcagccttcagtttgtggccaaaggcccaaaagcccctgacaaaccactggtctaagtccaagagtccaaaggccgaagaacctagagtctgatgtctaagggcaggaagtatccagcatgggagaaagatgaaagcaagaaacctcagcaagccagcttatcccaccttcttcccctgctttgttccagccgcactggtagccaactggatgctgtctacccacaatggtggcgggtcttcctctcccagtccactgactcaaatgttaatttcctctggcaacaccctcacagacacacccagaaacaatactttaccagttacctaggcatccttcaatcccattaagttgacacctactcctaaccatcacatcacatcaatgatttttaaggatcacatattttaaataaaactctgctcataggctcaaatgcaaacttatttcggtcaaaatattgattcatcttttaatatcatattaattagttatctttttcacataaagtaattgcttaataaatgttgaataaatgaatgcaagaaatatatatgaattaatgaaatatgttgataataacaataccattgcttttaatgaagaggaaaaaagggataaaattatgataggagtaagaggcaagaaaaaatgagcatgattttgaaacaaagtggggaaaataagggaagataaatatataaatttagatataatagttcacagagctctttaaggagatgcccaaatagacatctgcctccatccagtcacaggtgccaacttgcatttgaaatgtattacaaatttgtatcattacaaatccaattgatagcactgagaatataatccaaaattatttgaaaatagtttttcaaaaaaatgtattcctacaagaggagaaccaaaatcatatacaactttatctgacatttccatattagaaacaaatccggaaagtttctgtcaaaaagctttacatttgaataagaaaagatttttaaaattatctcgatgaaaccaattaatgatggcaaattttataagcctattgctataattaaggaatatgtttgctgtgcaagctgctagtctctgagtagttgaagttgacctagatctttgtgatactcaaaactggcgcaattcttgtgtgaagtgctaaattcaacattgctggtagaatataatagcttagtcatctgtcacaaattcactcatatgtggctattattagaaaccactgattcgcctaggtgtaagtcaagaggtaatttgatacatgataggctgtgatgggatgtgagagaatcaattttcattttggagcaaatggaataaatctgcacctgcaggtgacatggaggtcacaacctcatcctaggaacgcatagtaagccacagatgttcatagctttacaatttctagatttgattactgtaattcactgagtctacaaactggaactactcagtgacttctgcttgtatgggatgaagtggatcaataatttaaaattggctattgatggtaacacttcaaatatgatttcatacacattgtctctacttcagtgacacttcaccatcatttctaaaggccaagtacaggaacctgtaataatatggttgaaatactctgtgaaccttcaaataaaatagaacaaggcagcaaagctttcctttaatcacatactttactgcatatcagatagtgatacaggcatatagaagcaggcacaaatgtttagctcatttcataattagaatgactctgttattttgcccttattgcttccatgttaagattaggattttaaaactgaataataacaataatagtaagaaaatgccattgcaaagttggagatgattgactttaaaatcaaactcaagaatcttgtcaagagtatgggtacatgcaatttttattattctggctatagtttcagttctttgaaatcatagggttttaaaaatgttccttttcctattacagttaatatatcaatgtaaacttttatttatctcctttatgccattttatattacagaatgtgttatgtaatatttagcacaataaatatattttaagtaaacagaaaaaacatttatatgtgaattagaactggaaaatatttgttcttcaaagacaagtaaaattttggatagaagccgcattcaaatggtaattcttttcctgaaaaccatgagtcaactatcattgctaccattataattaaaacactttacttctttttctatgagagaaataatttgaaaatactagagaaagtaattactgggtatatatccaaaagaaaataaatcgttctaccaaaagacatatgcactcatatgttaattgcagcactattcataatagcaaagagatggaatcaacctaggtgctcatcagtcgtggattagataaagctaatgtatcacatatacatcatggaatactacacagtcataagaagtggaatcaggccctctgcagcaacatggacgcaagtggagatcattatcctaagtgaattaacacaggaacagaaagaaatgcctcatgttcccacttacaaatgggagctaaatgttgagtacacattgatataaagatggcaacagcaggcactggagactaaagaagaacagacgagggaggcaagggttgaagaacaatggttggacacaaaactcactacatgttgatgggatcattcgcactccaaacctcaatgtcactcaatacagccatgaaacaaacctgcacaggtacccccctgaactaaaataaaagttgaaatcataataaataaataaataaagtttctctgttatgtttaaaatacataaaaggcatggaaaagaatatggaagaaaagaaaacagaagtagttctcattgtcttagatatctgtcatcttttttgtattgttccatagatcatcttcaaaataatagagattatttggtgattacttaggcaggcctataatgagagtttttgggggatagggagtaagtcagaatggacaagatatgggttggacaaagaaggctagacatagacatgcttccaggagttagatatttcttttccaaatggagatagagaatttgaccattaatatttgaattcacccatatctatgggcaagcaaaaagaagtgaacttgtagacatttattgtcaggctgaataacttcagggttgttctacgtgatgggtcacttttgcagagggtgccaggccatggtcaggtttatggaaaaaagggtcaactcctgggaggtggaggaggcatgtgctagacagattgttcagtgctatagggacaggttgtcataagcaaaaacagaaacaagattataatgactggatcaatatagtggtcattaataaaatctttcagcttgatggaaaagcaaatgcacagcctagaaactaattctgggaattttctgacttgtaggtgtgaggctaagaatcatcttcataccttaattacaattggatcagttatctggggggataaatcagttatctgtaggataaattactttatagcctaatatttaggggacttaagagaagactgggacaaaaaacttttagtattaatttttaatagggaattctaatgaaattacactccatcatattatgggtgtctaaatttgcctttgaaatctatctagagatgaaaataaggagaaaaaagagggaaagattaaacagtgttatttatggcaaatgcttgacaggcaggagattaatctaggacatttgaatggcccttttatcttatcaacaaaaacatgaggtgaggtcaacaattcctttcttgctctggtaagactgagactcagtaaatttaagtaacctgactacatcacatttacagggatgttgtattcactatatgaaccaaggtttgcctgacaagctctgtctgaggagaaaattcaggagctttcagacacattaacacttctgatgtgccgtttctcaatgtatgcttttttccaacactactgatccatgctagattgacttttaaaaatgcgtgtgagctggatttatcacatggaagtgctttccaattttctgcaaaacatgagcagtagaattaagtagtggcaaaaaaactttttgagagctaaggggactgagcagtgttaataaataaatggggcttttctcttcttttgtggctagagaaacaactttcagatacaacattgaattatatcctccaaactacagaaagagataatgtatgttgtatatcaactaatttttaatagctaagatggatttaatatgtcagtatcatagacatatatgtataaattataactatttttaatattatttactgagattctattagaaaagcatatgatggctaatttggacatttagaaaagttttataaataggccgggcgccgtggctcacgcctgtaatcccagcactttgggaggccaaggtgggtggatcacaagatcaggagatggagaccatcctggtgaacacggtgaaaccctgtctctactaaaaatacaaaaaattagccgggcgtggtggtggacgcctgtagtcccagctacttgggaagctgaggcaggaggatggcgtgaaaccgggaggcggagcttgcagtgagccgagatcgcgccactgcactccagtctgggcgacagagtgaaactccatctcaaaaaaaaaaaaaaaagttttataagtaaataataaaaatagcataatgttgctacctaaaccagtagtcagcaggctatagtctgctaggcaaacccagctgtagcctgtttgtataaataaattttattggaacacagacatgcccatttgtttatgttctgtgtatacctattttcacgctactgtggtagaattgggtgcagactacaccagctggcctgcaaaacctaaaatactggttggctcgccctttatagaaagagtgcctgttcctaacccagaggataatactttttacaattgactctattattttgctgtttccctgtgcattgtatatgattccaattaacaggcagataattattgaagatagctataaaatgagaaaatctataatctttgtccaacattctagttatttttaacatatttgtgagaagatgtagataataggagaattttctatttaacctgtagttccattcatttatctaacacataatgtttgcataaatggtaccaaggtctgtgctaggtgctgggactactgtaactcagttttggaagtttttaatttgacatacttattagacatccaagtggagttatacagtgtgcaattaggtaaacgagttttgaatttaaatcggaggttctggaagaagagtatttttattatattacctcctattccctccattggtgagagagggattcccacgctattgttacatggatggccaaggagcaacagtcaacatggggaagatgagctagacatcagtgtattagtcacctaaattcagcttaggggaggagacccaagtagaaaggagatctactttgggccaattacagggaagcccaggaattattcccataaaattaatgataacttatgctatctttatcttcctggatatgaataagaaatatataatcgctctatttttaacagtcaagtagttaacaaatctacacatagagtacctgtgaccaagaagacacatagggaaacaaaattgaaactgatcatgttgagaacctcgatgtattcctaaagttttgcttgagacacagcatttcaatgtagacagtgatagggttcctttattggttaagcccatttttaattctattttgtgttactcacagatacaagagttatggaaaagctgcactcttctacttccaaagtttaacttcttcacagaagtcagtttcagagttgagaaaagcaaatacttgctacatattttgaggaacaataagtattgaagttgcaaacaggttctatggatatttgtcaacagaagatagctgatcacaaatgcgcagagaggtagaaaaatgacacaatgaccaccctaccctctgagtcagcaaattgttttctcagtacatttctactctggtccttgtttaataaaacctctttctccttacagctgcgtgcagtaatatttattatttaaagttcttgtcttcaccttaacaatcttagtttctgctttaaaataatctcttaaatattcatagggattgcacatgtttttcagctgccaataattattatttactatacactgtatagatctaaattttatgcagattattcagacaatttttaaaataatagattctgtccttcttgtgacagaaaagtaatttcttaccaatgataataaaagattttttgtgtatttgctacagttaagtttttttagatattcctgctttaagaactctaaattatttggaatttgcttttataaataatgtgaagttgagatatggcatattttttcttctaagttcataacttagagttctaacttctttttctggctgatttgaaaatggtgcatttttaatatggtaaaaacctccatatgcctgtgtatttcttccatattttatattattatatttatctgttcattctcccttatgagaaaaaatgtcacctttaactactatgggtttttagcacatataggatacaatataattaagcacatttaaaaatattttttaaattctcacttattttttctcatgaaatttaaaattgatttgccaattttctttcaatttccttaagtgtatacataattttggcctgtctcctatggtttgtatcactacttatcctattttaaaattgtaaaacttttgtggttttcttaatatggactttcctaatttcttacgaagtttatttctacataatttaaagttttataacttttgtgactgggatttgtttttcattgcatttcctaaatagtaatttctgttacatagtcaagctattgatttttgtttctctatgtaaagagtgccttactaatatccagatattctaatgactttcctagggttttcaaagcagataaaccttatataatataatgcttttgttccaatatgtataactcaagccaaagcttgaaaaaatgatttttaaaagcagctatgaatgtgactatttacatctaactatatttctgcatatgtcttaaatattgatatttattttgactttcatacttctaaacatattcaataaatatcattttgattcatttatctgagctttttttagttttatcctctacatcacatttggcaaaaataatgtgattttttttttcattttaagaatttacatgataaaatattaaaatgctttctagtagtgaaacctcctgagtgttactgacatctaccaatcccattcctgccttatcgcttcttttgggcagtcatgttctcgacttgttaatattttcttaacattttttaatcaaaatgcatcgataaattttacacactatttgtcctttttctttccattttatctagtggcaacagaattctgtacaatgcaaactgtggaacatatttgctaatactaagggctttgtatttatacagtgctgtattttaatcccagctatgtcattttctagcttgatcgtattaggtaatgtgttttaatctacatttttctgtttcttcatgttataaatagggaacccaatagtgtttggtgatgattaaatgaggtaagagaaaaggcaagccaaccagctatcccaaaggctggaacctcaacattagtcaataaatatcagtcatgaaataatggtacaaatcttgtctcttaatttgtcatttcttatgtttagatggtattttctaagttgataggttgttaataatgaaaatactcatactttttcttggacattttgaggggtcctcttttccaagtgtagaccaaacaagaaagctacaatatttcaggtacccatcagcttgttagaaagaaataatcacaattggtataattgctttctctattggaaagtttattttccctgatctatagcatctgtcgattagcttgagtagtgcctctattcattacttgtcatgatgttatttgccgtatcaagcaacatgagacatttaactctcccaacccgatttggctaccatggctagccctactttttattattatttattatatacatttaaggtatacaacatgatgttttaatatatgtgcatatatttcgtgaaatgattactacagtcaaagaaattaacattccgttatctcacatagttaccattttgtgtgtgtgtgtgtgataaaaataccgaaaatatattattttattgaatttccggtatataatctaatattgcatagtattataatattattatataacaggcatatgcccactctggagcctagacatgcttcctagagatgcttcaaggaacacagtaatccccaattctgaagcaatctttgcattctgagaaactgattttgctggcaaatcttccattgacttcctttatattcagaaagtcatgcattaggttgagctgccttcaattttacagatatataataactgtacatgtttgtgaagtacatgtgatttttaatacatgcaatgtgtaatgattaaattggggtaattaaagtatccatcacctcaaacatttatcagttctttgtgttgggcacatttcaaatattctattttgaaatatgcaataaattgttaactgtagtcatcccgctgtcccatcaaacacaagaagatattccttctatctaactgtatttttgtaccccttaaccagcctcttttcattgctccccagttctgggttctgttaacccaccattctactctctacttccacgaaatcaatttttttagttcttgcatatgaataagaacatgtgatatttgtctttctgtgcctggtttatttcacttaacataatgacctccagttccatccatgtctctgcaaattacaggatttcattcttttttataacatgccttccttttttattccatttgcagtatttatgagattttttctttaatgactgtccccatttcctttttaaaaatactgttgtaagttactttgtcttatatattctatctgtgatttcaacagattggtggataattaatacatgttccatccttatcttactgagagtcatctttatctttgagccaacaaatactccttcctcttttattattacaattattaggtcatgatgtgattcctcagagtcagcaataaagaaaactaagtaacacctgagattacagcatctgctgtacccaatttaatttctccttcataacaatttagggagaagtctatcatattttagaatagttagagaacagctgctgaaaaaaaatctgcctgtcaaagttatatcctgatgttaaattagcctgttacctgattgttgtcttctggtcctgaaaaaccataaagactatgccagcaactcacttagaagcagcacacatgtacatattacagcccatcatcataattagtggaggaaaagataacacaaagtgaatgctatataaatatatctaaaggcatttatggaatggtgggtaacaatataaactagtaaaatatatttataatataaatatttctaaatatataaggcacaagttcagccatagaatcataacattgtagtagtatgcagagaagacatgcaaaaaagaaagctgattgacgttttgatatgtgtgtatgtgtataaacaggtaaatataccatatatatgtatatttaagaattttcaggaaatatgtggttattggtacccacacaggtaggtagcctcagctacctaccaaacatttaatattaatgttaaagaagttatagaatacatatatatgtgttttacatatgtgtttgtaataaaatgtctataacgtgttttaccataattcaatgcatatttaaattaattaagagtactaaactgtgctcagatttcatgcagtatcaacagaagttctgccttagaggcctacagactcttacttagttccatggcacgttgagtgtgtgggattcccttagaatgatttccctttaatggaaatgaatattaaatatattggaatgacctatttgcaaatactccttcactgattaaactaaaatattttctttaacatttggcaaatccatcagctttcttttttgttgttacataagttcaacaccaaaatctgttttagagttagttaccccgaatttgatttaatacacatcaggcataaactttcattggttgttcatttatgtgtttattacttattctacctgttgttctcatttttacaaagtagtttatgccattcagggattttctgttttgtactaaagctctaagtagcagcttgttagagagagtgtggagtaaaaccttccttcactccatatccttccagttacctgagcagtttattttggagaccttcttctccaattcaaaaaccctatgaaaattgtgttattttcataacctgtgcaaataactactcttctaattggtgattttcatacataaaaatccattatggatttttatgtatgaaatccattgtgaatttttatgtataaaattcaccaattagaagagtagttatttgcacagattatgtgattggtaaggaatgaattaccgaaaattattaaccaaatttggggacaaattcagaagggaaaaacatcaaaggcaaaaaaattacaagggaaaagtctgatgtttcatggtcatgaatatcacaagagaaaaataatacttcaaggttttgtataagaaccattttccaagggaaagagcacaaagtacttattcctaaaacttgatctcttttttctcccgtacctagaatcatagaacaggagaccttgcctgtatattctaaacttcattccgtacaaattgtgtaacacatttcatcatactgactttttcctgtgttaaaaacctgccaagatgcttctcacttcaggatattttcattcaattcaaaaaccattttcctggtctttcacaaagctggcttctctcatgagccaagattcacagctaggtccatttcccagaaaggccttccccaaacacattatgttaaatgtcttaatatactccatgacagctagtattcattttactttgaaaaattatattcatttatttgcttttcttttttctttttttattatactttaagttttagggtacatgtgcacaacatgcaggttagttacatatgtatacatgtgccatgttggtatttgcttttctttagagttcatctctgatagaatggagacaagcagggaaaacatttctcttattcctgattttggcagatgcctgaaggacatggtactgaatgcatatgtgttgaataaatagatggataaatgcaaaggagaatgatgtcaagacaaagtgtttgtgaggaaaaggtagtagctacaaattttgtcagcaaagtaaattaatccaatgtagataaacttacttttattcaaatataatatgaattcagaatagaacacaaatttctcggctgcccacaattttacagaatgaacacttctatataaccagcatacagtttaacaggtagaatattatgcttctattcatgcctgttttagtcattacactctcccaaagttaatgtctagtattatttagcatatattagattagttttaaaatttataaaagtagaaccatatagcttgcatctttagtctctgctcttttattccatataatctttttgatgatagtgttagtctgtttctcattgctataaaggagtacctgaggctcgctaattataaataaaacaggtttatttggctcacagttttacaggctgtacaaaaagcataatgctggttcctggtcaggacctcaggaagcttttactcatggtagaaggcaaaacgggagcaggcatgccacatggtgagagagatagcaagagagatgtcaggctcttttaaatgaccagctctcatgtggactaacataagaactcactctcccactggaggccaccaagccattcatgagagatccacccccatgactcaaacccctcacactagtcccacctccaacatcgggcgtcacatttcaacatgcagtttagaagggacaaataatccaaaccctattactttcttccatatcgctgtgtattgtagtagtagtttcattgctgttggtgtctggcatctccttgcaagaatttaatataatttattattcattctactgttggaaaacatttgagagttttttccacttgatgtgattactaggtgggacagctatgaaaaattttgtgtatatatatttttgtacatgtatgtaagcatttctcttgagtataactttaggaatatactaacttgtccataatagattcttatgttcaattttttaagtacaagtttccaaaacagatgtactgctttgtagtctaacaagaggtataatgtttctggtgttttgacatcactgccccacttagtgcattcaaaaacagtaaaatttagcaccatatcatatgtgatatagtttggatagttgtccccattcaaatcccatgttgaattgtaatccttaatgctggaggtggggcttggtgggaggtgtttggatcatgggggcagatccctcatgacttggtgctgtcccttcatggcttggtgctgtcccctcatggcttggtgctgtctttgcaatcgtgaagagttttcctgagatctggtcatttaaaagtgtgtagcaccggccgggcgccgtggttcacgcctgtaatcccagcactttgggaggccgaggcgggtggatcacgaggtcaagagatcgagaccgtcctggtcaacatggtgcaaccctgtctgtgctaaaaaaacaaaaattagctgggcgtggtggcatgcacctgtagtcccagctatttgggaggttgaggcaggagaatcccttgaatctgggaggcagaggtttcagtgagccgagattgcaccgctgcactccagcctgggtgacggagcaagacttcatctctaaataaataaataaatacatacatacataaaataaataaattgtatagcacctccccaccccattccctccctctattgctcctgctttcgccatgtggtgtgcctgctcctccgccaccttccatgagtaaacgctccctgagctctccccagaagcagatgccagcatgatgcctcctgtacagcctgcataactgtgagccaaataaacttcgtttcttataaatttataaatgacctagtctcaggtattgcttaatagcaatccaagaatggcctaatatgtttaatcaataggtttattgaatatttcaaaattcttctttgaaaagtgtctattcaagatttttccacattttaaaaatagggctgtctatccttttcttattgatctgtaggagctctttacacattctggataaaaattcttatataattattgcaaacatctacttgtatcttttgatgattagagtcttcttatttattggttcattcatttatactcttatttatttatggattttaatgtgaactacatgcagtcatgagttggatgtaacatttacaggatcctgccctagtttggctaatgacattttgcttaagcaaacttgatgaaatcaactcttcatggactacaaaaagttatttaactataaacattcctagaccatgagatggaatagaaaaatacagtatttagaagagttgactgtctacaaatcctttataatacccttcctaagaatcactattagtattttaaatcttcttaatagtttaacaattgtgattttccaattgtgaacccaaatatgacattgaaacacaatagagtatgaagctatcaaagccacatttaatgtctagttttaccaactgcatcaaaacactttatggctgcatattactgctattactatcattactgccactgatattacagtcatttctgtatggccagctgcactgtgcatacgagctcctcaatggatatacttcatttttaaatcaaggtctacgatcaaaatatctgaatagagaaaataaacaaatagaatgtaaatcctctacatcacttttaaactctaagatagtttacttgtacatgttacaggccagaggagactgttttctccaatgaaattctatgtatggtagtaattaattccaatggaaaaatctactggtaaatggccaaatcattcttaattgaaaatgatgtcaatattaaattatttgtatgaagaccaatgcaccagaagaattactgacccttaaaagttcttagcttaaaagataaatagattccttctgactgaagcaagtttctcaacagtgactaggaagacaggacagggtttccctcatgaaataaaggcatttacaaagactgaggcatatcatcagacctctattagtttactcttttattcagcattttttaaagtttgtaacacactaggaattgttctgagttagactgaagtacaaaatgaagtctcaaaaatagacgtggatgtgagacatgcaaaaggagaaagtgcattcaatttcggcaataacagtaatgtgtgggcaaatccatagtgggtgagtttgtgattgactagatattacctttgcttatcaagcctgcgtttgagaaaacaaaaatatttccagcttttacttgtagaagcaatttttttttttcaggaaaaatacatagctaagtaaggtgcttaaattaaattagttactactgatctgtttggaaagaggcaaacactgactcttccataagcaattatttgttaattttagaattagtgtttagatgaaaagtgttgttgaatgttaaaatgagtacaattagagcatttgtttcagaaatgtcaaaattctgagaatatttaaaacatttaattatgagctgagatggacatacctaacataaggcacacattgctagtatcctttatgtaaaagtgcatacaaatataagccaaatagagaaatactaatattaaagtcattttggaaaataaactaacacctattgattatgaaagctgatttacaagaattgtaagaatcctgaaacataaatgtcaattgcagattcaaagcacactagcaggaaggaggaaacaacccagcttgtctctctggaggggctcaaccttctcaagtacaactgcccaattttccctttcttctgaaataaggtcgcttctggttttgaagtaagaaaacaaaaatgtgcgcagaactttgttctcagaagagggaattttggtttggatcttgctatagtttgaatgtgtcaccaaaagtttgtgtgtttaaaacttaatccccaatgcaacagttctgagaggtgagatgttgtaaaggtgatgaaaattctgttcttatgaatggattgctgccactatctcggaagtgggttcctgataaaagaatgagtctggccatcttcccttctttctctgtctgttatactctcttgcttttctgcatttcatcatgggatgacacagcataaaggtacttaccagaggtggtccatcaatcttggacttcccagcctctagaaccatgatccaaataaatttatgttctttatatattagccagtctcaggtattatcctatagcagcacaaaatgaactaagacagttcttcctacttttatattacaatatgcatgcagagagaaaaatatctgcctagctctctttcatactccagccggatatgctctgttaaaccgtgacttacaagtatacttacccatttagacagactgaatatgtcctgctaaatatatttttgtcaagataaaaactctctagtatcacacacttagcaaatattattagcatttacaaataggtccatcttttgagtttgtcattgcctacagagtcccctaggaaggtgcacactactatatcttccctaatttataaaagaagatggggccgggcgcggcggctcacgcctgtaatcccagcactttggaaggctgaggcgggcagatcacaaggtcaggagatcgagaccatcctggctaacacggtgaaaccccgtctctactaaaaatacaaaaaattagccgggcatggtggtgggcgcctgtagtcccagctactcgggaggctgaggcaggagaatggcatgaaccctggggggcggagcctgcagtgagccgagatcgcgtcaccgcactccagcctgggcgacaagagctagactccgtctcaaaaaaaaaaaaaaaaaaaaagaaggtggtcaaaactttagtcagcatgttggaaaaaaaatcttactcattatgaagtaatagcaaattacaacaatagttttctaataccaactattaaatcaatcatttttgttttgttttttattatgaccccatttcagatatcgtgtaatgctggaaaactattttacaatttggataagcattcttaaaaattctcctaagatttaacctggtgattttactcctagaatgttatcaaagataattatcagtaaatttgtgaataatgacaaaagagtccaacatgatcttaacattaatgtgtcacaaattaaagatggctaagtatatggtgcttttatctaaaactaaatttttctaccatttgaaatgttttggagacttactgacccaagggtatgctcatggcataacttgtagcaagaccctttaaaagtcttatagctttgagtcagtagttcatctaacctgaaagctatctaattaaatatagaaacatcgaaatatactaaaatatctcaaattatgtattcagtagaaataatgtgtcaaacagttgtagaatagtaatataaaattgctaattccatacatgataatagaatacagttattatagttgttatgaaaaattacagtaatattagatgcttataataaggttaacattttaaaagtatacaaaagtacacataagataattaagtaaaatacatttaagataaaattacatgacatctttataaaaattgtattttagagaaaaatggatgattttctagataaatgtaaattaccaaatgtcatctctttgtaacagtaatatcatcataattattattacattgtagaagatatcccaagctttctgtacaacatcttagttaatctacataataggtttgttattataaaataaggtgacattagtgtcaaagaaccttttatcaccatctttggaaagtgaaagaaatgaaatcatacattgcctatgtgtttcttattgttaaaataaaatacaggttcttttacagaagctcataaaagagtgacagtaatacacatactaaatgattatgtaaattctactattaaaataaatcagcttccaaccaatttcaataagcttgtaaattatttgaggtaggattttcctttctttttgtgtcaggtttataaaaattacttaatcagcacaaggaaagatcaatgtatatccttagaaaagttttattttatttgtttcacaaacaggcaatttgtaaaatatgaatccaaaaataaacgtggatttaatgtataaaaggtagtaaaaatatatttaaaataccaactttccatcaaatcttatatattgtcctttaaatacaagaaatgagtaaagacatctatctatctagataagtagatgtataatgtgattctattttagataaatcactctgtacattcaaacaagaacataaatgtttttttacatgtgtcagctcttaaaacctgtttgtgtacaaggcttgaaaaaatacgatcataataaataagaccaaaactttcataacaatattcaaaacactcagattttaatctgaaatcactcatcaccaagaacgagttttctcaaactgaatgagaaaagacagtaagtggatgcccacaataataaagacattagaagtatttggctaagactctatagcagacatcataaatatgctttaatactgaatcacacatttgaaataaatgaaaacataattatactaaataaataaggattctgaaaaaagtaaaacatgaaggataaaaattaaactttgaggactgaataatatcatgacaaacgctaataataaaataacacttagtggaaagtctcaatagcatgaaatactgaacataaaaaataatcagtgaccttggaaatagaactacaggttgtccctgatttacaatgatttgacttacaattttttttactttaccatggcatgaaagtgatacacattcactacaccccttgacttacaatgaggttacgtccaaataaatctactataggttgaaagtattatgttaatttatgttattttcaactaataatgggtttatcagaatgtaattccatcataagtcaaggaacatttgcttagaaattatcccacctgaatagtagagaagaaacacgctaaataaaaatgaatagaaactcagatatatgtgagactatagcaaaataataagtatttgtgtaaatgaagtcctttaagaaaagaaaaaaaaaaggatggttctgaataaagattttttaaaatggctgaaaaatttccaaattttgcaaaagacataaaacaacacattcaacaaattcagattgacacctgtgatggttaatattgcccgtcaacttgattgattgaaagatgcaaagtattgttcctgggtgtgtctgtgagggtgttgccaaaggaggttaacctttgagtcagtggactgggagaggctgactcaccctcaatgtgggtcagcactatctaatcagctaccagcatgacctgaataaagcacgcagaaaaaagtgaaataaaacttgctgagtcttccagccttcatctttctcccatgatggatcctcctgccctcgaacatcagactccaagttcttcaacttttgaactcttggacgtacactaatgatttgccaggggtcctcgggcctttggccacagactgaagcctgcactgtcagcttccctacttttgaagttttgggacttgggctggcttccttgctcttcagcttgaagacggcctattatggaacttcaccttgtggtcatgtgagtcaattctaataaactccccttcatatatacatctatcctattagttctgtccctttagagaaccctgactaatataacacctcaaaatttcaaaattcaaggaaggaaataagctccaaaaaggatagtttcagaacaatctgtgctgcaccatactcaaacttctgaaatctaaagacaacagaaaaaaatcttggcacatcagtgtgatgtgaatgatgatgaccttcaaagatgtccacattctaatccttagaacctgtgaatatcttaccttatataataaaaggtgctttgcagatgtaattaagaatatcgactggggaatttcatacaggattatctggatgtacccaatataatcaaaaatatctatacgagagagaggctggaaagtcagaatcatgaatggaagtataatgatgaaagcagatgtgggagcaataccaattctgggaagggctcaagtgccaaggaacatgggcagtttctgggaatctggaaaggacaagtacacagatttttccccaacagatcctttagaagaaacacagattttgtaaactactttggctttctgacctccaatattgtaaaatacgcatttgtgttgttctttgccattgaatttatggtaattttttatggcagcaattgaaaactaatgtaagaggaggaagaagaacactgtaatatgggtaaaggcaagagactgtccttcttgatctttttaaagtatgtttgactatggaaaccaaaattatagccctgtcttatacaaaataatacacatagtaatattctagataaaaataaatgctaaaaatagtttaagaaacccacaggaaggcaaaaaaaaaacaacctaaatacactcaagaaaatacagaagcagaaaatcaaacaaaaagaaaaaattgcagattgatgtcttaaaatataagtgaatatattaaacataaatgatctaggcatacaaattaaaaggcagaaacgggcagagtggactacataaaaatgatcagtgtatgtcttgtttataagacactcattttaaacaaatcaatactttataaaagaagagcaatgcccaaatacatatcgtttcactgaataattctacaaagatttaaaaaaaaaaaaaccaattctacacaatttattacagaaagcaaaaacacttacaactcatttgtgagtttagtattatcctgatattaaaaccaggctatgacagcacaagaaagaaaactgtagatcaatattccacatgaaaatagatactgatatcttcaacaaaataagatcagaaaaaaattcagaaatatattaaaaattgtacaccatgaccaagggggatttatttctatgggagcaaagctatatcaataatttttaaaggacaatttaattcattatattaacagagttacaaagaaatattacacaatcatagcattaagtgtagaaaaagtaattgacaatatcattcatgaaaatcttctagcaaaatataaataaggaaggcctttttcgaattgataaataatatgtacaaaaacatcctacaggtagctttatattcaatggagaaagacttaatgggagaaacactgaatgcattttccctgagattgtaaacaagacaatggggtcatctctcaatattctcaatcaattcaattctagaagctctaaagacttcaatatggccaaataaataaataaatgaagggcacgcatgctgcaattgaagataaaaaaaagtcccgatttgccgatgacataattgtctccactgaaactctcaactaatatacaaaaacctcctaaaataaattaggtcatcaaggacacaagatacaagcaggatacaaaataaacatccaaaaataatttgtatttctatatgccagcaataatcacatagatactaaaattaaaaattttataccatcttcagttgttcgcacacacgaagaaatgttttgttgtaaatgaaatatgtagaagacttgtgtattataaagatgtgcaatggttatgaaaagatcaaagaagatttaaataaagagagacatatactatgttcatgaattggaagacagcacatgaaagatgttaattctccataattatatacaggtataaccaaattcatatcagaatatcattaagatttttatagatataatgaacattattctaaaattggtataaaaaagcaaaagacctgaagaattaaaataatattgaaaattatgaatataaaaagaggaatcagtctatccatttttagactcactatatacctacagtaatcaagtttgtgtgatattgatggaggaatcaatacatagatcaacaaaacagaatagagaactcagaaatagacctatatgaatatgcccaattgagttttgacaaaagtgcaaaagcaaaatcataaaggaaacataacctttgcaacaaatgttctaacattcgttatagcaattggacatgtctcaaactttataaaaagattaactccaaatggattacagacagagtgggagaaatagagagatgttggtcaaaagatatgtttcacttatgtgatgtgaaaactttatagagatctaatatacagaatagtgactatagttattaatactgtgttgactattttaactgtgctaagagagtagatcttaagtgttctcaccacacacacctgctaaaaggttactatgtgaggtgaccaagatgaatatgttagttttctgtagtagccattactcaatgtacatgtatatcaaaacatcatgctgtacaccttaaatttatgcttttattttaaaagtgattgcagacaaatgtaaaatgtgaaaaataaaacttttgaaaattaggagaaagatatttgagatctagagctgggtaaataattcttttgctgtgcagaagctcatgtcctgcacatgtaccccttaacttaaagtaaaagttggggaaaagaaagaattcttataaaaggcacaaaaatcaaagaaaactttgataagtcagacttcattaagaacatcgaaatatattttcactgtgaatgaacctttgaagagggataaaagacaagctgcaggctggaaaaaaacaatttcaaattacatagctatctagattttacagagaagtctcaaaaggcaacaggaggaaaatgagaaatcaaatgaaaaaattggcaaaggacgtgaagaaccattttaataaagaaggtgtatggatagcaaataagcacatgaaaagatattccttatcattagccaccaaggcaaggcaaattaaaaccgcaatgaactattactacagacatatcagaaatgcaaaatttaaaaacaaaatcaaaccaaaccaaaaaatgtggcaacaccacatgttgatgaacatgcaaagaagtgcaatcactcacacactgatgactgaaatacaaaatggttcagccaccctgaaaaacaatttaaaatttctcaaaaatctgaacatatcactaccatatgaaccacagtttgattaccatttgccaacaataattgacatttatccaagaaaaatgaaaacgtatattcacagaaaacttgcgcataaataattatagaagctttatttggaaataactcagatgtttttcaatggataaatagaaaccccacaaaaccatggtatatcaatatcatagaatatctcccaacaagggagaaaaaaccactctttataaatataagaatcttgatgaattttcagaggaattatagtaataaaagccaatcccaaaagatatattttatgatacaatttatatataattagcaaaatgaaactagagaaataacagattagtagttgctaggagttaaagggggtgaaaatggaaggaaagtgctcgtagatataagagtagcataaaggatgctgtagcgatggaagtgttcggtatcttgtctgtattttatgtcaaaatccagattaaaatatagttctatagttttacaagatgcaatcattagagtagatctaataaaaggtacatagtacttctgtattattttttacaacagcatggaaatcagtaattttcttaaaatagaaaaaataattaaaaacattaaaatcttgtttgctttttaatttggtatttacaaccatatttctctagtatttacaactctatttctaaaccaaaagtatgtagagctatttttaaattttcatgtttgaaatatatttatactataccatatgaggatttacctttattaaaatgtgtttatagtcacacatataaacacataaactcaccgtcttcatcagtattctcagcctaaagttcacagcaactcatggttaaatcattattcactcatttcaattatttaatataaaaatatttttatgatcaagccatgttataattattattcctctgtaatcaaactatttccttttccccgatattaattattttggacatttagttctgtcatgaattgagaatgtttggctacataagacataaagaatttgtggaaatctagcatgcatgctgtggaggcaaaacaactgtaatagaagggtagtaaatatggataacagaatggtgatgtaggacctagagatggtaggaagtaagtgaaaagcagggagattgtggcctgagatatgaatgtatcaggaaatgaccacagagagactagtcatctgcctcttgccaaacatttcatgtacaatgctgaaagtgtatattgacaaaagtccttactgaagtgaagctaatcagaagaaaggcttcttatcgccaatattaggctgaaaatcatctttctctctgtctctctctctttctttctttcttttttttttggacggagtttcgctctttcacccaggcagaagtgcaatggcaggatctcggctccttgcaacttcagcctccccggttcaagtgattctcctgcctcagcctcctgaataactgggattacagtgccggccaccacacccagctaatttttgtatttttattagagacagggtttcgccatgttggccaggctggtctaaaactcctgacctcaggtgatccacccaccgcggcctcccaaagtgctaggattacaggagggaaccaccgctccaggcctaaaattcatatttgtaaatcactttgttaatattggacactaaggagattgcaatacagacacttacctcttctgaactgacattcatggtaatacacgcaacatttaccttggtagttattcttgttatatagtgggaggtaaggctttatcctagacagccttttaagttagaaatgacaaactatatcaataaattatattgcaagaaaatcaacaggaccagatggcagtcattcaaacattctgcagactctttaaaattaattcactgagctaaagataaaaatatgtataatccatcattgacaacagctatcctgcctaaagactggacatcagccaatcttcaacgtctatgctgccacaaaagtaactaacataagaagcatatataaaaacatttgaaagagattctatggtttcatataataaagtaagcttacatccatttttctgaaaattgtcttaggaaatatagtttgtctatattttctataaagtcacatatttatgtagataaatagataatgtgagttgtaatatgataaaattaggcttcatgtaaatgcaaaatcatttggctaacctaattatccaggatagtagaggattggtatgttaaaaggtagacttaaacttggtatagtttggataccatctctaagaacaagctgtgttagcttaacaggcatgagattttctaggatttctaagtatactgtgacaatactgagggtaaaggatttttctagagaatgcttgtcagcaaacctgttcttttgtgaaagcggtggacccagagcataatttaaagatgtattaatatgggatattatctgactcttttttagaaacaaaagttataaagagaatctgtatatttctccaagtagtatcaatggttttcacaaatatgagaattgttttgcacttgcaaaaatcctatttgccatacaacaaataatcatagaaatcatattccctcatgtccacaggtcatgttcataatcaaaggaaaggagttacacaggaataagtcactggggatcacttcagcactctgaaaaccacaaagtttactttgtttctaatatgcatttactctttgaaaagcatagtaaatttatgtgattgcaaagtaaaaacaaaactttcttgatcccactctccaattttaagttctaataaaaacagttaaaactgtaaaacaaagaaatacataaaggtaggagaaagtaaaattattctttacattataatgtcaactaacatgtggaagaaatgacagttaaactcattgtaataagattttgatatgtatcaatggatgttcaaacattagatgaatgtttgttgaaaacaggatcaaaattgctccccgtaaatgacttatcaaattctaagggaaggaaggaaactgtgtgtgggaaaatctgatggtcacttccacaccaaggttaccagcatcaatgatggcgtgcactgataccaggtgttccttgatgtatcattttacactgaaaaggatacagcttcaagtatattatattcctgccaaaaattaattacctggatctagttaggataaaatatgcaagcaaacacaacttgtgggaccttctataaagctcttggcctctacaattcagaaatatcaatgtgaaaggctgaaaaacagttccagaataaagtatgctaaaggaacattaacattgaaagtaaaatacatttttgtgttggaactggagttgaataaaaattgctatgaaggaggttttaaaggtaattaataaaagttaaacatgaatttgatgagaattataagtattgcatccatgtaaattacgtgaatttgataaatgccttgtagtttcataagagaatgttctcctagttcctaggatattcatactaaagaatttaagggtgaaggatcatgttatccaacacttaattttggatgtttcaacataaatattaataatcctaataatatgtatatatttattgataagtaggaataaataaggaaatgttagaaatctgtaaatctaagcaaagtttaatccatttttattgtactattcttacagtttttatttaggtttgataattttcaaaatagaaatcaaataataaaagtctgtttaaaagatttaaaatattcccaaaacacaattggttcctttccagttgaaataagagctattttaaccccttctggaaaatattaattgaaaaaatagtgagaaacttacactgagaaccctagaaaaatgtatgttgacatataagggaacaaaattagagaaaaagagaaaacaaaagcaaaggaagataagtgcaattggagtacacacaataattatgttatttttgtttaaaaacaaatttgtccctttgtactattaatctcatatcaatacaacagattttataagcagagcagtgaatatatttcaatggaaatcacatatacgacagttttatatgcactttggacaaactctgccccaaagataaaatatagcatctgtttcactatgcattgaggaaatgcagaacaaatttaaaaatgaggcaaagtattatattctgccaatctatttaatcactgcttcttttggtctttattttttaaagttaaaaataagctgttcacatgtggacatggagacacaagaaaaatgtacgttatgtcgacatatgtatgcttagtcacattttggagcatgcgcactgttgctacaagaagtaaattgcatcattattggtaaaagtcaacgaaaaacattcaatttaaaataaatgccgggctctgggatttcttcaccaaaatttttaataattatttctattgttagtaaaaatttactaaaacactaaaaaagagtattaataatagaaatattctagtatctcagatatatttatactaatgatattactaatgagattacatttgctataaagtcacactgtactacaacaaatagagcaaaaatccctccctcatagtaagtagaaaaacctattgttcttgtccagatgagcaccctgtttcaggtatgcaagtctgttgcttaaaacactgaagagacgatgtccaggggttgttgacccagtgatggtgttggtgtttcagagtcaaaccttgatgctatgcggtagcttttactctttggctactctttagcatatagcagtattctttcatccccttcctcccttccctctttttcttccttacttcctttcctcctttccttcttctcccctccttctcatttgaccatatccatttggccacagtgagctgtcagttaaactaacactagatgacacacagtgaccttgctttgatgtctctttgattgctggcttttggctgagatacttttcatacaacttttcgtgtgacttcaccagcagcctagctcagggtaaaaatgttccaatagagcaagagcagaaactacatgtcctcttgaagtcacggcttagaacttacaatttgtcatttctgccttattgtatttctcaaagcaagtaacatggccatcccagatttaaatgatggcaaaaaagacttgatgggagagactacaaagtattttctgccatctgtaacctggtataatgcctcttctacagtggatgctacctggcgagtgtggagactttcacccatcatgtccctttccactaatgcattcaaatgcttctttcttaggcttctttgtttctaattgtctacttgctccttccaggactctgataataaattgataattacttttaaaaagctaagccacactcagttcctagaattccaggaatatccctacctcaggccacttctccttcctcacaaatttcatggccagaaacactggtcaaagtcatgtgtactaggagcattttggggccacctagattggggcagtgtgtccattctggtagcacacaatcatatcaagttgatgtctccatagaacagaactgtaatttttccctctgacatctgctgctcttaaggatcctctcgcaaggctacagaatgagataaattaaataaactgttcctcagagggcatatatgtaatacatgaatactccagacttgatcagacttgaagccaaaaccactgctatttcattgggctatggagtactatggttcccactcaactttaggactggctgggctgaaaatttccagtttatgatgagcaataccagttgtagagtcttttaatggcctttgtttaggtatgctgtctactatggcaagcatgcctggagctgctttttatatcatggagagctttttacatcatgtagactctatatactgctacttaacagagagcagtggttcatgatggagctttggttcatctgatattaataagttggccctgtagccaacatccctaggaaaacctctttatgtttttgacccttctatcaatattcttatgaaacaattctgatatttccactaaagtgttaagtatagatattatatataatatttattatatacatacacatatatatctatttatatacacacacaaatacagagagggagaagaagagggtgaaggagagaagaagagaaaaagaaagacaaagagaaagagaagtagggagaaagacataaactttaaagagccatcctagaagtgttttaggactatctccaggtgtcctgttcagaactttatatcctaagttatctgagttatgggagcatgctcccacatcaatatttttatattattttactttagggatatgttctagaagagtttcattctttattatcaagatccactttttgcattttctctgattcttggtccacatttgccaagccctgaagttattttggtggggcaggaacactttctccaattggttcagctagttcatccttccataattaattatggaggtacaattcaaacagattttggtgagataaaatatcatcgtgtgagacagacacttcatctgagagcttcatgtacttttcagtctgccattcctaacagagaagacagagttatttcttctagcccagaggtggacagttggaaactgctcatgagttatgagaatgttaagagtggtaagaccaagggaaatttggcgactgggggacctaaagtgcatccacccaaacgccagcataccaggtcccagggtttcctcacttacctctcagggaccccattctagcataaaacatatccttgtgattcacatttaaccttttttctataactcttatactcacaaaatcagtggctggaattcttatcagtgcagtttttttcctggctccaggagatgagcgcctttgtcacggaggtgttctagctttcacaccaagccatgagtttgtggttacctaacataagcctattatttccttccttcacagtatttgtggtccttagctacaatcaaaaactctgcaatacttaaaattacttttttgcatctcaagcactatggatattacataggtccgtaaatgcttccagttgtatgctgtacatctcagttcacaatatgtaatagtcttcagaattgtaatgctatatatgacatgtcaaggagtgtcaccaccctatctaaaagcagcaatgagtccctgactgccatctggccagcataatagtcaatgtcacaatcccattccgaagatctgcttcctaggacaataccagttgtcttagttgagattcccctaaagatacccacaaagttttaattacaagtagcttatttaaaaggtaatcccaagaatcactggcacagaatagggaagagtaagggagaaaccagtggccatgcagtagactgtacattgtcaataaattactttcatgagtacttggagcttaatcccaccaaagaattctgaaagccagtgtagaagcacctgcctaagaatgagcccactggaggatttactcattaagtgttttcactcattgtttgagggctactggagaaaagtctgggaataatagtcattatttcctcaccatttcagtctggtatggactgaactgtgtctctctaaattcatatgttgaaaccttaatctcccatgtgactatctggagatagagtttttcagaaataattaaagttaaatgaggttgtaaaggtggagccctaatccaatagtattattggtcttataaaaaataggaagagagaaagagcttgttctttctctccaccatgcgaggacacagcaagagggtggtggtctgcaagccaggaagagagcccttacccgaaatcaagctctatttggactttgcagtctctagcactatgagaaaataattcataattgagtcacctagtctatgagatttggctgattaagacacaggtctactacgcatgaagggcaaaaagatatcttttgtcagaggttgactgtgggaaattggacaagggtgacaagaacgttaagggcaagtgtgacaaagactatgggatattagtgtggtactgacagcctctgttacaactatcataggaaaattgtatacattcatggatattttacttcaagcatcttatacatgtaaggatggcgtttactcaaaaaaatgatgttttatggggataggtgctcactgtctaccacaagatttcaacaagtacagagaggtcttgttaggcttagcattagctgaaccttttgcataatatgacaaacagtttgataatgttaacaatttagatactaaaataattagtactgaacctatttaaatatacagtaggataataaggatagatagttttaatgatccaatcattgtttaaaattgcaaaatcaattagtgttttttatttgacaagacactctgttttcctattgagtagtgtgatttataataatataaactattgattatatgttttagtcattctaagtaattaagacccaggaattgtaatagaaatctaattcattgttttcttattcaaattaagagcccactttattataacaaaccatgctgataaactggtacactcatgctgtaaattatactacattatggaatctgcaaaacacacttccatggacctatacctcttcccaagtattatctatactttataccaattattttctgatatttagatctgaagacctaatttgattcagtttccatttctagaaaaaatgctttatacctgaacatgtgaaatttcaacaaaacctacccactattcactggtccttgttttatggatgattaccccactcatgactattgcctacaatctatatttcaaaaaggcttgaaaatagtgacattcaaattatatcatgccttattcacttattaactaaaattatttgttttttagatttaataatctgatccatttgggatttatctgggatatactgtgagaaattgatatagttctttttcccaaatgactagcaaggtatctcaaatattccttattgtaaaacctaatttttcttcatttttttgaggtaatgtctttttatactctaaattttgaaatgtagtagtgttcacttatggaatttctgttctgttccattggtctgctttcttgtaggccaatatgacaatcttttaaatgtagagacgtcataatactattccatacctggtagattagcacaccataattgctcttacattttaggaaatttgttactctccttgactgtttgtgattccaactataattaataatcagcttgcttccgaacaaaacttgatggtatttttagtggtaatgcattatatttataaattaacttttgggcaactgataactttatgatattttctttctgtgcaaggatataataggtcttcaagtataatagtgagccttgataaattttttatggttttctagattaggaatatttcccattaagcttatgactaagattttgtctgctcatttttttaagttaaataattttgtttttgagcagatttaattttacagaaaaattgactaggaaatattgacacttcccctatgtcttatcatgaccttcagtttctcctattttgtcttacatcagtctggcatatttgttataaataatgaattcatattgatatgtcattgttaaagtttatagtttacattagaattcactcgctgtgtcatacataatgtaagttttgacaaataaataatggtatttgcccaccattacataatcctcaaaatagtttcattgttctgaatattccctgtgctttatctatgcatccctttttccttccaaaattttggaaaccactgtttgttttactccccatggtgttgccttttccagaatgccacataggtggaatcacataatgtgtagtcttttcagactggtttcttccacttagaaacctgcatttaagtttcctccatgtcttttcatggcttgatagatcatttctttttattatggaataatatttcatttcctatatgcactaccatctgtttattcatacacttattgaaggaacatattccttgcttctaagttttggtaattgtgagtaaagttgccaaggagcaccatttgtggtcatatggaaagaatatgtttagttttttaaaagcctatcaacagccttccaaaatgactgtgccatttagcattcctcccatcattccttgttgctctgcatacttgctacttttggtgctgtcagtgctttagattttagcctttctacctgataggtgtgtagtaatatctcattttatttttaattttttgcttttgtcttgtttccattaaaactaatagccacttcttgctttgtctatatatgttttattggttttatgttaattttacctaaagtatttatctaacatcactttcattatttttttagaatattttggtggtcaagatgtataattatgctgtctaactagattattttacctctccttttgaatttattttgcctctagttgttttctctcctctagtcagtttgtactgaccagtatagtcataatgttaaataagcagaggacccagaaggcatcattagtcattacttttatgataagtacaaagtgtatagttgtatatacacatggactacgtattttaatgtattttttataatttttttcttatttgtcttgttcttgattgaagcatttatgtatgcatacatatatgcttcataataaggaagtagctccccattcttatctgaataagtaagttatatttatttagattattcaaaggcatgataaaacagaaaattccaaattacttttatctaagaaatataatatttatccccaaacctgcaacaaaaaaattagtgacaaacagtattttaaacaatcaatcatgtaaatatatttactagagtattagggaaaatgattacaagacaacatttagacataatatgttataatcacttgagttttaatgcaggaattcaaaagattttaggaaatcataattcaattcataatagtataggagctgaggagaataaattaaattgataatctacgagatacagaaaagtatctgaacttaatttacacttctgaaatcacttaattttgcttatatctggtccttctactttgtttggctttgctgctgttttctgacactggtgtttatagttatatagtattatgttgatatatgtgtctaatactataatattcctctgatacctgattttgctgaattccttagattgtagtttattagctttgcattatcattacactttaaaaaattataatttacctaatttttttctttgaatcaagggtatttaatatagcatctttattggtgcttatatattttaaatttttgcagcaagtagcattttgattttgttattaatttatcctatttttatccacaaaatttatttatattatttctttacatttcttgtgttgttcttttcagtcaagctgttagaaaacttttgtgaatcttccaagtatattccaaatatagtggttatttttgtaacacacaaattttcatctgaaagtatattgttttaagcaacaaatcaaattttagtgcgagtacagcattccttcccccgcaaaaaaaaactctactccagaaaaagaacaaagagaaagaaactcatataaaatactaagtaatcaaagcagcacatataaaaagtctttcctttttgaatttgtctttatttctccttgaatcttttgctgtttcatctttatatcagttgtcgctatgtactgtggattgtagccttttgcattataaagtatccagttttgtctcttcattcttttgatcagatttctacctttacatataaaggcataactcagagatactgggggtttcatggtagaccactgcaataaagcacatttcaaaaaaaagggaatcacatcattttttaaattttgtagtgtatacaaagttatatttaaagaacattgtaatctattaagtatgcaattgcattatatatcaaattatttacataccttaattaaaaatactttattgccaaaaatagtaatgatcatctgagccttgaaggagtcatatatttttttttttgctggtggagagttttgcatcgatgttgatggctactaactgatcagcctggtggttgttgaagattgggatggctatgaaatcaggaatgatttttctgtaacatgcaatgctgtttgacagcattttaaccacagtagaacttctttcaaaatttcagtcaatcacctcaaaccctggtggctactttacaaataagtttgtggaatattcaaaatcctttattgacctttcaacaacgttcacagaatcttccccaggattggatttcatctcaagaaatcattttcttttctgtccataagaaacaactcttcatccattcaagctttatcatcatattgcaccaattcagtcacatctttaggtttcatgtttaattctagctatctttcatatgactaatctgacacatctgtagttgtttcctccaatgaagtcttgaacccctcaaagtcattcattagggttggaatcaactctttgtcccagatccatcagaagcatcactatttatctcagctatagctttgcaaaatgtatttcttaaataataagacttgaaagttgaaattacttcttcatccactggctgcagaatggatgttgtattagtaggcatgaaagcaatattaacctccatgtacatctccatgagagctcttgggtgactaggtacattgtcaataagcagtaaaattttgaagggaatctttttcttttttctttttgcctgagaggtaggtctctgcagtgggtttataatactcagtaaaccatattgtaaagagatgtgctgtcatccaggcttttatttttttccatttatatagcatatcagagtagaattcgcatcactgttttccctaggatttttaaagtggtcagtgagtattggtttcaacataaagtcatagctacattagttcctatcaaaagaatcagtctgtcctttgaagtttttaagccaagcattggcttctctctagctatgaaagtcctagatggcatctccttctgatataaggcagttttgtctacattaaaaaatcttgttagtgtagtcacctgcatcagtgatgttaactagatcttttggataagctgctgcagcttctccagcaacacttgctgcttcatcttgcacattatgttatgaagatgacctctctccttacacctcatgaaccaacctctgctaccttccaacttgtttcctacagcttcctcacctctcttaggcttcaataaattgaagagagttagcatcttgcctggaattaggttttggctaaacagagtgttgtgtctggtttgatagtccattgagaacactcaaacttactctacatcagcataaggctgtttcagttacttatcattcatgtgttcactggagtcacacttttaatttccttcaagaacttttcctttgttttcactgcttggctaactgtcaggtataagagacctagctttcagtctgtctctgcttctgtcctatcttagctttcaacatgccttcctcaataagctcaatcatttctatcttttgatttaaaatgaggggcatgtgactcttcctatcagttgaatagttagagcccactgtaggtctattaattggcctaatttcaatattcttctgtttcaggaactagggaggcctgagtagaaatagagagatgagggagagagctgtcagtgggggagcagaaaataaacatgtattgattgagttcaccatcttatataggtagaatttttggtgcccccaaaccattacaatagtaacatcctaacaagaatacagcaaaaaaaactaacataactctcactctagttgtgtttaagaggtctttacccatacctgcatgtagactaggataattttagagcactgagataatatgcaaaaacagcaatcatgtagtttttaaaactaactctgagattaaagagaaagtatgaaaacagctaactatgttttgttacagatatatatgagcattgtgatctgaccaaggttaaagacattcccagtctactcaaaccctcactggtgcccagatgtctgtggttgttggtcacctcttgataacaacctctttctctttgcccacccttaacataaaaagaccctgaaatatgttttgacttaagacagcaccttaggatactagtccaccatcttctcagattactggctctccagataaacctgctttcttcccgccatcgctcctctcctgtgtttggcttttgacaggtgagcagctgaacctgggtttgatgacaacatcgagggtcactgatcacagatcaccataacaaatataataataataaaaactttgaaattttgcaaggattataaaaatgtgacacccaaaccgaaagtgagcacatatgttggaaaatatttgaagaacatctaaatatattaatagaataaaaaatctataatccaaaacagcataattagaaaataatagacatttttaataaagattgagaaaaaagatgtgaagaaaatatcatacagacccacttgcaatttgaaattatagaaaatatttcatcaatgaagactaaattaaaacacaaaagctaaaaacccagtgtaagccataaaaatataagagagaaggaaaatataaagaaatgaatagaaaacataaaactatttcaaaaattctaaagaattaattaatttgtagaggttgaaaataaattatagattaagacttactagaaaaacacatgtcagagaatggtggatgagtaatggagggaaacatggtttccttagtaaatacttcttgtctatgctacattccttcttgctggtcttcaaatatttttgtgtgtcctttttcccacacaaagaacaaacttaatccatgctgggaaaaatagtccaaaagtttcatcctgtcagttcatctagcttaatgcccaggatttgattcttacacagcatactttgttaattgtgctttggtgatactgctctttctataaaatgaaggtttgtgcaactctgtgtccaacaagtctatttttccaatgcatgttaaaaatgttagagcaagttacaccttcaggtgtaatattgaagtcaaatgttttctaacaccacgtttaaatccatcactatcattaatcacaaaacctcacctttgccacagataagttgcggttagtacaattcctgaaattaatcagcttcagtaatggcctagaaaatcaccttttaaaaaatgtctgcaatgactgccagtgtttttcatctggtttattatagtgcccagtagttcatcaagttttgggaagactatttaaagtggcactctccaccacccgtcatctaaaagaaggtgctcattttccttgtttcattaattatttgcaaacaattacaaaactaaaatctttctttctggaaacttctcagtggttgggtgtctcccaactatatcatgactttatgtctctgatcctcaccttcatgactaagataaccttgtctctgcctgacagaggatggatagaatatacccatgctgcactgttagaagaaatgacctttacaatcttaagcagtgagaatattagtaacatagataataacatatttgcaatgtgactcataccaaaccttcaaattttagttcttctaatactgtaagtgtggatggtatgggggtatgtacatgtgtgtgtgaaatcctgtgaatcaggcatgtattgagctaaaatcaatttagtgaataccagttcactaaaaaccaattgaacaaaattttgattcactaaaattttgtatatattacatatttataaagtttatagattattacttcaacaggtttcaaattgttttgaacattcttttgaggtttcaatttcccagtagctctttcatcttagcaactgtgttatatttgtttagtagtcaaaattgtccctgttttattgaataaaatgataagaatataatagtatgttgatttctgcttccaaatactgagcatatttcagatgcttaaatgatatacaaagtagtgtttctatcaagcaagctaagaaaatggtaagtaagaaaaaataagaagacattaaatattgtgaaaatctattggagaaagaaacttgcttcacgtattatgcttgaatttcaaaaaatatctatataactctcatcttgcaatgtcatatttcccaaagtactgaaaattatactctggaattaactaaattttattctgcagtggcaaaattatttcagctgtattaatattaattatattaagctatgtgatgattttaaagaatatcacaggtagtaaaatatcctagacacaatgaataaaaaagtagttgagagggtaattttgtgaataaatttttggtaatgaccattttgtaaattaaaaataactagcctttaatggtcaaatataatcctatgtggaggtcctattttaccacccataaagataagtaaagtgaggcagaaagagtttaagtaatttgcccaaatgcattcttcaaataatgtggaagattagaagcatgcctttagaacttgtactatattgctacctgatttgtgctgaattgactttctgtgactttctctctccctaattggtcagctaactaaatgattttttgcaaattgatttcactaaacaattagtacatagttaagatttttggacctataaggaaaataatatcctatcacatgctcagtaaaagtttatagtagcgtatcattttcaatctttgaagcattttgtctttctatctatataccatccatctatctatcaccaatctgttatcatttatctactgtatctagaatggtccaaagtgaaataaagctgaggtagcaatttccaatatcagtataggatagatggctctcaagatacatccagtgaggtaggtaggggaattggagtcactgtatttcacttgaggttaagctcctgcttataattatagataatgtgactatataagcaaacataccaacatgttttccatatgccaaatattaattcattatttttcaataaaatacatatatcttttaaacaaaaccaacactttcattttactaattacaatatttcactatggaaaggcaacttggaaaacagaaatctcagctcaggggcaaaggcaaactctcttgagaaagaaggtagcccagaatcaaaggccaacagcaggtaagtgctaggtggtggagttatggggaggggaggcttcaaaactactcaggatttcggttaatggctggaactttgggagacctcacaggtaaccacagggcaggcaggccattcacaaagtgggtagatgttgattccttctgtgagtcttagaggatgctcacagagggtcacagctcaggtggtgtagtggggtgcgctgttttctctttcggcctactctcctggaggggcagggctcggaacataaagctctggcatcaaggcacgcctaaggctatcagggctaagagtggagatagatctcaggcccaaaatcctaggggaagaggaagaggaactctgctcagaaaacttagatgggaggaggagctggaagcaccagaggaggaggagctctcattgctgatggatgggaaggaagaacctcccaggtggagagggtgaggaggcatgcatacggactgcatgccaaccaggcggggaagcacttcttgggacctcaggatcagaagagcctgagctgctctgaaaggccagctgtcctaagccagccccatgggaaagcgtgttctcatcagctggcccaagctgagagcggcggctgagaagggctgatcttcgctgggtggaacggctccggagggcagtgcctggcgtcatgctggtgctgtgacgagcagggcttgaccttgctgtgcggccgcgaagggcagggcctggggggttgccacagcgttggagggcagggcttggcccggatgcacctctgcggtaagcagggactggcggggtggctcggagaaagagcagatgcagtagcaggacacagtgcccggaaggcagaacaatgaggctgcccctgcctccggtgatggctgtgggaccgggaatgaagatcctgttgcttctgtcccaccttctcctgtgacgcgtctccctgcggcagcgccgcgctgaggtgccacactgctggttccaacaccgcagccgccaccgccgccgccattttcgtggcggatgagggcccgtggctgcccttcatggctgctgtgccggcgaagaggcattctgacctccagggctgccgcaggcctcaccatgtccttggatgtgtgatgccctacggggacagccaggccgctgtggggccacccccgaaggccactggccactccgacgagcacccggcccagaccaagagccctgcaaacaaccgtcataggaagcggccaggccgcaaccaggctgtcgcagctcagaggcctccagggcggggtctgtttcctcggcctttgcagccatcttctccagggtcccagcctagcagccgttgcggttcccgggcttctgtgtcgagtcaggcaacgcagccaggccctgcactcctcagccatgcatctgggccaagccatgcatctgggccaagccctgctcgccgaagcagcatcgttctgccaggtcctgctctccgcagacgtgcatctggttcaggccctgccatccgacgctgcaccacccagtcaggccctgctcttccacgccgcgccactcatccaggcccagctcgccgaggccgtgcacccgcgccgggctctgatctccgcagccatgcctgactgggtggccttaacgccaggttctccctcagagagcaggaatgcggctgctagtcaaaatacatgtattttttaaagacctacaaatgtgtctacagttcagggcaccattttcttggtttcagtcagaacatttctttaattaaggcatagataattggatgtttttcatttaggcagtcacgtctagacccccagagccccatcacagaggttggcacagatgtaaaatgtgatagcatgtacctattaacaatgggtaaacattggaagggcctaatgaactattcctttccctaatcatatctctcaagtgtcacaaacctcatgcactcaaatactctctataatttccagatgtggtagataaatatggcaaaagtcttgctctttgtgacattgcctgcatcaaatgagtagcgactcaatcctttttatttcagcatagctacataatgatgtcatcttcatttgatttctaatgtctcctctttgttccttttgtttgcattgcctgtatctttacttgtccctttattttcaaccagttaactttgttgtcagtgtgctttctagcacgtataaataaatattttgctgattagcacaatatgtgccatgatagtcagaggtgaagccagctggacttcctgggtcaagtggggacttggagaacttctgtctagctaaaggattgtaaacacaccaatgagcactctgtaaaaacacaccaatcagcgctgtgtgtctagctaaaggattgtaaacgcaccaatcagcactctataaaaacgccctaatcagcactctgtgtctagctaaaggattgtaagtgcaccaatcagcacgctgtaaaaatgcaccaatcagcactctgtgtctagctaaaggattgtaaacgcaccaatcagcactctgtaaaatggaccaatcagcaggacatgggaggggacaaataaatgaatagaagttggccaccccagacagcagcagcaacccatcggggagccccttccatgctgtgggggctttgttctttcgctcttcacaataagtcttgctgctgctcactctttgggtctgcaccacctttaagagctgtaaaattcaccacgaaggtctgcagcttcattcttgaagtcagtgagaccatgaactcactggaaggaagaaactccagacacatctaaaggaacaaactccagacacaccatctttaagagctgtaacactcaccgcgaaggtccgcggcttcatggcttcattcttgaagtcagcaagaccaagaacccaccggaaggaaccaactcaggacacaataggagtaatcagaacattaatatgtagaatgttaacttctgtgtttttgatttctgcataggggagagccattctcataattatttacataatggaagattctgtcttatagttcttaaggactagattctctttttgaactttaaaaagtgaggtttcaggttgtgagacggcctgtgaaagagtcatctgccagggaactacaggcagcctccaggagctaagagcagccagcgagaaagcagggacctcggttctgcaactgcaaggaactgaattctgccaacaattgcatagttttagaagagaacactgtgctctagaaagaagtaatgcctgatagagacatgtgttgcagccctgcaactctctgagcagagggaccagctaaggcgcaccaggactctctgactcacaaaagctagaagataatcaatagatgctgttctgaaacaacagaagcttatttctcacagttccggagactacgagtcaaagatcaagagactagcatatttggagtctggtgaaggtccacttcctggttcagagatggtgcctcctccctgtcatcacatggtgtaaggggagagctggtttcttgggattccttttataagggcaccaatcccatttatgagggtaggcctaagcacatgccaaaggccccacctcttaatcccttacctcctaatacctaatacttcctaatgcccaatcatcttgaggattacaatttcaatatgtaaattttagggaacataattagaacataatatgattatttttcataaactttattcttctttactcttaatgctccacctgtttaaagattttgtcagtttcctctggtagttctgtgtcactaggtctgaattttgacgactacacctgagatcttctctgtgtgttattctttcccatagataaattttcagtttcttgttcagcttattttttactaaactcaggttttaggagagtactaaagaacacatttccatagacaggaaagaaatctagtatttatttgcatggccatgtgatatataaagtgtggcaggctctgcttccttctctctggtctgctgcttctctttcagatgctaaggtttagcctgaccctgaggttattacactcctagccattcttgagtcagaaattcccagtacacacgagaataaaaaacctttatggaaatgaggctgttatgtatacaactttgagcatcaagctcttcccaggatcccacctttctgactgttctccacgattttctgtagccaagaaggtagaaattgtgcacaaatccctcttgctgagatgcagagcaaggccgtggtttcacttacatgaagttgccacatctcaggagccctttggcccataggaatccaacatcatggagctggcaggagagcagaagggaagccaaaagctgtgtttcctacacccagaattcccccatttcccttgtcacttccattccatctccttctcttaagacccttctataccttcctacattagcttggggtatgccccttgggaatttccaaaagacatgctttaagagtgaactttaatagtttaatgctaaaaataaaaataaagacatggtaaaaaataagacaaagtaagaaacaggccctgtaaacatggacagcactttttaaaaatctaattagcattttctttttaaataccaatattaaaaatgttataattttagatacagcacttctagatagaacaaaaatatcacatgaaaaataatcagtattttacaatctggagagctagttattatctttacattaactgagaagggataattcagttaaaccttttgttttgttgttgaaacgggtctcgctctgtcactcaggctggagtgcagtggtgccatctgggctcactgtaacttctgcctcccgagttcaagtgattctcccctctcatcctcctgagtagctgggattacaggtgtgcaccaccacacccaggtaatttttgtatttttagtagagacagggtttcaccacgctggtcttaaactcccggcctcaagtgatccacccacctcagcctcccaaagtgctgggattacaggcatgagccaccacacctggcctgttaaaccattttttaagttcatttattatcatttgccttcatcctttaaaagacaagtattaattaccctcttatggaatgacaataaaatctaacatgttctttgttttccccttaatatagaatatcttaatgcatcaaactctattcaagtagattcaggagacatgcagtctttaaaactgtagttctcttctcacatgaaattaacgtgcacacagacacacatgcacagagtgggaagaatatttcagaaagcatacctttaatcatttcatattggatttatcattttaacgtatttaataatatttgaaagataactttagatcttaaaccaatttatgttttcatcatacttatgcaatgaaaatacacgtaatttataatttatacaatttatagtagaagtcataattaaaatgctgttagaatttatttataaattgttgattttaatcatcaatttaaacgctctcctccctcaacacctagttttgccacctacatgcacgctcattccagctattctaaaaaattttaagaagaattaaaagaaaatactttcatttatacacctgaatctccgttgttatataaagtcattacagtattagtaaaatgctttagtgataaagataagtaatgatctgaacttgattattttgaaaagataagcacaaattcattaagcctatgacatttaatgatgttgtgttcctcttcttctaacaatttgaaaaatatatttttatctgtctaaaaaatataaatgaacattaaacccactattaatttaaatttaaactaatatcccctgatcttgaagaattaagcaaatatgtaaacagaccattgtttcttttgaaaggatctatcaatcgccataacatacttactctttaacataatgaattagaaatcaaacttagcatcttatctttagtgttcctctgtgtaaataattttaaaaagctattaaaatgtgggagaataaagagtgaggattcactttattcatttcagactaaaccatataaactaaattttgaactaattttggatttatatttgtagaagacagtgcaaatgacagatcaaacagtgatgcacctaatctgtgtttctgccagtatgaccttaagagggacatggcttgcaagcataggagaatctgatgggtgctttcctgaggtgattatggaaatgttgtgtataaataaataatcagtacatatatttataaagacttctaatcagagactatagcatgtgtgattgcaatcatattctatttattaagacttgtttatgacaatgagacgtgttttatagctaagagtttttattccaaagaaggtttttcacattatttttttcttaattcatttaatagtattgttcaaactgattgctttattttattagatttgcagactggggactttattctttatctaagtactaatactgcttacttgttcaaaagcaaaatattaaatgcagccctgtacaatttaggacatgaatttaaaaaataatgcaatctaaaggcaaaaagtgatattctcttaaaaggccccagtagtaacataacagctgaaagtagcaacaattctggttctagttaagctcatctcataagcaaaattactttgtgaacatctatactctaacataaaccagactaaaaatatttttaatatacagctgtaacttaacaataagataacttttctaaaaatgagtttataatcctctatttcttcacgatgttcaaaaatcttcaatcaccctattcaaaaactcggaaaatgccatagtgtatcaaagaaatattaatttatcaacttatctgagactgtctactgcttaactcttcatgaaattgcaaagtttcatcttaaaatataatctgtttttaacatctgtagaataacatgccactttgagtgatagttgctagactcggtaaatactaaaacaatattgggaaatgttacctaataagatagtgttctataagcagaattttgagtgtgcaacatggaaggtctgtttagaagtccatatattaagttaatgatgctacagcttttggcccatttatggagcccttgtcaggagttgaaacatagagcctggcggcctctaacagactggtctgcttacaacttgcaatgaactggtaaaggatagactagaagaggaaactttgagtgtattatatattttgcagaatcacctatttccttctttttgtttacttttatcatctttaaatgagaataaatccccattaaaaagaatgtgagaagacagaaggtaattgctatggtttgaatgtatccccccgaaaagcatgtgccagaaacttgatccccaatggaaccacgttgggaggtggggcctaatgagaggtacttaggccatgagaaaggagtgaatagattgatgctattatctttggagtggattcattataaaaggggaaatttgcccccctccctttacacacacccattctctctctctctctccccccccccttcttctctctttctctttcttcctttcttgcccttccaccacccaccatgggatgatacagcaagaaggccctcaccagatgctgggccctgtttcttaggctagccagcctccagaattgcaagaaataaatttttgttctttataaattactcaatcttacttctgtttcttataaattactcaatctttggtattctattacagtagcacaaagtggactaaggcaataactgtatatactcaacaaaggttatttgtatggaagcgaatatgttcttaagacagaaacttcagtaaaattaaaatgttatggggcatgatgctagtttttcttctcatatttatacaatgagaataagttattacatgctgcaaaatatatttggaaagcaatatatgtgttgttacatgatgcactcttattctgggccaagaaaacttacccaccccattggtttgaccacatgacttcctttgaccagtggaattttattttgaaaaatattaactgaggcttttaatgaattcagccagtttaacttactacttgccatctggtgaacctacctgagaagagaatgtccaagtggcctggagcctgggcttctgcaataggaatactaatggtcccccaaagtcatctatgccctagtcttaagaatatgtgaatatgttatctttcatgaccaaaaaaaaaaaaattgcagatgtgattaagttaaaaatctttgattatgtggatggactcagtgtaatcacaatgtttataaaaaaaagaaatagagagaaaagggacgtgatgacagaagcagagattggtgtgacactaagaaagggctactaagcaaggaaggtgggtagactttagagactggaaaagataggaaagcacattctcccttagagactctagaaataacacagccctatcaacacttagcttttaaacctcttactgccataactatcagataatacatttgcattcgtttaaatccatgtgtatggtaatttgttttttgtttgtttgtttgtttgtttgtttttgagacggagtctccactctgtcacccaggctggagtgcagtcatgtcatcttggttcactgcaacctccgcctccggggttcaagtgattctcttgcctcaacctcctgagtagttgggattacaggcatgcgccaccacacccagctaattttgtgtgtgtgtgtgtgtatttttagtagatacagggtttcaccatgttggtcaggctggtctcgaattcctgacgttgtgatccacccgcctcagcctcccaaagtgctgggattacaggcgtgagccaccatgcctggctgtaatttgttagagcaacaataggaaactaacaaagcatccacgaacacataagacaagacctgaacccaagagcctgggcctaggtctgccagattttggtctaaaagagatcctagatgaaccgaaaagtttatttctgaagttgaaattctctctttctctctttggctttctatttgaaaaaaaaaaaaaaaaaaaaaactctctctatataaacatatatatatatgtatttttccggttttaacaaaaacattggattatagacaggtacataacacacagattctattacaaacttgctggcagcattacttaataccacatcttgtacatcattacatcatttcatatctgcttatatagatatatttgttctctttaagtctccatgttattaaacaccaaattacatagccagtagccagatgaggaattaaatttagtctaactgtccttaccatataataagagaaaatagaatgttgatataacttaaacatgttataattgaggaaagtttggattaaaaactaattgttcagaatttgttaattacaaatacacataaatgctaattaatgactaattatcagcactacatctggccttagtggtgatgattaaaatttagacgataattcacacttaactgagaattatataaatttttttattaattaggctaaactttttttctgtacttatagaaacagagaagtagaatttatatgttgggaaaaaaggattatttttgtactattggttatgccatatgttaaaaagatgagtaatttttaaactttgaattgtgtttattttgaatatcaatatagactataaagcatatatgttagctaattcaagagaatgtaggtaatttcatttaaaagataattaaatacatacttatcatttaagattacaaattaatcttttaagtcatctgagttgttagttttatttttgcccaaatcatagaaaaagttgataagcatttaaaattcagagctatactcaatatttgttagtaatctaatattccgatttgggatgaatagaaaaatacttagagaaattgttagattaatatactaaaaatgtatgaaacagcgcctcaatttgacagtttcgtggcactgtaactatattgaagctgtacgtttattttaattgttttcctgagggaaaaggatatgtatgagcctatctctttgcacctgtctgtctatctacttatctgtttatctatctaccaaatttttgttagagaaactaaatgctaaaatcattttacaggaaataagaatggcagaaatgtgaagagttattgtgtggggaagtggcctctacatagaaatgtttttccactgaatgttcctgttgtgctgatgaacaaaggagttcatcacaggccagaaactaagatagatagataaataaataaataaataaataa

SEQ ID NO: 374 - DNA, 16833 bp, Homo sapiens
gatgttttaatcatggccggttttgcaggaatatattggtttggttcagaaaggcgggacaactcaaagcgggcggcttccaggtaaatttaaatattttgtggttgacaagtggtggaatctgaagacctgggatcaatgaaagggaaggtttaggttaaggtaaaggattgtggagaccaagttttattgtacagaggaatctctcagataggtgaattaaaagagagagcagtttgtaaaatgtttattagacctaaacgggtgcctggctcttagttgattatctcctggatctgcaaagaaaaaaaggaaaacaaaaggggaaggggattctctacaaggcctaggcatgagaggagagtcacatcaagttaagtactgggccacgtgacatatcacaatccccatgtggacacattccagtaagacaacacctaggtgctgggcccaggaacatatgactgtgtcttttataggcaaacacagggtagaagaggggaggggataacaatcaaacatctgatgggccaagagatatgtcacaatgccccctgtgggcagggtccaggctggagacacatatcaccttggcgttgggcccatgaatatgtgacagtgccttctgagggcaggcccaaggcaaaagagtaacatcattatgcggctgggcccagtggtttgttacaatctctgctgcagttgaaacctagaaagaagagaagaatcaggccaggtgcagtggctcatgcctgtaattccagtactttgggaggccgaggcaggaggatcacctgaggttagaagttcgaaaccagcctagccaacatggcgaaaccctgtctctactataaatacaaaaattagccgggcgtggtggcacatgcctttaatcccagctacttgggaggccaagtcaggacaatcgcttcaacctaggaggcagaggctgtagtgagctgaaatcatgccgctgcactccagcctgggcaacagagtgagactccatctcaaaaaaaaaaaaaaaaaaaggaaagaaaagaaaagaagagttacaccagctaggtgtattgggcctagcaatatgtcacaagttgttttgtgagaaggaactaagcagtaaaagggaatcatattacctgggtgatgagcatagagatatgtgacaatgactcctgcaggcagaacccaaacaagagagtgacattacctgggttttagacccagcaatatgtcacagtgacccatgtgggcaaagcagaggcaggagagtaacataacctagtggggagggcagcaatatttcacaattttcattgtggacggcaccaaagcaggagagaaaactcccatcacttgggtgcaaggcccagtgatatgtcacgatgccccatataaaaacacagaggcaagaaaatagagtcacatcacctagtttctggtacagtgatatgtcacgattccatctatgggttaaatccaggcaggagagtaaactcactcaggttctacacagaggcatgtgtcacaatcacaagtgcaggaagatccaagatgagattaacaatcctgtacatattccgcttctgtgtgcagcagcaaggcagaagaggagactcacattacctgggtgtaaggctctgagatatgttacaatgtctttttcgagtagcaccaaggcagaagaatagagttacatcacttaggcactgggtccagcagtgtggcacaatcctatttgtgggccgggccaattctgaagaatcacattactcaggtgctgggcagaagtgtgcgtcaaaatcacacctgaaggaaagaccagagatgagattaacaatcctgtacgtaccctaattcttggtatgagagtcaacacctcctgtatgttgggtctaagtacatagtcacaatttttagaatgagctgaatcactgaatgagagactcaatccctcttactggctgtgtcaccttagtggaatcagacaaacaggtgtgttcaatcttggtctgaaagtcaccaacttacctttggactggattcacttatgagtaaattttacaacttgcaactgtctctgcatatgagattcagaatttccagtggaccgttcttgtgaaaagatgataatctttactgtcgactgggtatacaggaatgtcaaaacagctgtacactgagtctagctagaatactctctgtaccaaccgaggatttataaggtatgcatgagagtcacaatcttttgtgactaggaaacatttgtgctggtatgggcccatgatcatacctgtggctctatgctcagatgagagagtcaacatctctgtaatggctgggtccagatatgagagttgacacctgcctataagctaggctaatgagtcaccacctcatgttgcctgatgttcacatatgacagtcacaattttaactctgcactgcatccacatgtaaaatttaagacctcaccagtaggctctgtccatggatgagggtgacaatcttaacaattggcaaactgtgcaaatataaaacaatctcgttttctggaccctgttatgacactttctggagcactggagggctttatacaatatgggagagactgtaattttctttaaccttcctacaaaggggagagccagaatcttacccattttcctaagcccacatatgagagatagtatgtctcctattggctgatttcagatatgagagtcaacattgcaccaatgatctgaacaaagatatatgtcacaatctcccctgtggatagggagagagcaggagacttatatcatctgtgtaataggccaggtatatgtcacaatcttctctgagaacaggcacaaggcagaagagttaaaaactgggtgcttaggcatataaattttctcctgaaatcagggcacagagagtagagtcacattacctgggtgctgagaccagagatatgtcacaatgctttctatgagcaaagctcaggcaggagaaacacatcacttgatttctgtgccagaagatgtgtcacaatctctcatatgaggaaagccttggtagaaaaggagagtcacatcaaatagttgatgctcttaaagatatgtcacaatgctctgttgtcagggtccatacggaagactcatgccaccttgttgctgggcccagcaatatgtcacaatgccttttcaggtacaggccaaggcagaacagtaatgtcacattggcgtagagccccacaatatgtctcagtcttccttgctagcagaacctatgatggaagaagaatcacacttgtttggtactgagccacatgatatgtcgcaactccccctgtgagcagggaccaggcaggagaagaaagtcacatcatgtgggtgaggtgtgaaaatatatgtcacaatgctccttgtgggtagtagagttgcattaccagggtgtatgtcccagcaatatgtcacaattgcttatgtggtcaggtgacaggtaggaaagtcaaaaaacctggtgtggggcccagagatatgtgacaatgcattctgtgggcagtgccaaggcaaaggagactcacatcacctaagtgcaaggcccagcgatatgtcacaatgccccctgtgagcagcaccaatgcagaaaaagagagtcagttctgggttcagctatatgtcactattccatctgtaggcaagacagtcagatcactcaggtgctgggcagagaaatatgttccaagtaaacctgtgagaaggtgcagggatcaaattaacaatcccacacatgttccggttttaggtataggaggttaacccttcctatatgttgtgtctaagaacaggagttacaatctcaacagtagacaaaatttgtacctaacagcccatactcctgctgtggacttagtctaattagtgaagtcacagcctcataggcgtgctgattcttgctctgaatgtcaccaactcacctgtggactggatccaaatatgagagtcaagttttccacctttgacttcctctatgtgtgagattcagaactcacaatgatgatgtgtactgtttgatgggtgttcatacaatggtaaaagtctcctctgtgtgctgggtcttgttagtacactttttttcttttttttttttttgagatggagtctcacaatgtcgcctgggctggagtgcagtggtgcgaccttggctcactgcaacttctgcttcccgagttcaagcgattctcctgcctcagcccccggagtagctgaaattacaggcgcctgtgagggatcagtcagaatggtaagaaaaactatagggaaaggacgcaaaccttctgaaagttcggaaggttctgcaaagacccaggggagaatagctgaaggcagctgctttataaccctgaggcagagggccaggagtaggtacagtggagtgtaggggaatttatcttaaacaggcttgtttacttatattgaccaggaactgacctttgatcatccacgggagtgacgatccctgaaaggagaacaataaatgttaattacctgcaggttgtgtttgctccaggtttttggcattgtgcctgcactgaaagaaagcaagcagctccagcttcttggggcagctctctggccactagaggcaggccattatctagctgctgttacactgcatacctgtgtctgagtactaattctatccatcagccagggcctgcaggaaaggcccagtaggcggccacatccatgctcagctgattttttgcaattttagtagaggcaggttttcaccatgttggccaggcttgtctcaaactcctgactcatgatctacctgcctcagcctcccaaagtgctgggataacaggcatgagccatggcgcccagctagtacactctctatactactcaaaggctttatccagtataaataagagtcacaatttactctaaagtcatgtttgtaagcacccatgaccatacttgtggctctaagtccaggtattagagccaacatctctccagttggtagggtttatatagtagagtcctcatctgctatgttctgagtttagaagtgtgtcaccatctcaactgtggccggaggctcatatatgacagtcacaattccaactctggacagtgtttgcatttgagattcaagacctcagcaatgggctcttttcatgtgtaagggtgataatcctaatggttggtgaggtgtgcatataagaaacaatctcacctttgtgctgtgtgccttgggataacactctttgtaacactcgagggcattatatgatatgttggagggtggcaattctgtatgaccttcataaaaagagaagaccaagaatgtgactcatttttctaagtcgagctatgagagacagtatttcttctaatagctgactagaggtatgagagtcatcattacacttataagctgactacagtacatgcctccatttaacctgtaggtagagagttagcaggagagtcacatcacctgggatttcagccaagggtatctcacaatcttccctgagggaaagaaccaagcaggaatatcacatcacctgggtgctcatccagggatatgttacagttctctcctgaaagcacagcataggcaacagtcacaacacctaagtgctgagctcagcattatgtcacaatgctccctgggggcaagacagaggcaggagagccacatcacctggtgtctgcttccagggagaagtcgcaatctttcctgtgcagggcaggttgcaggcaagaagtgtcacatcttttaggtcatggatgcagatatatgtcacaaggtcactgtgggcacagcccaggcaggagcatgcaatctcataggtagtgggcctagtaatatttacaataccaaaaatatgtgaggccgaggaaaaacaggagaattgcaacacctagttgctgggtctagtgatatgccacaatcctcccttgccctctgtgaaaatgccctctgtgaaataagaatagactcacattacctaaatgctgggtccagcaatgaagcacaatcccatctgtacgctgggtccaggcaggagagtcaaattactcaggtgctaaaaaaaggtgtatgtcacaaacacagctgaattaaggttgaggtatgagattaacaatttcacacattttttagttctagctgagacataattccctctgtatcttgggtgtaagtacctgagtgacaatctcaatgatagtctgaatttgcatatgagaacctcaatccctcctgcaaattgtgtcattttagtgaagtcaccgactcacaggtgtgctgaatcttggtgtcagagacactaacatctctatggatcgaattcacataatgagattcaattttccaacttttgactgcatctgcataagagcttcagaacctcaacagtgagctgtgtttatgtggaaggatgacagtctttactgttggcaggctatgcatatgagtgtcacaacctcctctgtgtgctgagttctgttaggacattctctgtacctcttgacaactttacacagtatgtgacagagtgttctttatgaccttcatacaaagaggagacccaagacattactcattttcctgaccctggctatgagagatagtgtatctgctattggttttttcgaagtttgaaaatcattattgcacctttaagtttgaacaagatatgcatcacaatcccaccaatgaaaagggactgactagtagactcacagcacctgcattttggggcagtgatatgtcagaatctcctctgagggcagggacagggcagaagtgtcacaccacctgggtgctcaattagggatacgttacagtctcctcctgaaagcagaatacagtcagcagtcacatcacctggatgctaggcccagtgatatgttacaatgatctgtgggcaaggaccaggaaggaaaaacagatcacctgattcctgagaacagtgattcatcacaatctttccagtggtgagggtgcaggcagaaaaggggggttaaatctcaaagataatgggtacaaagatatgtcacaaggccacttatgtgctgggctcaggcagaagcctcccatctcatgtctgttgaactcaatgatacatcactatatccaaaatatgccagaaataagaaaaataaaagggtcacataacctaggtgatggaaaggagacatgtcataatacttccgtgggcagttcccatgtcataaagttgtatcacctaagtgctgaatccaggcatatgtcacaacacacaatgcatttagggcttaggcagaagaggagagtcataacacataggtggtgagtccagcaacacatcacaaatccctgcttgggcaaagccatagaaaagagtcgcatcacctatgtactgggctcagtaatgtgtcacgctacccccttaggaggagggcccatgcaagagagtcacatcacctatgtaacgggttcagcaatatgtcacagtacccattctggcgcaaaagagtcacatcttctaaattatgggcaacagagccaggctccatctcaaaaaaaataaagagtcacatcacctaataagcggtctcagagataagacaccatggccctcatgggtagggctcaggaagaagtgtgaagtcacataacctttgagctgggcccagctatgtgtcaaaattacttcagtgggcagggcccagacctaagaaaagagtcatatcatgtaggtacttggccaagcaatatgccacaatccccactgtggacaggtcccaggagaagagtcacacaatctcagcaattggcccagatatatcttacagtgacttttgggagccagcagaagaatctatcacctgtatgctaaactcagcaataagtcactctctctactatgggcaaggcccacgcagaaaaggagagtcaaatcaccttggtgctgggcccaaagatatgtcacaatctctttttgggcaatgtccaggtaagagagtagagtcacataaaatagtcaaaaagggccaagcgaaatggctcacccctataatcccagcacattgggaggctgagtcgggcagatcggctgaggtcaggggtttgagaccagtctggccaacatggtgatacctcgtctctactaaaaatacaaaaattagccaggcgtggtggtgcacacctgtaacctcagctattcaggaggctgaggcaggagaatcacttgaacccaggaggcaaaggttgaagtgagttgagatcacaccactgcactccagcctgggtgacagagtgagactctgtctcaaaaataaaattaaaataaataacataaaataaataaaatagtcaaagggccccagatatgttacaatacaccttgtaagcagggtccaggcaggagactcatatcacatttgttctgggcccagcaatatatcaccataccttctgagggcagtgccatgacaaaagagtaatgtcaccttagtattaggcctagtgacatttcacaatatcccctgcaggcaaaacacaggaagaggagaaaagtcacattagctaggtgctgagcccagtgatatgtcacaatcccttctgtgagcaggggccaggcaggagaagagagtcacattacctgtgtgatgggtgcagggttatatcacaatgtccgctgtaggcaggaccgaggcagtagagttacatcacctgggtgttggacccagcaatatgtcacaatggcctacatgggtagggcacaggcaggagactcacataacctatgtgtggggcccagcaatatgacacaatgccccctgtgaaagagccaggctggagagaagattcacaccatctgggtacaagacccagtgatatgtcacaatgcccactgtgggaagtgccaaagcagtagaacagttacatcactttggtgctgggtccagtgatatgtcacaatcccttctgtaagctgggcaggagcatcaactcactctggtgtcgggtaaagtcatatgtcataattacactatcaaaaatgttcagggatgagattatacatctggactgggaagaatcaacacatcaaaaatatgaccaggccgggcacagtggctcccgcctgtaatcccagcactttgggaggccgaggcgggcggatcaccggaggtcgggagtttagaccagcctgaccaacatggaaaaaccccgtctctgctaaaaatacaaaattagccagtgtgctggcacatgcctataatcccagctactcgggaggctgaggcaggagatttgcttgaatccaggaagcggagattgtggtgagccgagattgcgccattgcgctctagcctgggcaatgagagtgaaactccatctcaaaaaaaaaaaaaaaaaaaaaaaaaaatgaccaaaccaggcacagtggctcatgcctgtaatcccagcagtttgggaggccaaggcgggagaatatctggagcctaggattttgagactatcctgggggccacatggtgagacaacacctatattaaaaaataataattacagttaaaaaaatatatatatatatatgaccagcgcctgaaaaacatagcaagaacacatctctactgaaaaaaaaaaaaaaacatagatgattgattggtagacagagagacacacagatagacagatagatagatatagatagaaccagtcatggtggctcacgcctgtaagctcagtaatttgagaggtctaggccagcacatcgtctggctgcaggagtttgagatcagcctggaaaacatgatgggaccctatctctacaaaaataaaaagtaaaatatacaaaataaagcgccagtgtggtggcgcatgcctttagtcccagctactgggaagtggggtgtctgagacgggaggatcacctgagcccagggaggtcgaggctgcagtgagctgtgatcatgcacctgcactttagcctgggtgaaagaaatctaaaacaacagcaacttcagtgtacgggaaggagcaagagagacaaagagaaaaaaagaaaaaaacaacagaactcaatgtactgtgaaaacaaactcaaagtggtgctaaaaaaaaaaaaggaaaagaaaaagaaacagaaagatcctgagagccccagctatttgggaggccaaaataagaggatcaactggatgagcctaggaaggtaaagagtgcagtgagccatcattgaactcctctgctggaccgaagctgtactgtcccggtgagagccatctggtccaccgtaaacatttccagctggcaaccaagtcctacgctcgtggcccacatcctgtacacctggcagccagaaagagaagccagctggtggtggaggcagaagcagaagcccactgtgtctaccgtacaggccacatgtggcactcgcggcctgaagctgtccctgttggaaccttatttcccccaaggcggcccacctccgcagccagcctctaagtctgccgaccttccttcctaagctttgaatccctggtccacccaaacgagaggccagcagccacaactactggccacagctcgccacccacatctggtcacccggtggccagaccgagaagccaacgtgtccaccctgcaggccatgtgtggcgctcgcccctgaaaacgtccctctggcgtctaagtctgtgagcttcccatcactccctgggtgacagagtgagactccatctcggaaaaaaaaaaaaaaaaaaaaaaaagatgatggggaagaagggagggagggagggagggaggaagagaggaaaaggaagaatgaaaaggaaaaacaagaagaaaataaaagaggacagagcatggtggctcaaacctgtaatctcaacactttgggaagctgaaatgggagaattgcttgagcacagaattttgacaccagccctgggaacacaaagcagaaggaaaggaggaaggagagaagaaagaaaggtaggaaggaaggaaaaataaaaccaaaaaagttcagggaacatcactcgcactgatgatcaaaggtcagttcctggtcaataaaagtaaacaagcctgtttaagataaattcccctatactctgttgtacctactccttgccctctgcctcagggttataaagcagctgccttcagctattctcccaggaggctttgcaaaaccttctgactagaaatacaaaaattaggtgggtgttgatgagcctgcttgtagtcccaactactagggaggctgtggcaggagaatggcttgaatctgagagactgaggttgcagtgagccgagatcatgccactgtactacagtgtgagtaacagaatgagaccctggctcaaaaaaaaaaaaaaataaaataaaaataaataaataaataacttcttacctaaatctagattcatcatattttacaaaatctagaaacaacctcagaacaataacaactccattcccagaaagagcctcccaaccccacctttgtgccaatcccaactgcatctgcctgtggatttcaaggttttcaaggctctgtggcttctctaagtataaaggctctgtccatggctattgtgagcaggccaggacatctgcaggggaggctcctcaggcagaagagctgctttttcaatgatctccctttgcaggcaaaactatccttagcttgcagtcactgagttcaggcttctacttcccagtcaggattattcacttagtttgaaataagaaaatgaccaatgtatggccagacatgatggctcacgcctgtaattgcagcactttggaaggctgaggcaggtggatcacttgaggtcaggagttcgagaccagcctggcaaacatggtgaaaccctatctctactaaaaacacaaaaattagccgggcgtggtggcatgcgcctgtaatcccagctattcagaaggctgaggcacgagattcccttaaacctgggaggctcccttaaacctgggaggcgcaggttgcagtgagccaagatcgtgccactgcactccagcctgggtaacagagtgagactcagtctcaaaaataaataaataataataattaaaaaaatgaccaatgtttcaaaaaagtgcaaaatcactccaacacactgtttatagaatagtgtaaggaaattgtaagacttaaattttcaactacaatataaaaagcttaagtaaggctgggcatggtggctcacacttgtaatcccagcactttggaaggccgaggcaggaggatcacctgaagtcaggagttcgagaccagcctggccaacatggtgaaacccatctctactaaaaatacaaaaattagatgagtgtggcagctggcaactgtaatcccagctactagggaggctgaggcaggagaatcgcttgaattcaggaggcaaaggttgtactgagccgagattgtgccaatgcactccagcctgggcaacagagcaagattccatctcaaaaaaaaaaaaaagcatctgtccttttcagatgataaacatctcatttaactatttccatgatagataatttaataaacaatcatatgtgaacatttctagaagatgtcaagttccatctcataaaatttagcattaaacttggacatctagacaacagaatacagaacagagattatccactgttacaaattctagacaccacaaaaaagaggagctgatggtttgagaaatatatacaatgcaccaattaatctatcacatttgcttgtggaaatatattcactttgtatagccataatgaaaaaaagatttttcctatttcttttctctggtagcattcccaaagcaaagcctggggttctatttaaaatcatgcaaccaggaaaagcagacatgagaaacttactacactcactctggagaagataaaggtaaataagaatctttaatacataaaatatatgagtagatttttctgaaatatacctttcatagtctgactttttaaacatcttttaaactcttctgataaaatataagttacagttattaaaaaactgaaatagaaatgtgaaaaaatctttccaaggtaaaaaactcaggaagaggcacatgccacaatgcctgactaatgtttttgtatttttagtagagacggggtttcaccatgttggccaagctggaaataattttttactctgcggccaggtgtggtggctcatgcctgtaattccagctacttgggaggctgaggtgagagaatcgcttaaaggcggagggaggctgaggtgagagaatcgctgggaggcagaggttgcagtgagccgagactgcaccactgcactttagcctgggcaacagagaaagactgtctcaaaaaaaaagcatactctgcactagcagcattaacacaaaaagttctagtaaaccctgacacccactcaaatgtcacatcctctataaagccctccttgattttcccagtgctatgtcactggcagaattgatcactattaccatttagctcctcaatactttataagtctttttatgtacaagggttattctctccagaataaattaatcatttacacacctatccatgctaatgaactataaactcctatggggcaggtatgttgaaccctgttcatctgtgtaatccaaatgtctgatacttaataggtgtcatatacacataaaatcaaaatgctgtcagggaattattggaaaagctaccaaattcttttttttttaacttttaagttcaagggtatatgttcaagttttttacataggtaaacgtgtgtcacgggggtttgttgtgcagattatttcatcacccaagtattaaggcctagtacccattaggtatttttcctgatcctctccctcctccaataggccccagtatgtgttcttcccctctatgggcccatgtgttcccatcatttgactctcacttataagtgagaatatgtagtagtttgttttgcttttttttttttttttgagatggagtttcgctcttgtcacccaggctggagtgcagtggcactatctcagctcactgcaacctctgcctcccgggttcaagagattctcctgcctcatcctcctgagtagctgggattacaggcatctgccaccacgcctggctaattttttgtatttttagtagagatgaggtttcaccatgttgctcaggctggtatcaaactcctgacctcagatgatccacctgccttggcctcccaaagtgctggaattacagctgtgagccaccacatccagctagtatttagttttctattcctctgtttgctaagaataatgtcttatggctctatccacgttcctgcaaaggacatgatctcatttttttttaatgggtgcacagtactccatggtgtatatgtactacactttctttatccagtctatcattaataggcatttaggttgattccatgcctttgctattgtgaattgtgctgcaatgcacatatgcatgcatgtgtctttataatagaatgattcacattgctttgggtaaatacccaataatggattgctaggtcaaatggtattttgtctctaggtcttcaaggagttgccacactgtcttccataatggttgaactaatttacactcccatcaacagtgtatacgcgttcctttgtgaaaaaataattttaattttctaaaaggttagctttctaagacaaatggtatgcgaggaaatttccacaggcctaagccatccagctgctcttctgagaggctacactcttcctcctcaggctgtcctctaagagatgacccaggggatgatattcattagacactccaagagatatggccactgtgggcatcttgggttatccctgacggttctgaaaatcatgaacaagaaaagaccggagggctgccacaaagggccctggaatttctccaaagcaaaacttcaaccgaaagacctactaacaaggtgtatgcaccagggaagataaaaggacagtcacagagattttttttctttttaacagtggagttccagaggattattttctcacgtaacatgtttacagacttcggaggttgaggcgggtggatcacctgaggtcaagaattcaagagcagcctggccaacatgaggaaaccctgtctctcctaaaaatacaaaaattagccgggcatggtggtgggagcctgtaatcccagctacttgggaggctgaggcatgagaatcgcttgaatctgggaggcggggattgcactgcactccagcctgggcaacaagagtgaaactccatctccaaaaaaaaaaagaaaaaaaaaattgtatacagacaacaattattttaaaacctgccatccactgctgtgtaagaacatgattaataataaaaacactgtgtttgaaatgtaaaataaaggacaaatagttgatagtgttgtaaattggagagaggaagttgttctcatttccacttttgagaatgtaggaacaaaggtggaaatttataattttactacaagcctgagttaagctagggtaaaagggtagtggattagaagtcctgcttgccatacattaggaagtcacagaggaaaaccagtcctcctgtggagtgttatttaaaaagcaggaaattagactgaaggggctctagtgccctgtgttcataagtaaaaaatgtaaaacctatctcggattcacttcttataaattattttaggcagaaacaaaattcaggcttaacctgcaattaacctctgattacataaccaggaaatttccacccgaatcatacaaataaggtgactacataaactgtaaccaattcttgaatttggtttgccttctcacacgcccttttcaaaacccttccctttttgcctttcaggtggcccacatattatggctgggtgctttccatttcactaatcactgctcagataaactcgttaacgttttaacgttgactccctttactttgcaagagaagaagctgggcgcggtggctcatgcttgtaatcttagcactttgggaggccgcggcggtggggggatcacttgagtccaggggttccagaccagcttccaccatggcgaaaccacttctctactagaaatacaaaaatcagccaggcgtggtggtgcaggtctttaatcccagcttttcggggggcttaggcacgagaatcgcttgaacctgggaggcggaggttgcagtgatcacgccattgcactccagcctcggcgacagagcaagactttgtctcaaacaaaccaacaaaatgtttaacaaaagagactgggagccccaccggccacagctcctcctacgcacacacgagtcgggattctgccctgatgacccgcctggcatccctgaacaatctgggaaacactcggggctgcgtgcagagctgcccagggagctccagatagggcgccgcagggactgggcgggacgcgcgggtcattgctgcgggcccagccaccatcttgcggccagagggacctgggacggagctgcgccagcagggactcaggtcggcaacccaggagcggtgaggaggccagtcccgtcggtttctcagccagctctcccctctcgggatgctcaacccctcacactcaccctttcccaccttctggaatgtcctggcatcttagctgtctgtgcacgtcccaggacctgcagatcacagggcaacagcctgtcaccggctggggcgagaggggggcagaggtggaggacgttgaatagcagaaagcgatcccaagctctggctgcagcgagagacaaaagccccgcc

SEQ ID NO: 375 - DNA, 47350 bp, Homo sapiens
actgaaccagtatcattaaagcttgaagtgttgaaataagtggcctgggactggcttccacggtgataaaagattcatctggtagcaccagagtaaaagaagtctcactaaacactggccgggcagctgctgctcggtgtgagcatcccggggatgcaagcgtgggggaggtatgtatatattttttttctttctggtcactgatttttctgtcttagataaatgattcattggaacgccattctctattaggagaggatccagctttcttcctttgagggtcagaaatgtttacaaattcctctaaattatttccctactcccttaaaagataaggagttgatttgcctagggctattgcaaaagggttctgtccacagagcattagcagctcctgatatacaggcacatttgaagcggctggcggcaccacccttaataacactcttctttacaaagtgctcattgttaaatatttatgaagccttgcaagatgggccccgatcactgctagggcagatataagttccttgctctcccccagtgcgtggagctgctctgcagaaggtgggtgcagcgtctttccactccacccttctgtgatgctgctgaaactgcatgtctctgagctgatgaaatcacacactcaggggagggctgcctgcagaggtgctggcaacagagccaaagcgggaggggtggggggtggagggatgcgcttcgttcccaagtaagagccaaggcaggctcccaccatcacaatcttttaaatattaataggatccaaaaatatattcataaaaaatgaacaaaactaaaataaaaggaagagcaatagactggggaaacgtttgctgtaaagacgaaaaattaaaggttagtctttctctctcattgccccccttccccaccacgcgcagctcacttgggtacacagccctctgcaacaacagcagaggcgcaggacccattgggaagagagaagagtcgctgagcctgaatgtgctggtgcaacacctggggtcttgtcgcctgaagtttccagggcaggaggcctgggaggagcctgaggttctgatcccagcacaggctcccaggtgaagcatttcactagcatccctgtgaagagaccaccaaacaggctttgtgtgagcaacaaggctgtttatttcacctgggtgcaggcaggctgagtctgaaaagagagtcagcaaagggagataggggtggggccattttataagatttgggtaggtaaaggaaaattacagtcaaagaggggttgttctctggcaggcaggagtgggggtcacaaggtgctcagtaggggagcttttgagccaggagaaggaatttcacaagataatgtcatcagttaaaacaggaacaggccattttcatttcttttgtggtggaatgtcatcagttaaggcaggaactggccatctggatatgtacgtgcaggtcacaggggatatgatggcttagcttgggctcagaggcctgacattcctgtcttcttatattaataagaaaaataaaatgaaatactagtaaagtgttgggacggcaaaaattttggggatggtatggagagataatgggcggtgtttctcagggctgcttcgagcgggattaggggtggcgtgggaacctagagtgagagagattaagctgaaggaagattttgtggtaaggggtgatattgtgggactgttagaagaaagatttgtcatttagaattattggtgatggcctggatacggttttgtgtgaattgaaagactaaacagaataagagaaggagaaaaacaggtattaaaggtctaagaattgggaggacccaggacatctaattagagagtgcctaaggaggttcagcatagtcctgccagcagagattatttatttacttcaagagttaagagtggcagtttggggatagcaccaggaggtatcagctgtgatggcttggagaagtagtgtaaaccggcagtgtaaacaagagcagggcatgtctgagtagttgagaacggtgaataggagtatgactagacagaagatagtagggatgacaagttttttggggcacagtccaagatggtctggtgtctggaatgagactggggcctaataaaaaggagcatccaaacaggagctcaaatggactgtaccctgtagcattccgaggacaggcctgaattctgagaagggaaagtggtgaaagtattgtccagtcctttttaaattggtggctgagcttggtgagctgtgtttttaaaagaccattagtccgttctacctttcctgaagactgaggaccgtaagggatataaaggtttcactgaataccaagagcctaaaaaaatgcttggttgatttgactaataaaggctggtctgttatcagactgtatagaggtgggaagcccaaactgaggaattatgtctgacagaagggaagaaatgaccgtggtggacttctcagaccctgtaggaaaggcctctacccatccagtgaaagtgtctatctagactaagaggtattttagttatctgacttggggcatgttgagtaaagctaatttgccagtcctaggcaggggcaaatctctgagcttgatgtgtagggaagggagggggcctgaataatccctgaggagtagtagaatagcagatggaacactgagaagttatttccttgaggatagatttccactatggaaaggaaatgagaagttctgagaggtgggctagtggctagtagtatagcatagcctgcctttgctggtgtgtggcgattaggcctggtggaaccaccatcaataaatcaagtgtgatcagggtgagaaacagggaagaaggaaatgtggggaaatggggtgaatgtcaggtggatcagagagatgcagtcatgggggtcaggtgtggtatcaggaataatgtgggaggctgcattgaagtcggggccaagaacaatggtaattgtgggattcaacaaagagttagtacagctgaaggagccggggagcaggcagtatatgtgtcaggtgtgaggaagaaaatagattttggaagtcatgagaaatgtagagagtgagttgagcatagtttgtgatttttagggcctctaaaagtattaaagcagcggcagctgctgcacgcagacatgagggctaggctaaaacagtaaggtcaagttgtttggacagaaaggctacagggtgcggtcccagctcttgtgtaagaattctttccacactaaccatgcctaggaaggaaaggagttgttgttttgtaagggattgaggttgggagattagtcggacacgatcagctgggagagcacgtgtgtttttatgagcattatgccgagataggtaacagatgaggatgaaatttgggcttgactgaagtaatgggggctgtctgtgaagccttgtggcagtacagcccaggtaatttgcggagcctaatgggtgtcagggtcagtccaagtgaaagcgaagagaagctgggatgaggggtgcaaaggaatagtaaagaaagcatgtttgagatccagaacagaataatgggttgtaggaggaggtattgaggataggagagtatatgggtttggcaccacggggtggataggcaaaacaatttggttgataaggtgcagatcctgaactaacctgtaagccttgtctggttttaggacaggtaaaatgggggaatggtaaggagagtttataggctttaaaaggccatgctctaacaggcaagtgataacaggctttaatcctttaaagcatgctgtgggatgggatattggcattgagccgggtaagggtgattaggttttaatgggatggtaaggagtgcatgatcgatcactaagtggggagtagatgtgttttatacttgtgggttacggtggggagatacaaggggaggatgtgaaggaggctttgaactgggggaaaagctggcaatgaggtgtggctgtagtccaggaatagtcaaggaagcagataatttagttaaagtgtctcggcctaataagggaactgggcaggtggggataactaaaaaggagtgcttaaaagagtattgtctaaattggcaccagagctggaaagttttaagaggtttagaagcctggccatcaatgcctacaacaattatggagacaagggaaacaggcctttgaaaagaaggtaatgtggagtgggtagcctccatattgattaagacggggacagacttaccttccactgtgagagttacctgaaggtcggcgtccgtgatggtttaggggtcttccgaggcgattgggcagtgtcagccttcagctgctaagccgggaagatctgggaaggagtcagagagccttgggccagagttccaggagctctgggagtggctgccaggtgagttgaacagtccaattttcagtgggtcctgcacagatgggatgcggcttaggaggaatcctgggctgcgggcattccttggcccagtggccagatttccggcacttgtagcaagctcctggggtaggttctggaggaatgcctggccactgtggttcaggtgtttggaagttcttgtgtgctggagatgtggctggggtttgtctcacagtggaggcaaggaattgcagcttttttctattattgtacaccttgaaggccaggttaattaagtcctgttgtggggtttgagggccggaatttaatttttggagttttatttaatgtcgggagcagattgggtaataaaatgtatattgagaataagacggccttttgaccttttagggtctagggctgtaaagcgtctcaggggtgctgccaaacgagccatgaactgggctgggtttttatatttgatgaaaaagagcctaaacattaactgatttgggagaggtcggataaagaaaaaggagcattaaccttgactacgcctttagctccagccacctgtttaagagaaaaattgctgggcaggggggggagggctagtcgtggaaacaaactgtaagacggaccgggtgtgaggaggggaggtgataaaaggattatagggtggaggagcggaggctgaggaagaattgggacctagcttggcctggctaggagcagcccagggaggaggggagacgtcagatgggtctgtagaaagggaagattagaaagactcagtgacccttggggttgggactgaggggacaggtgggagggaaagaaggaggatctgggacaagtcacattgggaacagagactaggaagggaccaatgtgtaaaagaatgcctggacatcaggcacctcagactgtttgcccattttatgacaagaattatttagatcttgtaggatggaaaaatcaaaagtgccattttctggctatttggaaccattgtcaagtttgtattggggtcaagcagccttgtagaagaaaataaggcatttaggttttaggtcaggtgtgagttgaagaggttttaggtttttaagaacagaggctaagggagaaaaaggaggaatggagggtggaatgttgcctatagtgaaggaggcaagcccagagaaaagagagagtagagacatggagggaaggggttcaggggttcttactctccagaaaagtgggaaaggggttgaggcacagaaataaggggttggggtgcagagataagaggtggggcatggaaataagggatcagggcacagagataagaggtcagggcatggaaatgagggatggggcacagagataagaggttagggcatggaaataagggattggggcacagagataagaggccggggtgtggaaataagggatcggggggttcttgccccctagaaaagcggtacttgccgctaagggtgaaggagaaggggttggggggttcttgcctcccagaaaagtggagaaggagtagagacatggagagaaggagttgaggggttcttgcttcccagaaaagcagtacttgctgctaagggtgaaggaccaagactggcatccccgtgtggtcagatacctctgaaacgtgggtgaataatcagagaggcatcccttcaatgattaaacaccaagggaagtctgcctttccgagtccgtgactggcaccagagttttgggtccacggataaaacgtgtctcctttgtctctaccagaaaatgaaagaaattgaaattaagagaagggagagattgaaggatggtgccaagattgaaaggagaaagtggttgagggatagtgagagaggttggagaagagagtaagaagagtccacttacctgatttaaaattggtgagatgttccttgggctggtgggtctgaggacccaaggtcgcaggtggatctttttcatggagcaaagagcaggaggacaggggattgatctcccaagggaggttccctgatccaagtcacagcaccaaatttcactcatgtccatgtgaagagaccaccaaacaggctttgtgtgagcaagaaggctgtttatttcacctgggtgcaggcaggctgagtctgaaaagagagtcagcgaagggagataggggtggggccattttataagatatgggtaggtaaaggaaaattatattcaaagaggggttgttctctggcgggcaggagtgggggtcaccagttggtcagtaggggagcttttgagccaggatgagccaggagaaggaatttcacaagataatgtcatcagttaaggcaggaacaggccattttcatttcttttgtggtggaatgtcatcagttaaggcaggaaccggccatctggatgtgtacatgcaggtcacaggggatatgatggcttagcttaggctcagaggcctgacaaagcaggagctgccgctgtggcccgtgctggcccacctggagaagcaaggtctggagccccgtcccacagcatgtcctgagacggtggcttgttctgcatctgtgatgcccaacacacttgccacgacctaggcctggagagctagctagtgtggctgagtgtgaccaaggggccagggttttaacttttgttcattcacttagtttacatgtaaatggccttttcttttctttttttttctttttatttatttatttatttttttttggagaggaagtctctgtcacccaggctggagcttactggtgcgatctcagctccctgcagcctccgcctcctgggttcaagtgattctcctgcctcagcctcccaagtaactgggactacaggcgcccactgccatgcccagataatttttgtatttttagtagagacggtttcatcatgttggccaggctggtctcaaactcctgacctcaggtgatttgccccactcggcctcttaaagtgctgggattgcaggcatgaaccaccgcacttggctgtaaatagctgtaaatagccatatgtaactaagggctgcctgtgggagagctgcggaagaggctctgacagtcagcttgggagccagttcttgccaatggaagggaatgcctgcaactgggtcccgagtccaagccccttgggaactctcagtgcccagcaggctcctcccaccctgctcgtgtgcttctgtgccaagtccctgactgagctgccaccttgctctctggtttgtcctcctgctccccagtgagtggtgccagccccaaaatggcacctggcaatcaaggactgtgacaacctgcccctctcctgcacacgcctgcctttgagaactccactctgtccaaaaccccagatgctgccagggccctgcctctggtcagatgtcctcagtatttgaatagcatctctttgagtgcctctgcagacgccttgcccacagagtgggtggatccacatcagtccccaccgacccaagagcacggtcctccccaccctgtgcttcaggttgtcgccacgtgttcttgtgagtgtggcaaggcagcttgaagcagcgggaaggaactcaggctccaagtgcagaaaaacatagacgcaaaacctgacttgcttcttcctatctgtaaggtcttgggcaattgtaacttttctgagtgtcaatatcttctccccatcatggagttaccattgtatctacctttcagtaatataaggactagatatagtatttgcaaaatatgttctgtaaatgacatctgttgaggaagaggaagatgataataatgtaaatataattatatgctttacttcttcagctagacccacacctccacctccacctattcctagtttattctcttttctcaatgaccccacaatagtcccaaagatttaaaaaacaaaatatatggggacaattcctaagagaaattgccagatttactttactaagtagagcacaagtgagaaacaacacaaacactaaaagaaaaattttggaaatatgcttaaacctgctaatcattaaattagtgaagagaaaaccactgctcaaactattaaagagccttctagagcaacagaattctgtactggcagcattgtaaattggtataagaattccagaaagcaatctgctaagagtcattcattcagtagacaagtattgaatgcctaccaaccagatattttgttaggctctggggatacagaatgaataaggccagatccttattcacaaaagcttatgaaatggttggcatacataacgtgtcatcacaaaactccatcttacttcttgactcagtaaccacaagtaaataatattaaaaaggtattttcatatattgatgtgcattgctaaaccatctataatagtgaaagactagctacctgctacccaaatacccaaacaagcaatgtttaaaattagaataatttattaatagaataaaagttaacagtgaaatccaaattacaaatatgagaactatagagacatgacaaataatgccaaatggaaagaatacaaaatagcatctatataataattaagtatgaaaagttgtgcatgaataacctaagaatcagatatcagtgaattttatcaatggggatttcgtttcaagtggaggaagaggattgtggcagtcacgagagctcctgatgttgactgtcttcacatcccacccttcctacttcccagatcatggtatcgtggtaggatggcaagtttctgacccttttgaagtcaggcaaagtcatgagatttgcttaggccaaaaacatgtaagcataagagccacatggtttttctcagggtggtctttctcttaaagtgaagccagttctcttcatatggacaatttaccacattcctttcttgctaccatcacaactgacagcactttatatgttagatgttctgtcaacctgaattctggagtaaagggatatgaaacagaggcccagatgacctgaaatgtatacttatcaagtgtgaaaaataaaattttgttattttgagccctgaaatgctttttctaaccaatatcccgatcagtacagatatgtgtgttgttgttgttttttttaaactttgtagacagcttattacttctgaagggatcctgacatggctttgcagagctgtaacagatcacagggtgccatgagctttatgtccttagacccaccacctaggagaactccttgcatgtctgcaagcatgaaagggtctgaacaccaactggtgtgttccaagccagtagttctaaaatttttggtctctggaaccctttatgtccttcaaaaacatgaggttcttggtgtatagcagggttaccaatttgtgtacattaattttgtatcctgaaaccttgctgaattcatttatcagtagctgtgctactcaccaacagtggccaagctgagaatcaaatcaacaactcaaccccttttacaatagctacaaataaataaaacacttaggaatgtatctaaccaaggaggtgaaagaactctataaggaaaactacaaaacactactgaaagaaatcatagatgacacaaacaaaaggaaacacatcccatgcttgtggatgggtagaatcaatattgtgaaaatgaccatcctgccaaaagcaatctacaaattcaatgcaattcccataaaaataccaccatcatggccgggcgcagtggctcccacctgtaattccagtactttaggaggccgaggcaggcggattacaaggtcaggagatgaagaccatcttggctaacagggtgaaaccaagtctctactaaaaatacaaaaaaattagctgggcatggtggcgggcacctgtagtcccagctacttgggaggttgaggcaggagaatggtgggaacctgggaggtagaacttgcagtgagctgagatcgtgccactacactccagcgcctgggtgatagagcgagactctgtctcaaaaaaaaaaaaaaaaaaaaaaagtaccaccatcattcttcacagaataagaaaagaaaatcttaaaattcatatggaaccaaaaaagtgacctgacttcaaattatactataaggccatagtcaccaaaacggcatggtgctggtataaaaataggcacatagaccaatggaactgaacagagaacccagaaataaagccaaatactcacagccaactcatcttcaacaaagcaaacaaaaacatattgtggggaaaggacacgctattcaacaaatggtgatgggataattggcaagccacatgcagaagaatgaaactagatcctcatctctcaccttatacaaaaatcaactcaagatggatcaagaacttaaatcgaagacctgaaaccctaaaaattctagaagacaacatcagaaaaacccttctggacattagcttaggcaaagactttataaccaagaacccaaaagcaaatgcaacaaaaacaatgactaataggtaggacttcattaaactaaaacgtttctgcacagtaaaagaaaccatcatcagagtaaacagacaacccacagacaatctatggagattgtggagacactcttcataatttacacatctgatgaaggactaatatcgagaatctatagtgaactcaaacaaattagcaagaaaaaacaatcccatcaaaaagtgggctaaggacatgaacagacaattctcaaaagaagatatacaaatgactaacaaacatttgaaaaaatggtcagcttcactgatgatcagggtaatgcaaatcaaaacagcagtgcaataccaccttactcctgcaagaatggccataataaaaaaaataatagatgttggcagggatgcagtgaaaagggaacacttttacactgctggtgggaatgtaaactagtacaactactatggaaaacagtgtggaaattccttaaagaactaaaagtagaactaccatttgatacagcaatcccactacatttgatccagataatcctctgggtatttacccagaggaaaagaagtcattatacaaaaaagatacttgcacacacgtttatagctgtgcaattccacagttgcaaaaatatggaaccagcccaaatgcttatcagtcaataagtggataaagaaattctaccatatatatatgatatatataatatatatacatatatgtatagtatacatatatacatatacatatatgtatataatatatgtatatacatatcttatatatatatcttatatatgatatttcttatgctatgagatatatatctcatatatcttatgctatgagatatatatctcatatatcttatgctatgagatatatatctcatatatcttatgctatgagatatatatctcatatcttatgctatgagatatatatctcatatatatcttatgatatatatctcatatatatcttatatatatctcatatatatcttatgatatatatctcatatatctcttatatatgagatatatatctcatatatcttatgctatgagatatatatctcatatatcttatgctatgagatatatatctcatatatcttatgctatgagatatatatctcatatatcttatgctatgagatatatatctcatatatcttatgatatgagatatatatctcatatatcttatgatatgagatatatatctcatatatatcttatgatatatatctcatatatatcttatgatatatatctcatatatatcttatatatatctcatatatatcttatatatatctcatatatcttatgatatatatatctcatatatatcttatatatgatatatatcatatatatcttatcttatatatctcatatatatcttatatatatctcatatatatcttatatatatctcatatatatcttatatatatctcatatatatcttatgatatatatctcatatatatcttatgatgtatatctctcatatatatcttatgatgtatatatctcatatatatcttatgtatatatctcatatatatcttatgatgtatatatctcatatatatcttatgatgtatatatctcatatatatcttatgatgtatatatctcatatatcatatatatatctcatatatcttatgatatatatatctcatatatcttatgatatatatatctcatatatcttatgatatatatatctcatatatcttatgatatatatatctcatatatcttatgatatatatatctcatatatcttatgatatatatatctcacatataacttatgatatatatatctcacatatatcttatatatgagatatatatatctcatgtatatcttatatatatgagatctagatctcatatatatcttatatgtgatgtatagatcccatatatatcttatatgtgatgtatagatcccatatatatcttatatgtgatgtatagatcccatatatatcttacatgtgatgtatagatcccatatatatcttatatgtgatgtatagatcccatatatatcttatatgtgatgatgtatagatcccatatatatcttatatgtgatgtatagatctcatatatatcttatatgtgatgtatagatatcatatatataaaagtattcccttttacatttttcaaatgttagtcatttgtaaaaatgttcacttatatatgtatatatgtatatgtatatatacatatatgtgtatatatacatatatacatatatatacatatatgtatatatacatatatacatatatataccgtgtatatatatacatatatatacactgcatatatatacatatatataccgtgtatatatatacatatatatacactgcatatatatacagatatatacagtgtatatatatacagatatatgcagtgtatatatatacagtgtatatatatacagatatatgcagtgtatatatatacagtgtatatatatacgttgtgtatatatatacagtgtatatatatacgttgtgtatatatatacagtgtatatatatacgttgtgtatatatataccgtagaacactattcagccataaaaaggaacaaaacaatggcatttgcagcaaactggatggaattgaagaccgttattctaagtgaagtaactcaggaatggaaagtcaaacatcgtatattctcactgataagtgggagctaagctatgaggatgcaaatgcataagaatgatacaatggactcgggactcggggacagggtgcgaggcgggtgagggataaaagactacacattgggtacagcatacactgctcgggtgatgggtgcacccaaatctcgcagatcaccactgaagaacttactcatgtaagcaaacacaacctgtttcccaaaagcctatgaaaaaaaaaagagaaaaatgaataaaataaagaactaaaaacaaatgagcttcttaaaaggaattaatattacatgtgggttattgctgtgaatattgccatattagcaataaaaactgaaaaaaaccaagagtatcaattaatgtaaaagcaacaaaattcctttacacagtaacaaaaaaagaataaccatattttcacaaataaaaaaaagagaatgtgtcattattttacattttgccagtatcattaatgtctgatttaatagaatttagttagggactcatttctgttttcgtattcaatctgttggaataagttgttttgatcaaagtatctgaaaatgtggcctcatacagacatgtagtagggaaaaggagaaatactccaacagacttttcaggtaactgtggctattcttctttgacactgacctgtaattgactgttagtactagctttttaaaggccaatgagatatggaatctgacacaatatcaggaaacttttcatactctgttatataaaaattattggcttattttatacttttttattatagtttaagttctgggatacatgtgcagaacgtgcaggtttgttacataggtagaaatgtgccatggtggtttgctgcacccatcaaccagtcatctacattagatatttatcctaatgctatccctccccttgccccctaccccacaacaggccctagtgtgtgatgttctcctccctgtgtccatgcattttcattgttcaactcccagttatgagtgggaacatgtggtgtttggttttctgttctgtgttagtttgctgagaataatagtttccagcttcatccatgtccctgcaaaggatatgaactcattttttatggctgcatagtattccatggtgtatatgtgccacatttttttttatccagtctatcattgatgggcatttgggttggttccaagtctttgctattgtgaatagtgctgcaatagacatatatgtgcatgtgtctttacagtagaatgatttataaccttttgggtatataccgagtaatgagattgctatgtcaaatgatatttctagttctagatccttaggaatcaccacactgccttccacaatggtggaattaatttagactcccaccaacagtgtataagtgttcctatttccccacatcctctccagcatctgttgcttcctgactttttaatgatcacccttctaaccggcatgagatggtatctcattgtggttttgatttacatttgtctaatgacaagtgagggtgagctttttttcatgattattggctgcataaatgtcttcttttgagaagtgtctgttcatatcctttgcccactttttgattttttttcttgtaaatttgtttaagttccttgtagattctggatattagccctttgtcagatggatagatttcaaaaattttctcccattctgtaggttgcctgttcactctgatggtagtttcttttgttgtgtagaagctagtttgcttaattagatcccatttgtcaattttagcttttgttgccattgcttttggtgttttagtcatgtagcttttgtccatgcttatgtcctgaatggtattgcctaggttttcttctagggtttttatggttttgccttacatttaagtctttaatgcatcttgagttaatctttgtataaggtataaagaaggggtccagtttcagttttccacatatggttagcctgttttcccagcaccatttattaaataggaaatcctttccccgttgcttgtttttgtcaagtttgtcaaagatcagctggttgtagatgtgtggtgttatttctgaggcctctgttctgttccattggtctatatctctgttttggtaccaagtaccatgctgttttggttactgtagccttgtagtatagtttgaagtcaggtagcatgatgccttcagctttgttctttttgcttaggattgtcttggctattcaggctctttttttggttccatatgaaatttaaagtagttttttctaattctgtgaagaaagtcaatggtagcttgatggggatagcattgaatctacaaattactttggacagtatggccgttttcacgatattatttcttcccatccataagtgtgggatgtttttccatttgtttgtgtcctctcttatttccttgagcagtggtttgtagttctccttaaagaggaccttcacatcccttgtaagttgtattcctaggtattttattttctttgtagcaattgtgaatgggagttcactcatgatttggctctctgtttgtctattattggcatataagaatgcttgtgatttttgcacattgatttcttatcctgagattttgctgaaattgcttatcagcttaagaagattttgggctgagacaatggggttttctaaatatacaatcatgtcatctgcaaacagagacaatttgacttcctctcttcctatctgaatattttcccttgcctaattgccctggccagagcttccaatactatgttgaataggagtggtgagagagggcatccttggcctgtgctgattttcaaaggaagtacttccagcttttgcccattcattatgatattggctgtgggtttgtcataaatagcccatattattttgagatatgttccatcaatacctagtttactgagtgtttttagtgtggaggggtgttgaattttatcaaaggccttttctgcatctattgagataatcatgtggtttttgtctttgctcctgtatatgtaatggattacgtttattgatttgcttgaaccagccttgcatcccagggatgaagccaacttgatagcggtggataagctttttaatgtgctgctggatttggtttgccagtattttattgaatattttcacaccaatgttcatcaaggatattagtctgaaattttctttttttgttgtgtctataccaggttttggtatcaggatgatgctggcctcataaaatgagttagggaggagtccttctttttctattgtttggaatagttttagaaggaatggtaccagctcttctttttacctcttgtagaatttggctgtgaatccatctggtcctgggcttttttggatggtaggctataaattactgactcaatttcagaacttgttattggtctattcagggattcaacttcttcctggtttagtcttgggaaggtgtatgtctctaggattttattcatttcttctagattttctagtttatttgcgtacaggtgtttatagtattctctgaaggtagttggtatttctgtgggatcagaggtggtatcttttatcattttttattgtgtctatttcattcttctctcttttcttctttatttgtctagctagctgtctattttgttaaccttttcaaaaaaacagctcttggattcattgatttttttgaagggtttttcatgtctctctctccttcagttctgccctgatcttagctatttcctgttttctgctagcttttgaatttgtttgctcttgcttctctagttctttaaattgtgatgttagggtgtcaattttagatccttcccactttctactgtgagcatttagtgctataaatttccctccaaacactgctttagctgtgtcccagagattctggtacgttgtgtctttgttctcattggtttcaaagaacttatttatttatgtcttaatttcattatttaccctgtagttattcaggagcaagttgttcagttcccatgttgttgtgtggttttaagtgagtgtcttaatcccgagttttaatttgattgcactgtggtctgagagactgttatgatttccattcttttgcatttgctgaggagtattttacttccaattatgtggtcaatttcagaataagtgctatgtggtgctgagaataatgtatatttgttgacttggggtggagagttctgtacatttatattaggtccacttgttccagagctgagttcaagtcctgaatattcatgttaattttctgtctcattgatctgtctaatattgacagtggggtgttaaagtctcccactattattgtgtgggagtctaagtctctttgttgatctctaagaacttgttttattaatctggatgctcctgtattgggttcatatatatttaggatatttagctcttcttgttgcattgatccctttaccattatgtaatacccttctttgtcgttttttatctttgttggttcaaagtctgttttatcagagactaggattgcaatccctgccttttttgtttgtttgtttatttgtttgctttccatttgcttggtaaatatccctccatccctttattttgagcctatgtgtgtctttgcatgtgagataggtctcctgagtacagcacaccagtgggtcttgactctagacaatttgccagtctgtgtcttttaactggggcatttagtccatttacatttaaggtttatattgttatgtgtgaatttgatcctgtcattatgatactagctggttattttgcccattagttgatgcggttttttcatagtgtcaatggtctttatattttggtatgtttttgcagtggctaatactggtttttcctttccacattaaatgcttcctttaggagcccttgcaaggcaggcctggtgatgacaaaatgcctcagcatttgcttgtctgtgaaggatgttatttctccttcacttatgaagcttagtttggctggatatgaaattctgggttgaaatttattttctttaagaatgttgaatgttggcccccactttcttctggcttgtagagtttctggagagagatctgctgttagtctgatgggcttccctttgtgggtaacctgacctttctctctggctgcccttaacattttttcctttgtttcagccttggtgaatctgatgattatgtgtctttgggttgctcttcttgaggagtatctttgtggtgttctctgtatttcctgaatttgaatgttggcctgtctttctaggttggggaagttctcctggataatatcctgaagtgtgttttctaacttggttccattctccccatcacttttaggtacaccaatcaaacgtaggtttggtccttttgcatagacccatatttcttggaggatttcttcactcctttttattcttttcctctaatcttgtgtttgtgctttatttcattaagttgatcttcggtctctgatatcctttcttccacttgatcgattgggctattgctaacttgtgtatgcttcactaagttctcatgctgtgtttttcagctccatcatgtcattcttctctaaactggttattctagttagcaattcctgtaaccttttttcaaggttcttagcttccttgaatagggttagaatatgctcctttagctcagaggagtttgttattactcacctatgaagcctacttctgtcaattcgtcaaactcattctccatccagttttgttcccttgctggcaaggagttgtgatcccttggaggagaagaggtgttcggtttttggaatttgcagactttttgcactggtttttcctcatcttcttggatttatctacctttggtctttgatgttggtgacctttcgatagggtttttgcatggtcatcctttttgttgatgttgatgctattgctttctatttgtcagttttctttctaacagtcaggctcctcttccacaggtctgctggattttgctggaggtccactccagaccctgtgtgcctgggtatcaccaacagaggctgtagaacggcaaagattgctgcctgctccttcctctggaggcttcgtcccagaggggcccctgccagatgccagctggacctctcctgtatgaggtgtctgtcaacccctgctgggagatatctccccgtcaggaggcacgggggtcggggactcacttgaggaggcaatctgtcccttagcagggctctagcgctgtgctgggagatgtgctgctctcatgagagccagcagtcaggagcgtttaagtctgctgaagctgcacccagagccaccccttccgccaggtgctctgtcccagggagatgggagttttatctaaagcccctgactggggctgctgcctttcagagatgacctgcccagtgaggagaaatctagagaggcagtctggctctatattctactcttaatagatattttacctatgcctaatttcataacatcaggcactggacactaaaaaatactagtgtgctgagttgttcagctcttccaaaagctgacacattccattacacaatatcaaaaaaatcacatttattaatataattactgattacatcagaaaagtctgagtatcggaaagctgtcaagttcaccgtcgtagacacatgttttttttattctgatttttgctcagaagttcaacttttatcattggcaaccagtactctcagctgttttcctttaagtgacaggctcactttgctcatttttgagaaaatgcctgccaaatgcccaagtctgaataaccacagtttgtctggaatttgttattttaagcaaagattgtgttacaaggaagaaagtggctagttcagcgcacagctcagtggcacgagtgctgtccctcgaaacagccatcgtacttcagttagcagcgtatgtgctttatcgttttgccacacacaatatgaaaagggtctgtatttaaggaatgagatttaataaaattaatcatttttcctgtttcatcaaagagcatgcttaagtgagcgggcttctcttgccctcactgtgagtgtgtggtgatgaagaagaaccccacggctgctgataaatttgggtgcccctggcttgatttgtgctatggggccagcagttttacccacaattactttatttcatcagtgcaaatgtcaacagaggttaaaaatgaaatagctttcttagtatgattattaaaataattttgaccgcaaagtctcctgaaagtgtgtccaagactcccagggttttctgcaaacacacgactgttccagtcgattgcaaaagtggcctgtcacaatagcaccagcactcctcttcttcactatcctgcttttgagaatccatctggccttggggagggcactttatctattgagcttcagtttccttgtttgcaaaacaatagcattcattgacttatttattcatgcattcaacaaatatttactgtctcgtgttatatgcactgctagtgcataaggccttgagaataaagccatgaaaagacaaagttcttgcactcactttatgacctagaggagaccaaaacgtgtgtgtgtgtctctgtgtgtgtgtgtatatttatttagataaaaacaatatgtaaatatttaacaaataaataaatgaatgaaaccactacactgttgtatgcactagagatttcatttggtaaattaaatgaaccaaagggctctgataagatttaggggagtgggtggcacagtggacacaggatggccaaggaagcttctgttctgagaaagtgacattcaagctaagacctaaggggttgaagctaccaggcaggtatctttccaactcagatttcttctgattttgacagtgcccagtggggcacctgagaaatgtcttcgggttctaaaaggggtggtgaataagtgttggaaagggataaataataccagtattaattaacatattaagcacgtattgtcttctgggcaatgttttaaagaactttttatgaaataatttaatctttataataacttactgaagtaaggttctattactcccattttgtggaagataaaattgagacccagaggtcccacagctaggaaacagcagagacacgattcagactcaggaagtctgatgcaagaggtattcgccatttcctgaagtagataggaagtattttactatttctaaagcacatagaaatcccaagatatgggtacgtattatcattattattgatataaatatatttttaaaatacataaaactcagtaatacaaattgagttatttttaaaaattatttcacaaattatagaacatgttatctacagagctggataaaattgtaagggtaacaatgggaataaagttggagctgtattgaagggctaaggcaaagaaaagtatgaactgcctgtgtttggccttgttttaagcatgaaagggaaaggttagtgatctgagtgtgtaaggtgttggctctctaaactgctccgcttgaagggctattctaagagcaaagtgtggagggctctatgattgtgcgtaactggggcacacctcgggacggctctttggatccatttgttccagctgcctctgagctctggaagatgcttccgcttgcccttccctgaaatccttccctgcattattaaagaggcttccctgttccctgctcattcacgcgcactaatcttggcccaaggagaggttgggagcgaggtctggctgtattttctctgagaggcagcacggagagagctgcttttgaaattctctacttgacagatttgcagctgagcaccaggcatggtctgtgaaggccaagtttttattagcagcggcttttcttcttgctcttaggctaaggtgatcctggaacacaggcatgcttggtcttgagtttctcttgggagaaacaatgggttttgttccttctctgtttcttaagcagcatgctctaaattgggtccattttctcaggatgaaattttttaaaaccagaaggcaagggtttggagaacctaaagaaaaccattagctgaacaagagggcacagtgaataaataattttcagaatttcagaggcagtagatgataacgtagacacatggagttggagatgaaggttaatgtagagtcaacacggttggggggttctgaactgaagacctggcgcattttgacaagctaccttacgtttcctgccaacagacccaataagcattctgatttgtcataggtttatgtcgtatgttttttagcaagtgcatttttatcagtgtggacaaaacgtgaatctggatattttaatgctgctctccttggagcagcatctgagccatcagcaaagagaatgagagtcagtcattcactcaaccagtggtaacagagctgggcacagacagtgtgcagcaaatcagacggagcctgcccttgccccaaggagctgcctacacctatgtagatgctgtgcatggcatttcctcctgctgacatgcacatttagtgaagttactactgttaagataaatatgaacacttcatccttacaaaagagctaaataaatgccttattattactattgcaactgatagtgggtgatatggtttggctacgtccccacccaaatctcatcttgaattgtagctcccataattctcacatgttgtgggaggtaattgaatcattgggtcggttttccctctgctgttcttctgatagtgaataagtctcctgagatctgattgttttgtaaggggaaacccctttcacttggttctcattttgtctgttacctgccaccatgtaagatgtgcatcttgccttctgccatggttgtgaggcctccccagccatgtggaactctgagtccattaaacctctttcctttatgtgcagggggcctttatacattacccagtcttgggtatgtcttcattagcagcgtgagaacaaacaaatacagtgggtaatggtagtaaataactaagcatatgtaaaccaagggttatttatgctgaaggaaaatgagtgcaggtttttcataagaatgtggtaaatacaaattttaggtataaactctttcttcttcccccgaccccagaagatccagttttcatgtgcctatgacccttcttgccaagatttaggcgttagctttctgtaagcactgtccttgggggagtttagataaatactgaaaagtataaatttctgtgttattaaatatataatttaatgtgcagcagaaacaatggtcttgaaagtttttgatttgcaagtgctgggcttcagagagaagaaaaggctcagggcataaaatatgtgccacaccagcagctgggtggaaaatgcatgagagagaaaaatttaggttccacacaaccagaagaggtgaccctttccagttgcaatggtttccagagaggtgtggaagtgaatatgaagacaatgtcaaagctacgacatcaggaaataggacccctcccctccatcccatcctaggatcaagggtgggtggaatatccaagaagataagcttaatatgaggacgacagagaggcttctaccttccttcccagctgcaggtgtacttgggcaggggctgccttagctgcaggttagtctgcattgagagaggtgctagacagatgggcccaggggcagcttcacagcatacaggcagcatggtccagtgccaaaagagcaactgggaggtcctgagcctgcagcaaggcactaagggatgagagagtaggtagaactggagtagcctgtgcctaaaacagagaggatgcacagtgtttgctcctggatctcacagaacattctggaatggtggatatcaacaaaagacactaggggaaaatgacaaggaccagaggaggcaagtacatcccaaaggtaactgacaaatgtggagggcaggaaggagccaggtagcaacccctgcaatagtcctggatggtaatatgcctcccctcttccccatcctgttttgttctgaccaccgtcaggattggggggttgcatccgaatgtgtgctagatgacagctctaaggtgatgtgttaacaacaagagctataatcacttaatttatagggaaactgtagggggaaattggaaaactggacaatggacagaacttttaaataattaacgtgaagacagactatacatacacacacgcgcacacacacacataccactcacacatattcagtcactgaggcaatttctgcttatagtggagaaaccaatgacatcagtgaccaggctaaacctatgcattttgtgggtgaatttaaatttcaagtgagtgcagagtgttttggattatctccgccaagttgctgcctagcatggcatgccattcatgtgcctagatcaatataaatatggatacccctatatgaactaggcagggaaagtgggacaatttgacagccccttgctgagacacagcggcttccatccctgggaagggcctgaatagcccagtgcagccctgatggactataagcaagaaaacagcagcccggaaaatgcagatgctttggagatgctggcttgacagactgaagcctgtttgtcaaacaggctgtcacctatcagagttttaaataggagctttctatgggatgttacgtaacttgctggctcacaacagccccagtggaatggaacggggggcagggggggtggggggcagcgccaatgagaagcagctgcgggatagaggacaaggccctgctattcttttccttaatggattccctgcctcctgcattgccatacttgaacacacaacatgggaatggaggtgcctgctctttaagggctgtgtcagtcaagcaagggacattacatgtggcaaagttggaaagagagcagggtagaaagatataggttctctgtggtggctggtcccttgggctagtgccctgggcgatgcggggtgctcaccccagcgctgcccctggtctaccaggccggcatcgccctcctacataccatgtcccaactgaaggctgatggttgaactcggttctccccctttgggaagggacgtaggttcagttccacagagggtgtgagatgagatgttcatatgtttgaaatcatgtaatggtgtgtgtgtgttttttttttaatgttctctggacataatattgctgctttggtttgtcttctcttccaaggaggacctagttctttttttctttttttgggagatggagtcttactctgttgcccaggctggagtgcagcagtgcgatcttggctcactgcgagctccgcctcccaggttcacaccattctcctgcctcatcctcccgagtagctgggactacaggcgcccgccaccacgcctggctaatttttgtatttttagtagagacggggtttcaccctgtcagccaggatggtctcgatctcttgacctcgtgatccgcccgtctgagcctcccaaagtgctgggattacaggcgtgagccaccgtgccaggcctaggacctagttctttactgccccttcagtcaagttgaatccagtgagagaatcatcagtcacaacttaccctatgtcaaggtgtagtcctgagaatctattagtaaagtaagtttggagatgagttttattttagaggccctaggggagttggctattttaaagactcctgatgtaagagcgaataattctattgtgatgggatgaatcactctctactttctgatttatctgttttataagtttggaattttgcatattaagttgttcttcccttatgtgtattagccacatactgctgagtcatcaaagggcctgaagcagaaaggaagactttggatgtaagttttcacataatcaaattttatgtaaccaaaaagaagagccctgttaataggtaaaggggctgtactaaagtgactggaattttcatacatttgtagcagtcaccctgtgttatattggggtgacagcattctctgacatggaaagttgaagatggtatacataagctgttgttgaaaattcatacggattggttattgaggctgtcataattgagttgcagtgtggtggcagctatgccagtggaatagcagcagtgcctggcaacacccagttgtagtgtactatttacaaaaacacagtgataactttccttggttaatcccctcccacactgactctgggtctgcccatgcaatttctgatggctgataagacaatagcaaatcgggcatacccaacagcctgaacatttctcatgttttgtggtttgccctttttggctgctctggtggatcctgggaacaccaccatgagaaggagctcaggctaacctgtggataatgtgagacataggaacaagtcacctttattgccccagcagacttccccaaccaccaaatgagggaaggcatcctagaacacatggcctcgtttgagccaccagccggtcacagtgatcaaccaagccattccagacaaactgcccaaaactgtccaggcaccctaccagcattcatgaaaaataagaaatgtttgttgttcaaagccacaggttgggggcaatttgttaggcagcaaaagctaactgatacacaagttaagatcagtaagttgtagtattttgttggggagaggagaattgttaggatgacttgaagttgatcctgcttggataccaaagccatgtaacccagcaataacttcattatataatagggaatttaaatactaaagaattaatttagaaaaacttacagggattatggttaaattagacagagttttattaaatagttaacctagtcacgtatataaatgattgaaatatttataatacaggtgtgatgctatctcacaaagggattagcagattcctgcagctatggacaactacaggcaaagtctcagagttggtcctatcttgtacaggtttctcctggggcttcatatttgtccctgcagcctggtcatcatcttagtgataataatgtctctagagaatgttggctaccagtgctctgtaatatccctcttaactaattaaagtcaaatttatgttgtttcagccattttcttttaaaagctgccgctgctactgttatgctgttattattagtagtgtttattatgtctttcagctattcctctatttttgcctttgtatatccacacattgcagggcactgtgggtgtgagacatttgcttcagtcttgttaggaaaagcaactttactttaatctgctgtgctgtgtacttgaggcatagcattgatccatgctggtgacagctttccctgacctccactgacagtgagctgtatgacctttctgtgggctgtttgcacccacttctcaatcctgcaatctccctttagtcatctgcctcctaaacttaggttttgaacttcctggaatgttaagggactctgctctggctatgcagttgtccacctccctaaccacatgttctgcttgtgctgaccaaattaagcacactgactacacccacccctggctaacttgaccccgtcaagaacagcagaggcccccgacggctacccttctgccctttcttctcatcttcagattcaaggattcctctcattattatgaccctctggtcaattaattttgcattctcctcatagcctactggggtggctatgtctcttgccctgttcattttgaatgagcaggcccataatagtcccaataatcctgttgtgatggctaactttgtccgtcaacttgaccagtgtgcccagacatctggtcacacattctagttgtgcctgtgagggtgttttgtgtgggattaacacttaaattggtggatggagtgaagcaaatggccctccctattgtgggtgggtgccttgtcaatttttgtgttgctatgaaagaatacctgaggctggatcatttataaagaaaagggtctgacttggtccatgggtctgtaggctgtacaggaagcatggcgccagcatctgcttctggtgagggcctctggaagcttccactcatggtggaagttgaatagaagctgacatggagagattatatggcagtaagtgagagaaaggggtggaaggtgtcaggtgctttttaacaactataattcttttggagactaatatagtgagaagagaactcagccatcaccaggaagactgcactaaaccttcatgagagatcctcccccatgacccaaacacacctgatcaggcccacctccaacactggggatcacatttcaacatgaaacggtggcatatccaaaccatagaagtaggcctcatccaagccactgaatatggaacaagactgctgagtaagaaggaactcctcctgcctgatgacttgagccaggacattgcttttactccagccttcagattcagacggaaacactagtcgccttgggtcttgagcctcctggcttttgggctggagctacacattggttctcctgggtctccagcttgctggctgaagattttgggacttcttagcttgtagaatcatgtgagccaatttctctctttctctctacacacacacacacacacacacacacacacactcacacacacacacacacacaccccatattagttctgctgctttggagaactctaatatatattaatttgtaaattgtttgtcccaggagaaaataacaaacctttctctcatttttttctttttactctttgaaaagtgtcccccttctcttacagttgttgaacaaaacataaatggtcatgcttaacatatatcatccaagtcataaattcaatttattctagaagaaactgtcaacgaacattctaaaattgtttaatcctttttcgatccaagataagtgaattttattgaaatttgacttgagaagacattaacttggaaataagtagtcctctcatgagctattttatagaattgtaaagaaaacaaaactgctttgagagaaagcggggagaggctgagcagagatgtgcatgggttgtggtgagaatgagccctgtggagaggaaacttaattggacctcttattctaggctgcgatctagaggaaaatgaatttaattcatgctagttctgtagcaaaaacttagtgatgaccctgaattaggccttgagtgatttaaaaattagaaaaacaatttaacctgagaataacaaagagtggcctatgccataggcaggatgggctgagcttctcagtgccaaagaggccaagagaaagagctccaggctactgggggctgaggtgagaaagaaatagacaggaggttcccaggagctgtccaggctccatgcaggatgaaagccatgccaaacagatttgaacaacacgaggctgcgtccttgtgacttcctcatttatatacaattccactccaaggttctctgccactctgccacaatagcacatgctccattgaccgcctgtgttgtgctggaaaggacacagtgtggggagtcaatcccagagtccagctagaggtggggaggggacacacatttggagggaagactggtcacccagggcctggcaaacaggtcacagagctgtgttcaaatgcctgcagaggatcattctatatcacatttgccaagaggtgcatatcacttcggggtctgtgaacagaagggcattccggcaaagagactcactcttttgaacactggtggatttcctggtcgcagggcaggacagcgaggagaacaatgcttttttggaactggactctctatgctgcgtccttctgttttctgctcacatctgctggttcctcagctgtctcctgtttaggtttgatgtggaagtctggggcatcccactactaatagatgccagattgggagctgcctgcagccaggagcctggtttcaagcctgctcattaatgggttacatctccagtagcatctttgtgtctgtgtcgcagagagggcagccacgtgggaagcaaagagctttaccttggtgcctcctggaggtgcttcaggaagagtagacaggagggaggctccaagctgggaggcaggcagagctttcagacccatagtagggtgagttgggaggcgggcagaatttccagacccacagcatggtgaacagtgacaggcatgagtgccctcgggcaggtgctcactcactgacatgctcatcatacctctgacccagcaaagggttttgccttgccctgtttagtgagcccgttgagggagtttctcttgttgcagtctggtgtgtaagtgtataagagagaagtattctgaaagtagaagagaaaagggggaaaaaatcacacttcccggagctcttctataagtagggagaattttccagctggtatcaatggcgaaataagttaaaagagctcagatacttagctagtatgagaaaactagaattgttcttgtcaagattagcaataactccactaaaaaaaaaaagatcatatacattgactgtcttcagtttatttaattctttaatattttgggcattgtcattcactttcttctttttgaaactggtcttcaagtaagtttttgactcaagtgtaatatatacatatagatacaggaaaatgcacaaattagaagtgtatatataaattagttttcataaggtcagaatatgcatggaaccaccaccaaggaaataagacactgccaacaccacaggagtcccctcatatcatttcctgttcacctgccacgtctccaaaggtaactgctagcccgatctctaacgccatcagttgacttggccagtttgagtgctctacaaaaatgggatcacatattgtgtattcttttgtttctggcttgcagtgctaaatagtaggtctgtaggattcatccatgttttgcatatagctgtagtttgtttattcttgtgtagtatttcattccatagataaaatttaatggagcattgcagtgttaatagacatttgggttatttccaatttgtgtctactatgaatcctacttttatgaaaaccatcatgcatattttttggtgcctatatgcacacatttcttttggtcatctacctagaagagaaatttctgggtcatacatctaccttcagtacatattgtacatactgcaaaatcatgttccagagtggttgtgacaacttatactcccacaatcagtgtatgacagttccagttgctccgtctcttcaatgacacttggtattggtctttttgatgtaagatgtagtcatatttcattattttaagtcatagttctgtgattgctaatgaaactaagcactttatgattatttggtatttagagttcttattttgtgaaagtcctattcaaatctttttagacagaactttcagaaagttagaattagattatctgatatcacccaatgttatctaacatttgctcactttttaaaattaaaattttgctcactttttaaatcaaaattatgtctttttctatggatgtaaaggcgtaatgaatatattctggatatgagttctttatcagttatatatattgcaaatatttctttccactctatggctttgatttttacttttgagtgtgtgaaaacatacatttttaattttaatacagtccatttttctctacgatagtattgtttatatcctttcaaaaatttacataaatcaaggttatgtaaatagtgttctttctatctcctagaaaatttattttgttttccttttacattagaaactaaaatccatctgaaatttacttttgtatatgacatgaagtagagagcaaaattttattctttccaacgttgatattaaattcattcagcaccatttattggaaagattatccttcctttactctgccacagtaccaactttttcataaaccaagtgactgtatttatgtagacttatttctgggctctctgtccaatcactgcacacactgcactttcttaattagtgtacctttatagctgcagtgaatgagtcatggtatttagcaagttaagtctcctaacattgttcttctttttccagatagctttggttatttttagccctttgtattctcataatgtaagtatcaactggtcaatttccaccaaaacctactgcagagatattgattcatactgcatggaatctatgcattaattaaagaagaattggcagctttaaaatattaaatcattaagtcaccaataaataacgtggtctatttcaccatatattcagattttctttaatttctcttagtaaaaatttatagttttcttgtataaatattgtacatctttttgttaagtttattcctagtgtttgatggtatataaacaatatagtattataaaaatctcattattggtggtatgtagaaatataactatttttgtgtaattaatctggtaattattgatttgctatacctgtgtattaattataatacttgctttttgtagatcattttatgttttctaggctcctcatcatgctacctgtgaataatgatggttttatttctttcattccgattatgatgccctttttttccctgcctatttcatagtctgtaattttcagtacagtcttgaataaagatggtgagaatgggtatctttgtcttgttcttagactcataggaaagttttcaaaattccattacatgttagtgccatagttgttttttttttgttgttgttgttgataattgtcatcaaattaagaaagctctcctatatttctattttcgtaagagttttgtgtcattttatatcataaatggtgttgaatgccatcaagtcttttgcatctaaggaaataatatcttttatttagtgtacaatgtgctcaattatattattttgttttagatttgtgaaactgattttgagaaagaaggcatgtacttttatctcttttataatatttgggtcatgttttgataagaaagttatgttggcctgataaaactaattaagttcaatctgctgtgtaacacatttattgggtttataatttcagagtttattttccagttcaagaatttctgttagagataggtgtagaaattgcattctccagtgaaattcttcatcttgtcattcattttactgaacatattaattacaactattttacgttcagttttgaaaagcccaatctgtatcatatgtgacttttttctgttactatttttatttttattttgtcaattaatatgtttggtattttaaaaaaatatcagacatttcatataaataattaaatggctctggctaatgttgtctttctacagagcagtttactttactctctgacagccattagaatagaaacaaaacacatcaatccaatcacaaagtgagctaacaaaggcaaggttccccactgcaaagccacctctgggtctttcttactcctaggatctagcccttcaaagatactgactgagatccagaatatagcaagtgcctccaacacattattaaatgaatgaataagtaaatgaatgttggtaataaaggaggagggtaactctgaaaagaacgatgagaaaataaacatttccaagtgataaatatggttcaagaataaaggagaggagggatcacccatggtaaaaagtttctagcctgtgagtactcgtactactgatagcagagtcagtcactggaagcataatggaggtatttggaatgaagacagttcgagggaggaaataaggcagaatatgagtaccattttcagctagataacattgggtgatatcagataatctaactgcagacttatggtagatggctaaatatatgggatatgaatcagtgctctgaactgaaagagagaaagatgtcaagttacccccagcctgaaagttacagagtgggccaattttataagtttatatagatatgccagctgtttagaatgacatttgtggatatagcaagaggaaatttggaccaaatgaaaacaaaaattaaaacttgaaagttctgccttttgaaaagtccagctatgacttgagttcccttctaagttcaaagagactttgaatgaacaagcagaagatatttgttcattattctgagaggaaaccccttaaggggctgtcttccctgcttaccctcctggatccctcagtcccaggaccactaagcatggtaaaaggaaacattttttaaataaaagaaatcactttattgcttcctcagtactccctacataagctcttgggtatttttttaaggtcttgattagtccacattcctgatcaccttaattgttcttatatttgccttactgcacatctacatgttaatcaaatacataattcagtaccagaatatgcagtttggccacaaaactcacctatgtggcatggtaaacattgtgttgaaagttattgaaccatttaaatttatttaaattcatgatttccaattgtgggcctttatattttctgtggaaaatattctaggtagtctaatggtagcccagaaccacatttctctctttctgagagttgctagagcagggctccaagtaattgtcgtttccgctaagactccaacatgaattacagccccgtgtttcaggagccctttagtgtcctagggtttgtaatagatgtttctaattctcatgaaattattgaacaaacatcaaggaaagatgttttacaatgtaaagctaatgcagagggtcattaacattgttattatagacaatcagcatgatttagccaagacctttgacaagggtatacacctgtctgtgaataataggtctctgtttatcacccaagctattaattagactaagattaaagatggggtggggtgcatgctccaaagagtgtctaaatggccgagagcatgagctaagaggttgcagtgactctttcatagatgggatatcagctgctcctgttctgctatgggcacagacataacaagagaccttacgtcacctgaatgccctacccctaaactcaaattgcatcttctcccagaattccacataaagtgaactcttaaagcaacttgtatcatttctactattgtgacgtatccttaccagtattttgggtatttggatctcctaaatgtatgcctttctctaacatacttcaccagtgctgagttatttcttcttcattgtcaggacagaatatctattataggaataacttgagtctcaggttgaattttggtaaagtaagtgagaaattaccttgtagtatttttattttttttattcttatttttgagatggagtctcactctgttacccaggctggagtgcagagtcacaatcttggctcactgcaagctctgcctcccgggttcacgccattctcctgcctcagcctcccaagtagctgggactacaggcgcctgacaccatgcccagctatttttttttctatttttagtagagatggggttttaccatgttagccaggatggtctcgatctcctgaccttgtgatccacctgcctcggcctcccaaagtgctgggattacaggcgtgagccaccgcgcccggcccaccttgcagtatttttttttaattaaaaagtaaaataatacttctttagaagaatataaaataaaaaaatgtaccttaattaactaccacaagaacaaatcaaacaataccaaaatgtttgataaatggccaaggaaaacacacatgagctatgcattgtctttcttaattaacttgtaacccgtttacctgtcgctcaagactgctcacagctgggctttctataaagccatctatatactctggagctgggtagcaagcttccattgtcccctgctccatctcttacacatgtcattcacaggctggtaggttcagagtcggtgtccttgtccctttttcttactgcttgtacagcttctctgttctccattatggctcattatttgagtggatctttctttccatttcttggtggttgggtcattatccatatcagtcattgtaacctacactaatgcctttaaattcttactgtatgtcagatattaatacatttccaaatgctttaaatgaatcgtctaatgtaatactcacgggaatttgattccttgtttttggatgaagatatggaggctttggaggtactacactgactgtccccacaggaggttaatggcacagctgtgagggaggcacacccagtcttttctctattttcctgcttgcagagagactgtagtaaatccctcaactttgatgtgcctgtgagttttattacaatgcagattctgggatctgggatgggctgagagtctacatttttaacacactctgtggggaggatggcgtcactggtcctggatcacctctgactgcccaaggccaagagggaattctttctttcttcaggaatggggtggggggaatggagggtaggaaaatttgcctcacatcaactaaaatccgaaagtttctttctagtcctaccctattgcattttctaaatccttaaggggtaataaatttagtcttttttttttcccctctctgcctccgtctcaacagactgcccctgtggacagcatgggggagggctctgtgtgttccagagggtctagcacagcgttgcccctctgtttttcagcaaacacccctggaggatgagctgcaattgggcaagcacagaacgtttgatcttcttagaaaggctctctattgtttgcttcaaaaatgacccaaggctgccagtttccccagttgaggctttaaacatatgatgtccatttatctattttcagtcctttcaaattccttctcattcttgtgatttgggacgggggagagggcagcacctgaatggccgctcctcgccattcattatccaatagatctctattaagccaaagaatttttctgcaattgtttctttccttctctggataaagacctcctttcacccattatgtctctgatcatttcgctgcccttttctgaaacttcactttgttggctctgctttctttgaggcaaagatgatcaaagcagctctaagcatgccggcagtttttacaataaatagcattttctgggttatttttcatttccattttaatgcagctcactcaccttgctggtgctttaaactgtccccgtgcattccctatggctttatatcaaacagaaaagtcatttcagattacatcagaatacttgtccctatcccaaattcaccttaattttgtgattgaaaagattcagtaaattgtggctccgtaatggtttccttttctttttccttttcacctctctgttgttgttgttgttgagtttgttggaagcacagtgatctgctgccatagccaggagtaaatttgagtagcatcaggcatttacgaatttttcaagcttcatcaaatcgtagacatttcccttgacaaaacagtgcttctggagcttgtgacacttctcactttctgggtcttccagacggataatgaatcacctaccagttgcatctgtgtctgctttttcaactccagcttactcctactactactgcaactatttgccaggtaagagcagtttgtattaatggctaaaattcactgagcacttactatgtgccaggcatattttaagaacgttacgtgtgttaactcatttagtcctgtctatgacactttgataggttcaattattatcccattttacagataaaaaaattaaggtgcacagagcacttgactatggccatatagctagtaagtggaagaggcaggattcaacccagtcactctggttccagagcctgaacttttgaaaaccaatcaccttcttactatgcaataggcaagcattcaatgctttctatgcttttctatgccttacctaaatttcagtgatagtatgccctatttgaagaacttcatgtttctatctctcatccaaatgaaacgatatctcagtctgttacaaagaccttactaataaaggagtaagcaaaggtcagagcctccagctacaaatcattgaggcaatgccatgcttgtcacattggatattaaagggtttgcccatagtagacactgagcactttgaggacggggccatgctttcttcatctatatatcaaatctgtactagtctctgaggaaggtttaaacgcaattctttcaatggtccagggattgattcaaagccacgtagtatctgagaggagtgagtgtggaaggctgggtgtggagctcctaattgaactacttcctttattgcaagggctctggaaggtggttccacattcatcttgttttttctaaattctttttcttctccctgcactttgaacaatcctttccctgcttgtgcctgcaaattttgtagcttcctctgatcaaacgttgttgtctttagaagagagaaagggagattctggttttgatgtaactgttgactgtacagaactgaggggctgagctcattttcccccaaagttcctcttatgcctgtaattcaatacactgtcactgtaaggattcaaagacccccatttgttccatccaggaaatcaattccattgactgttttttgtgagctagcaccctcgcctcagagaggtcctcctcacactgcttttatattctgcagctcttgcgggtggcagggaagggtagaggacccaaataatgcacctcaaattcttggtgggcgtgggattcatcaagacatctcagtttccccatcatgccccaggcgtgtccctcagtgttcagagaggacaatacttaccttgcaaagctgtcggttagtgagcctgctccagtacaatgccaaacgcaatgcccaagcataataatcaattttgaaagtgttgaaatcctttcttgctgttcccttacttttctctcccatctctatttcctgttgactctatactccgagcagagagaatgaaagttgttatgctagtgtacagaaagcaaaactgaggcagagaaagactggcctttggtatgatttcataacagttcaaagcacaggcctagcacttggctcggtgacaattgatcagagctgcctttactctcagtcaaggacattcactctccattgtggggagttgagttccagaaatctaaatgcaaatataaaatcatatcaaagagtgtttaatataacatagtaacaataataatgacacttgcattcatgtagggctttcattgactgaccatgctgtacaaagtatatttgtagatcaccttcttccaaactcacatcaacagagtgctatttcattggtgcagtacaaagttaaatcagcaggaaatctttcagtgacaggtaacagaggttcattttatgttttattataacaaagatgtgctggttggtagtggcttatgtagatttagcagcttaataatgtcagggctcaaggtcagtatgtctgcaatgctagtgaccttttcatggtcataaaatggctgcagcagtgccagaaatcatgtcctgcattccagttaggaagcatggcacagagtattcttctctcagggaggaaaacccttcctatttccatcttattgcctaaaataggattaatgggctgagctatgtttcctaagatcaaaagatcccctctgactcctaaataaatatggggcaaaattctgcctgttagcaagaagaaccaggttttggggaggcaattagcagtacctgacacaaaaggacgttggcctagaagtaaaatgaacaaaagtcaggtctttttcttccatttgctaactgaggcacattgtaaaactccttatgcctctttgcgctcacctataaattagggataataatagcctattcctctcacagggatggagtgagaaaatatacatatgcagaaatgtttcgaagattgtaacatactgtggaaaagcaaattattacatctagggcatttttttcacttgggatatttaaaaagcataaaactgtctcttcctaacgtgactcataactagatagaaaacccaagctattcatatgcaaaatttggagtaatctaaggtttagctatcaactcaagacaacaatagtaaagttattaaaagcagtaaaaaggaacaataaaatataatggttaagagattcatagttacacatatccgagttgaagtcccaatttcagcacatctgagttgtgtgatcttgggcaattcacttattttctgagtcttactttcctcatctgtaaaacagaaataattcctgcctcacaatgcttttgaggtattacatcacttgaaatatatacaaaagaacacttagcacagtggctggcattggagatgaacttaataaatgttaattaacaaatagcagtcattacgtgatttactagaaatttctcctccctttaatgcttcctccatcccttctagagccaggtgttccgtgtctcagggtagtgacggccttttaacatattgaacatgtcctgaattatctcaacactcacattagttaccccaagctccagattaatcttttcccaggatggttattgacaatctactctcagtctttgcctcctgtctcttgatttgttttggatttacaaggagactctgttttcagccctgaggttgcaaatgaactcattcctctctttgcctgaatcttggccccttgttacttactgagtgaaaatggccctagctttgttttcaactggcttggaggacagcagggaataagacatgacaaaatgtcaagaggcctgtcaggagaagggagaccctcagatatgggcccctctatcctgtgtcagtccctattatacctgcatgaagatgttttagaattctgggagaaaaggaagaaggttgccaattgccttaggatttttggcataattcttttcatcttaaaacaatgttttacatgtgaaggctgttgtttgaagacttgtctgaagctggttttcttcattagaaatataaacagtcattgaattacaacaggagcacactgtaatttaaggtagaattgcaggagggctggtccatggaacaggggttttaaccctggatgggttaaaaaagaggctgcacatacccctcctctgctataaaacgggagagattttattattattattgttattttgagacagagtctcactctgtcacccaggctggagtgcggagtgcagagtgcaatggtgcgatcccggctcactgcaacctctgcctcccgggttcaagcgattctcctgcctcagccttccgagtagctgggattacaggcgcctgccaccatgccggctaatttttgtatgtttagtagaaacagggtttcaccatgtcggccaggctggccttgaactcctgacctcaggtgatctgcctgcctcagcctcccaaagtgctgggattacaggcacccaccaccatgccggctaatttttgtatttttagtagaaacagggtttcgccatgttggccaggctggtcttgaactcctgacttcaggtgatccgcccgcctcagcctcccaaagtgctgggattacaggtgtgagctaccgggcccggcctaaaacagtagagttattatgtaatgtcaatcattgtctttcttagcatcccttagctatagccactcacgcttcctaatctgagtgtattcctccctccctacctcttggctagaaacagcagtggaatggcaagctcaggcccattgggtggtggagaagaaactgcaatgatgagcttgggatagaccagcaactccagatacccaccaaatttcagcctcctctccctcttcccaacaattcctacacggtgttcaatctggagggtggatttcctggtttttacattcagagctagtgttcattttagaaccaggatctgtttatctgggctttgcacctactctttcttaccaacctcctccagcaagggctgaaacgggcttcattctttagccctgagctaggtcccattgtgagtggatgatccctgtgcccagaaagcccagttgctattgtcatcctgagcacgtgccaccagtgcctatgttgggcacacggacaggacagctgagctgccagctaccagaatcacatgaacttcttcctgtcagcctttgtcgtcctctttctacagagcccccaaaactaaaagcctgagcttgctctgtagctaatccacctgaaccatgagaaatcatatcttcgtgcatgaactttcagatacatttagagccaagctttctgtaataccctgggctaccatacctgaggaatatggccacatgcacaggtgctgggacagacataactggattcgagtcctgagtctgcacaggcagtgtcctcaggcaagtcacttccttttctgagccctcaattcctcaactgcaaatgacataacgagacccacgttcacagtgaagcaatgcatctgacacactcagactagtgcctggtacacagtaagcggcaatacaaagtactcattatattaccatgcatgattcgggaaggtaaaccttctgtttaatcctgtgatacctggctgcaatttaaaacatagttttaaacattgaaataagcagagttgcattgtgagcagagtacaacattcatataaatctttcagataaaacaggtaacttcccaaaactttctttctgctgtgcgttgctttgggctccccctctgacagcctgaggggagaagcttttttctctgctcttcaaggtatttcaaagacttcggtaataaacaataaagcttaagtcagaaagggaagaatacaggaaatacatttgcagagagaagatcaatgtgttaggtacggatggttaagaaggaggtttagattatttttggctctttttacacagacatttacccctatttccttggtcatctctgtccagcccctcctaccaaacaaatgctcctttcagggctgtagggaagatattgtgggaattgttatctggagggaagctggtttggaagctttgagagtaggaataagtttctgaaattctttggacctcagttttctcatctggcaaacgggatttctaatacttacctcacagcattgtgggattagatatacgtctctaaactaccacccacgtttcccagccctacccagaatcagagctgttaccagcctggccacagtcacctccaccatgacctgggctcctgcaacatcctcccagtcggcgtccctatttctgttctttctcaccctgcctccaataaccagagtccagccagcacatttttgaggaactgcactagcttcgtaccttttatctcttgcagccctcttttggctttgcattatgcttggaataaaatccaggctccttaccagcattcgcccaggctgcctctcctcctcatgctccaaccttctccccaggaccacacttcacttctttatgttcctgagcacattcctgtcctagaaactcagcctgccagcccctctcccagttgccctttgttctggccaccttgaggccgatccattcacatccttcgagtcccagatgaaatgccactttctgtgtaagacagaaggcaatggaaccccagcgagagacggtgagccctgaactagagcttctagctgatttccctcctcctggcctcactcttttcaaacccagcctcctcatggctcagagaaagagagctgaagcatgaacgcatcactcttcttcttaaatctcctaattcctccccgccatttggaggataatgttcaagctcgtgaatttggcccgtaagacccgccacaacgcttctgcagctccagctcccttgtgaccatctggccacagcccagtctgttttgctttcatgctaccatttctcagttcggtatcttttgttcatgttgccctgtgtacctgctgtgcccccctggcacctcctccaggaagccaagccacccggtttgcctcagatgcccctcctggtatccccatcaatctctgggcctaacctgaagctacctctctgcttagtgtcatttcttgatgtctttatgaccctagggtctcactagactcctgcttctcagcatctctgcactgcccaaggtgcacagtgcacccctggagtgttactcaatgtttgctgaatgagtgaataaataaatgaacctgtgattcaataacaatctatttcttggtgcatttgcttctttgattcattttgggcattatgaactctcttctgcttcgctaatataacctaatgtacatactcatctgactatattttggtcagctaatcgattctgtttgctactcccttgtcttttatgtggttctatgcagctgtgtgaaatgatacccatagctgtcatttattcagcacttactctgtgcctgacactgtttaaaggcttctttccatgtgttaagtcttgtaattttttaaagaaccttctcaaggaagtattattattatcatcattccctgttgtagatgataaatcataggcagagggcataatttcccccatcatgcataactggtacaaggcaataccagtctcggggcctatgcactgctgctctagggcctggcactaatcactggatggcattttccttcttctgccagaaccaacctcttctctcggtgaggcagcccggaacatcacttgtcctcattttggtgttcataggaccagtccgaggcacattttgtgttttccatgttcacatttgtcctttcaacatccttgtttttcctttttcttacctgatgctgtcatatgactcctttatgcttagggtagtggaccagaataatctggaaggcctcttaaagcacagaccatgcatcgcactccagactctctgattcaggacgtctgtaatggggcccaaggtcgggggcttctcacaagttcccaggtggtgctgctgctgctggttcgggggctgtgcactgagacctatggtccaaggccacttgcagctctgccctaccccacctccccagcacatggccttccatgttcttttctgattttcgcactcccagtctccagttttacttgttctagtgcttatggccccagggatttgctctggcccctgaacacttgatatatgtaaaagtgttgtgtatagttaggtattttgttaccccaactaagtagctgatttgcttctgtctggaagggtgggtggagggcatcctgggtggaaggaagaggtaggcgaatgggtgatactcaagctctcacctgcatgcatcacaccatgttggtaaatctttcccacctctgtgcaggtctggccttggcagggatccatggaagtaaccgacaaccctccttttcacccacagttctgcagagaagcccagccttatctatgcctcgttcttactgcacaccactcagggaatcacattaaagcaaataatgagatttgcatacagacattagacaaagaatagactccctaagcaggaaaccacacagcccgtaattgctgtaggtatctaaggtgtcaggcctctgctacccagtgaggctgcaaaccagctttttcatcataaaggaatgagctgccaatgattttcagagcttgattaatgctcttcaaaccgatctccattgggtgcagaagtgaagcccgaggaagatggatgtttcctattacttgacgtaatgactgtgaggcaagctaatgaaacctttacagcccgagtttacaggaaaaaaaccaacaaacacagatcaatacctgagttacagttccaatgcattgataaatggatgacaggctgtgggcctggccccagcataaaaaaagagagcaggaagaaaggttgggggatgttgaaagggaactggaggcagaaagaagaagaagggttaaaccacagtgtggactgatgggcccaagggcaccaagaggaggttgtaaatctgagcacgtgtgtgtcaagggaaagagaaggaccagacagccaggaggtgagaggaagtaaaaagcgggcaggctgcacagccagacttccttcactcaaggaatcgggtccacaagtgaggctgggacgcacatcctggccaggctgctctcatcatgaaatgggcagcgcttctgatattcccctgcactaattaaaacttcagccccactgcttgcattcccagttctcattatgattttcttctggtgacacaggcatccctttgtttcctgagtcctagaagcaggtccccgacgaggaacaacgatgcctggactcagcttcagcctctgttcttctaccgttcagaagccaccctccggcaaggtgaccccggctgctggatggggcaagcccaggaattctcggcttctgacacatgacgcattcatcttctccgacagtgttcccatgcacaacttgtggttcgggttggaaatgcaaagtggaaaaatgcatagcagtatcccctcctccaaggcctcagtctctgtgctcatattcactgagactagtgacccccgacttcccactcgccggcccctcctcctccccttccaacataatatgctgtttacttatttattgtgttcattttccgtctcacccaaatctattctagaaaaggt

SEQ ID NO: 376 - DNA, 109621 bp, Homo sapiens
tttttcactaagtctttagaggttttaagattcaaacactatgtaagaagaattatggtttgaactacgtaacaattacctagacatcttttggacttcagttaacctgtaagtaaaatgagcatctttaacttttccacggggctttggagaacgggttcttcctcataaacgctttcatatactcagacacgaggcgcggtagaagatcaagcgtatccatcaatttgagagcttttcacgacctcagtttacccacttagggaaacgggcgtattaacttgtttcctaggggacccgggggtgaaattaattagcgtgtttaaaatgctctgagatccaaagatgaaaggaaatgtgaaagacgcgcagagatgatgacaacaatcataacaataaaaagaatgactaacttgaagtctgcgttatgtaagggaggaaaagaagttatcagatccgcacaaacaaaagggaaacccaccgccccttttgtttctcccatttccctctcctccccgccacccgcagagctcccctctcgcagccggagcgcgcggccagccaggcgcggggctcggagttggccgccgcgcgccccgctcccgggcggagggggaggccgcgtagggccggttcctgacaaaggcgcttcctcgagccagggcgcgggatgcaggcgccgcaaactccgctccccgccgcagcgggggcgcgcaggcgggcggggagagccggctgctggccgccggggaagccgccgaggaagttgcgcgcccgccctccccgcgcccctcggcggccccgccgccatccatcccgcggcgccccgcggtcacacttaccggacaattgctggtggccgggatcccagagcggcccccgagacccgaggcgagagggtgaagtgttgtgcgcggggagcgcgagcagacagcccgccgttccgccgctgccctccgcgcccgccagccgagcccagcgaggggaagttgaccacggagccgagcgctgaggagccgcggacgcagggagaggcgttggggctgctttgtggtgcgctcccggagggctggggaccaattcgaccgcaccgcgggactagggctgctgccgctgctgctagtggaggcggcggcggcgccccccgacggtccctccgcctcacaccgcctctgggtcactgacatacactcgcaaggaggggaggggtctagccggggggcggggcctgagggaggggaccgggcagggccacagcggaaggcggtgtcgccgcaccgagaaggctcttgggaattgtagttctccggttgaagaaaaaagggattcattgttgtccagcaccctaccaggctcgctctgcactgagcatgctcgagggcgaggtttggaccgccccctcccaccgttaccatggtcaccgacacacttagcgaacgtgttcagtgctgctgttggctgaacaaggacggtcttgtattatggtgttgttggggatccaacccttagacggtccttcctacttttctccacctccaactcctagccttaccagtcataagtacccagtgaggtctgactttctctccatatttcagtcttccctgctgcgtaatttatcttccacaaaccctaaatcacaaatacctctgtccctcacttccctcaattgaatcttctccggctaaattcaattttctttacctaagacttgtcgaaatgtagttgtttccagtaattgaacaattaggttataaaacttaggaatatcaccactatcaaagtcccgtaattaattactttgctcagttagtcacatctaactttaagattagcaaaggcaaagtacagaattaagacccctatattttacttgattactataaaagaatccgggttcgttcattttaaggcctacaatttttaagacatacaaatttcataaagtatacgttcaaaagacaagttgaaaattgtttatgtgtattggccaactttagtttggtaataagagaagtctgaaccaaggtatgagtatgttgttgggctggtcagctaagtctacacccatcttgggcacccaggtgtggaaaggtggtagggaggagggtggagaaaggcaggacacattactggctctccggagagctaaaggcaacgcgtcctgagcgcttttgttttccttctccacctacctagaaccccacaccctggaagaaaaagattaatgcttaggaatcagacacacttttggagcaaggctttcagagagtctcaagatcagaaatccttatatctacagactatataattatacactcattcaaaaaatgcttgttgagtgtctacttgtgctaggcactgttttgagccccagaaatagagatacaaaaatgtaaaagaaacattcttattttcagagtgcttactatgcaaaggaggagacaggtaaatagacttaatttgagaagtactacaataggaaaatgcaaagctacccacagatgtgggcaaaatcaggaaatgcttcaaagatcacttgagataactaggaattaacatgtttgtgtattttggtaggggaggaggaagagagaggtgggtgagagcattgggggtggtgttggggagagcatcaagcacaaatacctaaaggtgtgagacccaaacgtattttggttcagcaaatagttgcattgctggcagtagaatggagttgggggagtggcaagaggagacactgaaaaaggtaagggagacagcttaggtaatgaagaatcttgcacaatatgctaaggaacatgaaccttttcctggaaacaatgggaagccacacaaggattgtaagcagatggaattttgataagataggcattttagaaagatcactctatggagtgtggtatgtatgggacctgttacagtattacaggggaaaaaaccatgagagactgaactaaggtaaggcagtggcagaagagaaaactgagggtaatcagacactattcaggggatagaatatagaacatagtgactaattgcctaggtttgggggtgaagggaaaagtaaagttatgaattatgatgcttgtggttgaaagcagcagaaaacccagctctaactggcttaaccaataaaggagatttattgaaccatctagctagaaagttcaggaaaaaggcagtctatagggatgactgattcaacaaatcagagatgtcattaaaggcactttttttccctcattttaattgctttattgttagctttattgtcaaatgacggttgccaacaacttgtgtagctttaagtttcgctatttaggtccaagaagaaataagaaaaagattcacttttggaagctcttttgtaaaggaaagaaaactcctttcccagaagcctcaatgatttagtcacatgtccctacataaaccaaaaatggctgccaggagatggcacaaggataattatcttaggatgaagacatgtgcgtacccttagagccatagaagtcagcttctaccaaagctgtgatgaggaggtgcaaatatcccagtgaaaattgagctgattactcagaaaaagaagcatggagtctgagaagtggaccacagtgtctactgcaaggaagaagccaatgatggatcccagatttttggattgtgtgtttatgagctagtgatcagttatgtacatgactcttgtgccctggagacagatttgggcagcagaagatataactggaatataccatcatataaatggctgttgaaattatggcaatggatgagatcacccatggagagtatgcacagcagaaaaaggagtcaataatagcaccttagagaacatcagcacttaaggtgtaggcaggaagatcgtgaaaatgcctgggaagtagcaagagaactaggacataacaaggaagcaggaaagtaatctacaaccaggaggagagtcagtcaacataaagccacaaatgacagagatgatagaattagcagtcaacaatgttgaaacaattacaataagtatgctcagtatgctgaaagagagaaatcaaagatataaaaaatggaatttctagaaattaaaatgacaatttctgaaataatttcactggatgggattaacactcagaggcagattaggcacagagcaaattagacactcagaagaaaagattagtgtacttgaagacatagcagtagaagctagccaaaagaaagcacacaaagaaaaaaaatgaaaaaataccccccaaaacagagtctcagtgatctatgggataataccaagtgtctaatatttgtgtaattggagttccagatgaaagatgggtcagaggggtgacagaaaaattatttgaagtaatatagctgaaaatattttcacgtttgatgaaaattataaacccacagattcaagcagctcaatgacccctaagcagagtaaacacacactcccaaaaaccactgcaaaatacgtcactattaaattgttgaaaaccaataataagaaaatattaaaagcagccagaggaaaaaggcaaattatgtatagaggaataaacacaaaatatcagcagacctttttttttttttttttttttttgaggtggagtcttgctctgtcgcccaggctgaagtgcagtggtgcgatctcggctcactgcaagctccgcctcccgggctcacgccattcttctgcctcagcctctggagtagctgggactacaggcgcccgccaccacgcccggctaattttttgtatttttagtagagacggggtttcatcgtgttagccaggatggtctcgatctcctgaccttgtgatcctcccacctcggcctcccaaagtgctgagttacagaaatgagccaccgcgcccggccaaatatcagtagacttctaatcagaaactgtgcaagtcagaagaccatgaaaaggcatttccaaagtgctgaaaaaaaaacctgcctggcatggtggctcaagcctataatcctagaattctgggaggccaaggcgggtgaatcccttgagctcaggagtttgagaccagcctggccaacatggcaaaaccccgtctctacaaaaaaaatacaaaaattagctgggcgtggtggcatacgccagtagtcccagctactccggaggttgaagtgggaggatcgcttgagcccagaaggtcgaagctgcagtgagctgtgaatgcgccactgcactgcagcctaggtgacagagcgagaccttgtctcaaaacaaacaaacaaacaccctgacacatagaatcctatagttagagaaaataatctttcaaaaatgaagtttaagacaacaaaagctgtgaggatgtcaccagcagaactgcacctcaagaaatgttaaagcaacttcttggaaacttggatttatattaaagaatgaagagtgccagaaatgataaatatatgagtaattataaaaaacttctccccctgacttaaaattttttgaaaaaagataactgactttaaaataaaaatgacaagactgtattatcaggttcataattaaagatttctgtcagcatttatatataagggacaaaattctagctgaagtcttcaaacatgtaaagtttgataacaatagctcaaaagatggaaggaagaagtggaattatatagaaaggtcttatattacacatgaagtattatactattatttgaaggtaaatcgtgatgagttaaaaatgcataagctaaaccttagagcagtcgtcaaaatgaaaaaaacagatgtggctaagaagtcaatagtggagataaaatgaaatcttaagaataaaaagcttgaatggagaagcagaaataaggaagaaatctatgtccctaatgaccatggagctgacataccagctctggactctacctcctgacttcttttaagtgagaaacaaacttgttttgtttttattttttaaaattttttatattaaaaaaatagagacagagtcttgctatattgcccaggctggtcttgaactcctgggcccaagcaatcctcctcctcagcctcccaaagtgctgggattacaggtgtgagccaccatacccagccaagaaacaaacttctatgttgtataaagacattgctgttttgtactgtgttatgtatagctgaacctaatcagactcacaagcctatagaagtttcatgaaatagagtatatttctcagaatcaggtagatccacgtgttgccagcatttcaacatagttctgaggttcctatatttgtcactaaaattccagggatacagcatctttcgtgtgggcatcatttactattagtttaattagtttttcttgaaggagaaaatacatgtaaagtgcttagcccaggcttggaatgcagcaaatgttcagtcaatatgtagtactttgaaaccaaaccacaataatgaggtagatggcccacaggttagacatatgttcgggtttgttctccaaagtcaggtgtagaaaatcatggtgacattcacttatatatcaaaatctgtagattcctttgtgaaattgtgactttacctccaccatacagttctgtacagttcttcagaatctacagtcctttgaattcagaacagttcagtcgtggaaaatgagtgcacctccaatcaccatatgctcagtctacatatctagttaaatacctacatttctttcaccagaggggctatccttttgttgcttatctgcagtttccaatttggtatattcagccatctagtcatttcagtaagaaagtgaatcctgggggactaaagttttttggatctcttaaattctaaaaagtttttgatctgtggatgttgctcagtaaacttcaagtttcctgtacaatctgactatatcaaaatcaactaaaactgtgtttctactctttcctcaaacaaacatgaaagcagtgcttgggataagaacataaggaaaaatcacaatattgatgtcatttctaaaacaacatgaaataaatataatttgctagtaaatgaggaagaggaaattagatacacgtcttttcttataacttgaagaaactgctgcaaacttatttttctcctttcactgcaaatatttcatccacttcaaatgaacatatcttcccatgtttagtccaaatttctcatggtttatactgaccctagactgcctattggactcttactgacattcttgggatttgagagtgataaagttgtgtgtgtgtgtgtgtgcatgtgtgtgtgtgtttaatattcagattttaagtaggttatctctcagaattcttacctccaatatttctcccaaaaataaaattattttctcctaatgtcctcaaagtctccaaatagctcatagtcaacatagcacatgttcctattttaaacctgtgaatggcacataatttgaaggcctgggctttcactcaaaagatttgtaggccccaaatgctggctctgacattttagatatatttagaaaatgtcaaagacaagccagttaaaatttcaatgttttaaaggagtctgcttgtacaccaaagaatgcagcctacaaattctcagtattagtgcagtcaacatatacacaagcagttattttggaattttaaataatactgtgaattgagagaattggaaaacccatgaagagaacatttagattgtgttttcatccctaaaatagatgtatttgctgatagactacttaaatttttgtatctcaaatttcatgtattctttcgtggaatacttactgagcacatactatggtgccagactatggatacaaagattaattagtcttggtcctaagctttttttttttttaacttttctcccgagatggagtcttgctctgtcacccaggctggagtgcagtggcgcgatcttgctcactgcaacctccgcctcccgggttcaagcaattctcctgcgtcagtctctggagtagctggaattacaggtgcccaccaccgcgcccagctaatttttgtatttttagtagagatggggtttcaccatgttagccagtctggtctcaaactcctgacctcgtgatctgcccgcctcagcctcccaaagtgctgggattacaggcgtgagccaccgcgccagctggtcctaagctttttgatgtttaggaaaggggaaatgcagagaagggaataatcaattttacatgagaataaagtcagaaaaacatttcaaagaggaggtggcaattgagctgaatgctaaaaaatgagtaggtgctcacaagctgaacaaagacatttcagcagagcttgtgatgttaaaaaagacatgggaagagtgaagtaacagcccatttaaagaactacaagcagttcagtatggccagatcatagggtgtgacatgggccaggtcaggaagtttctgagaccagatcatagaagtcgtatatgccatgtcatgacaaagagtttggcaatgagaaactgttgaaagattttaagcagaggagtgctataaaatcatgctagtatttgacagagtgactagctaagagaatatgcagtaatgcaggtgagagatgatggacaaaccaagtaagtgtggggaatcaaaagaagggggcagataccagtgatgtttcaagagataaaatgaatagggcttgatatattgattggatgtaagaggtgaaggaaagagaaaggaaggatcatttggaggtttctggtcatgtagctgggcattatatattatagttattcattagtatagaggaaaagcaactttttattgctttttgcagtcaatacttatttatattcatgtgtttacagtcttaccaacattttattttctgttggtttcattttagtaagtatgcagtgtctcattgtagttttatgtatttatttattttttggaaacagggtcctgctctgtgcccaggctagagcgaagaggcctcccaagctcaagcaatcctctcacttcagcctcctgagtagctgggaccacaggcttgtgctactatatacagataagattttttgattttttgtggagacagagtctctctatgttgcccagcctggtctcaaactcctgggctcaactgatacttgcacctcggcctcccaaagtgttgggattacaggcatgagccactgtgcccatccccaacactgtagttttaatttacatttccttgattgtgcatgcaactgagtaactttttataagaatgttttataaggtcatttggaaatcctgtcttcaaagaggctgtttagttttgcccatttaaaaattatatagtctttcttttttttcttattgatttacaggtgttctttatatattctagttaccagtcattcatcaaatatgtgtctgtgtatgcgtgtgtgtatatatatatatgtagactagcttttatctaagtttctcagcttgggattctcttaccacaaaggcaatggaaatttagaccctacactcaccagctatgcaactttgggtttagatttctcccaggagaatactttttctctctctagagctcagggcagacaacaaactactttggtacttgtccagtctgacagactaaacttttctggctccttttcgctgaccatgtagcttttataggactttatgtcctggaattagcagaaatcccagttgtagcccctgcactgcagatgcaagagcacatgtcttgtccctatgtgggcattaaaaccctggctaccagctgccagggcatatattcaggcttctggctttgagtctctccctaccccccactctaccatccccagcttttttttttttttttctcataacagaaatttttatttctctcaagctcagttatgtatttcattgttgttttagtggttatatttacccagtgtttctacatattcgtatcagaaaaggtggcttccattagctcagtctgccatgatgtaggaacctatttaccattcatttctgaaaattatttcagacactttgccataactacctacattactctttttctaaaagtatttcagggatacttgtaagaacacatctgactttctaaaatgctactttattcgtgtttaagtagaaaagaaacatactgttggttaggcatccccatctccagatttgtaatgtagaaactcttattacattgttagagaatcctggagatctggaacagggttgggagagagcttagggtaacaactatatttaaatttggtaaattaaaagaatataaactcataaagctcagtttaattctccctatttcatccctccagctgggtgcccacataacccaatcctttctcgttagtttcctctagttctccaagttactctagaaactaaagtagcaagttatgccctaaacgcctcagtttttgttttaaatctctttatagacctgagtacaggaatcctggattttgccaattaaactttcctatttgagttctgcctttttggagactgattcctcagaactagctttcccgaatggtactgcttttaatattttgtcacataatccccccaagcagtttcacgctttgccttaatcatcctgtgtcttctcctgctccttcagcctccacagttacctctcagggatatttcttcacaactctaccccactgcgtcaacataaaaagcacccaggctccagcctcccaacctgagtcaccccacgcccccttctagtgttaccagctcaggctcctgccctgcgtcttgtctcttctcagataaaatcagtatcatgtagtattagcataagtgcagttctatccatttggctagacttagccagcctggagtttttcagttgatgggatatttttttttttaatgcacaatttaaaaatctttttgttatagaaactttcaaaacacacagaaggagaaagaatagtctaatgaaacccgtgtacccatcatccaacttccatagtttcaattctttgtcaatcttgttttatctttacctccactggtttattttgatacaaatcccagttgccctaaaatttattttgtatatccatatgtgattctaaaaggggggatatcttattttaaaagcataagcacaataacactatcatacctaaaagtaaaaaccccaaatatttctcaatactgtcaatatccagtttttaaaaattgagatccaaataaagaatatacatgacattggttgatgtatctcttatctctctctttttttaaaaaatctttgcattatggaaagtttcaaacatatacaaagcaaacagaataatgtatgtactctatatctagcttcaacaatgatcaattgtctatcactcttacatcatctataccttcacccactccccaactcaattgttatttttaacagctttttttgaagtaacgtgtattagttgtacaactttgacaaatggatatactaatgtaacccacaatgctatcatgaacacaggacattttcatctctccagaagattgtctcgtgtctcttactctttcagaggcaatcagtgttttgattttgtttaaccttagattagtgactgttccacaactttatactcttttacatccagctgcttctcactataatatctgtgagatttattcatgttgttggattagtttgtttcttttcattgctataactactacaatatatttattctgttgagcttatttaacacatgtattttctctataaggcacatcgcagtctttttgtgattagggaccctaggcagcactttatcactacgctcgagagtcattttaaacagtgaaatcaccaacaaaaagcaaaaaacatggcactaaatagactgcaaaaaagatgtttatttacagtatgagagctgaaacaagtgggtagagagcacgacctcatctgagaacatatgcatcaggtgactcaatttttggccactctgtgagtgtccatgaatgaccacaacagtattgattttgaggttatgaataccttttagcgatcaggcaaattcacgaatactgaattcattaatgatgagtagcaactgtacatatgtgtatcagcatatgtacagatggtccctgacttatgatggcttaacacatgattttttaacgttatggtggtgtgaaagctatacacattcagtagagaccatactttgaatttaatatcaacaagtgtctctgccccagtgccttctaccaatgattctccagcctcatcagaagagagacaaattgatgaccctgttgatgtagcatcctcatcatccagcaattaattttagttcaatacttcaaacattcttgaggcccagtgtactttcagctgtgtgtgttaatggtgagtactcatacaaccattctgttttttactttcagtatagtattcaataaatcacatgagatagtcaacactttattacaaaacaggctttgtgttagatgattttgccccactgtaggctaatgtaagtgttctgggcacaattaaggtaggctaggctaagctatgatatttagtacgttaggtgtattaaatgcatttttgacttgcattttcaaattacaatgggtttatcagaacataaccccactgtaagtcaagaagcatctgcacatatgtatagatatgaaacaaggttatcatctatttctattgccttgaaatttgggaactaaaaagaagaataagcttcctaccttcagtaaacttgatgggactatattccagaagacttgggcttgatggggtatcctaccccaaaatatgtgtggatgtaagggtaaccataactcactgtgagaggagaaaatgtaaataaattgggttttagatatgctaacatttttactaacaaagattcctgccaaagtgagaaaaaaatatatagaggtaggaatgacatgtgttctagaaagagaaatataaaagtgtttaactaaaaacctgatttgaaaaaaagaggagactgatagttgtatactcaataaagataaaggatgcagttctaaggtatttcaatgaatggaaaatgagagacttgcctaatacagatgtcaggtgactgcaagaatcagttttacctgggagctgagaggtagagatggggcacaaacagaaatgacgttgcctcaccaatgaaagggaaaatagtcctgacctggaattgaaggtatatgcatgggaaggcctagtaagaacagactaagtgattccagaatatgggtaaaggaaattgtctcaacctggttgtgtaccttagagaacaatttattaaggatctgaagaattaatttatcaacatcaaatttgtattaaaaaaacgaattatctgtgacttacatttgaaaatagattttatgccccccaagatctttataaattgtagtcatatatttttgctctgtatttgacttactaagcaagagctggactgaagaacattatcagggatactacaagaaatgcataagatgaagatcatattctccaaatactagcatcacaattaccttttccaacctctaacctctactactattctctttgacgatgacaacagaaaataagtcacctgacttttgttccactctcacccttaaaatttccctctagctcagatacccaacctaagatacttcttggagtcaagtcatagagctatcctaccactatcttgggatccttgaccacaatacttacatctctatgctgacagaatccagtctccttcccaacctcaaaccataattcctataaagctctcctatcatccccactcctaagatgttcttacattgagaacttataacagcatgccttaagccatagcctgggtctcaattctttgtttattggatattttgcttgcactcaccagttttatctggatataagaatttcaaagactatacgaagacggtttaaaaagtcccttcatatggagggagaaaaggtgttgaaaagcccacgagtatgtatttttaaagaaaacaacttggctaatcagattatcatcactatgatatatacctacattttagtttctcactgaccagacttaatatttaggaaatttgtgagaagtgattttttttctcttagaagactagacatccaagaaagccccatcattcagaagtagttttactgattgataagaataaaacagaattcagtgaaaaacttgttttgttcataaaagttgtaggattgatataaaataagaaactaagccctttcataaattcaggttcagcttgaagttttgtttattcaatttctaaatttaattcttctattacaatcatatattaccacttgtgacattattttactatcttgagcaatttgttgctatttatttctcaaccataactatttaccctcatcttttactctccatttccaaattcctatagattattcaactggagtatcagcctgggctaggggttgcagaccattgttagttgatacttaataataaaatcagaacatgtcaaattactctgaagacaggtccccatgtacagctttgagaggtaacaaagggccagattagtgactgtgtgtaatgttaagatttgggaatggtgtttagctggcagtcattattgcatctcacctttccccttggaaaagtgtctgctatgttgcaatcactgagcaaatgccaaatgccttctgggaaagtctgatactgccaagaattccctcacccccaagctgtcttccattgtgtgggaaagttttagaatttctagtctctagcatgctacacctaaatcctggccaaccaaccctaacaaatgtgtaattcaagcagtcccttagattgcttgggtaaccaaaaatgtccagggaacagaagagaatgacagcatagatacatatgcttatgtatgacttttgacacaacagagagaaaaaattgccattagaatgctactaatgttggaatcaatggtcatattatgtcttgataaataagcataaaaaggaaccatagaaaccttgttctataggtatagagcagtgaaactgatacaaaataagaaaataagcccttttgtaatttgagattcagttaaaacatttgtttattcaattgctagatttcattgttcaattagaaccatgaatatgtaacgtttatgagataattttgctatcctaaaaaagttgttgctattcactactcaacaatagctatttaccctcatcttttactctccatttccaaattccaacagattattcagctagaggattagactgggctagtagttgaagataaataggtgataattgacacaaggaaatggaatacataatataaatatttgatgttttagtagattatgaaatgagttaggtgttaagatttataaatatcacggctttactgataacatggtgaactatggacttggctattgatacggttggctatccgtgaataaaaggcaaacatttgtacatggaaacacaggcaaactggttggcttagcataaaactgcaaatctatctttacaagtggaacagaaaaaaatggagttcaatcatatagtaagaaaaaaagaaaaagagccaggcatggtggctcacgcctgtaatcccagcactttgggaggccaaggtaggaggattgtttgagcctaggagttccagatcagcctgggcaatgtggtgagactctgcctctaaaaaaaaagaaaaacaattaactgggtgtggtggcacatgcctgtagtcctagctagttgggaggctgaggtgaggggattgctggagcctgggaggtcaaggctacagtaagccatgatcatgccactgcactcccacttgggcagcagagggaaactgtctcaaaacaaaacagaacaaaaaggaaaagaaagaaaaaaaggctatctcgcagttctatgtggtaaaaatcccaattaccttgagatctttatccagcaatcaaaataggactcactaacccagaagtcaaagtaaaacctctgagctgctttaaaaaaaaaaaaaaagaaaaggtttaaaaagctatatactgaagctcagaaacttgattaatagaaaaatttattatgttttaaactcattgaaagaaacctgattatttcattcctcgggccatagaagattagaaacaacaaaaattttccattcattacagattctaacatctattgtgtgttaactatgtgtgagggataattccacaagcaactgattttatcctctgaggtaagtattatgactcccctcattttacaaatgagaaaactgaggtggagagaggttgattaatttagccaagatcacacagtagaaagtagtagcgtcaggattcaaacacaagttttctactggtgtccacactttcaggtactactggcaaacagcagggtctatggacacagcaacgaacagagcatcagaggttcctgttttcacggttgagaagcaacagggaacagtaagagaaccatggccgggtgcggtggctcacgcctgtaatcacagcactttgggaggccaaggcaggtggatcaagaggtcaggagttcgagaccagcctggccagcatggtgatgcctgtagtcccagctactcaggaggctgaggcaggagaattgcttgaacctgttaggcagtgagccgagatcgcaccactgcattccagcctgggcgacagagtgagacaccgactcaaaaaaaaaaaaaaaaaaaaagacagagagagccgtgaactggcaggagcaagaactgtgaagagcagaacaacagggatgggagctgaagactggggagcactggactctttacagttattacctcatttactctttacaaccattctgcaagttaccatcatcattgtttagatgaagaaattaaggctttaaaaagtcaaatacatttccccaaattgcacaattagtaaacagtggacctggagtttgaatccaggtctgtctgacaccaaagcttaatttttctcactatacctcactgctgtaacaaaaaactacaaacacaggcgcttaaaaaacatttcagtctgggccactctgtgtagaaggaaacagtactgaacatactatgctagtcattgagggctttgttgaatgcataaatggttgaatataaaaatggcactataatgaatgtgtaaaattaagactctaataattgagaaacaactgcattctgttggttagtctccgtttaagaaaacagggtaatgtatggtatatttttaaagtctaaaaatagatatggttaaaataaaactaatctgtggatttaaaggaatgagtttcaagtacttagaaaattcttctatgtggaatatctattttctaatgataccagataaagttttcaatacagagaaacagtagaaatagacatattaaataaaggtttatgctattttgtgttaacctttatttaatacaataaataaagggtccaataaaaataaaggccaaataacctttatttaataaaataaataagggcccaataaaaaatagtccctccttgtttcatgttttcctagaaaaaataaaaaataaaacaacagtagtcccagccctttaataacaacttagattatgtgttaatgatgattcatacagtatttttaaatgtttttacaaattataagaaattataatttatcaggaattcaaactattagaaaggtaaaataattggattttcccctgcagtatactttggtgagaaagaaaggacatgagatgttcttcagaaaacctccaaactttaaattcaggtattcagccaagtaaacaaatcatttacttaaaagaacaatgtatattttacatctttaatgcatgtttaactccatttcctacactttccccatctatattactgtattgatgattggtcccgtaatgataatcatgatatacattctgttctctaagctacaaaagaacaaaaagataaactacattcactgcaattgaagaagaatatatttgatttctatatatatatatatatatatatatattttttttttttttttttttttttttttttgagatggagtctcactctgtcaccaggctagagtgcagtggtgccatctcggctcactgcaacttccgactccctggttcaagcgattctcctgcctcagcctcccgagtagctggcatacaggtacgcgccaccacacctggctaatttttgtatttttagtacagatggggtttcaccatgttggccaggatggtctcgatctcctgaccttgtaatctgcccgcctcggcctcctaaagtgctgggattaccagtgtgagccactgagctcagccttgttttccatatttaaaaattagtcaattattgcttatctggtagctttcagataactcaaatattaattattaattctttagattttttttgttttttgagttggagtctcactctgtcacccaggctggagtgcagtggtgtgatcttggctcactgcaacctctgcctcccgggttcaagtgattctcctgctggcctcccaagtagctgtgattacaggcacgtgccaccacgcctggctaattttttatatttttagtggagacgggatttcaccgtgttagccaggatggtctcgatctcctgaccttgtgatccacccatctcggcctcccatagtgctgggattaaaaatttttgtgaaaaaatttttggaaagttttcctagaaatataagaaaaccatgttttcattgattgcacagttacttgtactgacttccattgactttaaagtcctatgtcctgcttaggagtttgacatatttttaatgaaaaaaattttttttttctttttgagacggggtctcattctgtcacccaggctggagtgcagtggcctgatatcggctcactgcaacctccgcctctgtggttcaagcaatctctcacctcagcctctccagtagctggggatacaggcgggagccatcatgcctggctaatttttatatttttagtagagatggggtttcaccacattggccaggctggtcccgaactcctgacctcaggtgatccgcctgcctcagcatcccaaagtgttgggattacaggtatgagccactgtgcatggccaaaaaattttaacgatttaaaaatagtaagaatttttcaattggttaatgatcatagacaacattcaagcaaaataccatttgatactgaatagttctaacattttaattgtattgcaagaaaactttgtgttggagataattacttaatttagatccgaatatatgtgcactggaaagtggcactttatgttgattacaaaaatgtaattaggcaataggcttagttttgaccaagcctatttgctaattgtgggaagtttttttaaaaaaatcaaagaagtgagtgtagtttaaagtacaagagaaagaaaaacattatttccttcctaggcacttttctggtggatggatggaggctatatagctacaactactttttccagatttttcaagacagttcaaattttaatattacattttgagaccatattaaaccattcactctcatttttgtttcaaaatgtttggacaccatgggggataacagtctgacaattttaggaaaatcttacttttactttgattccaaatgtaatatcagagagtttccaaaggtggattccaaaaaatttagaatatttaagtaacaaagagtaattgactttggataggccttctcattggcctcagaaattttatgagatatggtctgggtttataaaaccatagagagacctatttttgaagcttcattgtgccagaactactttgaaagttctttcttccaacttaaggcttcatatagcacatatatactgattaatatgtaagttagaaaaagtttatcatctattactaggacagtatttcaacaatgtagaatatatttctccttttaaaaaacatttattataattattttttccttccttccttccttccttccttacttctctctctctttctttctttctttttggagacagtctcgttctgtcacccggtctggagtgcggtggtgcaatctcggctcactgcaacctccgcctcccgggttcaagctattctccagcctcagcctcctgagtagctgggattacaggcatgcgccaccgcatccagctaatttttgtatttttagtagagatggggtttcaccatgttggccaggttgatcttgaacttctgacctcaggtgattcacgcaccttggcctcccaaagtgctgagattacaggcgtgagtcaccgcacccagcctataattatattttctaagaaattatttaggccaggcatggtggctcacacctgtaaccccagcattttgggaggctgaggcaggcagattgcttgagcctaggaattcaagaccagcctgggcaacttggcaaaacccaatctctacaataagtaaataaataaataaaacaaaagtgagctgggtgtagtggcatgtgcttgtagtaccagctacttgggaggctacagtgggaggattgcttgagcccaggaggtgaaggatggagtgagttgatatcatgccactgcacattagcctgggtgacagaatgaggccctgtctcaaaaaaaaaaaaaaaagaaaagaaaaagaaagtaattatttaaatattgaatcggtatgacaggccttgtcaaagcaacaattaagtaattggcctagaatagtactttgcacaccttgatgaagctcagatagtagactcattaaaagaacataatgttttgttttctactcctttaaagaaaaggaagcattttagcagtaatggtgtaaatacaggacatccctatttcttgcttattaaagaaaatgctgaaaggagaccttatcttcgcttgcttgacatcctcttagcaaagaccagtcttttaatttcctttctttttttcttacaacttttaattggttcatatgttttagacctcagaggacaatgccagctttcatttttaatgtggtatatccttaataccctaatgcctattcttttggtacaatataggtggtggctcctaaaacatacttgcttttgtgtaatacttgggttacatatattttgtggtggttgtaacatacttcttatatataaaatcaggatttttaaatttacctattttttgggattaatgtatatagttgcacagattatgtgtatattagtatcattattatggactcatattatgactctgaaggtttcttttaatgatgagatcatacatgtatctgaaacaggattctaaaggttgctggagaaagcccaacactcaattcatgtaagggctctaaaattgagagcatttctgcttgtatctgatttcctggtcttgtatctttatataactaagaaattatgcaaattcatttaaccataaccaacagccaaatcttccacaggcactttgagtgtatgtgcatgttcatgagtagatatgttaaggattcctatatttgtaattcctaaacttttatgtctagacagaagaaaatacagtacagtatttgagcattatttttcatatgtgtgatgataatttgcagggaccatttagacagacctaaaatacgtgaattagatgtggtgcttctaaagaaactccttcccacttttctcactctggaaaaaataatttactcttttatttaaatattttttttctttgacttaaaggattccatgatttgtatatatttttcttgtaagtattttaaataatataccataaaaataacacgcagtaaattcaaatttaattcgaaaaatatttaattaagaatgctacgttttggctgggcgcagtggctcacgcctgtaatcccagcactttgggaggctgaggagggtgggtcgtgaggtcaggagatccacaccatcctggccaacatggagaaaccccatctacgctaaaaatacaaaaattagctgggtgtggtggcaggcacctgtagtcccagctactccggaagctgaggcaggagaatagcttgaacccgggaggcagaggttgcagtgagcggagatcgcgccactgcactccagcctgggcaacagagtaagactccattaaaaaaaaaaatgccacgtttacacagcattcttctcttgaaatttgatagtgagcttcaaaattcataaattcttttttccttttcttgaataaaacatcatctaacatgtaattggaaaataaaaacttacatattgcgatggaaacaatgataatattgttcattgtattcattgtacatgaggcactacattatgtgattgatcaattttatctttaaatgacttgtgtgggtgacttatcagggtttaaaacagtcacaatgaacgggatattgtttttaaacttaaagagagcattagtggtttcctaaatatttccaacctaagttcatctaggcagagcaagaccttttgccattgtttatgatcatgcttccattatgtcatcctacctccctcagtgttcactagaaagggattcagaggcagctctcaaggccctgtttcaacatcattttgtcttgctcagcccacagtactgcatctctctttgctgtacatttaatatctccctctccactggctgtctcccaaaaatgcaccccttgactctatccccttctctagctattagtctgtttctccttctcttcccattcaagtttcttgagagggggctacattcagtccttccattttcttatctctctttcatttgtttagtatctttcttttattgtactaaaatatacataaaactttccattgtaaccatttttaaatgtacagttctgtggcattaagtacattcacactgctctgcaacaatcaccacaatccatttccagaactttttcatcttcccaaatggaaaccctctactcattaaacaataactttctattccgcctctgcccagcctctggcaaccaccattctactttctgtctgtatgagtttgagaagtttcagtgcctcttaaaagtggaatcatgcagtttgtccttttgtgactggattgtttcacttagcagaatgtcttcaaagttcgtctatgttttctttattctctttattatgacctgtcttctccatgtcattgaaacattccttgccaaggtcacttgtgaccctctacttcctcaatattctggaaaattgtcttcctttttcttttagtggcatttaactgcacttagtactttttgatactctctcttctcacttctaattttcctccttttgattttctacctacatttctagcacttttttgtacatttctagtacttttttgtggactcctctccaacttaaacattgtttttctcctgtgtctctgtacactcaaaagtatatgttcctccaatgatctcatccattcctgtggcttccacctaccacttatgtattgactctgactttttatccaactcttatttctctccttagcttcaggaaagggttgctggagatctttacatgaagtttccacagacaaggtgttcaaaactgaaattaccgtctttccctccagatttgtatcaacaaatggctggaaccaacctgagtcactcttaagtctaagttttcctacccataacatgcagttgatttcttaagttttctcagttttacccacttaatatccctggaatctgtccttttctatccatccattctcaccattactgctacttgtcagctcaagtattattctttttttccgggattactgtcacagcctcctaatgagtctgcttctcttctttcagttttatccccatcgaacataatccccacttgctgccagaatgatctttctacaaaacaaatccaattatgtctctttctgaatagtttttgaatgccttccctttgccgtcaggaaaaaatccaaacctcttagcagaacatgccatggttctgcaggacctggcctctgctcacctcttcaacctcagcacttgctactttcctttatgcattacgtgcttccacaggtgtgataaacctccctggacacagtctcttcagacccaccatgtttttgtatgtggcattctcctgaacaactcctgctagtcctttaggactcagctccaaggccatcttctccaggaaatcttccttggagatgggtgtagtggatgctatggtatgctgcttgcatttctctatgtccttgggactgaagcacagatttcactaactgctgggaatgttggtaacggatagatcttggcaacattttgttctagagattgcccttggttgaagagagcttaagatcacgcattccttcctagagccagcccaggaatgactacaattattaattgattcagaagtttatacttttataagcctggtcccattgcttcagtggggacaactctgtaggccatcctaactccataattctcccatagaaaggctgaggactttgtggcaaccacatcataatcccacttcgccttttgcccagttcagctgttttcacttcaccctataggtgctaattctgaaagcaagcctcctgcacacaaatatccctctgagtctgtttcccagggaactgaagagcagcactgggccaggacccttaataccatttgcctactcctatcacagctcttacttgtccccccgctgccaacccatatcataattgtctgtttacttatgggtctatgcctaaatatagtgaggaaactagagaacagggatttcaatcttgtctttttatccttatttcctttttaccctgactcattaaatctgtttgaataaatgaaagcataaatgaatgcaagagagatttccatcttcaaaagctttgggggctttcctaaaatcagctcagcccttcctgaacattatttctttttggaatagccccagaaaatctgggtcatctctcctagggtgtattttaggtttgctgcttttcatgcttcatgaaattatgagaagcatggatttggaggtctggatttagaaacctgggttgaattcttggagcaccatgtactagttgtgtgattttggccaaatcatataacttcttcatgtctcagtttaattaactgaaaaacagcactatctagcccacagatactgcctggtggcaaataaatgagataatatctgtgtaaagtgatggcacatagtagatagtcagtaaattttagcttccttcctctttttcttctttttagattgaatttacccatctataataacttgcaaagaaataaattatagtagtttggtcctgctgagatgatctcaatagctctcataatctttttttcccccacatggcagaaatccatcattctctgttactattctgattttagaaggaaaaaaaaaacacagctgaaatcatctactcaacaatgcaagtcccttcttgctataaattttatttatcatgaggcatcaaatttgctagtggcaagaggtatgtgtctaggtgtgtctcagagtgaatcaaaggcgagtaaatcacatgaatgtaatactacctgatgggtttcactgatgtgtaggaggagctaaaatgattaacataaggtcacaatgaagggttaaagggatggtagcaagttatcccactgattcagccatatatccagttttcttcttctcagtacttggaaaaatcacatttcttagttcccttgcaattgggtgaaccacatgatgagctccagccaattggctgggagtagaagtaatatatcacatgtagaaagaagtatttaagagccagtgatcagttcccagctagaaacagtctgtgatattgaaggatgtaaaccctagacactgtcccagacctggggcagatttttctgcaaaaataaaataaccttttgttgtgttaaactctgaaatattcatgttacttattaccatcacaaaattaggcacttctaactgatgcattgggttcagaagaactcaggaaaatctaaataaataatatatctcaggaaaaacaggaaacacagccagctgtctcagaaaatagaactggaaggttatttaggatcattgttgatttactgctccaccactaaagtaacttagcttctccctttagatctgcttctttctgtgtctacttctgcttccacttccaattgccagttgtctttttctgcatcgttgtattttacatatcttgcagacagatacaacccagtaagtacaatttggatactgaatcagaaatttctcttgaaccagactacttcgtaggctactggggaaccgaaaatgctctttcagttaccttcccctggtccaattagcaacaaccatggagttgggtcctgaaatacaaaacatggccatgtatccttgaggaaaccttggggcctcttcctcctaacaggagctgtgagttggagtcctgttagacaggagctgtcaatatggtaggcaccatattggcctgttcagtaaactgggatacagacttttcaggtcagcgacagagaggctattattctgtcactgtaactgctgggcctagaactggttatacaaatgtcttggtattgacctggaaattggctagtggcttctgggtcgggacaaaatttttgttgaactgagaagtcttcctagatgagacaggaactgggcccaatgacccagggtcaaatgcagatttcttgccttttggatacttcttggtcatgacctaaatagtcaactttgagaatgtttttggttgataatatgcacaaaaggcaatagttttttcttaggacaatgtaataatcagtgacttaacattgttttgatgttaaaatataatttatggactatttcactttaccttgggcatttggttaactcataaatgtgaaattagagcttccctttgttcttaatgtcaccatcctagtggctattgtctctttatgaatactttttaaaatttaagttagtctgtgtttggcgtatatttatttatttaccttcttaaaatgcttactaccattttaaactccactcctcaacccaatcctttctcatttaaccttcttttaaggcaccttttatattttccaaagtactgcattgtcctctcaaatggcttcagtgccccaattgatctgcatctaactctcaatcaaagccgttgctgcctctgaagtgatctccattaggtggtttacagggaataagccaattaaatgactatatactaagctacaggttttggtagttatccaaaaaaaaaaaaaaaaaaaaccagttttttttttttgtaaatcagagatatcttcctaacagtctttaagttattacaggtcattcctgatttcttttaacgtacaaacagaatggtggtctccaacactaactcttggttagagataatggtatagaatagggatggtggacttactatgttttgggaaaccatgaccatatttcatataatttaagagactattatttataaaactcatctctattgcagggctgctaagctgtgaaaaagatgtgctaaaaattctactgaaatatgatacagttatacaccacataacaatattttggtcaacaacaggctgcatatatgcggtggtcccataagattataatatcatatttttactgtatcatttctatgtttagatacacaaatacttaccatggtgttacaattgcctacagtattcagtaggctgtagcatgctgtacaggtttgtagcccaggagcaacaggttatcccatatggcctaggtgcatagtaagctataccatctagttttgtgtaagcacactctatgacgttcacacaatgaaaaaattgtctgacgatgcatttctcagaaggtattcaggttgttaaacaacgtatgactgtacatgggttgatgcactatggggacggagcagtgagggagtagaatgagggctgagctttcactgagaccaggtttgacttccaaccctgcccttaattagctgtgtaaccttgggcaaagcatttaacctctctgagcccaagcgatttcatccgaaaagtggagataataatagctatgagcttattagatgttttgcataagatatcgtacatgaaaagctcttgacacacagcaggtgctcagtgggtgttagctgaatttgaatctacctccttttaagtatccttttacacttcaggaaagagactcctgtcctattaaggagattgacagaggactgtaaagaactctggttgggagagaaaagatcttagccttgactgcctaatctcctttatactattattgccttgataatagtttgcttgttattccttcttcccttcactaaatcattaaattttgagttcctacgttttgtcaggtattagggataaaaagatgaataagatacatggtatccatggatcacagagtcaagtagggaaagaaaaagtgtaagcgaataagtaagaagtgttaactattactctgaaaaaatttgcaaaccttttcattaaataaacaattttttaaaggtagattccttatagcatctatgatttgtaaaatgttgtagaaacatggacgatttaaagcaaaccctatcacaaagcaaattgccttcaacttttccctctcgttagagttaattttgactttggcatgaggacacattttgtttttcttctgctcacacagtgcatctactaccttctctgtcaggcaagtatggaaagtaaattgtcaggcaagaaacagtaagcacacatctaaaatctgaagcaaaattggtaggcataattttagctctacctgcatatggaataatgtatctatagaactcttagtttttctggtgaggcagcatggtacagtggggaaaatacaggctgaggaatcagaatataatctaaattttggctttactagttttgtgggcaaatcacttaacctcactgaccctcagtttcctcatttgtaaaaacgagtgataatacaagattatagtaacaattataatatgtctatacataataggcctttaataaatattattattcaaaccctagaacacaaaagaaaataatttatcaacccttaggtaattgtacaaaatactcaaatgcctcaatataaattaagtgtatattaggggcagaatttgacctgatcattttaagcagaaactaaaatagtcttaacttgggatgcctactgggacaaagtcattacaagctataaatgtctagctagagtagtaaaccctgaaaaccaggatgggcacaggttggagcttcatggaatgtggaatgcccaaacctgatccataacacaaaatcggagtctgcagtcttctggggctaaatattgggccaaaatagaatgtctgagtaaaggtatatagtagttttgtctttagtattcaatgtcgaacccttttctcaattggtagctataggacccactttccatcactaaagtgcaaggccagtgactcagtttccatattcttgtcaataagggcatgccatgtgatctagaccactaataactctagactggagaagcaaggtctagaaataactcattttggcagaagtgacagtggcagcagcatccaatgtctagtgacaacagcgtctatggggcttccagggtcatttctatgtcttgtggaggtaggggagaggttgtcagtgatagcagtccagtgtaccctgaccagacatgtagattcgtctgttctgatctcttaatctctcttggttctggctcatttcttgcagctggttcttcaggcttctcatcaattctaggagctacttattagtctgccaatagattccttatctgcttaagacaaagtccatttcagttgtctgcatacaagaatcttgattactatagggcaaatggaagaatcacagtgtggggcaaatctgaggtcaaagctgtcagagacttgaggaggaggtaaaggagaggacctcagtaaatatgttgatggtccagacgaaaatgtgtagataatatccattcgtgattgaggccttgccttgacaaaccacttcttgtcttgaagacacactcttcaactcagcttctcacagaaaccaaaacctcagctcatggcagaaggctggaaccagagtgagaaggctggttgcaacaaagggtaaaatgcttccttaggggataatctaaggcagctaaaatacccagacccattgctatggtaatccacccacataataattacaggttatttgcatatctggattccttttcatagccaggggatggtgtgaagtcagtgctaaagaagcaacaagtggctgtcatgtgtcatctctgccccaagtggttctgaaattggtttgaagcttgaggagccttcattctttttgggataaaggataagaatcctaacagaactcacccccagtcatcactagtcagagagagccttctggcagagtagggtagtgaaaggcctgggctccagcagcagtaacctgagtcatgtccgaggcgacagagaagaaaataaaccaggaggccagaatctgggaggactgagaaccagtaggaaaaggagggtgggaaggtgtttatgaagtaagacaaaggctgagggtattagcactccatgggcacagttacatgtggtgatggctgagggagtggacttgagggtgattctccaggcccagccccagatgtctcagggaactaacagtgcctcttctgattcacagtgataataaataattaacaattatttgttataatttatataatataatgatatatgttacatatatcatattataaaaatatatttatatattataaaaatagtcatagataatagtatatattactattatagttacagataatagtatatattatctataactatatatttagttatatgtgttgcatatataataatcataatttgtcactatattatttataataaaaattttaaaaatccaatttttgccttctgataccattctgagcctggaatagcctcttaaggggcaaaactcactgccatttagtgaagtaaatttagatgagagtcttttaaaataactgtcttttgaataatatattgagccaggcctgccctacccaaccccatcttgggaaagcaagaaggtaacccattgtaagagcaagtttggtgtccccttctccctctatagcttgatcccttggtcagggactgtggcatcttggagcttcaaggagagataagtccttaaggagagaaggggcattttgggacaagattgtcacatcttctatcactgtcctctcataaaacctgctctagcacactcttgccaaaagcaaactgaccagtgcttaaaatgcaagtcaggagcagtgcatgagcagtcatgcaggatgacagtgggtgagatggtttgtccttaaatcaggcataatgtcctcttgcctccatgcacatcaggacatctgaggagcacttcctgtaccctgggcaggatattttaaaaattagctgcctcagagtagaaaataaaactcaacaagattttatcttgtttttaatttctatgtctccctggcagctgtaatattatacttagtaaatatctaggttaaaccaaatagtcacatgggaaaatgatatttcacacctctattttggaattatgtgcaaaatttgccacatctgtgttgttgaataatacagagttaaattgataactaccccagttgaacatgatgatctataattaagttattagccattgttctgttgcataaaaatatttgatttttcaactcaggggtaaaatctatagtaacgatcgctgctttgcaagttgttatttatcactggcttatgtaagtttgtaaaaaacagattaaaaatggccaaaaaaaagagtgaatacttagagaaattattaggtcttctgttaaaaaaagaaaacaaacttttatgaaaatttagatttagttcctaatagaagagtaaaaccaaaagggaacttgcttcctcaacacccgagtgctagaactctgcagtcctgtggcatatgttagctgtgcttgaaattccccgctttgtgctaaagcattggcagagcaagtagagctgacattgcactatcctacctctctttattttttattcctcttcgcttttctcccactccccattgcttatcatctagtcctccctcctgccttctctatcctccttttcttttttttctgcttctttcctctttctctatagtcttcatgctttctctcttttctttcttccttatctccttcttcttcccctctccttcagacaatgctgccttgtggttatgaagagcatgggttctggaagctaattaaggcttctaatgttggttctgccattcagactgagtgatcttggggtaagctacttcatcttaaacatgtgtatcaatcagggttcaaccagaaaaacagagccgctactatgggaggcactggggaggagagggtctgaagggggagctagaagatcagaggggccacccatcagttcacctgagaaggcagacacgcccagctgctgaaataggattgtgaatagggagctggtggagaaatctatggggggctgttgccacagaagggtcacattcaagtataaggtggcactgcaattaatcattgatgccagaggcctcccaaaatggcaggacgtggagtagaggagagcagacagctggagcccactggcacctttatgtctgtccactgctgtatcgaaagatgacaatcttcagagagtaatggctgctgctttacttctgtcttccaaatctcctgcaaattctacttttggcaaaatcaacaccagaatcatactggggagaggattctggagaaccttctggagaaggtctagcttagctgattgaaggagtaaatatcaccacgtgaatcgtttttaaaaatgtagttattcagagttcatagctcatggggatgttgtgaaaagtaaatgagatttaatacatgcaaagaaagcactattcacagtctgacacatagtaagcacccaataaatgttgtcatttatgctttgctttcaatccatttcctctcatgatactcttctacttaagcactattaccaaatttatcagtgtcattgccatggtatgtatcatcaatgttcaggataattagtgaatgattgtgggatgtgtaacaataaaatagatatttattgagtacttagtaggtaacatacaatgtacttttacatgctttagcacacatgatacttatagcaatcttgtgaccatcatcattcacattaaaacatgaggaaattgaagtagagagattatttacttgcccccaaattacacaggattaaacacagtgccagtttactctggagtaatgtaaacccaaccatttcaaataatctgtttctgttaacaggaatacctcctgtaggaagattatcttcagaaatacagcaccttcaaaacttacaacagatcttagagttcctttttggttgttatagtttcacacaaaatctgggcaaattataaatctgccctctatggtttgcaatgagaccagtggtgggaaagaacttggtatgaggcagtgtttaacaaagtagccttgctcaagccaacaaaacgtagaagtagttgggaagagagatggagaaaagttgaagaaaggttaaagttggctcataattagatacagttttacaacataaaacatgaaaaacttgctctaaatagactcctaggcccttttaaagcatggcctgtgacttttactggaaaaaaaagttccttaaattattacagccagtagttctcttaccctagccctaagctcgagttgtctcctaaagcagaaactccaaattggcagctctacagattgcatggaatgggcttgtgcaatcttttaaaacttaaaaaaaaaaaaaaaagcctatctaaatgttttcagatggggcttatcacagtttctaatcatctctccttatctgtctcccagccttccttcacttattgatgctacatgcctcaatctagaaggcatgtgagcttccagctcctgcagagtcatgatttctaggacagatttcaaagggattggctggtcctgaatttccacatggaaatcaacagagacaaggggcatgaaccttcccaattcaattttctactcatctgaccccttccctcccagctcattcctgaaagttctttatggataaacttgttgtgtggcattctgacaacggctacgtttaccttctaagaattaagacctgaattgctcaaaaaaccaagtgctgaaaccatacaatttcacctttgtcaaatgtgacatgcattttgtaaatgaaaagtcctgagatataaaggctgactaagcaccaaaagagggaaacagaaaacttaggatttgttcataagtaggcacaggtgcaatctctgcaaatacacttgaaaatgggttaattgtgtacttcttaatttgtagggcttgaagttttaaagtgtggtattaggcaaatatttaatttcctagagtttggaacacacgtggtatgaaaacttgaaggtactagaatatgataaatgataatgttttagctatgttgacaagcaaaagctggatttggtattttatggtaaagattgacaaaaatttgtggcataatttaaaacacctgggtgtagttaaggtagccatagatttattgaatagaatcttccttttttatgaagatatggagataaatgggattatagagtctaacttgctaaaaggagacataaaaccttgctctttataagagaagccttgtaggaatttacatttgtgaatttctcctggtgtgctcagtttcccagtatgtgtacctgaatctgaggatctgccccattcctttatatcttcactattctcttatgctttttctcaaacttatataattaaagatgcttttgcttgtatgggtatttaaatcaaattattgctttaaattaagtataaatgtataatcttgttttcctaactctggcaatgttctgatctttgctttcacaaacaaaatgcttgtttatagtttacagaataagatgactgtaactagagtctttgatttaaaaaaaagcttaattgttgaaattaaaggatctcaccaaacatattgaatattattcatttggaaaactatatcaatttacacataattacaattccagaatgtgtgcaatcacgcacttaacataattagggaaattaatacaaatcccaattcctcatatactaatgatggcttctagaacacatatctttcccatttttatccaacgtatagtgcatagaggcctggcctgtgtaaaaaatgcacttgtagaaaagtatatattcccaatttcaaggattcttttgagtactcaggaaagtatataaaactatatatagagccttacaaatcaaagtagacaaatacaaattatttgttatatattttgaaagaaaaagaggtgaaatacttggtttaagctcagtcatcaagggggaacagttttaggggaaagaggtttaagttgcacaattaatattatcaatggcaccaataataatgatctgactcattttggaaaaaataatgctgtctttggccttgaattttagaattgcttgagttgtgctagtagaattttctacaatgatggaaatgctgtatattgtgcactgtcatatatagtagtgaacagcaatgtgtgactattgagcatttgaaatgtggctagtgcaactgaggaactggattttagttttattaattttaattaatttaaggttaaatttaaatagtcatatatggctagtggctactgtgttgaacagtgcagttctaaagtgttattgataaaaccgctttgtgaaatttctgtaatttactcacttattcatggacacatttatatatttttacgttcatttattcattctacaaatatttattgatggccttctttgttccaggcattgagaacataatggtgagcaaaactgaccaaggccctactcttgtggaatttatatagtctcatggaatagatggataccaatcaaataatcacacagctggtagaaattagaagaactgaaggttgtaagattatcctgtgtggtgatttctgtgaggaagtccaggctttgcaacctctttaaagtcttctgattttcccccaggaaatgacctctgacctgagatctaaaagatgtttggctctacaaaatggatggattttatcagttgacactacagagatcaaacaaggttgtaggaacaaatttagataattatcatactgactacatatgtaaacaaaacaactgtttctctttagaaagaagaatatcaggagcgtggtggcttagaattattaaagctgtcaaaactgaaagttgaacaactgatcacagtatagccagggagtttccaagtcattttgactcatagtgtgtaaggcagaggtgcccttaagagcttccttctctgttattgaaataaggtacagaaaacacatatacgcacacacgcacacacgtgcgcgtgcgcgcacacacacacgcagctgggtttaattaagaggaaagtggtcagatgaattacattttcttaaagaaatattttgagatgttcttggaaaaatatatccctactgaatagctaggtttctgacatagacaaaatatgtctcttgcaaacatgccataaaaaacagcgctgatctcttccattcagatttttcccagtgccttagggttatccagggaaacagttgatctgagggtttaggaaacaaagatgtccaaaatgatcataaatagggattgaaatctagtttgcatgtagaattccaatccccctggaagttctagctgataatctaatttaaccatgaaatgatatatgataatttgaaaataattatgtactttcaaatgagaagccactgaagtaccacaacactttcaaatgagaagccactgaagtaccacaacacagaactaaagtagcatgtgacactctaattttttttttttttttgagatggagtctcactctgtcgcccaggctggagtgcagtggtgcaatctccgctcactgcaagctctgcctcccaggttcacaccattctcccatctcagcctcccaagtagctgggactagaggcacccgccaccacatccagctaattttttgtattttttagtagagacagggtttcaccatgtttgccaggatggtctcaatctcctgacctcgtgatccacccgccttggcctcccaaagtgctgggattacaggcatgagccaccgtgcctggccgtgtgacactctaattttgactgctgtaattttaatttggggttggagtcagggtggcatggcctcctcaaaacatcctgatgctagtaacatatccaggcagaatatctaagacagatagactctcttatcttcaaaagtgtgcaaaaactattttgagcacctctcccactgtaatatttcatgaatctgcccagtttttatggaatgctgccaggtggctgaactctatccttcaccctttcttctcccttcttggtatgcctgagagtatgtgaattaagtgacatgcgtaataactataacaaaattttattgcattcaatagaaatcactacataacacacctgaatattctggggatatgtgctacatagagccagtgagaactcttgggtcgacgcagtattggatgcttttgtctcacccacacgagacaagttgataccatgtctttccctaggcctatgtgtaaaatctccatgagtgataggagtgataggatgctgctccatgagtccacatctgcagatcccctgaagcttctgaacgttatcgattgtactgaattcaattttctttcaaacacacacaaattgttttcattaggatatgtgctcagtccttgcccagaggtaagcattgcctctaggcaagtccctgggttattaccctgtgttcaccctttctgacttgtggctttacattaaagagatcttgttgagtaggcttgtgtgtatggagcgggaggcagggagattcagttcatttcactctggtggtcactaatgtccttccaggcccaaaccattatcatacattctgtagccacttacatgtgtacatgtaaatgacttgtggaagtcctacaggtaagttagcttgtagaatattttaactttttttttttttttttgagatggagtctcgctctgtcgcccgggctggagtgcagtggtgcgatctcagttcactgcaagctctgcttcccaggtccacaccattctcctgcctcagcttcccaagtagctgggactacaggcgcccgccaccgcgcccggctaattttttgtatttttagtagagactgggtttcaccgtgttagccaggatggtcttgatctcctgacctcgtgatccacctgcctcggcctcccaaagtactgggattacaggtgtgagtcaccgcgcccggccttaactttttataatgcaaaatttcaaacatatcctaaagcagacacactggtgtaatgaagttctatgtactgccatcactcagctttcacatgatcaactcatggccagtcctgtttcattcacagccccacctattcaccactttctgtattacacaacaagtcttcacttaacttcatccataggttcttggaaactgagaaacaatgtgtaagaaaaccaattttgtcatagggtaattgatatataaacaagagttacatccctaaaaatggaactaccattccagtcagcaattccactactgggtatattcccaaagggaataaatcattacatcaaaaagataccggcattcacatgtttattgtagcactattcacaatagcaaacatagggaatcaacaatggaggactggataaagatgaggtgtagatgcaccatggaataaagttataaagaaaaatgaaatcatgtcttttgcagcaatatggatggaactggaggccattatcctaagtgaaataactcagaaacagaaggtcatataccacctgttctcacttgcacgtggaagctaaacagtgggtgcacatgaacatacagagtggaataacaaacactggagaccccaaaatgtgggaaggtgggagaggggtgagggttgaaaatgtactaagagcccagacttcaccactatgtactatatacatgtaagaaatctgcacctgtacctcctaaatgtatgaaaataacattttttaaaaagaattaagtttctatggcatatttctgatcacagaaacatcaccagacttataaataaagaccctaaacacttataatattaaacactgaaataaacgtgagttatacctacatttaaggaagattaatataaacaggataattacccaattttggtgaatcactgagtgatggtaggcataaaggtagtgggttaaatcaaagaataaatgtttgcaaagtacaaatcataaggagcatcttctcccaccaatacggttcaaaatcaaacaaggacaaatctggtaggcttgctaagtgcttttgtgctgcatcatttattgttgtgcatttgtgtgattattgaacacttttcagatttttattttataataacttgtattcattcattcattttccaacctgcatattccagttcagggtcacaggtgactggagcgtatgtcagcacctcagagcacagagatggaaaccagccctggacaggacaccatcccatcacagagtgcatcacactccaatactcattcatatggggaccatttagatgcacccgtttacctaatgtgcacatcttgggatgtgggaggaaagttgagtaggagttcccagagaaaacccatgcagacatggggagaatatgcagatgccacacagacaggggccctggcgcagaggccattttttctttctcatcaacgttataacaatgttgaacgaaacagcattatccggggacttgctgcattttaaaacaaattcgtgaatagtttacagatggatggagcaattaatagaggaggccacttttcccccaaagccttctttgatcctttgctccccagtaggaagtaacggccacccttgagactccccatcattttctccctatttttcttctagcacctaccgttgtttcttgcctggaattatacgtctttttgtatatctctctttcctattgaaccctaagctccttgaaggcaggctccatgactaactcatacagcattcaataaatatttattgaatgaagacaggaatatataaagatgggttacaatgattgaaatccaaatttagatcaagacagatccatacccagcactgggaatctcttttttctgtgatttgatctggcttctgtttacagatcttaattgagtacagactttgagtttcttccaaatgccaataaaacctttagacaaaatatgtttatctcgaattgaataaagaactaaatatggcagaagatatatttgttatttatgataatataaaagaagcagtttcatgtagctatgtattaaaggacacaaacttgaaaatggaaatctctatttttgcatgaaatagtaaaagaaatttggaaaggatgaacttccatgtaaaaatgaactttagggtcaggcagacctggttgcaaattccagccctgtcactttgctatatgaccttgaataagttactcagcctctctgatccttactttcctaatccataaaaatgggaagagtttttccttgtttctcaggattgtgaaggattaaatgaggtagcatatgtgagaccacccagcactgtctctcatgtaaagttggtcctcccacgtgttggtaataattctaacaaccacttattcagagcttactatgtgctggcactggattaagcaggatacaagtattattttaattagtcctcacagtaactttgaggatggtgttaatattttcattttgctcatgaggaaactgaggtctagaaaattaagtaacttgctcaaggtcacgcagctagttagagctagggctctagaagacttgatcctgagtctttatgacatggaagtggaattcttgttcctactgtgctgcctaactttctttcattataatttctttgaaactggctggcacggtggctctaatacttgtaatcccagcacttgggaggctgaggcgggtggattgcctgagctcaggagtttgagaccagcctgggcaacatggcaagaccctgtctctatttaaaaaaaatttttttgttgttgaaactttgcatagaaaaggacttaaaactctagggaaaatgtctttcaatcactcactgctgttgcaatcatatataacagaatctgagaaatatgcaactttgagtatttgggagtttttgaaacggggagagtaaatagtattagaatgaatgtttgaagaccatattcatttttattttaaacacttataggaatagtgatttggtagaaaattaatacatttaatcaaggcatgcagaatgtacagagactttttttgtaacactcattacagtgatgtagtgggaaaatattcctaaaggcacaactcaacttccagaagacatctatagcaatagcagcatcaaaaatgtatacaatttataaaatttggaaaattttctgaagatcttaagtaaaaaatttaatattagtaaagttttagaaagtatttagaaaatttaatattagtaaagtttttagtaaagttttttagaataaatatagaataggtgtttgttggactacatgaaggatgaggcataaaatgcccaatatattcagtcattcagaatctgaggcagtatccagggcttaattaggagttctgaaatttcttaaatctattagttccattagttatcccaacacaaatgtctagaaaagcttctactaaaatattcagtttgattgttggaagctgtcattactgttctctttgaatgaaaatatttaaaggatttgttctagaaaatgcaatccagcctggaactctgtcttcaaggtgggactgacatggctagtccctacaagcttccatgatccaagtacagatttactgtagtaaagaaaaatctgagtcaaatgtctgaagaacagggtgtgatttagctaaaagtgccaattttgttacagcatgtttggaaaagttgcccccgaaccggctgtcatgagtatttcttacattaaaataattcccactgaactttttgaaagtaaatagctggtatccaagaatctcccaaaataagccattggaaagtctcatgaggacaggaatctttgtctctggctctcaccataaacccatgttgactgtgaaatgagagggaaattatctctgccacggttcagccataccaggagtctggctttgtgtttgttcttacatttgaaaacttttccttaacaagctctcaaattcctggatgttacatgaaacattcttcaaataagttttggatgataaccttgatatgatctaagttgtatgcagcaaatataaatctccaatattattattgcatctcctaaaacttcccatggatttgaactctggcagagataaagcagaccccaaaatggtctcaactagacaaatgttgaatagaacaattgctgcctccagttgctcttgacacaagtatttggtggggtggggaggaggacagggtgttgtttgctattcatgcacaggctcttttctttttcattctgcagacaatgataactaattaatactgcagggtcctcaaggtaggacacatgggtcagttcctctgtacctggacttctaatcatctcagataaggagaaagaggaaggagcagtagccacctgcctttagtagaaatgttgcttggttttctggcagggctctgccattccactttggcttgggtatggggtgggcaacttctcaccaagaggtcctcaggaagagaaagtcttgggaggaggggcagcatgatagatgaaacatcaggttgaaaaagtccaagtatgttcatccttggtctcatctttaatgtaagcagttgagaaattaagttgctcctgctgtgttagagtgtctcagtttccccaaatttagccatcagcagagagcacatgtacatcctaggggctgctgcttgcagcagaagataatgcttttgcatgcatctctaagcacagcgtgaaatgagtccctagtgggaggaagcatgaccaatgagtgtcagatgttcaggctttctgtgtgactccagtcaggggcagggctgtgggtaggttaagacagggtttagggaaagaaaggaatttgaaggcaaccagagctccagcttaaccaaccccacagtataaaatgcataaagaggcaagtgggaaggaggatgaaagggaggcagtgggataaaagagtgggggttgggggtggggaagatctttccaagccatatatgagagctcttgtttactggcctgaccactcaccagcagggtgaccttgggcatgttacttaacttttcggggcctcactttcctcatttgtataatgaggatgataagtctacttaggtcatcagatttttaatgaagtccaaatgaatacatgtaaaacattcaggtctgtgcctggcaaatagtaagtgttcaataaacattagcctttagtatctgtggctcaggcttgctcttatgatgtggtttcattagtttacctacagtttgtactaaaagaaggctcttttggaacatgcagagagtgttttgcaatacccagagaggctctagtgggtattacttcatagtttgaataaaatgtatgcttgttcagggaaagcttggagatccttaagaaatgtctttaagaaggattacacctgccactaagtgtaaattatttgtctaattcagtgtttcaaataaaaaaaaaaacaatagaagaaaagactttccttacatatgtactcacttgataatataataggacacttagggtctccctctctgatttgctcaaaaataaaaaggcaattaaagaactttacaaaacattcagtttcaaaaagaaaaaaaaaaacaacactgaggctgtgcatatcttgagagcagttcctttcttctgcaggaatgccttctcattagctcttagttcagcctgcatctgggagttgggagggtgttggtttgaaacagacctctctgtacaaatctgcaaagagagatgatctaaaaacccaccagaaggagaaagatgctatgagcttccaaataactacacggtcaagaactcataggacctgaaatttgacatgtgatcaaggccagcacaggcttttgagaaacacagacaaaagttattgtaaaggtgatacattaactggttcagtaagagacggagggcaataccatttaaaaaatgtattttggatttattaaatcataagggagtgaagacttacttccttatgagatagctaacctgtttagggttaatcttaggtgtctccttgccagagtagtcaaaagagttggtacaaggtcattttagatataaaccagaaatagcatggaggcataattattatatcaaaaatacaaatcacagcaaacaaatttttctagagactcagttatggttttggtcaggaaaagaatcgttggcgtattttcactggagtctagcttcatagggtaacctaggggcaggactagtactgaagttactggaaagtcactgttatttggtgtttcttctaaagtctgtcattaatatgtctctgacagaaattaactctgcaaaaagcgctgtggagaacctgggttttaatctagggttttgcaagttcatgcacctggcagtggcctaaggcgcagaaggaccaaactgaggtgggttgttattaaattgtttgcattcaaccttagttttcttcttattaaaaatgttttcagggcaaataattgctaatgcttcataaatagaaaaaaaaataaagttacaaatcaaattgctgtagttcataaggaaggagagaattaaaaagaaaaagaagttgaactcttcatttgaaagtttagagtcagaacctgggagcttggatcttgccatcagtgacagtgtgatcctgaatagatatgttagcttccctacataggaagctgagtaagtaacaatctttctgctacacattaggaatactttgtgaacatttctactgtgtttacacaacacaaaataaagtgattgctgattatttagtttaggtgatcggtgaagttggcagaatcagccaagacaagcctgagattcattgtccttgacttgtctgccttgattacttacatgggtcttaattagccaacagattgcagacttcctttcactttgtgctcagcaaatttgacagcagagttgttttcctccctagtggaaacgagcaatatttatattgctagggtctaaaagaaaatttttaaagatgattaaaaaactagagagtgggaaattttagtttactgaaactctgctttcttgttcctttctcccaaagcgtacctcctcatttccttgagtcacctgtttcacttctaaaccaatgactctcaaatttgagggaggatcagactcacctggaggctgggccccacccctagagtttctgattcagcgggtctggggtgggacctgagaatttgcatttccgacaagttcccagtgatgccgccgctgctgctggtccaggcaccacagttcaagacccacagacggaactggcctcctgtcagtttctgaatcgcccccgtggccgtggatccacccacagccttcatctctgccttgggctcttgcttccttcactgcctgtctccacgtggatcccaggcctccctgggagctcccagctgggaggtaaggtgcaggaggcctaattccccacaccccctcaaacacataacttatatgtttttaaatgaaaggatagagaacaaaagggaattacaagcaggagtgaataatttgaagctgaaactaaatataattgctctggaacactgttcctcaaccttttttttttccttatcacccttcccccaaaggagacctttagacatttttttttcctaattgtactccaccccaacctttactccactcatgaaatttaaactccacagatacactgtatatttgcttatttactgtggccattgggaaggccacaagccattataatatctaagattttgttcatccactgagaaccaatatttgcccccttggagatgataacattcctattgacaaatgcattttctagtctagcaaggtaaaatcagtaaacaatgggaactgttcatgggttcctctgtaggcacactgcccttctcaaccttgctccaatgttaccaaggcttctcttgcctcttctgtctgagaatggcctattcttcaattttcttagtgctgcttctctgctgctctagtttttagaaaaactccatcccattcttttaccctcaggtctagaaagtgatagaggaagaataaagccacctaagagatctacaactctctgttttccttcttagttccttaccaactgacttcagggatgaaactctgccaaagagggaaattatattaaaatcagtaccagatgctttcctccttttgtctgaccaggtagtctaatgataccacaacagcattgcccgaggtctgagttattcaatcaagaatagccccatagggactttatcaggacagtcaatgggaacctccaacccttcaggaaaggtcccctcaaggtttcttcactgccgagatgtgcagaagtttctcattctccctgcaagctttgtaggggtgaatatgagaacatctccttcacctccctctcccgacacaccctccctccccacacacagacaccacaaacacacacatgcaagcatgcacaaagaaaaagcaacaattctcagagactgaatagaaacctttttttttttcctaaatacaattgggagtatttgtccaaattcctgtgcccacaagggagacagacttttacatttttttatgcagaacactttcatttcctttctcctgttgccagataataccctaactcctgctgtgagaagcccattagaacatcttgacaaacaacagaaccctctaccccaactagaactggagctggaaattagagctttttcttcacttggggtcattatttccttcagtgagctctaaagtagaagaggaagcttaggccttgttagcctgctgcccacagtaaacacctggagagataatggcaggtggtgtgctaggaaagtattgtgctgctagtcacattttttaaaaaatggaagtctgttttattaggatggtatatgtacttttgtgcctcttctaaatggaaaaatggaagaaatatcacttaattcattggataagatcttatatctagcacagttgatggattaccagccaagactcaaaagaggcagatggcaaatgcttgggctgaaaatcatatctctagcagatcggaaacggtggctctattacaataacgtcaacctgccatgttagtgactcctacttccaggcctaggaaagatgttaaaggtatcctaattgagcttgctcatctatactgaggagtgagatccagaggggcataacatggtttgtccagggtcagccaggtgaaacggaaaagagccagagctcaaaactaagatctgattcctacctgggtggatccttccttcctttctttttctttttctttctttccttcctttctttctttctttctttctttctttctttctttctttctttctttctttctttctttctttctctctctctttctttctctttctctctttctccctttctctctttctccctttctctctctctcttctttctttctctctctctctttcacagggtctttcttgctctgttgcccagactggagtgcagtggtgagatctcagccttctgcaacctctccctcttgggctcaagcgatcctcccacctcagcctcccaagtagctgggactacaggcacacaccaattatgctcggctaatttttttctttattttttgcagagatggggttttgctatgttgcccaggctactggatggttctttctaccacaccaggacacttcctccatttccttcttcctttgtggtaaagtcaggattatggtttcttcacagatattgctgagatgtgttaaatctacaacagaaaaatctgaaaggtctgtctgggtttaggctccaatttcctgaagaattaaaagaagcaggatgacctttttggcttatgaattggagtgggggtaggagagaccaaaaaggagacccggaagtttaggacagctttcctatgttttcaagagcctcagagtgagaaccccaaaacatcttcctatggctgccgtatggccaacatgaaaactaagtaaggaaaaaaggaagctaggggtgagggcaggacagatttccctttccttctcgagttcctcttctagcatgtgaaactctagaagcaagattcaatgacatcagcatctttggtgaaaaggcagacagaagtggaggggttacgagagaggaattagcgaccttgacgtgcctgacctaatgaatgcagcgtaggcatcccacagctttcttagtggaagcaccatctgaaggtggactcagttgcagggtatgagcccagattaagctgtaacttgacctaattcaaaataaaaaaatagtaagctttgattatgtgccaggtaagtgttgtaggaaatagaaagacaaatatgacatggattctgatttcaagggatttattattatctaggagacagagagagagctgtatacaaactacaaagatacaagacagaatgtgactgtgctattaaaaagttaaaaacaaagttctctggaagcctgaggctatggctgcaaatgagctcttagccagtatcctgtgcatttgggccactatcagatgttagagaaggcagaagtgaagggcctatgctagggagtaggtggaagtagttgggggatttgatgatagagaggttttccgttgactgaagaagcagctacttctaagtagtcatttgtcatcatcgaggtcaattttcaattttagtttatgtatttgcattcctagttttggtgaaatccctcttcctactcacaaatttgtgcttgtaaatgaccagttgttcttttcacttgggcagttaagcaacaaaaggattgcatgtgcaaattcaggggtttggagacaaacacaacggtgcggtgttagtggttgcgtaactccaaactgggaaatggaaaaactaagagacaactgtgaaaatcattactaacgttttctttctgaactatcaagaaataaaattatttatttggtttttggaacatgatagatggggtagaaagtttccttaggcaaaggacatggtgattttcttttcttctttttttttgagatggagttttgcttttgttgcccaggctggagtgcaatggcgcgatcttggctcaccgcaacctccgcctcctggattcaagtgattctcctgcctcagcctcccaagtagctgggattacaggcatgcaccaccacgcccgcctaattttgtatttttagtagagatggggtttctccatgttggtcaggctggtctcaaactcccgacctcaggtgatccgcctgcctcagcctcccaaagtgctgggattacaggtgtgaatcactgcacctggccaggacatggtgattttctaagtcgcttatgccttgttatttgactcagtagggtctacattaaaaatgaaaaaatacaacaacaacaaaaacccaaatcacaagatctggaatatttttggccattccatttcagtataaatgggtctagaaataaaacctaggcacaccccggatagcgagtttgaggttttgtatggcagagatggccaatgattcatcaaaactttaccctcctcttttcatagtggagttattgctgggaggtggcttctaagatggaggctacattttttagcatgtcctaccttcctgactccttgcatccaggtggtcatcgataaaatgtgacagaaggtgtgcatgtctctttttctaggcccagacttttaagaaatgagtgggggcatcttcattttctcttccccatctgctggctgaatgcagatgggtggaaccacacgatggaaatagcctgggttttttaataatcacatgaaggaaagctgcctacaaaccaggcacacttgcattgaagtattacgtgaatgagaaacagaattctagttttaggtaaattttatctgctacctgtagagctacaggggtcttctgtggtgagcttctctggaggaagagcatccttcctgtccactgatgttgggcttggtcatctgacgtgctttggctagtggaatgtgagcagacgtgatgtagaccacattccagcagaagcttcaagagctattgcatgattccaccatgatcctttctcctgttctagaacagcatttagcctggatcccatatacagaagggacatttaggctggatcccagataaagaagacaagtggagcagaggagcgactgacacgtagctaacatattccatagcaaaacataaacctttgcggttgatatggggattgcttgtcacaggagaataacctagcaaaagctgaccaacagattgtgctaaaccactgacattttaatagttatctaggctagcatttggtgttaccctaccaaactagaaggattaagtgtgtggtaaactgggaagtgggtaacagtgaacaagatatcataaaacatttctgttttaaagtacaattaaatgcaaaatactctaatggaattaaaagtcatagtaaaccagcctgagcaacatggcgagaccctatctctacaaaaaaacacaaaaaatttagccaagtgtggtggcacacacctgtagtcccaggtactcaggaggatgaggtgggaggatcacttgagcccaggaggttgaggctgcagtgaaccctgattgtgctactgcactccagcctgggcaataagtgtgaccttgtctcaaaaaaattattaaatattaattgacaaatcacaacctggtaaaacggcagaccaataaattcattttcaaacacaaattgaataatgcaacattaaggtaatggaccactctctggctccatggagctatctgacttctgccaattgaaagttcttggcagaatctgaagaggtgggtggattgatgcctaaacatagagatgatcctataaagattcctctgtttctgcaaccccagtacaacctgactctgcccacaactcccttcatggaatgtcataggagaaggataccagaagggtacagatagggtgatgcaacaaagatgcatttaaacttgtcatttttgcacaagactgaaaccttcacagggactaactattgaagaaaagggcagggtcattttggagctccaggacacctggagatggcatacctggtgagtgtctggagatgggatgtgggaaggggtagaaagaaaagcttgtgatggaaccaaagtgatacaactgcccagaggccctaatcagctgatacctggggaccttgggcaggttactcttgtccctcacttgatcaacaggatggttatgaataagagatgagtaattttaaatataatttaaaaatgttgtcataagaaaaaaaaatgaaaatatgctccgctggttgaaaaaaagtctgttgtattgttttcttttttcctttatttcattatgaccagggaatttatttccacaaacaataagtttataaaaaatagtgaagacataaaaatagttattcataagctagagaataataatgtccttggtgatgtctgattgagttgcagaaggcatgagtttgccaccaacagctcagtcacctccatgctctccaccacaggaatgtgggatgagggggtcttgtcatacgcggtgctacccagctcttttaaaaatctggttggctctgtcacatcatactctggctgtggtttcccttgggtgacactgaccattcattcaacatattccatttggcagatatcttccatttttaccctagtgacagtcttttacaattacttaacttggcagcctctttgcgatgttaatggttgttttctaaacaggaaaggtggatggtgacaaggacctggcttagctcctcactgcatatcatatcacatcccattttggctgatcatcgaaaacactcccgaaccatgccatcagctccaaagtttatttgaagaaatttatatggaaagttaactatattactacgagactagtcttaatttcttccttgttttattaagaaattaaatgtatgaaaattaggaggttagtgtatcatgggagttgaaaccgtggcagcagcatgtaaagtctatgtctgggaatggttgaggccaagagtcagaccgtgcaatgcttagtattgcggatttcagggaataaaacggatataaagacaactaggctgccaggcacagtggctgactcctataatcccagcactttgggaggccaagacaggtggatcacttgaggtcaggagttcgagaccagcctggccagcatggtgaaaccctgtctcttctaaagaaaaccacaaaaattagccaggcaaggtggcaggtatctgtaatcacaactactcaggaggcggaggcacgaaaatcatttgaggctcaggcacgaaaattgcttgaactcgggaggtggaggttgcagtgagcctagattgccactgcactccagcctgagcgataagtgagactctgtctgaaaagaaaaaaaaaagataactaggcaatagttttgcccctttctttctgttctttcacttgtaaggtagttaataaagtccatttagttactaccaaaaatgcatttaaaagtgttaaactacagccaaagatttattcttttaaaatgcattgaaatgttttaaaatacagcaaaagatttatttttttttaaataccaaatattggtgtcaacatagcacaattattgtaattcaaactttggattttgttggaagtgtttttgcattcgtattactattatgtacttccagcctgacctttctcttttcctagaagagcaaattggagttagaggtgagggaagtggcaaaacaggaggctataaaattgatgaacagcctgtagggacgcaagaaactaaatattgatctttgttctttcagtgaggactcttgcgtttctaaggatgtcattacagccatggcagtatgggttcatccgatctgctattcagctgtggttgctctcggcattgaaaggacgctttgttcatggggtcagctgatgaccagggagttttctaaagtgagacttacagtgagaaaattcctctccaggtgttatgtgagatatttggggtatgtaggactgtgaggtaaggaatacagtttgctttaaaaaatgacacaactaaaaaaaatggcatagcttatacattcaaattagtgctattcttccaggaatcatagtgggagatatgaacttatcctagtaaagacaccattttgcaaagcattttggaactctttatcttagagttgccttcagaaccaaggttagggtctgcagaccactcgggactaaatacttagtgttttacttcaatttttagccacgacacagaaggttgattagttatttttctcccttctagatttaactccaaataacttggggtatttaaaaaaattaaatctattcatttactccttcatccatagattcattttttcaataagtactcattgaatgcccctgcatgtcaggctctgtgttagaagttgaggattctgtgatgcataagacagatacagttcctgctctcttggagctgatataataagaaagacagaccaaaaccacccccgccacaacatctaacaaacaaattaataaaacacttcagagttgggataagaggtatgaaggcaacagataagggactgagctagagaaataacaagaagagaaatgtaggctgggttggaatgggaatggtgacatttaagcacaaattcaaccttaaaggaggtatctttgccaccactgggagtgtttacaggaataaactttaattttgaaggacaaatttctccattgtgtagatatctttctttctttgcaactgagacggagtctcgctctgtcgcccaggctagagtgcagtggtgctatctcggctcactgcatgctcctcctcccgggttcatgccattctcctgcctcagccacctgagtagctgggactacaggcgcccgccaccatgcctggctaattttttgtatttttagtagagacggggtttcactgtgttagccaggatggctaacctcctgacctcgtgatctgcctgcctcggcctcccaaagtgctgggattacaggtgtgagccactgcgcccggcctggggtgacattttgaagctatgtgaatttcctgttttctgacaacattttaatgccaaaagatttacccagtttcatagcgactaagtcacagaaccgtgactgtggtaggaagcaatatctcctattctcagtctcatgcacttccacccggccacacttgtcccattcatagtacatggacatttcaggagaggtttggagaagtcagggtgctaagaaaatctaggtgctatttagacctttatagtttattaaatgaattgaataagaaaagtttcattagaagttctcattttgtgggaaataattagatttcccttgatgtggctaaagaataaatggcaatactactagataagtaaattattgctattgttactcaaaagaaacagatgtatggccaagtttcctgcccccaaatattcttaaagaagttggatcctgtttcctttgctgtttgtcactttgaatgccagtgtagatgtactggataaagactccgctgggcatgagtaaaaatatctttctttagaatcattaaccataactttatatcaagtggattaatgttcacttttattttttaaaccaggccagatgtggtggctcatgcctgtaatcccagcactttgggaggccaaggtgggtggatcacttgagatcagatcgagactagcccggccaacttggggaaaccctgtctctaataaaaatacaaaaaattagttgggcttggtggtgtgcacctgtagtcccagcttctcaggaggctgaggcacgagaattgcttgaacctgggaggtggaggttgcagtgagccgagatcatgccattgcactccagtctgggtgacagagcaagaccttgtcaaaaaaagaaaaaaaccacacacacacggtggtggcttttaggtgaatcaaatcccttttactgagactttctaacccttaggagctgtcccaaagacttcctgtggcaatgtagtctgtggggtaattgtattaggataatagggttgaaacatatcataatttaatgagtttgtggttttcttactcccagaattaaaaagaacctctatgaatgtcaaatttagtaattatcaaactgaacagactttggctctatttaaccaacgggcacatagtctgtagataacagcatgatttggtatttataaagagcctattccccctgctcctacccttagacaccagaaattcattaaatgtaaagccttacataattctgtaaataaactcacttatctggaatgttcctagcctctaaattaggtattaaagaagagatatcattcttttgggacaggccttcggctttccctaaaatgtagtggctaggtatggcccagaatacaaactggctagagtttgatggaatttaatgaataacaacaacaacaataataaaacgccaggtctccttggtgtgagagcaataaacaattaaattcttgggaaagagatgaaaataggatctagtccttaagtggcctaaggcctagcagattccttctggccttaggttacatacatttgggttgatttggattagaaacatgaaagtacaaattttgcctttaattacatatttttttcagtagtactcttgctaaatgtccaaagaaatatagagctagacaataataatagcttagattcatgtcgcaagtgttttacatggatatcttttaaccctcacaaataaccccagaagggatactattattattttcccctttgaaagataaagaaactgggatccagatatgctaggcaacatcctgtagaataatctggctgcaaacccaaacaaacagaatgactgcagagtctgagatgataaggacaggtaataccatctcccaaactctgctgcctctccactaaggggtagcagattgatagcaagaccttttcataggaggatcactaagtgctttgcttgaatgtaatgataacttcccccagcaatcctttggtgtggtttatagttttgttttgtttttgagacagaatctctctctgtcacccaggctggagtgcagtggcgtgatctcggctcactgcaacctccacctcccatgttcaagcgattctcctgcctcagcctcccaagtagctgggattaaagacatgctccaccacgcccagctattttttttgtattttttgtagagatggggttttggtatgttggccagggtggtctcaaactcctggcctcaagtgatctgcctgccttggcttcccaaagtgctgggattccaggtatgagccaccgtacctggcagactggagtgcagtgatgccatctcggctcactgcaacctctgtgtcccaagttcaagggattctcatacctcagcctcccgagtagctgggattacaggtgtgagccactgcaccctgcctggtgtggtttaaaaaccaagaactaggctggatgtggtggctcatgtctgtaatcccagcactttgggaggccaaggtgggcggatcacttgaggtcagaaatttgagaccagcctagccaacatgaggaaatcctgtctctactaaaaatacaaaaaaaaaaaaaaaaaaaaaaaaaaaaaaaaaaaaaaaaattagctgggcgtggtggtgagcacctgtaatcccagcttcctgggaggctgaggcaggagagtcacttgaacccaggaggcagaggtagcagtgagccaagatcacgccactgcactccagcctgggtaacagagtgagactccatctaaaaacaaaacaaaacaaacgaacaaatgaacaaaaccaagaactgactagaggcccatcaaatggaaaaatgatttgtgttaaggcactccttgcaaaactggcagataggggcagaaagagaagaggctcttaccttcacttctgggacttcgccaatggccagtgctcttctgaactccacatagtgaaagacaaatagcattctttccagtcagtgtgctcatttgctactccttctgcatttctccctaggggccaaaattcctggcaaagaaaaataaaaccaggatcatagccatagaaatcagattataaaattgcttcctatctgaattcatattctaacctttctttagtgctttcataaacccctcccagactgatagaattatcttttttatgactcatggatatattttactttgccatttttatcctctttactttgagggagaagatcagatgatgaagaagattcaccctgtagtgctacataagattttattttaccctaacatgtggactatggacctaaaaaaagaaatatgttcagcttagtattatgtataagaaatacttttcaaagttttacaaaaacataatccaatgataaattttattcatttaaaaagcatttgttgaattctttctaggtgtcaagcactgcagtagattctgaagatacaaaaataaataaaacattcctgccctcaagacacttacactcttatgtgtaacactgtgtgaccattcatctgggccttcctgagacagtcttggtttacacctgttttcccaatgtaagtataaatagcaacccctttcactctcaagtgttcctttttagatgataaattatatataccctagtaataatatttcccactagatgatgtttttaaaatacttgtaattcttggatataaataaaaagtacaaacagcgaaggaccaaaaatgtacttgacactctgtcttcattttggaatcactatttctgtcactgagcgtcagtttaagtcagttcattgggaaaatgtgaacttggttcacattatttttgttgtggttttacattattttacaaaatgcagctgctgtccaatctctatagggaggaagaaatgaatggctagaaaacttaagaagatgagagaatactgcaataaatggagatcagagtatgtatcatatcatatactcaactccagttttggtacaggccaaagatgaatagggcacagaggtctttaagggcaaaagcagtgtcaggtagagcagccaaagcaatggctgaaggcagttgttgtcaaggacctctgatcttagaactcaatgtggcatgtggctttccctcagactctggtttctattccatttctaaaaacacccaactcaatggtttttaaaactatccgcaatgtacttttgtgaaaggttggtgtttgcagaacttctcattacacatcattctatgtactgttgtctgaatatgtatacgtatgtattttgatattgaagacagactatttttagtttcctttggatatgtttggagaaactcctaactgttgctatgctgctatggaaacggtatccacgtatactgacatgtttacaattgcttaaaacactataaactttccagggcaaaggcaaacagcttacttctatcaaagttgctccatgctttcctttttttattagtttatttattactctcagccccatgttggaatctgtttcatctgtgcctgcattaaagagattttttttttttgctgacccacatattcgtttaattgatttcacattcacaactatagtggcgctgaaagccagtgaaaaattttccccgaaataaaaaatattccttgttaggaattaagaattgaatacctgctattttcccagaagaaaaatggaaagaatacttcttgagagtatgttgacagtctgtctagaattttcaagtgtaggagactttgaaagtagcttaaatgtaacgattgtaattactatttgtgtatacaaaatgaatttaaggactattctaattgctaggaaacatgcaaacctaaaaaggaggtttattgctttttttcaagcataggaaaaactaggtggctgagaatctttacaatttttggagaaaagaatcttaacaaaaccacaggaatgaaagtgaataagaacctgtttgtttgaagacatcagaaaagtggtttttgtcagggctgttttctaggagtcaaaaaatatttgaaagtagaatctataattgtgactcatacagcagtgggtcctgattacataaaaaaggcacacacgctctagtagagcatattttttaatagaattttaaacccagagtactttctcctttaaaatctcttttccaaaatttgatacctattttgcgtaagtgtacagtaaaacaaatttaggctgtcatgatggagtctactttcctctctcttctactgaaatctcctttttgtcatcttcttgaaatggtcattttaagtcacacataaaaaaacaaaacaaaacagcaaatagaagttttatgggaatggaaatgattcacggagagctggttgcagcagggaactgggcctcgcttgcatctggagatcagggctctgtagagccagtacttgcccctgacccagccccctttccagcagtgtttatatgctttctctgcttcagctgatcagaggatattccattctaagcctttcatgggacaatgtttatgtgattttttttttcttcttctttgtggggaggattcctccctgcctcttggagcttagcagcactaagaaatgtcatcctaaggtcacatttagattaaaacccagtaaaacctgatggacttgttatagcaagtgactgtgagggacactcacagtatgatgactgtggcttgctagtctaccatggggacaggaatgagggtgggtcacaggaggtcctaacggggaggcaaatctgctttagcagcagctcgtttcaagaggctgggtgttgcggcattaattctcctgggttgggagcctgggcagggtgggtgtcaagtggctctggcaactggaccccttcggggttgccctcaggatcaggatgaaaagggggaagtcaggctggagcagcagcgcggttcacgcagagagcaccccaggcagccacgaactggcttgctccgttcagatttctcttaaacagcagttttccgtttctgttctatggcctctgagggaatttcccaaattaaccttcactaagctttcctgagggactgtttttgagcgctgatgggggaatttcccccttttgaccacactgttgcccggagacttgttgctgctcttcatctggggattttctcactggcattttgctacttcctgtttcccaagagtctctgctctctgggaactgaagatttatcaagagaaggggacaaacagcctttaggaaaaaggggaggagggtgtatttaatacagtggtgcttttcttcccctcctttagttctttgctacagtaacattggatttgaaaatcaggcccagggagcttgctgagagcttcggattgattacgctaaacattccacaggaacttgagttgtacggtgtaatcacaaatcacataaatgattgttttattagaatatctatcctctatttgggatggatagaaacccctgtgttaaaagaaaccactaaagaaatcattactccttttacttagtgaaaatgcactaccacttgttgaatgtttcctgtgtgtcagccatggcactggggctttgcatacatttctcgtctgatgctagcaacaacctggaggagtagggcttattcagactcatttaatagatgagcgaaccaagcctcgaagaggctctgagaggttaactgacaaccacattttcccggctggtattaagcaaagctccaattctgtggattcctaaagcctatgctcatatttactcagctataaatttgtattgaactggggatttgtttcatgggtctcttaggtgctattaccaggaaagcagcaggagagaccccgagaagaagcagatccccaaaaccagaggtgaaaatattttagggagcagtattgatagtccttggcttaaccctgtgcacttgccaggcccttttgccatgtcacctggaaaaagctgctgacttgaaaggtgacaggaataaatatatttaaaaagcttcaattgaacgaattcattagttctttctcttagagaaactttccacctaaccactgctgtcaccttgctacttcctaccctagctttgtacattttatcaagggtattagaaataattcccctggggacaggtcccagaatctctctggccctgctctgtggaagttgacatctagagaaaataatgttctggaattgctctacctccttgactcttgatgctcttaagccagatgagtgtctgtgcatgcatgtgtgcacgtgtgtctgtgttcttgtggtatgaggttcttgggggatggattattagccacagttgacctttgcaaagttctccaagtattaaatattttcacttccactggaggagtgatcagcatacacgagggggtgctggaagcagcttggggagtgacctggctgttcctgggagttcctgaggaaagggggtgcaaaatctgcattggtgccccctgcttcctgcacactttgcagcagctcttcctctccagggtttgtctaggagggctcctagctgtattgtcttcatccacatagtgaactctgataaccaccaaatgttgagagttgactagttgcctaatagtttacctgcattgacttaacttgatcctcacccatgaaggtaggcaaaatgattccgtttaaaacaaaacaaaacaaaaacagtgagaagaccaaggccctggaaggttaaaatggcccaaacctaccggccgggcgcggtggctcacgcctataatcccagcactttgggaggccgaggcgggcggatcacgaggtcaggagatcgagaccttcctggctaacacagtgaaaccccgtctctactaaaaatacaaaaaattagccgggcgtggtggcgggcgcctgtagtcccagctacccgtgaggctgaggcaggagaatggcgtgaacctgggaggtggagcttgcagtgagccgagatcacgccactgcactccagcctgggtgacagagtgagactccgtcttgaaaaaacaaacaaacaaacaaacaaacaaaaaatggcccaaactacctaactagtaagtcaaggggttgagattcaaatattggtgggtctgattcatagctgtagctttattatggccaggggtgggtgagtggagtaaatcttatttattttttaatcactaggaaactatatcctagccttgaagttgcaaatatacaggctgttatcatttcaaataatcaggtggtagaaagagagcaagattctaatcagcacaatgcccaggccagggaaggaacgtggcgcgacccagaggaccctggcttgaccaaaagtggtatttggaaaagggggcaccgatcctcttttgtgctaaaggggacatggttttcttatcttcactgtttccaaggcatcttcttagtggtggctctgcaactagagagggctaaacaagcaacgccaggtttaggctttcatcccattgtgcttgagaaaaaaacaagtcttcccaaatctagtactttacaacacttcataattaagcagccaagaatctgtctttcagtgtttgtgcccagtcactggtacacattataatcaaaatcccttttcccttcaaagcagagcatcactgcctttcccactattctcctgcagaagagcaggggaaggaagcaccagggtccatcatggaggtaagagaaaagttctgcttcccatgcccactatgatgtatgcctctcatgtatcacatggggtccaggctgaaagatgtaatgtgcaagaacctcgagaaaagcacagctgtgtcttggtggaaagaaaggcacttctatcaggagtctgtccaagttctaatcgttacccttctctccaagtgccacatcttaatcaatttcaatcccttgaatgttgtccctgttcattttgtgctgctataacagaatacctgagactgggtattttataaagaacaggtttctttcagttctggaggctgggaagtacagggtcaggggcctgcaccgggcaagagcctgtgttttgtgttatcctatagcagaaggcagaagagcaagacagtgtgagaaggagagagggtgaggaagggggcctgtctcttaaagtcatctcttaaagatctcactcctcaatgctgttgggtaggggattaagtttccaacacatgaactttatgggacacgttcaaaccataacaaacataaaaatcaaaccaaaccatacaaaaatactctgaaaatattttttcttttcaaattagaaatgacatcatgtaggtttcttcatggcctatggaaaatggtgtggtggcacatcctggtatatgggagtttggcaacaaacagaattaccctcttcaaattctatcagaccacaggtagattaggggaattttctagttcattgctacctgtgtaccaagaacaactggttcagagggctctggcttggtgtgacaggggaaacccatactgctaaaataagctcttactgcatgaaatctggctctagaaaaatcttgcactactactgactcaaaatttatttatttatttatttattagagacagactttcactccatcgcccaggctgaagtgcagtggcaccatcttggctcacttcaacctctgcctccggggttcaagcgagtttcctgcctcagcctcttgagtagctgggactacaggcacccgccaccatgcccagctaatttttctatttttagtagagtcaggtttcaccatattgtccaggctggtctcgaactccagacctcaagtgatctgcctgcctgggcctcccaaattgctggaattataggtgtgagccactgtgcccaggctctgacccaaaatttatcatcactttcttcaatttctattcctatggatcaaaatgtaagatggagccaaatgtccagtggcaagttaacgtattatttgaacttaatacaattcttgattgcttcattccttaatttttcttaaaagacaaaatatttcattcttttaaatagttcttgttcttaaccctgatggtcatgggcaaagatccttattttccagtggatgagagggaaccctttatatttttgatcatagatatggtttatgtgctcatccacactcttgctccccgtatccatcaactctttgactgtgttgttgcaggtgcattgggttgtttggtcctggaacttctccaacttgcaggtcaccagggcctgaggatgcagctttccctgcagtactttttctgctgcatggaggcattgttgcccccatggtagccagcgctgcatgggagcaggaggccctgcatcctcctcatgttctgtctttctgccacatcctagacccaaccctgcgcagtacctgtctctccagtgcccagatgaactcaggagggcatgcctcccccttcatcggcacttcctgggccatcactgtcattgcaggtctcaaaactagtgttcttaaccattctgctatattatattacaattggaatgttgctaacacagacataagtttcacacagagattagcaatacattcttttccatagtatattaaacataatttcaacatttattcttgcacaaggaaactacttatacagctaggtgaggaatgatctgtgtcagtgaaaggcataagatagaacatgttctttttacttagagatgatctttactatgattgtgggtgcaataaatgttatctcttttggaggatattttcagagctatttaaattaaatcagatttttaaaatgcaagtttcaggatattaccagtgatttagataccatgatatggcttaggtatagtttgaataaagagcaaaatagcaaaaaattcctgctgttctcacctctccaaaaaagaaaagtcttaaaaacaaacaaacacacatgcacctttgggtttgaagttagcctttgttattagcacaaaacaccaaaattacagtcaaaattagtcactggagttatatctgacttttaagacatgcttcctcctctgtctttatcttcctcacacccacagcacccacataccaactcactgcctttccccatcgtacagtattattggaagtaagacattggatgctaagagctgcaaggtcttgggtataagtggcaaaggttgctgtgcttatgcttcacaaggtgctcttgctgagataaatggtagcattttgagaaggatgggagtgaagatcctaaaacatatatcaatttgagaaggcctcttttgctcttttctttctttctctttctttctttctttctttctttctttctttctttctttctttctttctttctttctttctttcgttctttctttctttctttctttttctttccttccttccttctttctttttcttctttctttctttttctttctttctctctctctctcttcttttctttcttctttctttttttccgagatgaaatctcgatctgtcacccaggctggagtccagtggcattctcagctcactgcaacctccaccttccaggttcaagcgattctcctgactcagcctcccgagtagctgggattacaggcgcatgccaagacgcctggctaatttttgtgtttttagtagagacaaggtttcaccatgttggccaggctggtctcaaactcctgacctcaagtgatctgccctcctcggcctcccaaagtgttgggattacaggcgtgagccactgtgtctggcctgcacagtttcttctataatggagatgatattataatctctaaaaagaccttgtacagaaaagaaaattcatagtttgttaattccattgtaaattgttaattttccaataatgttctagtaattacatagtatttagtagacacttattagacatgtttgcctgtctgaaaaaataggacattcatttagcaagtattaattttacatactaatgcctaacaaaaacacttaagaaaaatggggctacagccccaattctttgcatctccttttgaaagcagaatttttctaaatggttatcgatatttgctgcctctaatttctctctttttatcacctcttaatctttcttcagacaagtttttctcccatgaatcctctactgaagcttgtcttttcaaagtcaccaatgacttacacttttcttttgtttttttgagacagattctcattctgtcacccaggctggactgcagtggcacgatctcggctcactgcaacttccacctcccgggttcaggtgattctcctgcctcagcctcccaagaagctcggattacaggcatgcgccaccacgcccagctaatttttgtatgtttttgtagacagggtttcaccatattggccaggctggtctcaaactcctggcctcaagcaatctgcctaccttggcctcccaaagggctgggagttcaggtgtgagccactgtgcctggcctgacctacacttttctaagcccattgctcgcttctcaggcaacatctgaggtgtgtgtcagtagcatccgacacagtgatgactgacttgtctctgaaacagcttctttacttggcttccagcacacaccctttctttattttcctcctcctcacttccttctgagactcctttgctggtcccgccttttccctctgacctcataatcttagtcctgttctcttccttactcaccttcttggtgatctcacctggtttcatagccttaaatatcatcagaagctgccaaatgtgcacctccagctcagatttctctcctgaactccagagctttatccagctgcctgcttcatatatcaaacttaacaagtccaaacttggacttctgttcttccctttgaagttggctccactcccagtctgcaccccatccgtcgatggtgactctattcaaaacctttcgagtctttctggactcctctttctttttttcttttttcacatccgaatcttgttggcttcctcttcaaaatatatcccacatccaaccacttctcactacctccgctgctaccaatctgttccaagccattgtcatctctctcttggatgatcacattcacttcctcacaagtctctccacttctacccttgccacactgtgggatttggtcagagagatgcttcagatgtgtaggttcatcgtatcacgcctctgctggaaaactcacaatagtgccctctttcattcagagtaaatacaagtccttacaaaggcctacaccactcagatgaccaactcttcattacctctttggcttcatctcctgctaacctcaccttcactcattccatgccagccacactggtctcctgactgttcctcaaacactccagctatgtctgttcctcaaatgccccagctatgtctgttccctcagacggggatactttcccccacagcacatgacccacccctcatcctcatcacctgttcactcagttctcaccttctcagcaaggcctcccctgctgcctagctgaaactgaacttgccttccctctccacagctggcactcctgatgccttaccctggtctaacatttccttttcccaaagcatttatcgcatgtaatatcctactgaaattacttacttattgtgtttatagtttgttttatgtcttctacctagaatgtaacctctataaagacagagatcttttgttgttgttgttcactgatgtattctaagcaccagatcaatgtctgccacatggtaggaaatcagtaaatatgcttgaataaatgaaagttcagaacttcagagacaggaacgacaaaaatgagaaaagtctataaaaatcatatctgtgggcccagcatgcgggctcatgcctataatccctgtgctttgggagcccgagacaggaagattgcttgagtccaggaatttgagaccagcctgggcaacatagtgagacctcatctctaccaaaaaataaaattaaattaaaataaaataaattaaaatacaaaagttagctgggctttgtggcatagcattgtagtcttagctacttgagaggctgaggtggtaggattgcttaagcccaggagtttgtggttagagggaactatgattgtgtcactgtactccagcctgagcaacagcaagaacttgtgtcaaaaaaaccgcactccccccaaaaaaaaacaaaacaaaacacatcatatctgtgttgattcagtgaatttaaaaggaattttttcacttacttcctgataacagaaataagcatatgactttgcaaatttacatattaaaagcacccatgacagtttattcacttcaactgttgtttttgaagaactcaataagtgccttttcttttcaacccttctttttttttttttttttttttttgataagcctccttttaaatactcaaaccatctgggtatttgtactctgaaggcatcagaaaggcatgtagctaaagcatagaactgatcaggtttcatggtcaaaacgacacctcaacatttattctgtatctttgaaggacaatacccatagctcccatctggagagtactcacagtgttcatagcactgggtagagggcttgaattcctatcacctgtgttttcagctgaaaacaagtgggattctgactcacaagttggcttgtgggtaaaaccattgactacagttggtccgggtctgatgaccactgtagctgttacaagtttgtactaatgcttctctttttgagacatttcaagtacttttctcagtattatgaggtagattacatgtacgaatgactcaacatttctgaggctgcttaagagtgttttctggtaagcctagccactacatcataggtgcatggtaaatgacaacatggtttgtatagaggttaaaaagggccattcatctcactgccctcattggaaggcctaaaatagtccaagatattttattctgtggttttcacctatgcccttttcccttgtcccaggaagacttaagtggatttgctgtaataactgtgttatgctatgatagatagaatctgtgttatgattaaatagttgacgtctgtttataaaaagtaacttttacaatttataatggaggttatattacttaaagtagttttatttgaagaaataaaaattcatcactcaatttcaatactagggcttgagattactgttgtatttttaaattcaaaccattagatgaatataattataggaatatgataacattgtaggaatttggggaagttttaaaaattacccataatttcatctaaccattatgatcatttgtacatatttcctgtcagtcatttcctaaatgcatgctgcttattcctataactgaaactaataccagtatcactggatggtaagttctttgagaatggggcccctttctgatgattctgtgtatacccgtagtttaacacagagcccagtagaggcagatgctagaaaaattattgcaaaagaatggattaataagcagatctgctgaggatctaaaacttaattaagtacaaccaatgctggattgattattttgttgattcacaagaagaggccaaagtcccaaccctcagcaaagatcagccattctatgacctcctcttctgctcagatctctaggggcagcacgggagaggaaggggacagtcaaatggtgatgtgttactctcctgctttgctcgaaaacgatagcagtaatttctcttacttctccattccttgtctgcagatcacctggccctagaatggccttatatctctgagatacagactgacgctaataaatgagttgctgatcctaaaataaaagtggaaatcaggtttggagtttgatgtaaaagctggagaggcacaggtttgttgctcatttagattacaaatgtcatcgaaaatagaaaccaaaaaggttaggtaatttctaaattaatcactcttagaataattaccatgtcacagcatctgtgtgctttggtagaatttgaataacacttttttgctcagaataatgttctattcttgtcaccaaataatacttgacgtctgtgctcttgtactcccgaactgcaggaagggtgttgccctgaacagctgacacaccctcagcaatgaagcttagttttgctggaacttttcaggtactaaaaaaaatccctttctctactccccattcattcacaggcatgagactggagctttattattttttctaaatctaaattgactgagtcaggcttgtagtagtcaccactaagaacagaccacagtagcatggagaatattacttgaatcttctttccatcggaaactggctgtgaaaagagtaggcccattaatcataatttgaaaaagcaagttacaaaggcttgctttgtaacttgtaaagcctcctttgatgaaggctttacaagctgtcattgcagtaagcagaactgaaacacttttttttttcgttgagcaaacacacctggtcattttggacatttccattttgatagcttaatgggtgggagaagattcctgggcttaaaaaataacttttcagcatttcatgtttctaagactgagactgaattaaaggaatgttaatctgtctccttttataccacaaacctacagaatttacacagagttttgtcaaaagtgacatgaactggttgtcactgtctggcagatagctcctcactatgacacaaaattgcctttatttgaaggccacacatgacataagtaaacaatggcagtgttttgtatattttttctgttactttaatgtatttcaatttcaattatgtgggtataaaacatgagttgtatttttaaactctgttacttgatgatgactactctttttctttctgtattaaaaagaaactcttttaactgtggtcaccattcagtgcaatgtattgtatatttcaaaattgctaaaagaatagctttctaacatcctcaccacaaaaaaattggtaagttgatgaggtgatggatatgttaattagcttgattgactctttctacaatgtattcatagatcaaacaatcacattgtaccccataaatatacacaatttttgtcaattaaaaataaataagaaactattctagcttaagagccttatgtattctaaaaatgaacaatcaaaatgcagagactgctattggtcccctaatatgtgttcttttcttccatagtgatagaacccctgatttttttctttttttttgtcgagacggagtctcgctctgtcgcccaggctggagtgcagtggcgctatctcggttcactgcaagctccgcctcctgggttcacgccattctcctgcctcagcctcctgagtagctgggactacaggtgcccgccaccaggcccagctaattttttgtatttttagtagggatggggtttcaccatgttagccaggatggtctcgatctcctgacctcgtgatctgcccgcctcggcctcccaaagtgctgggattacaggcgtgagccactgtgcccggccgaacccctgagttttaagctaggcatgtagctgttcagaaaaaaaaaaagcagctgttttccaatttcccttgcaaagtactaatggaagtatatggcaacttctctgtcctgttgcctccaatatggacatgcaagcaggagctctggctgccatcttggaccatgaagacaagggtaacagtgcagatgagtggacagaaatgtaataagcttgtctacctctgcagctttgtatgaaagataaactgtcttgtttaaatgactgttcttttgtgtctatgtttctcaaaatgaaaaataatcttaatgtatacaatcacgaataatggaaaagatagattttatctgacatgaagaaaccaacatactgtagcagacacctattggcttatctgccaacactctttttcagaattaactgactctgtactagtgtctaggtggttatagtgggagtttccaaactcaagaacatgaccccatttttggttaaaggataatcttgaccctggctgggccagtcaaaatctttccccaggtacttgaaaataagacggagaaaaagagagcttagtttttttgagccgtaagactgtaatagtaaatatctgagctattggtagctgtatttgccaccatgttgggagaagtagcagaaaccaggttgtgatataaaaaaaaaaaatgaatcagagtcgaagagagaagcaaagatttagagacagaagagagaaaccattcctaggttcctccatagtcctccagtgcctggttgtgtgggaactgttgctcacttaacttaacaatcactcttcatttcttttttgaggcagagtctcgctctgtcacccaggctggaatgcaatggcatgctctcggctcactgcaacctctgcctcccaggttcaagccactctccttcctcagcctcccaagtagctgagattacaaatgtgcaccaccatacccagctaatttttgtatttttagtagagacggggtttcaccatgttggccaggctgatctcaaactcctggtctcaagtgatctgcctgtctcagcctcccaaagtgctgggattccaggtgtgagccaccatgcccggcccactcttcatttcttaatgttgatgtttttctggatccatccatccttagagagggttgcagactggtccaagacactatgtgcatggcaatgccctggcaactgtattgatccagtgatggacatgtgacctaaattggcccaatcatctgattgaagatttgtattccattcctaggggagaaattagtcttatgctggacgtgaacaaggaagtgcatagttctgattgccattgtcagctttcttgccatcatgaacgtgaccatgcttgtttgagggcaacactgaagatggcagcaagaattctaaaaagcctggacctctgatggcagttttgagtccaccttggcactcaagccaatatattagatagtaaatgacccattatagaagccaggggtcgccaaactttatctgtaagggccagagagtaaatattttaagattgctggccgtaaggtctttgtcacaactagtcaagtcctctgttttgctctaaagcagtactagacaatacatatatgaatggatgtgaatgtgtcccagtaaaacaagtagctaatctacaggctatcatttgccaacccgtgttataagccagtttaagtctgagttttcatgacttgttgccaaaactagcagatacgatacactggttcttgctcattttcggggtccggctgcatctagctcttagagtatatgaggaactccagtgttcacggctgctgggcaagatatttaacaaagagtagagcataaacaccaaccaaccataaacatgtaggataaccatgctggggtgaatcagctaaatatcactctgctgttatccctccaacaagtcctctttgttagttaaactagtcagagtttatttctgttatttttaaacaaaggcatccttccctgttctttttagattttctttttgggtactactttaatcatttcacttatttttttggttaaaatgctgatcagttttatatctttcttcttttgggttctccatttctttagttcagtaatttcaaggccaggatggcattactgattctttttaaaaacgggtatctgggccaggtgtggtggctcacacctatgatcccagaactctgggaggctgaggtggaaagatgacttaaggccaggagtttgagaccagcctgaacaacacagtgaaaccccatctctacaaaaaaaaaattttttttaattacctaggcatgatggtacacacctgtagtcccagcttttcaggaggctgacacacgaggatcacttgagcacaggagttggaggctacagtgagccatgattgtgtcactgcactccagcctgggcaacagagtgagaccctgtctcaacaacaacaataacaaaatgggtatgtgaaaacttttcccgataatgaatctctgcagaccttatgatcaaaaacacaagctaccacttgacaggatgaggtgtgagcataacataccagaaagattttagcatacatgccacagttcagaaatccaatgtgttttgtgaaatgaagtcacaactgggactcatatcccagtaatgctgccatttctcaaaatatctttagaattcctccaatctcctcactttattttaacatctgatattgataaagatatatcacatcgtcatcaggcttggctctggatagagtcctaccatttcaaaaaaaaaaaaaatagatctctcttttttttttttttttgagacggagtttcattcttgttgcccaggctgcagtgcaatggtgcgatctcggctcactgcaaccttcgcctcctgagttcaagcgagtctcctgcctcagcctcctgagtagctgggattacaggcatgtgccaccacacccagctaattttgtatttttagtagagatgggtttctccatgtttgtcaggctggtctcgaactccctacctcaggtgatccacccacctcggcctcccaaagtgctagaattataggcgtgagccaccgcacccagcctaaaaaatagatctatcttaatatttataaatcattgaatattttcccttccttcctttctcacataattcataggcacctagctatgccagtcacccttcaagatgctggcaagataaagtccttatcatcaatgtgttcatattttaatacgggagaaaataacaaaataagttataatataacctaaatttgtccaggcttcaccagtctatgagtgcaaatatggtcctcataagaaaaataacccagatttcacaggctttggcccacttacgtatataggaacttagcttcctgccagccttttcacagagactcccacactgacccctgaggcttctctagttcagctctcccctgttcatagctgctgctttcaagcctcaaggattccaggtatctggtacttcttcctcatctttttttttttttttacttttaaaacttttattaaatgatggaagaaaaaatactacttattatactagtttaaagcttttcaaaaaattctagaaaacattttacaggggagaaatcgctgcagtaggcagcctgactggcagccagtgtctctcgaatagcttatcgtagagaatgcttactgttttctaaactgatctgctgtaaaaaggaagaggctagtttaacccagtgagcaaatgtggagccaaaagacaggaagaaaatagggacagcagagtaacagacattttctactgaagctcagcaagctgccccctcttttggagtgaggggttaaaagaacataaatactctgctacagatagtggtccctggtcatcacacagcagcaacacaccccatgagggcagaagttttgtccattttcttcatgtcttcatcagacctagaagagtgcccgacacttactagctgctcaatacatatgtgaacgttgaatgaacaaatgtcaaaatagggttagtccttcaatccacatttcactgtgacccagttatcttctacgcagaaatggggagaatgactctccccttgctcattgcaacattttgttttctgcgtcccaatgcaaaggtatctgggcccctcttcttccaaaatccttgatgatcatagcccttttcaaattctgcatcagctcctttttgtaagaacagttttggtctttgagtaactgctgggaaacagacatacttgaaccccaagtatggcctaggctcaaacttaatctcctgacttaattaccagttagcatgataagagctatactagatgcacatacagggacatgggaaaggaacaaagaaactgcagacagcaggaaatcagagggaggaggacagatggtgtagaaagatgatggatgaaactctgcctgcttcgtgtttttgctttgtacttgctcccaccccccaatttttacttcataatctgattggaacttcctcttcctcattttgtaatttcctctttccaagtacatgataggtgctaattttgtttgttgactggctaacaaagagaattaagaccttagtggagtcccattgcctttcccctaatatttgcttttccatattgattgctctttggttgaactgggatatgaaatactggataatgagaacacaataaatcctcagttgttcaaatcaatcactactaatggacggcacacaatatcccaagcattgtgctagatggaaagccacacagattaataagggtgcagctctaaagaagcaaacagtgtagcaatagtgatgaagcatgccaagcagctagactgtaaggtagaaagagtcctgtggtgtactagaagatcacataacttgctataagaacacagagaacacagaggaagcaaagagaagtctagtttgtaggctctgggaaggttccatagacagctaggaagaataaacaagattttaaccagtggagatgtgtgagggaagcatgcagacagtggaagccccatgaacaaattccatctacaaagggacatatagatgcttccagtggtttctctcatcctttatcagttatgtggcagtctcttatgacataaccagtagaatagttatggcatgttttttagagtttgcattgaaggacagggtttcattgaacaatgctgctggcagtattttaaaagaaagattaaagtgtcacactgcatgtgactctgtctatctaattctgcatacaaagcagatggctgttaaatgtttgttccatccctggtattgtttgccttgtaaatgctaaagagagctgaaaccgagaattctaccacagtaaaggaatttttttgcctataatttgtttataacatattctgggctaacaggcaagctctctgctccctggggctatgctgtaagtgcacacacattccggaatgatcagccttttcctcgctgatgctaagagccccaaaatcaatacatacaatcatttatcactgacagattagcaatttctattgatttcttctgaaatgggaatttgcacactccacggagctttattcttttaataagcaactaggcaatcagttgtaatttcaggttttgaaatgctttggcaacagtttttatgaaacacacagaagaaaaacaagaaggggccctggatagtttcaaagtcttgcgaagatgtacagaagcgaatttcgattgcctgcctgtgccaacagtgtacctctgtcccctgaagcagatgctctgtcctttgccatgaatctaaggactactgttaatttgcaaacttccaaagtctggtgggcttcttgtctttcttccctttctaaaaaccattgtcaacctgggatacaatcttaggctgtacatcttcagagactagcaggcagcagtgtttggaggatccacttttaagcaggcttaacctagcgcttttcaaactctcctggggagccccttaaaatgtggattctgattctggggtggggtctcagattttacattttcaacaggctcccaggtgctacctgtggcaggactttaaactcttttccctgacagaattcctcttcaaggtagaaaggacaggtgtgagacaagggcagagtgctaggcactcaaaggccacttgatgacacagagccctgaacaaatgtcccacaaacaccagcaatagaaccaaaaaggagagtctgagctcttcactgataaagcttgttcatttttatgtgtatctctgaggcagtacgtgaatgggataatagaagaagggaaagaaaatcaatcattcattcctctgttctgtacatttgaatcccctactccataccaggcattttaggtgcaggaaatgtaaaatatagtaaaagtggtatagaaaagtctattttggaaatgcagatactgaaagcattcccctcaacctttttcttttggtcaggaaacttactccaagacaccctacacacaaggaatccagccgttcagcattcccagcagaacaacattatctatcattgttctttgtgttcagagatattctggcaaagatgttactattcctgtgtgtgagtttggcagaaagccctaagatgtgacctaatttccaaatagcttgtccttctggttagctgttattagtaaaacctgctgtagtttatgactctaccttatagacttcgggaaaatcatcaggaaagcaatggagatttcccacctgaattagcttgtgttaactagctaatctttttagaatagtagcttctgcccataatttaaagaaacgatgtagaaaccaatgcattatcttttctttctgggagaagagctcttaaaagcctggaagtggaagatcattaggtaatgtgttgttagctcaagaagagcacattgtggtatacttatagtcatactgtccagtggggagaatgtttatgtatggacctgtcttatcatcccttctaccctgagtggatcttgaaagttaaattataacattgcattatgcataaaggagaaggatgctttacagaaaagacatttaccaagctcttgagggaccattgtgtgctgatcaatgacagatggtgttcagctttcacaatgtaggagtgctaaaggatgtggggtcacagaaaagccgtggaaaatcctagagtaaaatatggtgcaagttgttgtcagtctggcacaagaagaggaggtaccgaggaaattgtaccaaacaccaagagaggaaaggaaactgaaatgaaaaatgatagtacttcaatttctgaaaaacaggcctgcccctaatttagctatgagatgttgggtaagttaccaatgtctctgggccttgctctactagtacaacagaggagagagaaattctagaagattttcaactcccctcctgctctgtaactctggttcgctatgtgctaaatgcaccttgaaataaacacttcctttgtgtgtgtgtgttgcgcggtggaatcctcactttacagaagaggaaactaaggttcagagagcttaggaacccaggccaagcttacacagctattaggaggcagagctagaacttgagcccagacaacctgacaccatagataatgcttttaagctttatgttgcctttatatgtctaagacttttatgggtaaagaaggaaggaatattttgtaactttcttagaaaatcaattgtcaggagatctcttaaaaaatttgttacataccttcttttagaattcttgacattgggccgggtgcggtgactcacacctgtaatcctagcactttggaggccaaggcaggtggatcacttgaggttgggagtccgagaccagcctggccaacatggtgaaaccctgtctctacaaaaaatacaaaaattagttgggcatggtggcgagcacctgtaatcccagctactcgggaggctgaggcaggagaactgcttgaaccagggaggcagaggtagtagtgagttgagatcacaccactgcactcccagcctgggtgacagagtgagactcggtctcaaaaaaaaaaaaaaaaaaaagaaagaattcttgacatattggagagtggagtttgatctgaataaaggaagctgttgtaactgacataataatttaaggtccaagaatttaagacatgagatgagaagcacatactttcctcctgccttactcagctcaattagttgcaggtgctgatacatttacttttcaggtttttgtctggccagttgagcccactatgttcaggccgggctgccgaaaagtagctgcacaagtgatggctagtgacaactagaattcatgttcctgtctcctaaacttgagatcctgggagtctagggaaacgctgggctgcaaatggcagcttctccacatcctcatccaacagtctcccatgcccatatgatgaggttctggcagagtttcctggtttgacagacattcctcctgaaactgaattctttattaaacaccatcctgcctggctggggctatgatacctctcagccctcggaggcagtgtgttaaagggcagttggggagtgccaacttcatcatttttgcatatctgtataccacttgtacatactgttatttacttatatttgtctttaaatggactcacttttgaaattaaataccttaattttttaaagaaaatgtcaagttttatagttaataagttttgtatctaggtctgtgattcatgttaattttctaaatggtgagaagtaaggattcaattttgtttttgcatactgatatccaattattcctgcactatttatcaaaaagactatcttttcttcactgaattgtctttgcaccttcttccctctctttgggagttaaattggaatttttgttcttcttaattgttagctagggagccaaaatatgagctgccatccacctgtcttcaaccaggactccttccaggagtacctcctgctgcccacccattagtttgaaatctaagtttgctaatacctttgaacattgtaatttagtctcttattggcttctctttggccactctgcttactaataaaaatcctcccttttcttgagagtttataagtactctggcactatctctgccaattcctcacattctctccttttctaccaacctgcctgtgatgccccaaaagttaaaacttacaaaataagtttgaaattttataaggggtggaatagggtagcaaaaggtttgaatttttgtggaggagaaagcaacgtcattaattattggcatgtcacaaatgagattcactatttaagggctcctgtggccaatatgttatttccgccataagattcctgttttggagtagccatgtatatactgtcacacatatatgtacatatacagacataaacacacaaacatacacagatacctggaaatattttgtgcttaacgatgactttccttctagttaatttacagatgtattttgtagacctgctatagggggcaaaattttaagttataggatcttagagacactaagggatcatctgggttggataggttgtcaactctgataaattggtggggatggcttggagcattgtattgaaaaggattgctaggctgagtttagctcagcagggaagacagctgtcattgattagtcatagactcccattgctgggggtggtggcatgtatatggtgtatgactaactctaagactaggccactcttttccaatgccataatctcttctacacttttcttgacagctgaattctactcattgtaggaattctttcagtaattgtgagcttactatttttcaggaatgctcattgctacgttgaacagctcttctacatgttcaagtctaaaatctatctcacagcaacgtctaatcatgtctcctaattctaccgtttagagccatacaaacccattttatacctattctacatcacagctcttcaattatcagaagacagccattttgtaacctcttctagataaaaaccaccatttctttcaattatttctcagatattgtggttcctgggtcttacatcatcctggatgttatttaatttttccttgctccctttcaggtgtgctacccaaaagggggcagagaatttcagataggatctgaccaagtaaaattaattgggactctttactattggcttccatgtactaatattaataagcttcagtctgcacctgaaacatgttactttgttatttcatattgagcttttgataaattaaaaaattctttctatatgaactatttgattcagctcttctctttcctcagtttatgtttgtatttgtaccttttgaactgcatcttaataatgattgccctttcttgagtacctatgagtacctatgtattttctttaatatctatgaagtaaatattctattctcattttgcagttgtgacaactgagattcagagatgtccaatctactcacataaatagtaagttgcagagcctggaatcaaacccagttccttctggctctaaagtctattctcttttggctactgatatggtgtaggatctgtgtctccacccagatctcatgttgaattgtaatccctaatgttggacgtggagcctcgtgggaggtggttggatcatggaggtggatttctcatgaatggtttagcaccatctccttcgtgctattctcctgatagagttctcatgaggtctgggtgtttaaaagtgtgtagcacctccctctcgccttcctcttgctctggttatgtaagatgttgctccccctttgccttccactaggattgtaaactttccaaggcctcctcaggagcagatgccactatggacagcttgcggaaccatgagccaattaaacctcctttcttataaattacccagtctcaggtatttctttacagcaatgcaagaatggactaatatagcaaccagatactcaatttagcaattctgaatactgagtccattatagaaaaaaaagaaaaggttgggggacataggtcatccttttgtcaatatgttcgttgtttttgggattgtgatgaagtcaagcattttgttttttaaaaataaataaaaaggaaatacagtttggcttgactagttctggtgaactcttactggttcttaggagtcacctttctaaagtgctcactagctgcttgcttaactattcaatctagaactttgctggggattgatggcaaatgtgtctgtctataattgctagaatccaagtttatggggatatttgtttatgtcctttgtctgatcctcgtcctatttcccataagatcccgtgggctgctcgcagtggttctaccctcatatctgcatgtttgttcagttctccattatggaagtggggtgggggaggggtttgccttcatttaaggtaagctaaatgctttcacaatatattcctgtttattctttggtttcctcccaatgttatttcttccatttccaatttgtaggtaaaaagcattaagcctctctcttaatggagggattaatggaatagaggcactcaataaagctccagtaatttctgttaagtggattctaaagtaaacacttttatggccccaacaacaacaaaagacagtgaatccacttactcaaaagcccacctagtattatatataagtcagtgaaatgcatttgggaactatctactctttcagatgatctgtgctgggaaatctctccattaataaaaataatagccaaacttgagtgctaataaatagggttaatacttagtgtctcaactagacctaagagtatatccattttaaaagttttgtttttttttttttaagtttctagcccatgacagactgacgtatctaaaaatcatagattaggtaaagaatgtgtgcaaattaaaatccatgcacagaaacctatgtgagaagaaggagcgttgtcatcgcagacgtttaactgggtaagagttatgaagtaagcacttaaaatccagctaaaagcctactctcggttgttttcatgctccccagtgctagaaagagagcctgtctgcgaaacaccagtaattgcacgttgtctgtgtgaaaggacattgaaagactcgataaattacaaggagggagggagctagctctcattgcaaacttgacctagcctagattagcaacccgggatttgactttccatgtgacccttcctctttgtagtcttcaaaagcaagcccgtacaaagcccggctccttccttccttctaactccctatcaggaagctccttcgcccctcaaatcccttcaggggctttgaaatcctgggctcccgagcccaagctgggcatgaatattcatcgggggcgtggccccgccagcgcgcagggctccaagcagctgcgactagcggaaagcgcgcgccagctgcacgcagggaaacagttctcattttgtgtgctcggctgactgcacgtccagcctcgggccagctcgagacggccacattgtgagtctgtgggaggggttctaccgagacgaatggacttttctgaggcagggcccaggagctgtaattcgaggggcctcagatctccctgccacccacctgccagggcaagtgaaattccactgagaaaaaatcaggcgtatctattctcttccaggagtttgtctcccttttaagaaacaaatgtcccttgtgtgaatgattggaggctttttatcctctggtggcgcctccttctttgcaattatctacaatggagactgtttcttctcccttcttagtgattacaactgctacttgcattctttttttactttcaagatcatgaaggcatgttgtctctatctttcctctccttcatcctttacttagtagtaccgatagcacttttaacttacgtctagttaaaagccagacatcctggattcagattctagcttgaccacttataagcgccatgaatgtggcaagttagccttttttgcatctgtttctttatctgcataaagcaataacaataccacctacctcatggtttttttcctgagaataaataattatatacagtcatgcattgcttaagatcagagaaatgtgtcactgggcgatcatgagtttgtgtgaacatcatagtgtgtacttacacagactcagatggtgtagccttctacacaccttggatatatggtatagcctattcctgctaggctacaaactcgtgcagcatgttatggtactgaatactgcaggcaattgtagcacactggtaagtatttatgtatctaaacacatctaaacatagaaaaagtacacagtaaaaatacagtattatactcttatgggaccacaatagtatattgactgaaatattgttatacagcacatgaccttataaaacatgtttgaatagcgcttggcatatagtaaccatttagtacatactagttattaatgttattattttgattggataggcctggttgaagatggctgagcgtaaaacagaatgcaagtcagctggagcacgtactactggaggcagagccccatgagaaggggccaagaacccgcacccatcaaaatcaagaagaaaggctgaacccggagagaaaagggaggtgagcctgcggagggagatgggatgcagcggagggaattggggtgcagcggagggaattggggtgcagcggagggaattggggtgcagcggagggaattgggatgcagctgagaggggagcgccagtggggaggttttgggagccaagccattagaggaaggatcacacaatgtccagaggtaatgaacacagaactttttagtttgtttttaggtcagagtctcatatcctggtctgcactcgatggattcttaaagcaattggaacctcaggctggtcctggagcaagagctggtcctttacttggggctctcaggttgagaagtttgagctctaggattctccactgaccacctctccctgtctttgctcacttcccatctttaaactcccattgaactggcatgctattcttagcatggcactcaggctcttgactccacccagtccttctagttatattggccatggtacctacgttcttgtgtctcctagcactgtctacctaccctctctccacaacacatattacacccccaatccaacccataattcccattggtttccaggtatgccagtcttcttacggtttcctaaacatgtcatagtagggaaaatgctacatgttcactacctcatttcaccttcctaggcagatgagaagacatctcccagtttctttttgcagctaggttgggacactgaccaaatttttgacaacaaaaaagtgagtggagggatatggcattctggttcaggaagactaagagggggtctgagttcttcatgcttattctcttttgtccatatgctaggatgtgcaaaactctaactcagtgggttgtaaaatggaagcaggctgggtcctgaatttctgttgcaggaaagctgaccaattggcataagacatatatatatatttttttaatgagcaaaagccactgagattatggggttttatttgttacctcagcctgtcctattctatcctaacagcacacataccatgctttttcttattttggcatctctatagttacattatgtcacttggaatgcctccctgcattcctaccctgcagcaaattgctactatccttggattctcctctgtgatcttatagcaccatgctcaggtttctggcctgagtgattagatgaatcttggcaccagtaaggaaaaagaaagggaggaagaggtgtacatttggcagagagaaagaactctgtatgtgcactatgtgtttgagaatgggacatccagggatatatggatctgaagctcaagagagaggtctgagctagagataggtagagggttgagagtcatgagcataggggaagaagtgggcaagattacccagcgaaagtatgtaaattaagataagagagtggaagatggaaaggtgaatcttagtggaacaccatcctttaaaggaaggcagaagaagcagagcccttataaatttcacagagtccccctaaggacattcagaattgagcgtgaaacctgggaaagcagaactagtttattgatcaacatttacaaatgtgaaacttaattttgaggaaaacagggtatactgcaattgaagctgttgagtagacccaaaaatgcctttgaaggtggaattgctcacctttgttactgagaaaactcccgggcaaaagtttagttttgatcatgttaaaggtaaattaaaagctgaccttggcttttatattcctggctttcctcaacctgaagtcttctgacttctctgaacctaaaggaatgagaaagttgcaaggatttgtaaccggctattggaattaattgtgctcactagcctatattttgttttgcttttttctccatgtgtttgctttttggatgtaattcttaaattgtctaaatggtcaccttttgttgttgttattctttaaatggtacctggacagctatgatgggtcaagagagagaattgctttatactacaaggctatcagaagatcactgaggttgtagtgagccgatatcgctccactgcactccagcctgggcgacagtgagactgtcgtgaggaagggaatgtgataatccaagagagagatgacaatggattggaacacagtggcagcagtggaggtagtgagaagtggttggatgcaggatatattttgaagaggaagccaataagattcggatgtgagaaaagaaaaaaaagtaagaggagtccagaaggactctaaaggttttgaatagagtcaccatcgactgagagagtgcagactgggagtggagctggcttcaaagggaagaacagaagtccaagtttggacttgttaagtttgatacatgaagcaggcatctggataaaggtctggagttcaaacgggcgtggtggctcacacttgtaatcccagcactttgggaggccgaggcaggcagatcacttgaggccaggagttcgagaccagctggccaacatggcgaaaccccgtctctactaaaaatacaaaaattagctgggcgtggtggcaggtgcctgtaattccagctacttgggaggctgaggcaggagaatcacttgaacattggaggcagaggttgcagtgagccgagattgtgccactgcactccagcctgggtgacagtgtgggactccatctcaaaaaaaaaaaaaaaaaaaaaaaagaggtctggagttcaggagagaagtctgagctggaggtgcacatttggcagcttctggtgatatttaatgatttaatgctatgaaaccaggtgagatcaccaagagggtgaataaggaagaaaaggtgcccgagggctgagccctggggccctccaagattatgaggtcagagagaaaaggctggaccagggaagcagtctaagaaggaatgcctagtgaataggaggaaaatgaagaaagggtttgtgctggaagccaagtaaagaaacaaattcagaggaaagggagtcatcactgtgtcggatgctactgacacacacctcagatgtgacctgagaactgagaaatggacttagaaaagcgtaggtcaagccgggcaaggtggctcacacctggaatcccagccctttgggaggccaaggtgggcagactgcttgaggccaggagttcaagaccagcctggccaacatggcaaaaccccatctctacaaaagcatacaaaaattagctggacgtcttggcgtgacaaaaattagctggacttcttggcgtgcgcctgtaatctcagcttcttgggaggctgaggcaagagaatcgcttgaacctgggaagtggaggtggaagtgagctgagattgtaccactgcactccagcctgggcgacagattgagactccatctcaataataataataataacaataacaataactgaggttcttataacactaatattattcaacatctacagtctcagagattctaggtccagatcgttggactgtctctcattcagaagtataactcctttgaaataaggtccttgtgaaaaagggatggtttctctttgatatggagatacggatgttgtcaactattacagtctcatataaaatgccaatgcactgtgctggtttaatgtagtttttagttggaaagtgagaatccccaaatgcatttttggtagccagctctgttgcaaatgatgccactggatgtagcattaagtaacttaactcttaaactttgggcatattcaagtgcatagtacatctgccctcaatcttgggagtctgtcgtaaaatgcagtcacagggtatatgatataccactctccagtatgtggtgtatttgctgaatattatgtatcagaagctcagagagagaaagaaagagagagagagcagacaatttagaaagcccagcctgctctgcgtcaagggcactgctccagagttaaatctgcttgtgagctaccaaacagcatttttctcatactgaaaaaaactatccttgtaatctgcagtttgaatgacctgttcctgtgtttattcattactttagatcatcaagtcagtggaaactttacacgacctctgactgatgctctgctgttcctagtggaatcattgtcataactagcattttgtttgtggctttgtacctgagtgcccattttggaccactcatgatgttaggggcttatatcacatctttactttgcacatcaactctatgagacagtcattatcattttcattttagaggcgaggaaactgagtcttgaagaggttaagttgcttcaggtcatggctggtgagtaatagagctagattcaaagccaggactgcctgcttccagagctcatgcccttccttgtgccatcttagagttcttcctatacaacttctcacttgaacttggaggcttctatttcttgagccaccctgtgagagagtttgatgagttcattttaaatgttctcatttgtgattcgagagaactgaaaattctctgaatttagacttcaaattccatttatcttagcattcctgcctcctcagctcctggcctcgtcgttggtgggccagttcattggtggctggtggatgcttgtgcctcgactcctgtcttggctgtgcttctaacatagagggtaacctgaggaggtcactcaaccagttcatgtctctcgttctccaaatatagtattaagagggcttgcctggactagccaattaggcactgtactgcatgttggaactatgaagcctattaattcagtcaattaacatttactgagtgcctgcagtgtgcagaaccctggggcaagtggaggcatggtattcctgacctgtggatgtactattctatatatttcgtttatttttgcacctctgtgtgactccacccaacccctaagaatactcttatccccacctacatgtttcttttcttttcttttttttttttttttttgagacagagtttcaccttgttgcccaggctggattgtaatggcacgatctcggctcactgcaacctctgcctccccggttcaagtgattctcctgcctcagcctcccaagtagctgggattacaggcatgcaacaccacgcctggctaattttgtatttttagtagagacagggtttctccatgttggtcaggctggtctcgaactcccgacctcaggtgatccgcccgcctcagcctcccaaagtgctgggattccaggggtgaaccacagtgtccagccacatgtttctttaatttctctctgtgccaggattcactcctgagtactttattatcctggcccactctgctttgcttgcagtgaaacagcatggtttcctcttggccttcaggaaatcctgttataattcaaccagttttgaaaatgacctctttctgctctactgagctggtaatgtttcactgggttagagtaggccaaggtcatgtacagttctatactattagcttagaggagcatacttttaaattttgatttcaaacatgtaacctgacttaacagtgggtcttcccacagtgggaccatgatagtggcaatagaactttcacgtgtttggggctctcagccaatgcatccatgagcctgagatagagcattcctgtgattcccaggtctgctcttccttggtcctctgtgccaacccatgaaaaaactgcatgctatgaccaaattcaggatcaagtttatcctgtctagagccagctctccaaaggtgaaattttaccttattcctttgaatctattttcttgtatttttattttgggatcttttagtaacaaggcagcttcccgagattctgttgtgagcagttctggagtcgatgggtatttttacataggtgtacatttgcttctatttgtgtgtgtgtttgtgacctaccagaggaaagagcctccatttgcctggaagcctgggatgatttaatctctactatttgggttgcattaattaaatggggtggatgtttcaaatacttagctatcttagagatacaaagggaaggtctttgaagaatctgtaccgtagtgaaagatacgtaaatagtgtgtgctgagaagaacgaacagccctgtgggccaggaacaaaactactgaaaagaattggtgaaggattcatcagctttctaggaaaagggcagcatgggtctttattcttcactttgtcaagtttgagtcatgcccatttcataaagtatttggcctgtgctaagtgtggttcaaaatgtgatatccttgtttgatatcacaaggtgacatgaagcggtggattaaagggaagaaaactaccattttagaaaaacaacagcaattgaacacctgaacgtacaaaaaaaaatgagattactattcatctctggaaaccaagtttcatcagaaataagaaaacggaatacaatttgagacaagttcttggctgttgggctactttcaagattccttgactatcagagctctataggggatccaaatgtagccttaagggttttgtcttgtctgttaaattaattcacctgacggccgggccagtggctcaggcctataatcccagcactttgggaggccaaggcgggcggatcacctgagtcaggagtttgagaccagcctggccaacatggtgagaccctgtctctactaaaaatacaaaattagttgggcgtggtggcacgcttgtaatcccagctactcgggaggctgaggcaggagaattgtttgaatccgggaggtgaaggttgcagtgagccgagatcatgcctctacactctagcctgggcgacagagcaagaccctgtctaaaaaaaaaaagcatggtggcttatgcctgtaatcccagcactttgggaggccaaggcaggtggatcactggaggtcaggagttctagaccaacctggccaacatggtgagaccccatctccactaaaaatacagaagttagccaggcatggtggtgggtgcctgtaatcccagctacttgggaggctgaggcagaagaatcacttgaacctgggaggtggaggtggcagtgagccgagattgtggcactgcactccagcctgggtgacagagcaagactctgtctcaaaaaaaaaaaaaaaaaaaattaatttacctgacaacatgtaggtatgaaagatcaaagccagttgggagggctatacaggccggggacctattcatgttttctgagagtgggatcacttttttttttttgagacagattcttgttctgtcacccaggctggagtgcaatggcatgatcttggctcactgcagcctctgcctcctgggttcaagcgattctcctgcctcagcctcccaagtagctgggactataggcacatgccaccaagcccagctaattttttgtatttttagtagagacagggtttcaccgtgttagccgggatggtctcgatcttctgacctcgtgatccgcccgcctcagcctcccaaagtgctgagattacaggcgtgagccaccgtgcccagcctgggatcactttttaaaaacagcttttcatggtgatgactaacatgacagaaagtacgctatcacaaacaataatcctaaaccaagttgttggatgaggttcattagctttacttttttgactatgattatctgagatgcagttgactttaagaatggccactactgaaattcatcctgcacagcaagattttctttaggtttcctttagaaacatcatggctccctaccttttatttctagcattaactttggaggcgcttttactcctctaggagtgcagccaagctgaccttctcaaccctgaatcctgttatttatggaatcagtgattctattcattattaattcacagtaggtctggcttcacactaattttagaagctctttcctcttgttaccaggcaaaacaacaaatggcctggtttgccttttaggaggtaagaaaccaaaagtactcagatatgaccttttaagatttgtgctaatctcgaaggcttgagatctttcttggaaacatagtgaagaggtccatgattgttttctaagattatcactcaattgaacatatattaaaactccctggaatcagaaaaaaataccatgacaagtatcttcaatattgagtcaagaatgctttttagggccaaggtgctgccatttccagatggcaccttcagaatttctttcaatttagcattactaacattttgctgctttgattgaagcaatggtaaagcaacttgaagaaatggtaaagcaattcaatgtaaataaatacaaatgctgttaaatgttcattttttgaagttgctagctttgtgctctttgatttaaaggaaggttatgatctcaaacctggatgaaatatcctgtgtgaagccagtttttcccatacacaattgcaaatattaggccctataattttttttttctcaagatggagtcttgctctgtcacccaggcttgaatgcagtggcgcgatctcggctcactgcaacctccgcctcctgagttcaagcaattctcctgcctcaacctcccgagtagctgggattacaggcgcccaccaccaaacccagctaatttttgtatttttagtagagacagagtttcaccatgttggccaggctggtctcaaattcctgatctcctgatctgcccacctcagcctcctaaagtgttgggattacaggcatgagccactgcgcccagcctggtccctgtaatttaacccctttactgtattaaagcaaataattaaggatgtatgcaaagatttagttacaagttgatactggcaaaaatgggaagtaaactaaatgttcaactttaggagaatagttaaacaaataacggcacatgcatacattaaaattcttctagctacttgaaaagatgttgtagaggaatattcaatgacatgataagatgacaagatgtaccgactaaaagatgcagtttacaaaataatatagataacattagtttttaaccctttttgggtcacatacctcttcgagaatctgaataaaaatgcgcatttaccttgggcttcctagctccccatctttacccccaggaaagttgtgtgctgttacttgattcatgtagattcttacttgagaatggaatcaacacctgaagaattagctgtactgtattatttaacattttatttataacctttcagcaattttcataatcagcattatccagtcagagatgtcttccgaatcaggtcccaggctctgacagccatgtttttttttaagatagatgatttgtagtacctctccaaattgtttcacaatttggaatcttccggtccttgcctattcactattgtaattttacagcagactacgtcagcaatagcaattagaagacttagaagctctattctagcgctgtttccaaaagaagtatctaaaggctctgtttctaaggactttattgttctggtttttttttgggtgtgcatggccaagatagtatttaaattttggctatgaaccaacaggaatctctatggctatcactgggattggggtacaggaaagccaaaactcttaagagggatatttctcttttataaagttattccatgataggtatgtgcttcttaagccttcctgatgaaccacatctaataagttctctaaattttcaagtataaaaatctaatttccttatcatttagcaaaccatatttaaattaaatgatagcttaaaaattaaaatgtagacaattttttttgtttgagaaagaaaaccttttgtgaatcttaaataaatgtttttccagtttctagtcattaaatttcttaggaatgattttcaaccaggatgctgtatttcaattaaaacaaactgggctaaatgcagttagatatcctggaacagaaagaggacattagcggaaaaactagtgatatccaaagtctgtggtttagttattagaaatgcaccagtgttaatttcttagttttgacaaatgtaccaaggttaagtaagatgttaatattaagagaaactgagtgaaggatttacaggaattctctgtacaaattattttataatttttctataaatttaaaattattccaaagtaaaacattcattaaaatgtaaagcaaatcgggacatagatttcaggcaccagaattgaactaattattacagttgatcattaagtttagtgccaatcttagaaattaagataatgaggggtgtgaatagattgtatggttcttataagaaaaaataatagattcattaccttcacttgaagttataaaattttccaggttaaaattttagaaggaatttactgcatagatgcttatataagaaatcatgagtaacttaaacggtgatatgttcaattactatttaattaaaaaacaaatttttttaaaaaaaacttttaagttcaggggtacatgtgcaagatgtgcagttttgttacataagtaaacttgcgtcatgggggtttgttgtacaggttatttcatcacccaggtattatgcgtagtatccattagttatttttcctgatcctccccttcctcctacctgctaccctctaataggtcccagtgtgtgttgttctcctgtatgtgtctatgtattctcatcatttagctcccaattataagtgagaacatgtggtatttagttttctgttactgtgttagtttgctaaggataatagccaccagttccatccatctccctgccaaggatatgatctcattctttttcatggctgcatagtattgcatggtgtatatgtaccacattttctttatccagtctatcattgatgggcatttaagttgatttcatatctttgctattgtgaatagtgctgcagtgaacatatgtgtgcatgtgtctttatactatgtaatagacaatagaacaatttaatatacctttcagtatatactcagtaatgggattgctgagtcaaatggtatttctgtccttaggtctttgaggaattgccacactgtcttccacagtggttgaactaatttacagtcccaccaacagtgtgttcgtttttctccacaacctcaccagtatctgttattttttgactttttaatgatagtaattctaactggtgtgaggtgatatctcattgtggttttgatttgcatttctctaatgattagtgatgttgagcttttttaaatatgcttgttggctgcatgtatgtcttttttttgagaagtgtctgttcatgtcctttgcccactttttaatgaggtttttttttcttgtaaatttgtttaagttccttatagatgctggatattagacctttgacagatgcatagtttgcaaaaatgttctcccattctgtaggttgtctgtttactctgttgatagtttcttttgctgtgcagaagctctgtagtttaattagatcccatttgtcaatgtttgcttttgttgaaattgcttttggcaccttcatcatgaaatctttgctcatgcctgtgtcctgaatggtattgcctaggttgtcttccagtgttcttatagttttaggttttatatttaagtctttaatctatcttgagttaatttttgtatatgatgtaaggaaggggtccagtttcaattttctgcatatggctagcctgttatcccagcagcatttattgaatggagaatcctttccttattggttttttttgagtcaagtttattgaaaatcagatagttgtagttgtgtggtcatatttctgggttctgtattccattctgttggtctatgtgtctgttcttctaccagtaccatgctgttttggttactgtagccctgtagtagtttgaagtgggtagtgtgatgcttctagctttgttctttttgcttagaattaccttggctattcaggctctttttttgttccatatgaattttaaaacagttttttctacagtttagaacagtctttaaaaatggttctgtgaagaatgtcaatggtagtttaaaagaaatagcattgaatctataaattgctttgggcagtatggcccttttaatgatattgattcttcctatccatgagtatggaaggtttttccatttatttgtgtcatctgtaatttctttgagcagtggtttgtaattctccttgtggagatctttcaattcccttgttagctgtattcctaggtattttattccttttatggcaatcatgaatgaaagtttgtttgtgatttggctcttggcttgactgttgttggtatatgggaatgctagcagtttttgcacatcgattttgtatcctgagactttgctgaagttgcttatgagcttaagaagcttttgggctgagacgatggggttttctagatctaggatcatgtcatctgcaaacagggatagtttgacttcctgtcttcatatttgaatgcctttttatttatttcttttgcttgattgctctggccagaacttccaatactatgttgaataggagtggtgatagagggcattcttgtcttgtgccagttttcaaggggaatgcttctgccttttgcccattgaatgtgatgttggctgtgtgtttgttatatatggctcttattattttgagatatgttccttcaatacctagtttattgagagtttttaatatgaagggatgttttattaaaaacctttctgcatctattgagataatcgtgtggtttttgtctttagttctgtttgtgtgatgaatcacatttgttgatttgcatatgttgaaccaaccttgcctcccaaggataaagcctacttgatcgtagtggataagctttgaaaacaaatgatgttaaatagatttttaaaaaattaatcttccaaatgtcaagtacctaacttaaaaaaaaaactcacccattattttggcagagggggttgggagaactaagacaatatgccctaggtatattgcttttcaattatcttagctgagaagttagaaatatagaaagttaggattattgtttggagaacctaaatgaatgaaactaatatatccttcaggctgtgtctcttaactaaaaggtatcacagcttaatcagggaggggtcataaacttagtgttgattcaaggggcactgataagctttaggaagggcaataaaactgacaaagatgtattaatttaggaaacttacaggtggtgggtcatccctcttctaccccaagataggcttcatgagtcctattaaaataactttatttttatcccaaaatgaatttttgaatctgcttaaataattgaagcaagctaatgattgtgagttctgcaccaatttgtatgtaacaggtgattttggctgagaagtttttgtaactattgccagtcaactacccagaccatgaacaaacaaacaaacaaataagcacttaatgtgttcttgtagaataaggactaaacttaaatcctgcaaaggctcagtaactcctctgtggtggagaatgctagctgtctgccagaatcagtgcttctatttcccaggctcctttggagtttgggaggaattgatttgggcaactttcatcctatttacttaagagtcatctctggccctggactgtcctctttccctttctggatagctggaatagagcagccctgggagatgcatgttgaagatagcaagagacactgtctgtaccagctctcaaaggactatgtggctcagagctgtctgccaaccctgagcgagtcatctaagaccaaaatatgacagaggcaaccttctgcattctctgagttagtgggtcttccatcacagctacttagcccactttgtctaatgtaccttcaaaaaacagggattctggcaaattgtgctggggagtatgacttggacctatgatctcccatctttgaccctaaatctctgctttaggactcacaaagtccagtgtgtctttgggcacatgcctaagcctgcagcacagattccaactaacccagccacctgcgtggaggcaaagtccatctcactccccaggtcaaggctgaacagggcagggaagagaatggttggcctccccttgtgagaggaccttgctggttttgctcctatatggataaatgaagcacaggggtggacaagaagaatttgaactagataggctggagcctgttcctcctattatgagacatgtaatccaccatagataagagtggggcttagtcagtgttaagctctggccaactggttcagcccttcctcccttgaggagcaacagcaagtagttagggagaaaacatggagattccctctccatcattccccagaagggaggacacagaagctctatagaaaagacctggtatagggaagtgtatattgattagggtgggagaaggggtagagaaaatcttccctttactcaaacaagtcagctatcaaatgtgctttccgagttgatctgttgaatgagcctaattggtggcatccacatcaatattagagaatgtttgccaaatatgagaattttggtttcactgtttggtaatcctggcctttttgagacacaccctgtgggagaggacacagaagcattggataatagatgcaaaggtaatgaatccccaggaaacagaatctcagtcacaccctgttctttcccatgtcctgtgacaggttcctgggtgactcacaggcaggcccaccctaacatttgtggggtttgagagaaaagtatcaacagttattcaaatgttttgaatcaagctaacaaattataaaatatgtgctattctttgaaccatgaattggaatatttagaaaaagcaagaaaattgcctctgaacactactgcaaagcaatctttaatgcaatagtctattccattcatggtacctgaggaaaggttgggcaagttgtcttctcttgtgttttagccactcaaacccataaaacctctgcagcagtgtccatctctgaagtccacagcagcaagatccacatctctgatggcatttggatgtgaggcaagagatgtggggaacatttccctgaagcctgaacagagaaggtcaggagatctgatgtttagggtcagggtctcagttgcaagagctgagggacaaagctgtccatgtgttctttaacattatgtcttttttgtgtttgtgacatgtggagtcctccaaagcatggtcccctcttgcctgggcctaagggcagtatgtcttgcacattctttttggacgcttacttggaagatttcttgcagttgtgaatggagccactcctgctctgctgtctgagactgtatatgctgctctgagagtgagctttcttcctaaggattctttcattagcatcctgaatggagggcgttgtcttttctagttcctgatagccctctttctagggaacaggggacaacagccccagagttagctcaggggctatttgggcagcattatcctttgtattatctggaagcatccttccacaccaacagtcggccagagcacccaggcagaatctaggcatccaagttctcgaccgcttccccaacttcccttcagtcccacatatttctttttcattcttttccttcagggctgactgagtcctccagcaaatacacagggctcctactctccaccccagtagccaaatacctgaactgggcctgcagattaccatggccccttccccatcccccatttccacagtttatgctcaactacattgtctccaaataatcagacaacaggtacaactgcttcataaagctgttgcaattccctagtgataaactcacatcagcaccagggaagatgcttgtctttctattcccaatggctggagggcatcaatctaaccctcccaatggttatggcaaataccaaatgctccccaatggggctatgtcctgataagtctatttaagttgaaaaaaaattaagtcaaaaatgcatttaatgcacggaacttactaaacatcatagcttagcctatcctacattaaaagtgctcagaacacttacattagcctatagttgtgcaaaatcgtttaacacaaagcctataatagtgctgagtatctcgtgaaatttattcaatactgtactgaaaatgaaaaacagaatggctgtatgtgcactcaaagtatgatttctactgaacgcatatggcttttccactatcccaaatgccaaaaaaaggaaattcctgcaagttggggactgtttataatttacacagatgtttaaaagaatgggagggactaacataggctctgctttacatcatttaaaatcgggatttccttttgtcaaaaggttatttctacctactctagatttgggcaagtacatttacacaggatttataggatttatagcccaaaatgtacaccatgattattcaggtgttttttgtttttgaactcaaagactaacctgcagaagacctgcagatactgagacaaagatgacactgtccttaaccacaactttcttgaaatgcagtagaacatgatcataagggcaacccatcatccttgagcctaaatgtagtatttaatatcattagactaggggtttgtccttgagtatgttgagaagaaagctgatgttcaattttgagggaaaaatagaagacttcactcgaaaattggtgagtaggatgactcctttttggagatggggttgattgtacttcagttttttcctgaggagtccatacatatgtaattaattaggatagttcagcaaggattgatatccaattagaatgctacattccaattttgaccatctcctggttcatttctgtatgtattttgcttttaaaataataattgagcaaaataataattgaacttggtatgttccaggcactatagtaggctctttcccaatgtaataacttacttattcctgaccaaaaaacttctgtaagataggtttaattgtgttcatttgacaggtgatggagctaaaggtagaagagggtagtcacgtgccaaaaatctcacaagtaacaaatctcagagctggaatttgagcttgcagctctatggtcccagaaccttttgcactaagtcatactgccttctacagtatttgcaaatacacaggtgcctggtctaaacaactcatgctaagggagttcaggtctggggtgatcaacagaagtttcactgcaaaggtaaactaggaggtgagagctagtcctgatattaggtaacacagatccatttgaatacaggaaaacatttgcttcccagaaagtctagcctgggtagaaactgccttggactgtgtcagaatgccaggtcctatggcatgttggtttcatgttcatgggtaaagttaggctggagttttgtttttaattcaggaatccaaaaaacgtcttttttctttttttttttttttctgtttaggtttatatttgcttctggggcaaagcactggaatgaatgtgatgcagctgagaaagaatagcagctttaatataagcctgctttttcctccctgccaggccaaaagtttcagcagaacactccagtgctctgattccattcagttacagctcctcaccattcagaagccaaaactcaagagacaagaattggtgggagcaaaagcaggtttatttggagggccagcaaactgagaagagggtagactagtatcctaaagcaccatcctaagtcagtacaaattttaggctctttttatgttaagaacatgggaaaaggaggaggtcaaaatcaagaggtaaccagtgatcacagacatctgcatgtcagtgagggtctgagaaggttgggaatttctttgtccttggtcagatcacaatgcttctataaacgtttaacaaaacatagttgtttacatacttctcctttaatcccagagttagtttaaaaaactacaggattgctgtttttgcatattatctcagtgttctaaaattatcctagcctacttgcaggaatgggtagaggccccttcaacaaaaatggagttagttttgttagttcttttgctgtttcattgttacacatttgctttgggcacacagctttggtccccctatcccctatttcaactctcctggggttctccatgtaacaaaacaccttacctgtgagttttatgtcaacagggaaacgtttagagaatagtatgtgttctacaacttttggcaacatgaacctttgtgagcaggacattaacatttccttttccatcattgttgaactaattttgtggtgcaaaatagaggggatgatgatgtcaccttggggatgagaagtggaactgtgaagcaagttcctcagggcctccacacacctgcctagctctccccacagggctctgcattcttggaaatgatcagaactttcactgaggttttttttttttttatgtttccttatatcacctcctgattttatatgtattccatgtttctttatagcatgtgaattaatcttattgtagagagaggaggtgcaatgtaacagttaaaaacagggaccattgtggaagacagtgtggcgattcctcaaagacctagagacagaaataccatttgacccagaaatcccattactgggtacatacctaaaggaatataaatcattctattctattataaagatacgtgcatgcatatgtttcttgtagcactgttcacagtagcaatgacatggagtcaacctaaatgtccatcaatgatagactggataaagaaaatgtggtacatatacaccatggaatactatgcagccataaaaaggaatgagatcatgccctttgcagggacatggatggagctggaagctattatcttcagcaaaagaatgcaggaacagaaaaccaaatactggatgttctcacgtgtaagtgggagttgaatgatgagaacacatggacacagggaggggaacaacagacactgggccctgccagagactgaaggagggagagcaacaggaagaatagctaatgcatgctgggctttacctaggtagttagatgatctgtgcaacaaaccaccatggcacacgtttacttatataacaaacctgcacatcctacacatgtgcccctgaacttaaaataaaagctggaaattagaaaaaaaaatgcagggattatggaggcaaccagatcatttctgtcattttctagttgtacggccttgggtaagttactcaatttctctgtaaatagtctataaaatggggaggtaattcctcccatccaggtttgctaagaggcttaaatgtaaaactgtatgccagcccttagcaaaatgcgtactacattgtaaatgctcaaaaagcggtagtgattattgttattggtttgtctttcatgtttctagtttcttggtgagagagtcatgactatttttttttcttcaacagcaagattgatgacaatgtctgtgtctacaccagcatttcctaattgccgatataggccatggaagcaaaatgttcttgcctttggttttcccctccctgccttgtttctgggtggtctttcccctctcccacttcatctcttcttccactccttaccctccaccaccagattcagtgtagagaatatgggcatgctgttaccagtgttcagcataattttaatggaaaaatgctattcttcataatcccacaatactaggctgcttctgttaaccaaaaactatttattgtatagaccaaaaaacatctggtgactgaattttctctattttttttcaatcagtcatgcaatatacacttaatacaactctgagactccttgataacaaactagcaaaaatgaggataaaacactttacagactaaaaattccatttaaatctttgtttttgatccaagcacatacaggggtaggaatgctgaatgttcaaaagagttgtttctatacccaagagaagtggcctggaagggagggagaggtcatcatcaatgaggtgtcattggcagtcacgctgacatggtctcagccatacttgctgattcccttggaagggtggctccactcggggcactgctcagggtctgggtcagctcacccccactctctattcctgctgtggctgtctgcacagccacgccatcagcccagccattcctcttcccttcccagagaattcatgctttcctggcacttagaagcggtggtagttctggaaaaggaagccaaagtgagatagagagtgtagagcccagtgtgggagtcactgcatgagtaagtctgggttcaagtctaggctctaatgcgtcctggctgggagcctctgagtaaataatttagcttcttgagccctactatctgtaaaacagtgcttcctttattcatcgttagatattgagtgagtacttactgcatgccagcactgttctaggtgctcactggtgctagggatgggggttaggggctatgggtatagagagtccagttttaaaataagtcagagaagaattcactgagaaggtgacatctgagtagacacttgaatgaagtgagggtctctgggggaagaatgttctgcaagaggtagctagtgcaaaggccctgtggtaggaaggagcctgatgtgctagaagcccagtgagggcgccagtgtggctagagcagttgagagaagcagacaatagcagcagatgggtcagctccctagccaaggtgtgtgaagccgtgtagtcctgggaaggattgggcttttacattgagataggatgggaagtcattggagggttgtgagccaaggacttatgttttgcaagggtcactctggttgctgtgttgagaatagaccataggcaagcctacccaggaagcagggaaacgggttaggaggctattgcctctgcgtgacaggtggtggagtggaccagggtgtagctgtggaggtggtgagaaaaggctgaattctggagatagcttgaaggaagaatgaatagcatttctgatggagtggatgtgggtgtgagagaaagaaaataggagaactcagaggtttttggcctgaacaattggaagaattgtgtagctattaactgagatgggaaagccgggggaggaagggatgggagatagatggagaacttgatgataataataattttgccctgcctccctcacaggactaaatgtgatgatttatgtgtaatttaccccgccaatatgctctgtggttactggtattcaaagggccctctccttcctatgcagaagcagtctgttccctggacatgctcctctctctcagtcctcaggtggtgccagttggtgggggagaatgttcctggcatgtggacttgaatctggcaggtatcatctgagctatgtttaggtggatattttgggataggtcctcacaaatgtgactcaagtatgacttaacagttaatatctttatttctccctaacagaatattgtttctaatttttcttttatatagcaactgatgttgccatgcagatcccttggttgctatgagatggtaacatcactctgccccaccattggccagtgcctcctcagctgcggtgcctcccaggctgtgtggttctcacgcgggccactgacacagagctgttactatggtgaactttacaatttcctttgattggtggatttcagaaataggccatcagcggaattcattatattcagctaagtaaaaatgaaaaataaatactataactttcccctcatcactaacatgaaggaaacgtgacccttcatgacataataaatcgctgttcggtaacttaggatccttcaggggactgaagcgggatgatcctcctatgccaaatttgggtgggaaagatattccctgtagctttgagtcgactcttcagagttaagggcagtgggccaaccagagttggaacttcagagttgggaggaggtgtgggatggggcatgcattgaaatgtaaactctattgtctctgaagtgatgggtgatgctgggggcctgagtgtggagggcagttttacatctcaggacaatgttttctcagatgctcttccagaaagaaaagccaggagtactcctggctggaggcggcatgcctgaggtcagagtcaaagtagggtttgtgctgtctgaatcctttctcccactctccccagcctggctcagcttctcagcttctcaggtggattggtgagtcctggccaattacgcttcagctcatctctactctcagcaaataggaaaagggagtgaaggactgagttttaactcttctaatttcgtaacctgactctctataagaaaaagtaggagaaagactgaagaacccgagagaacaggtgaattattttaagtgcatcagatctacctttctaacaagtcttgtttggagtgatgggggtgtgggtgggggaggggaggggaaggcccaggctaaagggaggaagagagtcagggaaccacaaaaacaaagcaggtaacagattggaagccctagggctagtgtttgacacccagactacatcagttttaaaacctctttgctctatataataaagctgtttttagtaataatcacaacatgaaatgaaaataatgatggccagaaatgttcttttatgaaattttgtgtcgtatcaataaaaactaaaaatacagtaaatgctacaatccaaaaaggaaagaaagttatagtataatatttttagtttcattagtgtattttttgaataaagggatgaaaacttatacctacatattggtctttcatgtcaggcctctgagcccaagccaagccatcgcatcccctgtgacttgcccgtatatatgcccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcatcttgcgactcccactcctgcccactgagcaccttgtgacccccactcctgcctgccagagaacaaaccccctttgactgtaattttcctttacctacccaaatcctataaaacggctccacccttatctccttttgctgactctcttttctgactcagcccgcctgcacccaggagattaaaagctttattgctcacacaaa

SEQ ID NO: 377 - DNA, 9317 bp, Homo sapiens
tcgcactttccacatgtgggtttttatttctagtccttcacattgaccatagaatcgcctgtggcttccaaacctgtcgtaagcagtttgttgttgctcttctgtatgtgattaagtggatttaccttttgtatactcatagctaccatctctgtttatcgttcatttagggtccttagacaaggtgcaagacaaacagaagagggcatgtggggtcaaactcgctagctgcctgcctgatttttctgcacacaggtgagatattcctgcacatcctctggtgaccccagaatgagggggactcgctggtgaattgcctcgggcttcacgtccagtacaggctgggtccccgtggtcgccaagcctcctgcctgctcaatgatgtaggccacgggattgcattcatacaggagccggagctgtggaggaacagaggcaggtgagtaaactctgcaagtggccaaatgtcccgagccatgcccctaaagctgggggaggagtttgtactgcggtgcttccatctggctagcatgagcgcaccatgcaccttgcaagagtgggcccgagctttagagcctacagcaggccagatgcatcagatggcactcatccagaagccttgggggcccctctggccaggtgactgagccatgtatctacccatcttgtgatccttgtgcttatgagagacctgcctcttgacttggaaatatgagatctaggcatctatttcttggttcaacaagaagcaaactgatgctgcaggccttggtggaagcctttatatgtgagacctcaaggctggtaaagagtcaagcttggatgggacagtaaggtcaccttgaccatgccggcttgtctctctggggacagccacagtggctgggattgtgtggaggaactccacatcttaagctttgacttgtctaactagtttgccggtgtttcaatggtcttgtcttttgacccttagactaagtgaaatcccatcgtttgcactcccatagcatcctgtacttcccctctggtaccactcatcacactgaggcctctttaatgcctggcttcctctctaggctgctgtccatcctagctggtcactgtactatctgtattctcagtagtgccgacacagagaaagtgttggctccggcctgtaatcccaggattttgggaggccgaggcaaaaggatcgcttgagtccaggcatttgagaccccatttgagatagtgagaccccatctctacaaaaaatttaaaaattaaccaggtgtggtagcgcacacctgtgatcccagctattcaggaagctgaagtgggaggatcaactgagccccggagttcaaggctgcggtgagctgtgatcatgctactgccctccagtctaggtgacagagcaagagcctgtctcaaaaacgaagaaagtgtccaagcaaggccactgtttcctgcacgaggggtcccagccgagggcagaaactgggttgaaatcagcctgtgccctgcttgccagtctctgcacaagatccagggctgctgttcagaggaaggaaggccttctctaaccctcctgcaggcacatgagaactggcaggaggctgcctgtgtcctgtgagtacgcagtgaattgaaatgaatggggttggattgaatggactttttaggtctatttctgtgatgatgtcatgacgcccccagcctgactcacaacacacacccccatcaccttagattcagggtgtcgttctggccgaggccctgctgctgtgcatgactcagtatcatcttcttctttctccccatcagtgcaacctgtgtaacttcccaaaagttcattctccattatcaccttacgaaatggttgacccagctatgtgcagcctttccttaccattcttttcttccagtccgttttggtgatatgtttaaactactttgagaaagagtcatatattatggtaatttttttctatttttctattatatatttatatgttattatatattatataatatatatttacatataatatgttatatatttatataatgttattatatattttttctattgtatatattatatatattaaggagaggaacatgatgcctttggtctaggctggagatccaggcattcgagagaaagtaggtgaagactccatgggggtatttactgccattttggtcagtgtaaggtgccctcaccctagacctctggctcttaaagtagtgggtgtccagaagggtgtaaaaaagttgtggtgcatgcgggctgtctgggggcagatagttctgtccctcattacccacaggagggacactggaggccatgctgtccaggacagtctagccaaggagactctcaccttgacagcttatagcgctcagcatttttctccccttttatgtgggggatttggggtatcagataataaagtctcagattgtaatcaattatcctgttgagtcaactactttaatcaaaaaaagctcagcattagtacctaatgcgcttgtcttggagccaagttacttttgttctgacctcagatgcccctgttgtaggaaatttaatatcaaaatgcccagggcttcatggcaccttggcctgcaggccatgtgacatgtgacctgtattttttttttttttttttttttttttttgagatggaatctcactctgtcacccaggctggagtgcagtggcgcgatctcggctcactgcaagctccgcctcccaggttcacgccattctcctgcctcagcctcccgagtagctggaaccacaggcacatgccaccacgcctggctaattattttttgtatttttagtagagacggggtttcactgtgttagccaggatggtctcgatcttctgacctcgtgatccacccgccttggcctcccaaagtactaggattacaggcgtgagccaccgcagccagccatgacctgtactttctctgcaattaaatctacacagctatacagatgcagacacacacaggataggagtgtgcacatgcacacacagacacacacacacagagagacgtcggcacagggaccatgacagcagaaatgcggagattaggatccaacagaactttcagtatgggtggtggttatgcgcagcaaacgcagatctatctatggagtgacatgtgcttaagggacatgagtatgtgatcccatgtgagtattttctgactcatttacgatcatttgaataattagtaataactgatctttatgttctccccaatgtaactgagtaagtgaccagagtggttctaagaatttccatgtcttcgccgggcgctgtgactcatacctgtaatcccagcactttgggaggccaaggcgggcggatcacgaggtcaggagatcgagaccatcctggctaacatggtgaaaccccgtctctactaaaaatacaaaaaattagccaggcgtggtggcgggcgcctgtagtcccagctactctgaggctgaggcaggagaatggtgtgaacctgggaggcggagcttgcagtgagcctagatggtgccactgcactccagcctgggcgacagagcaagactccatctcaaaaaaaaaaaaaaaaaaaaaaagaatgtccattgtccatgtcttctacttgcctcacttagtcctccatggtgcttagctttccttcagcaccacttctgcaggcttatcagtgttcttagttcagtgggtgaatacacctgggctaagcactcacatgaagagaaacacctgatacaccaacctattaaaatctctctggcttcatgtgctgtgtgagatctctcagcgtggctttgattcttagcattcgaataattcaaatctcaaggtgactctgagagacagaaaaatgtgtcgctggttgttggtgtgtcagagaaaacagaggcctttatttgatttgactacttacctacgatttctgtgattggctaaaattcagatgcatttttatgggaggttctctgcaagatagctggatcataaggttctcacttgataatacaagtattttaagttttgcatcattaagttgcaattagaccttccaggaactacctttccagatatattggctgagttctgagtagaagttcttattctgaggtttggaaattctctaggggatacttgggcggacttcagggcatcagtgaactccctcaacgtgtaatttgtatgtaatgtgtacgtttacatgcatttgttctgggaagtgtgttgataagttttattaggctccctatagggaccatcatcccagatcagctggtgctgaagctaaaagtcagatgcagcctgtggaaagtgagacacacagctggttcatggtgaacggtgggtgtgaggctggagggggtaagaccagtgagaatcaccagtcacataacgtcagcctgtcgccttcttcttcaaacctcccacagcctggagactcactcaagggaaacagagttcatttttcctcccctgcccatccccacacagacatgccatgaagcagtgcagtagccaaacagcaggtgtgacgggagggagctcccccacctccctgaccggatgcacagccagtggacaagggagaattaccttgcccttagggctcttctggttggctgggtacaggaagattcctccatagaccagggtgcggtgcacgtcagccaccatggagcccacatacctggccccatagggagcactgccatcctagaagacagaaagcgaagagacaagatccagtggctttcaggattagccagcacctgctcgtggtcacaagtccagttggtgtgacctctgccttcttgaatccctatcctccacccactagtgtaggaattgaaaagattatataattgtgcatttcatttattatgagctcctcaaaccttaccttgtgactggacttaacaaatgcaggactgcttaaagtatgagacaatatcctgcagcaatcttaaaagagccgctaaacaaacaaagaaaaaggaagtcacccatcccacatgcagtgccacctataggctcaaaataaagggatggaagccaaacatatagaaagcagaaaaaagcaggggctgcaatcctaatttcagacaaaatagactttaaaccaataaagttcaaaaaagacgaaaaggacattacataatggtaaagggctcaattcaacaagaagacttaactatcctaaataatatgcacctaacacaggggcacccagattcataaagcaagtccttagagaccttcaaagagacttagacacccccccacaataatagtggcagacttcaacacctcactgacagtaatcactgaagcagaaaattaacgaagatactcaagacctcgaatcaacactagaccaaatggatctgttagacatctatagaactctccacccaaaaccagaaaaatatacattcttctcatcacacacagcacatacagtaaaattggaacacacaatcagacgtaaaacaatcctcagcaaatgcaaaagaactgaactcataccaaccactctccaaccacggccatctcattactgggtatatacccaaaggaatagaaatcattctattgtaaagacacatgcacatgtatgttcactgcaacactattcacaatagcaaagatatggaatcaacctaaatgcccatcagtggtagactggataaagaaatgtgctacatatacacaatggaatactatgcagccataaagaagaatgagatcatgtttttgcaggaacatgggtggagctgaaggcctaattatcttaagtaaactaacacggaaataggaaaccaaatgccacatgttctcacttataagtaggagctaaatgatgagaacacatggacacaaagagggaaacaacagacactggggcctacgtgagggtggagggagggaggagggggaggagcagaaaagataagtattggataccaggtttagtacctgggagacaaacaatctatacagcaaacccccatgacaggagtttacttatataacaaacctgcacaactacccctgaatctaaaataaaagtgtagaaaataaaattacacctgcatcataggaatatgttatagtgttctgaaccactgtaggatgaatatatttaacaataatatatgacatattttcaaaaagctagaaggaggatattgaatgttcccaacacaaagaaataataaatgtctgagatgatggatttcctaattatactgatctgatcactgtatattatatataatgaaacatcagtatgtatcccataaatatgtacaattattatatgtcaattaaaaataaaacaatgggtctggcatggtggttcacgcctgtaatcccagcattttgggaggccaaggcaggtggatcacctgtggtcaggcgttcaagaccagcctgaccaacatggtgaaatcccatctctactaaaaatacaaaatattagctgggcatggtggcgggaggctgtaatcccagctactcgggaggctgaggcaggagaatcgcttgaaccagggaggcggaggttgcagtgagctaagatcgtgccacttcagcctggagacagagcaagactccacctcaaaaaaaaaaaaaaaaaagatgttcccagtggggtttttgagggtggagtatcttacacatgaattttgtttacattttcttatattttttgttgtctttatgtgatgtgttacacaggaacacaatttttatatttggggaaaacattaagtcataaaatcaaaacatttaaatacagaaagaatctttcagcagacacacagtgaactatcaggaactagagatggaacccatattcctaagctcctagttttttagcccagaaggacttgacataacagagacaggtgtttctactctaacttacctttgctctataaagaaaagctacgagaaatctctcagttaaagatataggtagatagatgatagatagatagatagaaaatagatacatagatgatagatagatagatagatgatagataggtgagagtgagggagggagcgagggcaggagggagggataactatagatgctcgtaacttgggggaggagagcaagggcctctgaaggtgtaggatacaatttgcccttgactaattacacccattcatttttacaacattggggagaaacatccttggcccacatctgcttattttgagagtgttctgagaaagccacagttttagcagaaaaagcccaggaaagttcaccgtagagttcttctccaccacatgaatgctcctgcttaatcttctcatcaaacaatggcaattttgcaagagttttgatggaaaatcactataatcctgatttagctccttttgacttctttttgtttcctaatcttaaaaaacctttaaagggcactgttgggaacaggccccccaaaacctggccataaactggccccaaaactggccataaacaaagtctctgcagcactgtgacatgttcatgatggtcttaatgcccacgctggaaggttttgggtttaccggaatgagggcaaggaacacctggcccgcccagggtggaaaaccgcttaaaggcattcttaagccacaaacaatagcacgagtgatctgtgccttaaggacatgctcctgctgcagttaaccagcccaacctattcctttaatttggcccatcccttcctttcccataagggatacttttagttaatcgaatatctatagaaacaatgctaatgactggcttgctgttaataaataggtgggtaaatctgtttggggctctcaactctgaaggctgtgatttcccacttcacacctctatatttctgtgtgtgtgtctttaattcctctagctctgctgggttagggtctcccccaccaagctggtcttggcagggcacccatttttcttcagcaaataacattaaaaagactgccttaagattaaattcccagtatctcagttcattacagatggattaaagggttggtatgaagccttacaaaagcatctgaacttgatggagcttatgttgagaaataaagtttatattttatgtttctaatctcttttaatttcatttttccatgaactttttgaaggcctctcatataattatttattctaaaagcaaatgcaactgagtgagtctataggttggagcttaaacaaatgacttcagagaggatctggcgtgagctctgaattttgtaaatgtgatctctgccttctttataaagaatttatcctggaaaaactcaaatgtaaagataagtactacctttagaaggtaaattttagctatataagatactgaatgcttatgaagaaaggcagagtccatcatcttcatactgaccacagccataaacagtggcaccaacctctttcagcaaagcccctgaagccaccacccaaacaggaccccatggggacagcattctgtctgccacccacctggctttcttcactcacctcagggaatttctttttctgcacatattcagtggtggccgcatcaaaatacttggcatagccctcattcaggctgtaaatctttcctttcttcttaatcttgacatctttttccaccaggacaaattcaccaagagcctagcaacatgaagagagatgccaggaagaagagagaagccaggaaacaagccaaccgcacaatccccacatcagagcaggagaagatgggggcctgctggcagagctggggcttggctgtggtcactctgaacctgctctttggtgttttcatgagtggtgggaagaatagggaccatatggagcccacacaggaagctctagcagtaacacagcaagcaggaagacaattctaaggaagcagcccatagtcttctttcttttcctgtgcatcttccactgtcagtgaggctcctcatttatggtgaacccaactgtgtgtatctcccaagttctcacccgcagattaatgttttcaggaagataggccatcaacagtgagaggaagaagttacattgtcgtatgagggatgcattttaaccattaatttgtggtacaggctgggcgcagtggcttatgcatgtaatcccagcactttgggaggccgaggtgggtggatcacgaggtcaggagatcgagaccatcctggctaacatggtgaaaccccgtctttactaaatatacaaaaaattggccgggcgtggtggtgggcacctgtagtcccagctactcggggggctga

SEQ ID NO: 378 - DNA, 49171 bp, Homo sapiens
agagaccctccccaatcccggcctgccaccacctggctcgcgcgcagccccggcccagaatgccttaacctgcgccgattgctgccgccgaggtgcccctcccctgtagggaccccgacgccgccagccccttcctcctttcccgcaggtgcgcactgctgtgcttgcggccgggtgggcgccccgccgctgcggtcgcggtcgccgctggtaagctgcgctctggggcttggggcaggaagcagtggggggcgctcgaagagcagggcagctacggccaccgtggccgccggaccggccatgtgctaaagtttctggggctcggcgccccgctgggcgcgcagcgcggggagcagacgcgccgtgggtggggcagcgcggtgctgctggcgcccggcccccgcggggtgcagctctgcgcgttctcatgctgtctctctctctttccctccgcgctgcctctccgaggtcctcccgccgagccccggcgcggggcatgaggagcccccgggtgccgcccagagaccagcaggctgcgcgcacacctagccagcggcagacggggacatgagcagcgcgcacggggtcccgcgcccggcggccagccctatccggcggcggccagcgggtcaacgctgcccgggagaatgaggcaggagccggcggcagcctcctttttttccttctcctcgccttcctgcggctccggcgctccgggtccgggccgggctgcggctctgctgcgtgccccgcgcgcccctcaaccgcctccggatgcgcttctcggtaagccaggccctccgcctcgcgaacaaagctcccttcgcagggcccggaggccgcctcagggcccctgtcctaccctccttccccacttacagcctggaaacattcggggcttccgattgaatcgttcaatttcccctgccccgaagccccgcctggaggctgaactgcccgggcagacctggtgctttcttctgccttctggagaaagatgtgggtttgacatgcaggcgggagacctgtctggtctagataacggcatgtgtatgcagctaggttcagacttagcatttgggggcaacaactcttatttagtgggtgtccaggccgtgccgggcagtgtgcctcaaagccgctctgggaaataggtccccgtttctccttggcccagatgaggaaactgaggcttagagaggttgaatgacttaatcaaggtcacaaggttaggaagtgggagaccaggattggaaaccagggtaccctacttccctgccagactgttccctttgtaacaaacacacctgtctcatttcttctactaactgcttccgtctcgagagtcattgcgtgtgtgtgaaaatacttgctccaatgagtatctgttctgatgaaataaattgcctgtagcaagcactttttgtccatcctgccatcacgctgctgccaacccctaatgtgtactctactttttagttcaggtgagaggataatatgttttcctaggtgttctctttcctggggttctgttttcccagtcctcctgaaggatggaaaggacagtggttcctcctgtgtgcccagcacatgctaggcctcagaactgcatccttaacctttccctgggggcagggctcatcaaggttacctgcccctggttttgtaaatcttggagatgattacttaaccggagcgggggctgatcccagatggccactgtgcaggggctggcccagtgttggctcatatttgccagccctcagtgtcagcagaacttctgagccccaaacacttctgagccccaaagaaaaggagttttaatgcagatacgatgcctgatgcatgcccccagttctctggcttgccgctgttagctgtttgcttaagtgcatttagttaactgtttgcttaagtgcatttagttaactgtttgcttaagtgcatttagttcctgaaggggcaagccacctggaatcaattgatcctggtctgaggggcttgttccattggtgaagtcacagtgttgagctcagttgtctacacgtacatttgtgttggtgcagagaaagtcccttagcagtaggggcctctgtgtctctgttagtaaagagcaagggtggactgaccagcccttcagacccccttcagctaaatgattctgagtgacaaaactagtaagttacaggcttgagctaggatgtcttagtccagtcatttggacgaacattctacactgaatgggttgttgatttccaagaagaggacttggtttccagggagctgtgagattcaggttcagcccaaaagaggtgaagctcgagctgtgcttaatagattatttactgggctaacacatagtggctataaaatgttccaagctaccagattggggttgtgggataggttaggcctttcagtaggagagatgacattagctcctaagaactgatgacatacaatgcattaagaagatgcccagcaggctagaaagcagcaagctggtgagcttttcctgcccctccaaaaataatcaatcatatttgcataggtaaaacattcccagcacaaacaattactgcaaataaataaagtgattttttttttagactcttccaactgcattgtttgctgagtatattagcgatgcgtggagccggccttagcttggctgcagaggggctgggacagggaaggtgggctgaaggatgttcagaccctgagttagtttttggctgtggattagagctaaatccatcactttgacctatgggtcgttaatggggttgtcattggtctttttaagatgtggattaatgaacctcttaaagtgttgccgaatcccaaatgaaacgggcatgtcccacctttttcccagaaactcggctctcagcgggttttgtgactgtttgaaattcacaaaaccagagcaaagctttcatttttgacaggctcatagggatctgcaaaggaaaaataatgcatcttatgtagggatattaatctcccagcattgtgtgttttagcttctcatgattaactggtaaggttttgaataaaaatgaatgcagagaaacaatcttcattaagttgcttttgaaaatgctgaggtaattatgaaataacgatttttgtgtcatagatcatactactcatagccaaagctggattacatcacaaaacattactcttgttactgatatttattttttaattcattagttttctcatattttttgccttttttctccccgtgtgaaaataagccatcgagaataaattcttccttttcagtttttctttgtcttaaatccagtttttttttttctgtaagatctctaagctgaactcttccacaccatacatataatggcctcatgttaaaatatgttttaagtgccttggatttcttttgggagaacaagagggttatgtatcgtaagtaaataacagtgatgagacatttcccttgtttgcttactcttctaagtcagggcttgagaccatgccctcatgattgcagctgccacacttagcatcatggggacacagcctgagtgctgtggcatttctgcatcagtgaggatgcacacctggactgatcggagtgtgaggaaaacaacagcttccgtaggccaggaaacctggggtttattcccgactcagttgttcattggctttgtggccttgggcaaattatttccatttgctgggtctgggtttacatatatgcaatgggtgtgtacgtttgcatgtatatgtgtgtgtattggtaccagatattgccctccaaactctaagtttgaagaatcctcaaaatttgggtatagctggttattaatacctccagaatgctctgtactttaaggttacataacgttccaattagacattcctataaacaataagaaattggtgattatagaaaatatgctgtttattaccctaagtggagactccgtaccctgagtgtgtgaaggaggatggagctttgatccatcctgattatgccggcttccctatcagagtccccttgcacggtagaggctcagcacaaatctgagagcactagaatgagccatgaccctctctaggatccatgtggcagaagatgcaagaactattatgtaatttgggtcaatggggtaagaagactatgacattctatctgtgtagctttagggttcaggggacttggagattccgcctcaatctcaggctgttcctggaaggtaaggaaggggaagtatgtaatttgaaaatggagagtactttagttagagccttgaactcagctgaagctgggaaatggtgaggaagaagcttgtcagtttggcagtggtattttttgccaggttttgtgtgtaggcttcccttgtaacatctaaggaagtgtgttgtctgaggtcaggctccctggtgaagctgcagtcattttcagatagagagggcatgagaaaggaaccaccagcccttaaacactttgtccttgcaactctgcaaagtagacattgtgaaccctgtgttctagatgaggaacccaggctcagagagctgaagtgtctttcttagtctctaataattatcgaatggcagaaccatgcaatgttttaaatggactctgctggggtttaaatcaacccgtgctggacctcatttccactgctactgcagtgtgtctgtctggcaaccaaattgtgtccttcctccccaatttctagataaccatggcactaaaaaaagcatgcagatgatttgacgtaagtagcatacggaggtgattttgctgtcaataaacctctaaattcaccaggatttttgttaatgcattagatttcttttaactacacgaggtcaaacatgtcgatttccaaaaagattcctaaataagccaagtgtaaccctaacagggttagtgctggtgattctttgggaaaagctaaaagaattctcctgggtcccacattcatccccctggggttctgtgggaggtgaacacaaactgatgtatgcgacgtcagtctgaggagttgtcgctaggctgctcctcctgaaaaagggacacaataaaagttatgtaacagctttcaaaagaactgtttctcctcctccaggatgcccatgagttaatcctcccccaaacaacagactagagaaggtattcagaggaacacatgtaagaccttcacggttcacctacagctcttaggagtttctgggactcgggaggaaatgtaggtctcaaggaacttttcacgttatcgagtagagatgccgtcgtagctgatgttggggacggccttcggaaggtcacccatgtgagtatagctgctgctgttcttcgctgtaagtgtgcagagctggccaagcatccaccattcccaggaccagagattccagagtcctgttggtaacactcaatttacaaagagcaaaggaaaatccctgaaatactctgtcaccccattgcgtggctttacattctgctaacgatactcaggctgggtttcttcaccagcagttgaaaatgcttctgtctctgacgctggccttgcctgtgtcatgtgagtgacgtcttcaccaacagacccctccttccgtctcccttggatcactgagctgcttatatgccaaaagcttcaagtttgttgataggtgatgagaaaaattagacagaatgagttagaaagcttgactatgcttcatctacaatctttaaaataccacatctcagcagtcagcacaagtttttgatttggtaaatgaggaataacattgcgtgtcctcggtgcggcccatggaatctgcatcttctgcccccagactttgagagaacaggtgccccagggcttcagctctgggctagatttctaacatgtgtagttactaaaaagtagaaaatgcaagagtagctttgcagagtcaccagagaggataagataagaagacagagaagttcatggcctctgatacgtgattactgcgaacacttattcagggcatggtagtagaaatgatttcacacccgtttccagcaacgagaagcacaaaataaattcactaagaaatttagctgtgtttcttgttgtttttgtatgtggcttatgacaagtgcagatggcacttcatgtagttaaaaaccttcgccttcctaagtccttcgtggtggctaagagaggctaggctaaatgccttggcagacctgcatttttgaaacctgactcccaaggtcaggtggtggtcttggtgagggtcagtgtatttccaggtgcttctgtttcttaataatctatgatgagctgctgtatgtacctcatttagcatcaccaagcaaaagagcaaacagagaatgcccagggcatttttcccaacctgccacatttctccgcctctatctgctaatatggtctggggatcctgatccacttcttgattcttttaattcagaaaatggatgataatgacagtcattttttaaatgatcaatattgataagtcttatatttttaaataaagtgaatgcccctgagagcatcacgtgcaagtttaaaatgatttatgaatggatacagtatcctttaacttgttcagagggctttattgaatacttctaaaacagtacgtctattatcctttaatttgttcagagggctttattgaatacttctaaaacagtacgtccagttttgcagtgttcaagtctaaaggtagacgtgaaaaccacatcctgtgttcttcatctgaaaaggaggagtggaaaaatacacccgacttctaaaagggaatgttgagactgttcctctctgttttactgacaagataacattgcttcggtctgaaaattctctgtagatgcatcttctacagcagggctggttgtcctccagtctgctcgaggacatccctgtggcggttgagagtggctctgtccatctgtgcaggcatggagctgtctcctccacagagcatgcctctctctggtcccgtctggttactaggatccacccccccaacacacaccatcatcctttcctcagacagatgtcagggacaacagtttaacaaacagttatggagcactagctctggtccaggcactgctaggcattgaggctgcagtggtggacacagacagctgtagtgtgtcataggctgctactgtttcagtaggcctggggcgtcaccctctgccctttttaaggggtctgttcagaatctggaggatttagctgttgcatacttggaggcacgctggggctggtggggagagcccaggctgggaggcagggggccttctctctcctctcacctgggtgcctagggccaagccacccccccgccgccactctgacccttcactggtttcaagtgcaaagattgggtcactgcaggttttttccaagtgtgatccagggaccacttccatggaaacaccaggtgagcttattaaaatgcatatgggtggaccttgctgcagacttgccaaattagaactcctggggatgggggtgcccagaatctatatttttaacatgcttccaggtcgctctcaccttgagcacagtggtgttcaagaagcactggttctcctgggtgtcgaatcagtaatgcccctccctgctctaaaggactcagaatgtggcactcacccccatgctggccactcttcccaccttcacccaccgccgtgctgtccaagccaatcgactctctcttcaccacgcttcccgctcctcctcctctgtgcactacagtttgtttcccgtatggtagccagagtgagccttttaaaggatctcatttctccttggctgggagagcttcagtgccccctgtgcccaatagtcagggaccttaaggtgaccctcagggccctgcacgatctggccctccatctcacctcctctcccaccacctgcccccttgcttccctcttcatgtcacagccctagaacccacccagctgccaggcattcactccaaggagccacaggacctggggactggcaaggcagggtgccagccctggtaggtggggcacaaccctgtgaagctctgttttctgtcttgccactatgctgaaaacccctgcagactgacactcttaaacccacttgggcaaatctgtttctgggcctgcccaccaccatagtaaaagtaaatttagaagcagctctttaagtctaggcaccgtgttacagggtgactcatcatgggactgcattgtcaaagtggctctagaactttttttcgaggaagtttctggatatagactgcaaccctcttgggctggactattaactcagccacttttgatcccagggccctgtcatccctccttgtcttctttccacaagtattcacaagacacctgctacgtccaaacactgcggtccccacaatctgtgtctgcgtggttgtatctccgactgccgctcttgcttacagatgaaacaatgtggtctggaaagtatttctctggcctttttttttttccctcctactgagaaatagttgctctggcctgtgtatcaacagcagccctcttggggcctaggttaagcaaactgcactcgaaaggatcaatcccttggcaagtaggagggaaagatggaccatgttgtgagattaacctccaaggcgagctgagtgcgtaactggaagatctgtggggtctctcagatgggatgcgtgctcagcgcatggggccagggcttggttttctgaaagccagcctgcccagcagtgcaaatgagtgaaaaaggccaggaaaacttcagatgcttttgggtctgacattgcagatgccttaccttgaatcgtaaggagggaagcattttcacgctcagcatcaatcttctttgggatgctttctctggacatattgaccaagccttcactgagaggccattagcaaagtggggtggaggatgaaagtagagatgttccctgccttttatggtttcagagacagttggggaaaacgtgttacgtaactacctgtagctaattagagtgactgacgtgctctgagaaggcagagataggaaagatgggtttggccgggggagggtggaggcgtttgacttgagccctgagagacgagaaggaatttcctgagcagagttgagcgggaaaggccttctaggtaggagggcaagtgtgagcagaagcacagaggcctgtttattggggagagggtactgtgttataggtctgtagagtcaggctgaggctgcaaggcagggacaaggctgggtcactcctgcttagatgggagtgggtcttgaatgctagattaaggagggttccatgtcttacaggtgacagggaactgtgggaggggtttgactcaggatttgcattaaaaagatagctggtagccctgttcatgaccccctgtaccctctatattataggatagtgaagatgtgtaaaacgttcaagaagaaatactgtgtgggaatgagcatggttgtcccgggtgtaacctcaggcaccatttctctgattgcagtgtctctgcttgtctgtatctgttgtctgatcctctgggccctgctgcccagaccccaactccaccagccctgctggggctcggaaggaaagcaaggtagccgctggcttcagcaattgctgcccagccatcgtggactctagccaacaggaaatggagcgggcagtgtcccagcctgattcaccgagccatgggtctccctgtgcctctgcaaatgcattcaggctgctcctggcctaaaaacaatgctcccagacctacatccacagctgagagaatccagggcacacatttgcccgccagcttccctgagcttcccccagcagtgggctcagtgggtaggagagggggacatggtctggaatcaaggcgtgtgccactcagtgaccatttgctttgaaatcaatgtgctcagcagggccagtgacttttgcagagctggctggacaaagggaacatgaagaagggaagagtgtctcagggtcacgggtggttatactacccttgaacttcaccttcctattgctaaggaagagagagagacagaaaagcatgttccacaagccagtgggcaaattcttagctgttttctgtggagtctgggcctggcagagagccctcttcacgactggctgactgccagatggtgccaagggcacggcatcccgggcagtcagcctcctagtgaagattgccatcctctggagggttccctgccccaggacatgggcctgggaagggaatgcaattccaccctccatgggtcccatttacaggtcaacaaattgaggccaagagaagagaagtggaattgtggccgagtagcacatgaaatcactctggagtcggtcatgatccctgaggccggccaatgcccagtgcccattgctggcagcagtccacctggaaatggacagtttgtcctcacactgccttgctacccaccaggcatggaggatgtggctttctccttgttcatctgtcttccctcttggaacccaggcccagagccagggggctgggcatgacccctagatgtctggccttttgtttgcttcttggtttctgaagcttgtgtggaagttgaatgcaagcagagaaaggaatttagtagcaagttatcagagcagattagaatggttgtcaggatctgggcatggaaatcgatggggctgagttctctctttggagctctagggctcctgaaacgcaccatcaggtcctgggaaagcctttcatcctggttctcagagcacctagtgcacacttacgtacatacataagtttaagccaaaccatctcatgagatcatcatcgctggctccatctctttctttcaactgtctcttccctggatcctcagtacctggggtgaaccttgcttggcacctggaagtcactcctggcctgttagtgactggatgggggatgcagtgtgcaaagggacttgtgcagcggtcagtctggctgagcttttggggcagcctggtgctcctgactgtttctcaccttatcaagtaggttctcctaaatgcataagaagctgatgacagctctgctggctgacttcaaaacagtcaaaccttcagtgctttatcaggcagatctgtaagtacagttcctgctcataaaatgcatccgtcacagccccgtgcaacataaaggaattgtttgcaaactttcccaggttattacccccaaacttagtaaatatatgtattggataaataatcttgggaggtccataaattattgcagtttcggacagtactaatctacctgctggcacatttcataggtttcaccaccttattgactcacattttaatgaaagaggagagcaaagctataaaaactatcctcatgggttggggacccgaccagatgatggatgacaaagcagtgtagaaaatgtatgagttctgtgtggttattcagggtaattattattaagacattttgagcatctgacctcagttccttttgttttcctgggcaaggacctactacctcccagattctgctgcacttggctggcggcactctgtgcctacaatctcaccattggaatggcagttcttcaacaggattttgatggctgtcacagtcactttgggggacatgcaccttttatttgaagctgttcttcgagtcagattgtgaggcactggacagacctggattgaaatctgagcttatcctctaattccctgtgtgattcttggacaatttgcttcagcctttatgagtcctgttttctcttctgagaaatgggcataataacaacaattaatggtaatcccagctttgattaatatttgctgggtgcttactggggtagggaccctgtgcaataagtcctttccgtggactctttcactgaatgtgtacaatagcttgataaaggagttaattttattattcccattttacagatgaaaatactaagccttcgagtatgtattggtgcatacaaaaacacctcagataatggttttgaacatgaataatcatttattttgctcagctaggtggccttgctgcgggcctcatgtgaggttgcagtcagactgtgactggggctggaatcatctgggaggcttcctcactcgcatgtctggcccctgagtgagaaggggtgcacagcctgagggtgggagtggggaggctggcacagctgagactctccatcgctctgtggacgctccgtgtggctgggtagccatactgcctacctgtagtctagggctccattgacccaagagagagcaagaggttgtagtgcgtgggggtgtctgtctctatcctctttggtgatcgagcctcagaagtcacatagtatcacttccggcatgtccttagaagcaagtctctaaggccagcccatattcgaggggatggggggggcagttagactccatcctttgatgggaggagtgccgaaggatgccagtacgtttgaagccaccacggagtgcttaggtgacttacacaaggtagaccgttgcaaggcagcagagtggggtgtcggatcccgagcatggccgtcacccctctgcagtgtaaagtgtgaagcactacgggccccgtgaaacgggacctctgtaagcatgtgagctgtttccccttcagatgtcctttctgaagaaggaagcagagctgtgtgcgagtccagctgctgcttctcagcttcaaagaggcctttataccaacccttggggcagaccacctcccctcccctcccctgctgtccctggcctcccttcccttcacctggagccacattctcactttcttgggtcctgggcaattctgttttcatgggcctcttccaccataaaaagaaaaattaaaaattatttcttaggactgagctgatataaagatgaacatattaatgttacatattaaaagattttcttctacccagaagttcattgttttccttctgattttaaattggaacatttctgtgggccctgggcaccgtgcctgctgcatgtgaaggagaagttggcttgcccttccacctccacccctcaccccctcctctccctccccctcctcctcctccgcctccactattcactcttctgccctggccaccacttagcaggctgctgtcctctcctaggctgtgaactttcaggttctctgcaccctgggcaagccccgtgactgggagctgactgctccccgtaactctggctttcctgtctcctggtccttcaccaagggtagacctccctcgtgaggaggaacttaagcagagactcatcttccctgtaagcccacggagccgtcacccctgtctggcttctggctggtctctcatagcagagtaccggaagggcctcccttcctgtgcacctgcaggggtggtggcagtgcagagatggctgctctcctggctcctgcgtctgacaccccagccagcccatccatccgtgaatcctccactcaaccatttaggaaacagctttttactggtgagcatttcacgaggcctacctagtctccttcctcatggaatttagagggacacaaagacaaaaaaaaaaaaaaaaaactgacaaatgattctaagcaatgggagatttttttccccaaggggtggggtctcactgtgttgcccaggctggaaggcagtggctattcacaggcgcagtcactgcacactacacccttgaattcctaggctcaagcacttctccttttttagcttcccagcaatgggagatttttttttataagaaattggcatttcatggaaatcgaagcaagaagtgtagtctggcttcgtgaaggagaaatgaagccatcagcgaccaggatgttttccttcctctctgtctggagccccaggtctcaccatcttgtaccctttgtctctaaccttcctctccaacttcaggtttttcttctcgtcctctgagcatatggccaaacaatggtcaccccagtatggcagccccaaccctacatttgtgtggcctcaaagctcactccatctccccggggcctaatttcccaggagagaagtagagtggcctggcttggtgaggagccctctgctctaaacagctgtggctgggaggtggtgtcacatggtagggaaagctgtccctcgaggctgtcactgagacaggctccccaggtagggtgtgcaagaggggagagagaaatagcacgttcactacacctttgcctcaaaaccaattctggtttagggtggtggttgccagccttttgatgtccacagaagaggatatttgtttagttgagaaattggtataagattgcccaattttaatctgccctctctcatcagcatgtgataaataatttagaaaacaggaagaccttaatattagaatcgtgaaagtattttaaatttgttcattaatcaaattaatcaaatgtaattaaattaatcagagtattcttggttttcccatttcacccctgacagctgagactttggtcacagagctgaacgggtctgtgggcttacaccgggacccacagcactcggagtcctcagaaatcattgttaacaacaataatacaacccagacagcagcagaaagaatcgacccgtgtctggagcctgctgaagttggggggcagggaagcgacatgatctagtctgtgatttagaaagatagcccttcggccacgtggaggtcgaactaacattcgcaaattagaaatctgtgttggcaaacacttttaattagagcaaatgtttggcatatgcagacacactcaaagtgactgatttctgaaagtgcatccccattcggaagctagagccaaggtcccacctgctcgggggttttccctggagcttgagaggaacctttcactcacccacctccgagtctgaagacacaggctgccagcggttgtgttcatgacgtcaactttgacggttgattccttttttggagaaaaccactggcttttggaataattttcgccctctctccacaagagccctgcgattcatataagttctgtttataaaaccccttcgggggcacaggtcaaatttagcaagtctgggatagggcaaggcttactggcccaaaatggcagatgaggaaaaaggctcagacaccctcaggagcctgcccagggccacacggctcctgagagatggtgcaggaattggaccagagtctctgctgccaagttcatctccctattactatacactcgctacacatgcagttgggaagctgttcctgatcttggctctgttgtctgttacgtgtcctagctgggtgcttagtcttctagggttgccataacaataccaaaagctgggtggattaagacaacagaaatgtatggccttgtagttctggagatgggaagcctgaaatccaagtgtcagcagggctgtgctccatcggaaggctccagggcaggatccctgtctcctcccggttgctggtggttgcctgcaatccttggcattcttgcctgtagctgcaccactccagcctctgccccgtcttcccatgaccttctccctgtgcatctatttgtctgtgtccaaatcctctattttcctcttatgaagacattagtcattgggtttactcaccctgactcatgtgaccagattttaacttaattgcatcagcagagatgccatttccaaacaaagtcacaggtactaacagttaggacttgagcatatcttttggggggacacaggtcccctatgacactgagacgctgccagggggcccctggtggaccacactcatacccagaaggttctgtgcctggtcagtgttctcccatccgtgggttctcctcaatcccctgctcaggcccatgagatgcttccagtaggggctgtgctcatgagtccctctgccaggagggacatgaagtcagctgctgccagcctgtggacggattgtgccgctttcgcatctgtctgagatgctgcaagtgcgtggcctcagtgagtgggtggcagtgcgagcacattgtgtgttccggggagccgggccacctccggctggatgtgtcgccttcctcagggctcctggcagcacctggtgcattactgggtcagggtatcattttgacctcagggtggctgaggaagctatgtttggggaagtggcatggagcttagacattcgagctggcctgattctttttccccaccagatgacaagcgtctctagggcagggatgcctggccatctccatttcccctccagcagtttcaggctcatgggagctgccatgtttctgcagctttagtcccacattgctgtgaccctgtgaggctcccctgggcaagtcttcactctctgagcaccatgcagggctgctgtggggttccatgagatgatgcattttaaaaccatgcacgacttgaaatgcccgcagctctcattatctgggagatgcctcaggacaaagtggcaggacctgattgaagaatagggttgaagacagcacctcgatatgtctggcggtgcagggataggtggccatgtaaccccagtgggagccacttataggaaaaggtggtagatttgggcaaggaggtggcccctctgaaaacctgttgcagtttcaagtgaatttctgaagacgcgtcaagttttagatctactgagtctgcagtgaccatggccaatgggatgggaaaattttctcactagaggagaccagagagagggaacacggactctccagagagtttcgtgagggtccctgccaaggactagtggaaacccaagcagttggggacagggatagtgggagaggtgggaggccacctgggatcttggaaaagaggaagcttcctttttgcagcatgggaggcagcctgggaaagttagggttgcaggatgggaatccagggtttcaggaggcaggaacctggagcaacctgactgggcagtgctgtcagcagacccaagaatactgactggcctgtgaaggaaaagtttgctgcaaagtggaatcgaaagtgaccaggggccaacagggaaggggccgccctcactccttatggctctaaggggttgggtctgttctcaggttctgcgtgtgtccctgattcctgaagctacctggatgctccctgagagcaggagctgcttctgaaagaccatggatcccccccaccccactccccatcaagcagccagcagagtgccaggggcatagcaggtgctcatttaacaaaaatagacaagacccgttgccagagacagcttttgctcaagtgctggagttctcaacccagctgtctatgagaataaccttcccaggagcatttgaaaaatgctcatgcccaggctcctcactttgtattaatgatgcagttggtctgagctggagcctggcaccaggcattttcaaagctgctcatggacactgcattgttaaggttcaccaccagctccgaattgtggctgcactatgtgggcacatgcccggtctttctgggcctgttcagtcatttgcaaatagccttgcagaaatgtacatggtgggtccagtgtgtgcctggcacccagagccactctggctaatgctgattcaaagtcgcaagacgattttgccctgttttggtggatagctcccctgtggagatgactgctcagggaaactggcagatttccagaagagggaagaggagcagccattgctgattggatcatccaagctgggttagcgtctggcttcgagcactggtttaaggtgagcattaaggtcccgtgggatgttgagagtgtttgaggagaaagaacacatctccttggtctagatctcctttcaatgaaaaatgccattttgtcagaaattcccctcttttgggatcaggcagtgcatttgatgttaacgagctctcattgaacacacgctatgtgctgcatttgtgcaagggcttggggaccccctaaatgaattagacaaattagacagtcatgccctgttggagcccagtggcttttgggtccccgttccccaggcaccttaacccaggacagccacactagcaggaggagggcggggagggagagattcacacgtgaggatcaggatttgcgaacttgcggaagagtgtggtttgcggggcccctggcaacagtcctgcttgtcgaaacacttttttcttggtgtaaactgttcccaatcgattgagaaagaagatttggaaccaggcccatgaccttctgcaggtgctgagctgtaggtctatagattgttggaatgttacataaaacaaaaagcccctaaggccatgcctggaagagcaagctctcccacaggtcagcctccttctctgcatattgcacagcttcaagagatcttaaaagaaaggactcttttaagcaagggtcagatgggattgggatgacgcacagggaaggtgtagatgcggttgcagtgaaggagagagtgaggacccagagacctcctgtcctcagccacaggtggcttcctcttggagtccacagcatgtgcatattggtgcagggcactgcgggatggagtgttcatcccagccacacgttcctgctgggcaccacctctctcctgacgataggttggagctgagggcacagaaatggccaaggcagggagtcaagccagacagccagcatctccagagaatagtgacagatgttgtctgccaggtaagtgcaggaagtgcagaacctgccttgaagctggacgagggtcatacaaggtgtcccagagaggggacatctgagctgcatcttaaaggaagagtagcagttagctatgtgcagaagggcagtccaggcaggaagaacagatgtgtctaacccaggaggagagcatgggccagcgggaagggcaggaagctaggactgggcaagatagaaagatctgcctgctggtttgatagagtgagggaagtgtggggccctgttttagctccgtagccaaagacctgagttccagcaaatcacacatgtgtgcatgttgttagagtgtgtgtggtgcgtgtgtgtatgtgtgggtgtgcatgcataggaggaaagggagcggagagttgtcaaatgaggcaagccaaaacccaggcagtgggatggtcatgttagcatctgttttacaagggagttcccgacgcatcctccaggatcatggttcgctcagcctcacattgctacaaagtgggaattttaccaatgatttaaagcccttccaagggcttccagggtctctgatcttcctggcatagctctctggcatcttcctcacccccagcaccctatgcaccagaccttgggaaggtgtttccggcccatttttttcttgctttgaaccacagcacgtgctgttgcccccactggaacactctcccgcttctcttcctccttcagatctcagcccgctgtcgccttctctctgaccctggtcccttccactgcaggctgttgctccggtgtctctgggctgctccaccacgtggtgcctgcccatcatggcatccaccaccaggtggcctttttcttggtaagttccttacaaagcaacatgctttgtgcacctctcaaatcttcaacacctagcgtggtacctggccccaggtgggcacttggtcgcatatttgttaaattattgaatccttgagaaagcccaagctcagcaaggttaaaaaaacgtttctgccagtgagtaatagagtggatattcaaaccggccttctcgctggccccactcctgtgcacctctcactgcacctacccacctgctgcctttcctaccgatctcaacgattatgcagtgagctgtggaagaaatggggctcagagtccggtcttctagaaggtgggcactggagtgagccaggcagggtgtcagggtgtcagtgttcaagctcaatggggaaactgaggtagaaccccagaaatagagattgggctgttccagctaagtagcggcagtgcacaggcatgaccctgtacccactggagacttcatttgtggcatcaaggctcactgcagccccacctcctgggacaaagcacctcctgccctgttttgtgtggaataaagctgggacttccatgaagggactgggctgggtgaggggcaagccagaagctgcaccacaccctctggaactctagaggccattccaagcctcacttgtttttcttttcgcaaaagtggaagcagaaagcctctgctctgtttgccttactctgcaaataaaaatggaatcaggagagtagtagtttgaatcccacttgcaagcagtttgtaagaagtgcccaggtgccccaaaaggtggaaacatttattttccatttgtaaaaaataacactttgttatgttgatatcatgcggcagcagagtactctgcagtttgcagcttgggaatgcaaagggcagggtctccttgcaggcctggctctgggaagcctcctcaccacagccctccatattttccatgacactctccagctcccagagcgtgctgccttgcctgcttagcaggctctaaaatcgtactttacagtttatgccatgattcgggcttgcgttggaatttgttccttcaaatagctctggcatatgtttttatttcacagtaaaaccgtttttaaaagttaacacatgcacattgtcacaaatcaaattgtataggcaagtatatcataaaagccctgatacatcctgaatgcttgctttgtgccaggcactgttctggggatgtttttcctataaactcatttaatcctcgtcagaactttgtccccactttgtgtgatccaggatttgcatccagacagtgcattgatcgtctttgagccccagtcatggacttcctgatgtggaagaggaatccactgccgtactagtggctctttctcctcctctcagtttcatctgtgcttgttaaagtgcttctctctgttacttttcaatctttagatacatttttctccagcacccttgcacagtgtgtctgtctccttatttcataaggtgaggttgttaatccatattgttccttttgtctttcctctcaagcttcggtgccacccacctgctactttcaggctgacattccttcaaggttgctgaagcttgcatcccatcctgaatgctctagcgtatgcattgtccatagtttgactctgaatgttgagaacagtaggtgacattgctataattattgctgcatcagaagtggctaatgctgggttaactcatgcactgggatgaccttttcttctctggagatcaatgccagaacccctagaccactcaaagcagaatggcctggaacagacttgagtgggttctcccgcctacacaatgtcatttgcttggaagcatgccatattgtagtttgcttcatctttggatcatcactttattgcacaggatattttttctgggatttctggttgcctttctttttttcttcttgctttctatgcctttttcatactctcccttttttcataccgcctgttccattgagcctttccccattgtttttctgttttgttttgtttcttctggagagctaacccctctcaggatgctctcccctcctctacccagggtactgcatcctctccagggctgctgcccccaggtcatcttgggctcaccgtcattgctttcctgggttggaggctctgtttgcttaagttacctcctaagaaaaggtacatggaaagtaaagtgtctgaaaatgtctgtattttatgctcacactgaaggtcgatttccaggttctagatcatttgccttcagaattttgaagactttagagttttccttgttgctgatgagaagtccgatgcctggttctttgtagattatttattctctatttgtcttgtccagaagattataagaattcttcttcattcatggggttcatgtattacatgaggatagtctccagggtgggtcttcatttattcattgttctggatgcccagtggccccctttcatctgaaagcccacgtccttcagctctgggagattctaatggaactgattgttttaaaaccttcatttgttttccattctccatatctgagcctcttacttgtcagctctaaaatcttccagaaagggattatattcttctacatttttctcatttctttgcctttttgctctttattcgagattttgttgacttcattttctggtttgtcattttgcttttttttaacttttaaaaaacatgttggcactaacatttttaacctctgagagctttttcttgtctctgatcatttcttttcctggaatctattttcgttttatagctactagtatactgagtgctggaatagtaattagagcattttgtttgtttgtttgctttagtccatgaattatttctgtctcctctaaggtcagtttttgattgttttgactctgctcttcctgctgctcactttctcctgtgccttttcgtttcgagttgaaaaaagtctagcagctgttgtgagattgttctttggccaatgagtaaacaggctgagaaagactgggtaactgaccaggatcacccaggtagaaatgactagctggtaaccaaaccccagccttctgatttctactcagcttcccttccccccaaaacttgattgatttcaagtagattttaggccaagacttgtcccactttgctgattgcatggaggctggcatctcttggtaactggggctgtgggagaagctgactttcccatttcccaccactggtctgtgcctcctctgtggtatgctggaggacccaggagttctgtggttgtcaggagaccatgcagccacatctgggatggttggtggcttctcattggcctgatgtcctttgtcgaaggtgaggccccagaatccactcccaggtatcccacagccccccacaaaaagctcagacttctccctctcagaacaggagaccctcagctctgagatggggaccacagtggagcagcacccactagaaggattcctgggtccccgaggcttggttagaagtaaatcttcacctgcatgcagaataattcaagggggtgtttgactgcaggcaggctgcctgtcttcatccatttgggctgctataacaaaatagcataaattgagtggcttctaaactacacacatttatttctcacagttctggaagctggggattccaagatcaagttgccagtagattgagtgcctggagagggcccactcggtggtttgcagatgaccgtcttcatgctgcctcctcacctagtggagggaggggtggagagctgtcttctggggtcccttttataaggacactaattctattcatgagggctccaccctcattacctaatctccttccaaaggccctgcttcctaatactagcaacttgagggtgaagatttcaacatatgaattttggggggacatatttagatcatagcagtgcaaaattaggaaaatgtggaagaaaccattaaaccatagatattttaactcatgtcaccctcatcttctgctcctggaactttctcctatagaatattctgacttgcagagagaaacagtgaaatcattcaaaggaatttctcggtcctccagctttgggatgctccttaaatcacatggaatctgagactgagccatttattgggagcttttctttattcctttttttcccccatttattcagcagatgtatatgaaatcttcctgtaaacataaaacgatgcttaaatacaagaggtgagaagggtgcagaggcaattaagatgtggcgtctgccctcaagggccctgcaactcagagggagagacaaacatgtaaacaggtgcactgtgaggcgaagggaaggctgcgctgctgggaggtacagttagtgggctgcatgattgcggggaaaggagcgatgaattgtgctcgggggaactgaggcagactggagcagagacggcaccagggctgggctggacaggaagttgagtgttattagatggaaccagtaaagcaaggcatggcttgagcaagagccaggagtcagaggctcacaagtgccaggcccatcccagggctgctggccccagttggtgggagtccagggtagcaaaggacttggccatgcgaaggtttgggtttcttgtctggtgagggcacagtgcctccttcttaggtctgtgctggggagtaaatgagccagccagggcaggaggtgggctccatgctggttgcatagtaagccttaatccaggttagctgtcattgcttatgacaaggtggccaacagttctacatagccttggagcgcatactagtttggagagcaagtggtgccgggtttcaaagaactgtgggcattaaaaacagttcatgacaaaaggggagaagcagatgcccttagaagggatgcagccaccttctccacatcgccattttgtggacaggcaaacaggctcgtaaaggacagatgtagctcatttatgtgcggtgagacaggactgaagccatgtggtttataggtgccttttgcttctttttttgtttagttggctagttatttttgtgccctttacctatttttaggagcgtatttttccctgctttttagtttcagtactcatatataggtttctctcttttcttttctagcatcatgtttgagatgggtaagagacagtccaggcaacagcttcagaaggtgtgtgtttaacggacaagcaagcaagtgctgttgtctggctcggtgtaagagctttctgaccggcagagctgacaggagccattgcttatggactgctttgggaggtgattcatgcagccccggaaatgctcgagcagaaatctgggcaaccatctggtgaaactagtagagaagggaatgaggattcaatgagtggtcagactggaaaagcccgaacattctcttcctccccagagagttgggggccagggattctgttcatgtattcagaccctccttctgtaagcattttgtgagcctctcctgggtgccaggccccatatagatgccaggaataaggaagttaagggacagaggcaggagatgtaaattttgctaatgtggggcacaggagttaatcttgtggatttgggctcaggacagccccaagggttgacagccctggcgcctagcagggccatcgtggacaaattacttaaccccaggaaccacaacttccttttctggaaaatgggcagatactcattcattgagcctctgccatatggcattgttcttggcacaggggctgcaatgaaggacacgattgctgtcaagtggcttctcttcaaagtagggaggagaaatgaaaaaataacatactttggagtagggaatcctactttcttcagtactttgatgaaaatgaagtgtagggtacatagctggagagtgatgggaataggggacctttatagacagggtatcctggaagacttttgctgcagggacacggtatctgagcaatctgaatgctgtgatggagccagccagtgcaaacgtttgggcaaagtgtgttccagtagaggagacagccagtgtaaaggccctggggtagtaatttcaaaaaagatcaaggatgttcacatcctttagttgtgatgggattgacagagattgtgtaaagatcacaatcctttagttgtgatgggattgacagagaggggagagtagcgggaatttagatagctaggcagcagtagtatcaagtgtatttttccagtgtagcaccttatagcaaagtcattttttttcaagtttttttttaacccctgttagtctggacaagtattggatcaaaattgtaagcttgacttctccctgcatgtcagccgcagtttcttcaaaaagttatcattcagaaggatgctatttccaggctggacgcaaacacagttggagggatccatatgcagagatgagaatttttgtatctcagaagatggtaaaacccacccagctgtctagtcatgttggaaaaaaatcacattaaaatgcaaatgctcctgagtaagtgaaatgttgatgggtgcagcccgccaaagaaaaatattcatgaaatacaggctgttgatccacagctagcatggccaagccatttgctcagcaagacctgagtgctaggaaatcgcacttacgggagctgttctgtgcccttagcaaacgctgatctccccaggggcatttggaaatggggacgctcaagtgctgggtaatcatggggatggggtgggggagcctgcttggtaaaaggacactctggccacattgctttcatcgtctatttgaacctctcagcatggaccttggggacaaagactagagacggtgtcacctccaccttcccaagaggaaggggtctgcatttccctgcatcgtttcaacttgtatttctgagcctatcagggactctaagctggatttccttaaaaagcattctcctttcatgggtgggtctttgaaaaagcattgagaacatagattttctcagtaaatatctggtatttgcaactttgagccataaaatgtaggagtggagagagagaaaaaaatgtgtaccagacatcatgattgtttcccattgaatccatacaacagtaatcaggtgggcattgttactccattttgtagacaggaaagctgaggctcagaaacaatagagtggggccatttagagcatggccttggcgaacatgagagaatcccagctctctcacaccctgaggaaaggggagatgtttctcccgctcgctgattccactttgcccatttataaaatgtgatgatagtgtcttcctctcttctgttgttgcaagcattacaattattgatggacataaagtgcttagaacattacttggcccctgggaagcagtcagcaatgctaggggctctgctgactgctttaaatgtgaccacagtcactcagcaagcagaaagagatgatgacatcagcacgattgtccctgtgcagaaagaccaagctcaaagcccagagaccccttgagatcaccagcgacaaacattccacacagatcacaaatgagcattgttctgctcgcagagttcttgctcagttacctgtggaattattctccccactttacagatgaaaaaaattgacattcataaaaagccctcttttccttaaggattgcaaacaaaagcctctttcagccagtgttcccgttacctattgctgtgttacaagccagtctaaaacttagtggcttgaaacagaaggtcgttattatctcatggggttctgtgggttgactggactcagctggtggttctcactttaggtctcctgggtactgggggcagatggtggctggggctggagccactgggctggcagctgggctgggctggccggcacagccagggctgtagggcttctctgcccatttctctccacctggctcgctggggcttcctcacagcaggtggcctcaggggagttggatactggcatggcagccagcttcccaagagggagtgttccaagacacaggaaatggaagctgctgggctgtaaggctggcccaggaacttgcatgagctctcacccaaggggagggaacatggacccctgcctcatgattggaagggagtgagtggccatctataatcccccattgctgggcaaggtggattttgcagatcctggagggccaagtatgtaatagttcactcccctgtaacatgggttctgctaggtccctcagcataaacctggagccttgcttgatcctgctggagacataggccatcactggctcctgtgggggggcctgggtggttggcttagactagaacctgcctcactggggatctgggagaaggtcactctggcagacagactgaacccaggcaagcagtcaacatgcaaggcctgtggaggatgtgctggtgataggcagagcacagtgggagggagtgggagaggaaaggtgggccctggaatgattcaggaaggcaggcaggctgaccttcaggcctcaggagcacagccaaggcaaccaggcaggtgcagggcagaccactctctctgggtgagggataggtatgaaagtcaacagcccaggccagggtcaccaagcagcttcctgggacaagagctcagccagaggccgagtcctaagaggtgggccacactgtgtactggtaaagcccaggtgtcatccctgaaacacagaagctgtggttcccagaacccagggcccttgaggctcagccccatagaggtggggagccccttccaggcctcgggccctgattgcttctgagaaccaaggcaggtaaggtctgcagagaaaagtccaggaggtggaggggctgcccgggctgggtaccccgcagtgcctgagtttatatcctcttcccctcaggacgctagccctggctgaggacctgcgcaggatgttccagagatcccttcagttctggggctttctgtaaccaaagactgtcccagagcctgtcaccaaaaaccagctcattccacaagggccctggaagctctggttcacatccagcactccttagcctctgttccctgcatcctctagaggcattgatactagagcaatccttaagtgggacttagcaaaggccctggtggtttggtctaagtgtttgtgaaatcattcaataagggacttaaacattacctctttttaaaattttgaactaatgtagaagtcatttccgcacccagtggcccctcccgtgaacatcttatataacctgagtgtaatcagcaaacccaggaagttaccaacgtgtaatactattaactcaattgcacaccgattcagattgcaccagttttcccacaaatgtccttccatccaggatcccgttccagatcccacactgctcagttgccatgtctccttattcccctccaatctggggcagttcttcagtctttctttgtcttccatgaccctaacacttcagaagagcacttgtcagctattttcttaaatgtccctcagtttaagtttgtctgaagttcttttttggactgaggttgtgcacttttggcaagaatcccacagagctcatgttgtgaccttcttggtgccccctatcgggattcatggtgtggacatcactggtgacattgacctcgatcactgggttaaagggatgtctgccaggcttcactgtaaagtcactgtcttttcttcgtaattgataaataccttggaggaaatactttgagaccatgtgaatctctttctcctcaaacatgagctcattacttttagcatccatcggtagatcttgtccacaataattattactgtggtgattgcctactggtgatttttctgtttctctctgtctttgtagtcctacatttatttattggaactctactgtaagaaagaattggtctttctcccccatttatgtatgtgattatttacttatgtcaatgaaaactcatagacatttcttttatcctgtgatttataatctaatcctgtggttatttattttcttgctcaaattatcccagctttggccattagaagttccttcaggtttgctcttgtgttttcaaccagcccctccacccccacctgtttttggaagacttccttaactttctggtatcacaagatgttcaaggcttatcttgtatgttcccttcctcaactctggaatcaaccacttctccaaggagccctggttcattttattggagaatggcatagagaaaccaaggtttgggtgccaggtatgtttattgccactgagctgtcattgcttttaggccttttaggggacatagctgggaatgatatggacaggcactaatccatgcgtgcacactcatctgtatttctgtgtccacctacctggatgtatattaaaaaccacgtgtttatactggtatctctaattctagtccaacatcacaaggctcattttaactttttccctttcctgcaatttttttccccaacagcaagaaactcagcttttgttagctaaaatatatttatttaattctagtatacactaaagtagtttcagatttattaacccatgtccccatgagaagcacatttacccaattactgagtaggtgatagcgtttgtgtacagtctttttgtcctcagccttatgctatccaatcaaaatactgttttccaaaattacttaggtgagttcttttctttcccacccccttcagtgtggtaatactatttatttgtaatagtttggtccacttattaatgtttacattccattttgggtttccttccggtcttggtaggtttgaattgctttgtgtggacatatgaaagacatgctaaacatcgcaatgctcctgagtcagatctatagcaaaagatacactcagagaagcatcacttcctccccatcctcgccatcgtgatcctaccccactcttctctgcatccctttctcttccaccacctctagggaaccagtctctttaatttctagtttacccttcctgtatttcttttgcataagtgagcagatgcatgcatgcatttttgtagcccctttcttccatgaggtgtagcatactgttgtatgttacatgtctgttgcatgcactttcacactttgcttttctaagttaacattgggtccttgaaatctctccaagtccattcatagggtccttcctccttcctttttgccaccacatcgtactctgtgtggacatgccatggtttattcagcccttctcctatatctgagcatttaggttgcttttcgtatttttgcatttacaaatgaggctgcagtggatgaacttgcgtgtgtgttttcatagcattggagcttatcttcagggtagagtccaagaaatggagttgcacagttgcaagggaaatgtatatgtggttttgttaagtgttgccaattttgtttccagaaagctttgccttcaagggttggaaaatagttatttcttgttggaagtcaacggtaagcataaggggcaaggtgggggtattgctactcttcttatgggatctttagaatgttgcttttctggccagaaatctctgtggccagtggtgcctttgcccaagttcttgtccggcatccaggaagaatgaggtatgcagacaagtggagggtgagcaagatgaagaggtgctttactgagtgttacaacagctcagaggagatctgcaatgggtagctcctctctgtaggcaggtcatcccattgagcgtacagctctcagcagagaagagaccctggagtgagtggcttctttatgccagcaggtcatcccaccatttctgcagctctcagcagagaggaggccctgaagagggtgactcctctttgcagctgagtctcaacatctgtgcagatctctgaagccctcagcagagaggatagatcctctctgcagctggtcctcctgtggtctctctgtcctctctgacctctgccctgctctggctgaacctggggcttttatggacctcagaggagaggaagtgtgtgtcagttggtccatgggcagccatgggtgggcctggaaaaggcaccacaagtccccagtttgatctgcaggactggcagtctggcccccagccttcaggccctccctggccttaaggtggagcattcctagggacctgcctgcttctgctcaggaatctgtctgcctcctgatgctgttcatggcacctgggcttggccccagttttgctctgagatcagagcagatgccaacagcagggagaagtcagatagtgggaagaggcacttccgaagctatgagggcagggatgacttcccaggtccccaagagtgcagggaggcctgagtctgcagccatggtttgggcagctgcagctgcacccagtggggtggggctcctgcctactcagccgctccagacgacctgccactgccatcactctgatggaggctctttctcaccaggcaacgatctgtcaggcaaagtgcgtcctcccatctgtcctcttagcatcaaggaaaggcagatgctggtctctcatgacaacttactgaggactctcatatacgctgcctcgttttgtcctctaacaacatcatgaaggatctgagcttactctactgttggctccattttaaaggcaaggaaactgaggctaagagaagttaagagattttcccttggtcacagagttagttgggatcacaagagtctcaaaatcagttttctcagattatggccttcttcccctctccatgtacactattggaaccataagaggccttggctatcacccagtttgagcccatcatgaatccattacagatgaggaccagagagggaagttgatgtagtttaggtgacacagctcagtgagggccatacctggaacccaaatccctgggtccttcccctactccctgttagtcctgggaattggaggtagagtagccctggcaagtggggtccatggcccagtggaagtggcaggtaggcggggggtgacgttgctgggctggaggtctgcaccacaggcctgcgtctcatctctgctgttgaagcatcctttcctcagagatacctgatgacttgggttcctcagggaagtctggactaacagaattaacttttcccacaagtgaaaaacgtgttctcgttgagcaaaggaaattttgattaatttacccttaagtgtcagtacagggagctgttttttctctttagatcagtgtttaaacttttctcactcaacacacagtaaactaatcctcctttccatcagacttcagggggagaaagaaaataaacaaggttatccttgctgccatctctttttttttttttttttttgaggtggagtctcactttgtcacccaggctgggctgcagtggcacgatctcggctcactacaacctcctcctcccgggttcaagcgattttcctgcctcagcctcccgagtagctgggacttcgggcacccaccaccatgcctggctaattttttgtatttttagtagagacggggtttcaccgtgttaaccaggatggtctcgatctcctgacctcgtgatccacccgcctcagccccgcaaagtgctgggattacaggcgtgagccaccgtgcccggccgctgccatctctttatagggaaatccagctaggtgggctgggctaggctgtccctaccccccatctcagctgcctctcagagtgagccaatgcatgcactcactctcagtactgaacactgcggctgccccaggccaggctcaggggccagaggacatggaggtgaatctgacccacccaggcctgtccttccaaaggagctcagtttagtggggaaagacccaaatcaagagatggtgacaggatagggcaggagttgcccagacatccgaagacggggtcctgggaaatgctaccaatggaatcgagcttcaaagggccagcagtagttcttcaagccaggaagagcatgtgaacaaatgcacaggggttagagccccagcaggcggtggtgggactggaatgtggggggcatttgagggcaggcaggagatgggcagcacctgggagtcatgttggctgcgtgatttaaatcgcaactcggtgtatgatcatttctttacttttttcactgccgtatccctagtacctacaaacttcctggagtgttgcagagcttcactaattatttaagtctcaattccttatctctaaaatgcagataatgcttatttttgtctgtgctgtcgctgtgtctctagaatagggtcttggctgggcacggtggctcacgcctgtaatcccaacatttggtggaggtgggcagatcacttgagcccaagagtttgagaccagcctgggcagcagagtgagacctcgtctgtaaaaaacaaaatagaatggggccagcgtagattaaatactaaataaatatttgttgagtgggtgaatggatggaggaactgtgtatttattaattagtagctatgacgtttatcatcatgtgtggctggatagtagctactggccccatcatgacagatatcaagtacaaagccagatccagcaacatcttggcaattagggaggggaagcactgtaattaatactaatcattgtgaaccttcgttgatcagactaaatgctttacagatattttatctcttcactggttctttggaactcctgggagtaattcctatcaccagggatggcctggctgccgtctcccttgagtggcttgtctgatgacagccaggccattctgtggctgcctgtgctgggcatgggcatgtgtggaggagcttgtcctttggaaaactcttgcccagcccctgacgaagaccttgcctgggttcagactttgtcactcagaggctcccagctcatttcctgaaagcctggaaggcagctgtggaatgttggcagagctggcggccaccctgtctagacatttagtcctggagagccggttacccattttacttactgtggtttgattttaggagccaagtgagtttcaaaaatttaatataaagtatctaatgcatacaagagtatacatagtgtatatgtgtgattgaaaaaataaacaggaattgaacatccatgtacctattgcatctaatgaataaattccacaggtgccttgcatgacttacaagggcctctgttctagtccccgcttccccctccagcctcagctcttaggacagccccctcaccatgctgctgcgccagccctactcgatgtagcattccgcacttccacattttcttcacatctgccagtcccctgcctcgttgcccttctcccaccatcagctgagatggtcctactggcctttgatgtctcagctcagacctcctatcttgtggagacagttcactgcgtgccctctctgcagtgccctgggccctcatcaccatagtgatcaatttgtgttttccgttcactgggccatgagctcgttgagggccagggcccttgtcttccatttgtacatgcccgttgttatgggcagctgtgttttaggtgaccactgaggtctcttcttggaagggagaagttgatgcttcctctgtgttctggcctcatctgctagatttgtcagacaacgatgctaaatttccaggcaggagcttgccatcgtagataggatcagcgtgaaccttccccgctccaaaatatggaaatgttctcaagacggagaaacactcagaattacagttgagcctgagccactccattgaaagcagccagcaagtaatggaaagaatttggatagaataatccctgtcttccttttccggaatgtctggtaccttttagcacatcagggagcaaagatttagttctgagactggcattattttgacaaacaagttggtactagaattaaatgacccaaaacccaactcccattcagcctaaacatctctgctgtactatagaaaggctgtcagaacctccttcatttgtcatttttcacatacagcaatggccccttttggttttcaaattccagcctctcaggcagagagatactgacatgaagatttctccttgcataccggcgttgttcttgtcacttggctggtgaggttctttgaggattgttggaaaacagaagcactcgtagtcttcgtagttttatttatttatatattgattgctttgaacatgataaaagtaaattaacataatcaactatgttatagaacatttctgaatttttcccccagcatgtttttcctaaacaagtaaggttttaaaaatcttacttgcactatattgtactttgtatttttactttagtccccataatcatgttgaatttatgtgatcattgattttatttaatatggaaaagcaaatttcttcttaaatttacattacctaatattctcactggctacgttctgcattcgacactgccttttattgtaatattgtctaaatagatgcagaaaaatggaattttctctattaaagtattttacatttgaaatataaaagaactagataacagttttctattcaaatgtgtttattttaacattgtttggttaaaaaagatagatgaagttccagtcaaccactttttccccctgaaatttcaagataatgctgtattaacttttctagatctaacactagcttatccttccctcttacaaaattgtttgaacttactgagaaaatattcccatcattaacaaaaataaactatttaatagaaaaaaattatttgcagtcataagtagaactgaattttaatatcctgtgcttttccccttatcacatcgtgggcatcttcctttttttctttttttttctttttttgagagggagtctcgctctgtcgcccaggctggagtgcagtggtgcgatctcagctcactgcaggctccatctcccaggttgacgccattctcctgcctcagcctcccgagtagctgggactacaggcgcctgccgccacacctggctaattctcttgtatttttagtagagatggggtttcaccctgttagccaggacggtctccatctcctgacctcgtgatccgcccgcctcggcctcccaaagtgctgggattacaggcatgagccaccgcgcctagccgggcatctttttttttttacctcatggtctttgtcaccatcattttctttcctttttttttttttttaaattctactctaagttctgggatacacgtgcagaacctgcaggtttgttaaataggtatacatgtaccatggtggtttgctgcacccatcaacccatcatcatctaggttttaagccccgcatgcattgggtatttgtcttaatgctctccctccccttgtcccccactccccgacaggctccggtgtgtgatgttcccctccctgtgtccatgtgttctcattgttcaactcccacttatgagtgagaacatgcggcgtttggttttctgttcctgtgttagtttgctgagaatggtcaccatcattttcagctgccaggtaatgcatcagtgagttgtaatcacacgaatttttcattccgcaatttactattgatcactgagtggcttggcaagggacaaactccatttcttagaattggctctgagaaattggtctagagaagtcataaagaggaaacctcaccagcaaatagaggctgcagaaagtgccaggacccagcatcttggatatcgctcagccatggtctgtccagcagggtcactaacctagagacctctaagtcctagatggactggactttttttttttgagacagagtctcactctgtcactaggctggagtgcagtggcacgatctcagctccctgcaacctccgcctcccaggttcaagcgattctcctgcctcagcctcccgagtagctgggactacaggtgccagccaccacacccagctaatttttgtatttatagtagagacggggtttcaccatgttggtcaggatgatctcgatcacttgaccttgtgatctgcccgccttggcctcccaaagtgctgggattactggcgtgagccaccgtgcccagcccctaggtggactttatagcaaccttggataaatatgggccagaggagaaggcaaacagtaaccaattgacagccttggaagagtgctaatgaactagttggtattaagctggaaacctagtcaaaaactggaaggtgagtaactgtatggagagggtgcacatccagtgtgtggatgatctgaagctgggaggagagtgactgtgtaggaagacaatcatctagaagccaaggcaaactcaacagattggcacagtgggcagaggtcagccccctggactgtaatgtaaatactaagtcctattcttgggttaaaaatgctcaccttccacaaacagggagcaatgtgattttgtagcatcgtaagtcatggcatactgtggtgaccccaaagtgaagtggttcttattagcatccatggatgtgccacatccaggagggagaggacaaacctgcccagtttgggctgaaaatctttcccttatgttttccttatgcatgctgtgattttagggtgggccttcccaggagaagggatcatgattaggagtggctatgtggacaagtagggaacagaaggtgcttagctggacaaaagggcttgtgaagtcatgagaatgagcctctgtcatcattgtcatcatcatcaatcatcatcatcaccacttaatcatagtggctgccattcatcaagctaggagacttagaactaatgtctttaatcctacaagctactgttatccctactttataggtgaggaaactgaagctcagagagatgaagcagcttgccccagtcacatagctgataaaccactgagacaaaattggatcccagctatatctgaagccagagttgtcattccttccgtatcaatttttcaaaaaccgtggtgctcccttgcagaggataacaaggacttgcttttgtttagttcctggttataaaagtagttccagtgggtgcaagctaagcgagaatattttgttttaaagcaaagggctttcctgactgagctgtcggcaggtagaatatacttcctgagaggtggtaaattccagaatgataggaagtcttcaagaggaggcttggttagcactgtgtgttctagagggagctcaaagaagccaacaaaataaccttgaataccccttctgtacaagtaaaagctctggttgcatgcaacagatactggtaagaaatgggttccaactgccttaagcaaaaacactgttttttgcagggatatggggtagttcatgggatagaaggaaatggtgagctgagctttaaaaagggcaaaagtcagcctggctgcaggcatccaggcggcagcagctaatggaacctcatttcagcaccgtggctaggatgagtcagtgtttacagttgacccacctgctatcaccctacctaagactaagctccagagacagagcatcttataggcttagccaggatccagacccatccccatggcagcttgattgacagcctccattaggaagggtaattttccagaggaaaatcgagaccaaagaaagaccatgaatgctggttaggcccagtgagccatgacctccgtgccttctagccctgcccggctgggattccacactgaaccctgagtccccctgcagggctctccctagctgctctgcagcctctaggcccaggccacacacggcgctgtgtcactgtatactcgtggtttattttccaagacacgcatcctaattaagcaaatgattaaaaactctcaagtgtgctcatcggaagcagcccaacagaggactggcttgctgggaactgtgcttgaaagtgagttgcccatcgccttagcacagtaggggtgctgatgaggagcactctgtctttccagaaaagtggctcccttcctggttaccatgcggggcttcttttggcattcagcacagcacttaatatacccagtctttaaaaccctgtgttttttaaaaaaaattgtttttgctaattaatttgttttaatatcagtattgttttattgttaattatgcagttaactagtaagtattaaatcaccaattaacttattaagtatggaatagatatgagaagcatatttagaatgtaagtataaagagcaagcgctcatgtacccaccaccagcttgagaaatattaccagtggcttagagagtcctgagcatcctctccatcctgtccacttagtgggaaccactacgtcggctttgggatttattgttctcttgtttttctttgtgtttttatcacacttgtatctccatataaaatattgttagaatctccctgtttctgaacttcccacataagtgggaacatcctttctgtggtcttttgcaacgcgcttttgcactcgatattgtatttgcaattcatccatgcgatggcacgttccagcatttcattttttcctcgacgctgtgtgtttttccagcatgagaactcacaacggtagatccaggccaccgctgatggccattgatgctgggtccagcattttgcttatgctgacattgctgtctttaaatgctcttatccatgtaccctgctgctcatttgcaggtgtactcggtgtgtatctcaaggtggcatggctgggtcactgaggtgtgagtatgtttggctttataagataatgccatcctgttttccaaagtgacagtatccactgatactcctgccataggtatctgagagtccctgctaccgtacagactctgtcagtgttcagtggtcttgtcagatgttttagttcttgccaatctgatggctgtttgatggtagctcactgtgtttcaatgggcatttctctggtactgaggtttagcttctttacggctgtttactcttttgtaaaccatgcctggacatggttttgcccagttttctactggatatttatcattttcctactcatttgagactagaatgatgtatagtgtatatcccagtttgtggcttaacttttcacttttgatgatattttatttttttgataaacagatattgaatttaaggtcatcgaatttcataattttccttatagtttgagcttttatgtcttgttaagatatccttctctaccccaaggtcatacagatattcctttatattgccttataaaagtttcgaagtgttctttttctattcttatctataattcatctggaactgatgaactactgatttgatttcatttattttttcatacagatactcaggtattccaacactgctcatcaaagacccgtttacccctgtggatcagcagtgtccatgtgtgtgtaactttgtttttgtttctttggcctatttgtctaaggcttgtataagccttagacctaagacatattgatgccctatgaggcagatctccctaccttattctttagtaaacatcttggctgttattatccatttgctctttgatatacattttagaacctacttgtcaaatatcaccaaaaaccccatagacattttgactggaactgcaaaaaacctatagaacactttaggaaaaactgatgtttttaggatattgaatcttgcttattgaatctagcattccgtgaagatggtatgtcttctttttcatgttggtctgcttttatgtctttcagtaaagttttacagtattcttcatcaaaatttcacacatctttattagatttatttctgggcactttatatttcagatactatcacaaatactgttttttaaaaattaacatcttgattgagatataattcacaaaccacagaattcatctatttgaagtgtacagtttcatggctttagtatatttagtgtatttagggttgtgcaactgtcactaaaaatctaagtttagaatattgttgttactccaaaaagaaatgcctttactgttatcagccaatccccacttccccctccacccagcccctggcaggaagaaatgagtaaatgattgagtggataaatgaatgtataacctttagcaagctttatgtcagacattgactggccccagcctttgcttgttgtttatttttaattttttaaattttattttttaagttttaatttttgtggctacatagtgggtgtatatatttatggggtacttgagatgttttgatacaggcacacagtgtgaaataacacatcatgaagaatggggtatccatcccctcaagcatctatccactgagttgcaaacattcccgttacactctctaatccattttaaaatgtgctgttattattatacttgttgcttattgtttctgttttcctttcccatctctgttattgttctggtttctaggctaatctcctggattctatgagtctcctccatcactgttcatcctccagaccctggccagacaactttttccaaagaaaacaatattctaacttctccatttaaggaagccctcagtaactcccctgggaatcaagccacactcccaacgtgttgtctacaggggaattgaagtttccaagttgatgacttaagcaacttggaaacaaacacccgaggtgcaactcttctgtgagtcggagaaggtctcttctaggtctttgtttgcttcagagtcctcggaaagtaaacacagctgacctgattattcccctccacttcctcctgagtcagagttatctcgagttaattcagggaagaggctaaattaagccttgaaaccaagcagcctccatgacaggcgctttgttttgcttgagtgactgtgatgatgggtctttggttataaaggcagcactaattgtatcttcttataccaatcctggccatctattccctggcctgtagagactgggagatgccaggttgccccagagcacccactcattcattcagcacaattttcttaagtgcctgctccatgcccggcatcacgcttggaggtggggattcaaaagtccttcctccaagggcttgcagtctttctaagacgacggatgataaaccagagactccattagagacatgactagtgcttggatagacatctgtccagggcagtaaagggagtggatttctaagattcttacaacagacttctcatgactttgtgcaaagtttgagctgtggagtcaccaaaataaaaaggggggatccactaatacctacaaactagcaaacagacacaaccactttgaaaagctgtttagcagtatccactaatgtcaaacgtatgcgtaccctgtgcccggcagctcctcttctaggtatgtatgtagtaataggaaatgcacgtgtgaattttacattaaaagagaaaactgtaaataaaaactgtagttaaaacatgcagcatgctgcagtgtttacggggaaatgaaatagtatctgcagtttaggccaagcatggtggctcacacttatgatcccagcacttagggaagctgaggcaggaggattgcttgagcccaggagttcaagaccagcctagcaacatagtgggacccagtctctacaaaaagaaatgtaaaaattttagctgggcgtggtggtgcacgctggtggtaccaactgcttgggaggctgaggcaggaggatcgcttgagcccaggaggtcaaggctgcagtgagccgtgatcaccccactgtactccagcctgggcaaaagaacaagagcctgtctcaaaataataataataatagtaataatgatatatgtagtttaaaatgcacccaaaaaagaagatagatgaataaggaatgggcagatatgtgacaaagcaagtatgggaacatgttagtaatggatttgagatggtgagtttatgggtgctcactgtaaaattccttcaaatttgctgtatgttaaaaaacttaatatgaaatattgggaaagatgtatgtatatgcttgcccgaatatatatacaagaatgttcatagcagcattattcataatagccccaaacttgaagcagtgaaaatgcccatcagccatagaatagagacataaattttgggtgtagtgatccagtggaatactgttcacatataagagtgaacgagccacagctatacacaacgacgtgagcaaatctcacacacagtgttgtgagtaagaaatcagactcaaaagaggacatactgtatgattccatttacgcagaattcaaaaccaggcaaagctcaccaatggtgctagaagccacaataatggttttcaggaggtagggatagtgattggatggggcactgtgggaggcccctgggtgctggaaggctctgtttcttgatctcggtgctaaacagatatgaaaatgtatcaagctgtacatttaaactttgtgcactttcctgtatgtttactatacatcattaaaagtatacgaggggagaaaaagcaggaaaaccgaacgaatccaactagaagctttccctagctgagctgtgggagtaggaacccactgtaggcctatctagtaaaccgaagttgtgaagaatatgaaacttgcctttagggtgttcatttgttcacttatgcacagtttcatgttgcatcagttcctccattcttcactgatgtgcttgcctctcgttcatacggatgttcattcacatgtcctgtcctccggatccagagccgctctgtaaggtgcgagcgacccagccctttcaggggctcatgtgcacagggggagggcatgcagacgtttcatttcccatctcatttcacattcccacattcctggattcccgtttgtgatccttcctggatatgtgccctaagatagcattcgaatgagagaaacagaactggtaagatatatataggtgtatataaagagatttattatacagagttgactcgtgattttggagaccagcaagtcctgagatccgcaggatgagtcagcaagcgggagacccaggatggccagtggtgtggttccatctgaagccctgcaggctcaaggcccaggaagagctacctgaaaatcaacagttcgagtccaaaggcaggaaaaagccattgtcccagcttgaaggcaggcaggcaggaggaatttgggggaatgtcagcctttttgtttcattcgggccttcagctgattggtcagtcaccacccacatttaggacagtctgatttcttcagtctcccaattcaaatgttaatctcatcctgacacacacacccagaataacgcatgaccagctatctgggcgtgcatgacccagtcaagctgacacataaatttaaccatcatcaaaccctgaagcgtgaaaagcctcctggctctaaaggcacagccctccagtggaagaaatgtagctatggggctggcctggtgcacatcacatcacaagtggacgggctgccaccaccacacacactgatcctattttacctgtggtttggaccagcaattggtagaaaagaaggctttggctgcccagtctgcctcctggatggccatgttttctgtcttcgaaaataaaaagttattttgattattgcaatacataccatgcatacaaaaagagtagctggaagatatgcctgcagtttaaaggaacagtttaaagcttaacagatggcagatgactagtatctgaaggccactggtgcccctccctcatggcagcctgctccactcttgcctggagaaagccactctcctgagttttgcgctagtcactttggtgctaatcattccattactttttatgaaaatcaaatagcacatgtctaaaacaatagatgacttggttttgcctgtttcgagcctttataaatcaaattgtactgcacaaatttgtctgccatgtgctctttccctccgctaagtgtctgggctttgttcttcctgttgcctgtagttctaattcattcatttcaccatcatataatattccattgtagagactgaccaccacatgttcatctgctctcctctcggtgcatatctgggtaacttccagttctctgctatggcagatgaagcccatgggagcagtcctgtgtccatgcctccaggtgcacagaagtgaggccttctctagggtataacctggcagagcaggtgcccagtggtagaatatgtctgttcacttttctagctaatgcctggaaactttctggaatgattgtagcaatatctgtttctaccagggattatgagaatttctcatggcgttactcatccacaccgtgcatagaccctttaccatcctgcctggtctcaatgaatcaccttccctggcttccagccacccctacccataccgcagtcagagctttagcatggtaggactgtgatgccccatacacactttgtggatactcaggacagcatgtttcttgcgtgtaacccaatatgtgagagtatgtgaaattcccaccaccaggatggagggcacagactttagtttcactgcagtgcagctgacccagtttctccttcaagggaaggggggaaaaccagctcaacaaagtgggtgatgcccgggtagacttctaggctcctctctctgtaccaatgtcaggacactcatcttctaaaccaattagccgtgttctgcctttttcccatggccaagagcaaggtgtcccaaggtaggatccttgtgggatttgtcattctcccaccatgttctgacctgcaagcagatcactacccactacagatctgcctggctatggagggcatgcttataaatgatcatcttttgtgctgcctctttccaattacaggttagcctggcaaggaagataaagacatttgcaaccaagatggtaatcactagtgaaaatgatgaagacagaggaggtcaagaaaaagaaagtaaagaggagagtgtcttggcaatgctggggattatcgggaccattctgaacctgattgtgatcatatttgtctacatatacaccaccctgtgaatggcccagagcgtcctcagaggcctcagaatggccaaagacggaagtcctgcgtgtcggcgcatcactgaccagaccctgcgagaacaagcaggcttgacccgcacataccacccaatcaaatgcaccttcaaactttacaaaaggtcacacaaatagaccgatcctgctgcagggagcagacactaaagcacaatgattccaacaaaactcattcacagcactaggaactcaacgtctttggcagggggcccagaagaatgcttggaagaccagcctctgacaccatcagtgagcggatgggtgcagaaattcattattccagatcgctgacagatatcacatatttgaaaagatgaatagggcggacatggctcagatgtgtgtctcccaggacaagtgtttcatcttcacttgacgagctatttagtggaaaaaccacaggcgcagccctttgacaggcatcccattcatcaaaagtgtctaactatttgatactggggagataacttatttttcttttttcattggcttgacatgtgtatctgttcatgtcaaggtttataaatatatatttttaataaatgtgctctattttttagcatgaaccaaatacttggagaggcactcccagatccatagagctttccttagttttatctgctttgtcccctcctcccccaactacagatgttctgttgtggagccattctagtccttttgtctcatcttgagtcttttaccttgcgcttttgttctctctctctcctctctctctgcctctttggtctgaaggacattttcccatactgtcagccatggttttgggtgcatgttttaagattgtccattgagtggctttttgttgttatctcggagatataaaatgattgtgggcatgcagaccttagatgcaccctatctttactgagaattatgcatgaataagggctgagtgatagatcagcttaaaattaaaaggactacctttgaggaagaagagcgtggctatatttgcagatgaacttttgaacagaatattcagcttcttaccggcagcgttattgtttcattcttgtgaccattcgtttatcagattttgattttagcggtcatgtaccgcgagagttgggaagaacaagggggaaagctcgggattaggtgcattactccttcctttgcaagatacctgggatcctcctcaaaagcgggtggggtataaatgacacaagaactcccccaggagatctcatggtgattcaggctgtgaggacagccctgtgacaggtgacttttcagggacatgaggaggggatttaatgattgccctaaaggacttctgtatttttaaagcccctggtttacacccacatgaagctatttcctctctggcagggatggttgcataaaaacaaattagctcccttctggctccctgaaatgggcccttgcctggctacagtggcatggccttaaagagagggttagtattccttctgccattgccagctgtattagtctgttttcacactgctgaaaaagacatccccaagactgggcaatttacaaagaaagaggtttattggacttacagttccacgtggctgaggaggcctcacaattacggtggaaggtgaaaggcacgtctcacatggtggcagacaagagaagtgaacatgtgcaaggagactcccatttttaaaacagatctcgtgagactttttcactatcatgcaaacagcatgggaaacctgcccccgtgattcagttacctcccaccgggtccctcccacaacacatgggtattcaagatgagatttgggtggggttacagccaaactctatcaccagccttgcccctgggcagaagcagcagcagtctgcctggctggattcaaatgattctgaggcttctatagtctatgcctgcagatctctccctcacccatgctatagtgtctgaaattccaccattagagagtcatttcttgggctctgttaaatggaccaggctcttttataaagaaaatgcccctgagcagctggctctggcattgatttatgatatcttctcttccctgccagaaggaaggaagctaaggtgcatgtagggcgtactgtgtgcccaggcactgtgccagatgctttggatacttggagtcattgaattcttgtagtaaccctgtgagagagggagtcttttctccacattgtagaagaaggaaaaagggctcagagaggtcaagaaatgtccctgagatcacatggcttctagtggagtcaagatccaaacccaatgtgtctgattccttagcccttgggggtccggaggctgctgaacaagaaaggaggtggagaggagagaaagctgcaggcataccaccgcacacccttctccctcccctgtaaaaacaaccctgggaactccctggacactagcagaatatcatacactaaggataagggatgagaggaggctggttagaaataaagcagtgtcagggggaaggagctactcagtaggctctgtgtgattctagaaagactgtatgaaaattctgaacagtgaacagaataaacaataaaggtgcaatgg

SEQ ID NO: 379 - DNA, 5432 bp, Homo sapiens
ggagggaaaagctctttaatttatttctcaagatatagatccaacaggactgcaaagtggaacagttctcagaagcctgattcaggaagatgtacccgggttttggcaccaaatttcacacgcgtccgtgtgaagagaccaccaaacaggctttgtgtgagcaacatggccgtttatttcacctgggtgcaggcgggctgagtctgaaaagagagtcagcaaagggagataagggtggggccgttttataggatttgggtaggtaaaggaaaattacagtcaaagggggtttgttctctggcgggcaggagtgggggggttgcaaggtgttcagtgggggtgctttttgagccaggatgagccaggaaaaggactttcacaaggtaatgtcatcagttaaggcaaggaccagccatttacacttcttttgtggtggaatgtcatcagttaaggtggggcagggcatattcacttcttttgtgattcttcagttacttcaggccatctaggcgtacatgtgcaagtcacaggggatgcgatggcttggcttgggctcagaggcctgacattcctgccttcttatattaatagaaaaataaaacaaaatagtgttgaagtgttggggcagtgaaaatttttgggggttggtatggagagagaatgggcgatgtttctcagggctgcttcaagtgggattaggggtggcgtgggaacctagagtgggagagattaagctgaagggaggtcttgtggtaaggggtgatattgtggggatgttagaagaaacatttgtcgtatagaatgattggtgatggcctaaatacggttttggatgaattgagaaactaaatggaataacagaaggagaaaaacaggtataaaagatctaagaattgggacgactcaggatatccgattagagagtgcctaaggagattcagaatagtcctgccagcaaagattatttatttacttcaagagttaagagtggcagtttggggatagcaccaggagatatcagctgtgatggcttggagaaacagtgcaaaccagcagtgtaaacaagagcagggcatgtatgagtagttgagaacggtgaataggagtatgactagacagaagatagtagggatgacaagttttttggggcacagtctaagttggtctagtgtctggaatgagactggggcctaataaaaaggagcgtctatacaggagcttaaatgggttgtaccttgtagcattctgaggacaggcctgaattctgagaagggaaagtggttaaagtattgtccagtcctttttaagttggtaatataagtgatataaaggtttcactgaatactaacagcctgaaaaactgcttggctgatttgactaataaaggctcgtctgttatcagactgtattgaggtgggaaggctaaactgaggaattatgtctgacagaagggaagaaatgactgcggtggccttctcagaccctgtaggaaaggcctctacctatccagtgaaagtatctacctagactaagaggcattttagttatcttactcagggcatgttgagtaaagttaatttgcgagtcctgggtgggggtaaatcctcaagcttgatgtatagggaagggggggggggcctgaataatccctgaggagtagtagaatagcagatggaacactgagaagttatttccttgaggatagatttccacgatggaaaggaaatgagaggttctaagaggcgggctagtggcttgtactatagtataacctgccttcgctggtgtgtggcgattaggcctggtggaactgccatcaataaatcaagcgtgatcagggtgaggaacgggaaagaaggaaatttggggaaatggggtgaatgtcaggtggatcagagagatacagtcatgggggtcaggtgtggtctcaggaataatgtgggaggctggattgaagtctgggccaggaacaacggtaattgtgggagactcaacaaagagtgagtacagctgaaggagccggggagcagaaagtatatgcgtcaggtatgaggaagaaaatagattttggaagttatgagaactgtagagagtgagttgagcatagtttgtgattttgagggcctctaaaagtattaaagcagcggcagccgctgcatgcagacatgagggctaggctaaaacagtaaggtcaagttgtttgcacagaaaggctacagggtgtggtcctggctcttgtgtaagaattctgacctcactaactatgcctaggaaggaaaggagttgttttgtaagggattgaagtttgggagattaatgggacacaatcagctgggagagcacgtgtgtttttatgagaattatgccgagataggtaacagatgaggatgaaatttgggcttgactgaagtaatgggggctgtctactaagccttgcagcagtacagcctaggtaatttgctgagcctaatgggtgtcagggtcagtctaagtgaaagcgaagagaggctgggacgagaggtgcaggggaatagtgaaaaaagcatctttaagatcaagcacggaacagtgagttgtggaggaaggtattgaggacaaaagagtgtacgggttgggcactgcagggtggataggcaaaacaatttggttgctaaggcgcagatcctgaactaacttgtaaggcttgtctggttttaggacaggtaaaatgggggaattgtaaggagagtttataggctttaaaaggctatgctgtagcaggcgagtgataacaggctttaatctttttaaagcgtgctgcgggatgggatattggcgttgagtggggtaagggtgattaggttttaatgagatggtaaggggtgcatgatcggtcaccaaggagggagtagaggtatcttatacttgtgggttaaggtggggggatacaagaggaggacgcaaaggaggctttggattgggaagaagggcggcaatgagatatagctgtaatccaggagtagtcagggaagcagataatttagttaaagtgtctcagcctaataagggaactgggcaggtggggataactaaaaaggagtgcttgaaagagtattgtctaagttggcaccagagttggggagttttaagaggtttagaagcctggccatcagtacttacaacagttatggaggcaagggaaacaggcccttgaaaagaaggtaatgtggagtgggtaacctctgtattgattaagaaggggacgggcttaccttccactgtgagagttaccggaagctcggcgtccgtgatggtctagggggcttccgaggcgatccggcagcgtcagtcttcagctgctaagctgagaaaatctgggaaggagtcagtcagagagccttgggccagagttccaggggctctgggagtggctgccaggtgagttgaacagtccgattttcagtggtgtcctacacagatgggacgtggcttaggaggaatcccaggctgcaggcattccttggcccagtggccagatttccagcatgtgtagcaagctcctgggggaggaggttctggaggaatgcctggctgctgcgtttcagacgtttggaagttcttgtgtgctggagatgtggctggggtttgtctcacagtggaggcaaagaattgcaacttttttctgttattgtacaccttgaaggtgaggttaatgaagtcctgttgtggggtttgagggccagattccaatttttggagttttatttaatgtcaggagcagattgggtaataaaatgtatattgagaataagacggccttttgaccttttagggtctagggctgtaaagtgtcccagggttgctgccgaacgagccatgaactgggctggatttttatatttgatgaaaaagagcctaaacacttctgatttgggagaaagaaaaaggagcgttaaccttgattatgtctttagctccaggaacctttttaagagtaaattgctgggcaggtgggggagggctagtcaaggaaagaaactgtaagccggaccaggtgtgaggaggggaggtgataaaaggattatagggtggaggagcagaggctgaggaagaattgggacctagctcagcctggcgaggagcagcctggggaggaggggagaggtcagatgggtctgtagaaaaggaagattagaaagactcagcgacgcttggggttggtactgacgggacaggcgggagggaaagaaggaagatttgggacgagttgcactgggcacagagactagggagggactgatgtgtaaaagaatgcctggatgtcaggcatctcagaccgtttgcctattttacgacaagaattatttagattttgcaggatggaaaaattcaaagtgccattttctggctatttggaactactgtcgagtttgtattggggtcaagcggcattgcagaagaaaataaggcatttaggttttaggtcaggtgtgagttgaagaggttttaagtttttgagaacacaggccaagggagtagaaggaggaatggagggtggaaggttgcccatagtgaaggaagcaagcctagagaaaagagagagtagagaaatggagggaaggggttcgggggttcttaccttccagaaaagtgggaaaaggggttggggcacagagataagaggttggggtgcggaaataagggattggggtgcagagatataagaggttggggcacggaaataagggattgggggttcttaccccatagaaaagcgggacttgccgctaagggtgaaggagaaggggttgaggggtacttgcccctgtcccagaaaagcagagaaggggtagagacaaggagagaaggggttggggtacttgccccttccccagaaaagcgggacttgctgctaagggtgaaggaccaaggcaggtgtccctgtgtggtctgacacccttgaaacgtgagtgtataatcagagaggtgtccctgcaatgattaaacaccaagggaaggctgccttcccagtccgtgaccggcgcaggagttttgggtccatggataaaatgtgtctcctttgtctttcccagaaaatgaaaggaatagaaattaagaaaagggagagattgaagagtggaaaggagaaagtggttgagggacagtgagagaggttggagaagagagtaagaagaggacacttacctgatttaaaattggtgagatgttccttgggctggtcggtctgaggacctgaggtcataggtggatctttctcacggagcaaagaacaggagtacaggggattgatctcccaagggaggtcccccgatccgagtcacggcaccaaatttcatgcgcgtctgtatgaagagaccaccaaacaggctttgtgtgagcaacatggctgtttatttcacctgggtgcaggcgggctgagtccgaaaagagtc

SEQ ID NO: 380 - DNA, 194171 bp, Homo sapiens
gtgagcaataaagctgtttatttcacctgggtgcaggtgggctgagtccgaaaagagagtcagcgaagggagataggggtggggcagttttataggatttgggaaggtaatggaaaattacagtcaaagggggttgttctctggtgggcaggggtggatctcacaaagtacattctcaagagtggggagaattacaaagaaccttcttaagggtgggagagattacaaagtacattgatcagttagggtgggggaggaacaaatcacaatggtggaatgtcatcagttaaggctgtttttacttcttttgtggatcttcagttacttccggccatctggatgcatacgtgcaagtcacaggggatgcgatggcctggcctgggctcagaggcctgacattcctgccttcttatattaataagacaaataaaacaaaatagtgttgaagtgttggggcggcggaaatttttgggggtggtatggagagagaatgggtgatgtttctcagggctgcttcaagtgggattaggggtggcgtgggaacctagagtgggagagattaagctgaagggaggtcttgtggtaaggggtgagattgtggggatgttagaagaaacatttgtcatatagaatgattggtgatggcctggataccgttttggatgaattgagaaactaaatggaataacagaaggagaaaaacaggtataaaaggtctaagaattgggacgactcaggatatctgattagagagtgcctaaggagattcagcatagtcctgccagcagagattatttatttacttcaagagtttagagtggcggtttggggattgcaccaggagatatcagctgtgatggcttggagaaacagtgtaaaccggcagtgtaaacaagagcagggcatgtatgagtagttgagaacggtgaataggagtatgactagacaaaagatagtagggatgacaagtttttttggggcacagtctaagttggtctggtgtcaaatgagactggggcctaataaaaaggagcgtctatacaggagcttaaatgggctgtaccttgtagaagtgaaagtggtaaaagtattatccagtcctttttaagttggtggctgagcttggtgagctgtgtttttaaaagacctttagtccattctacttttcttgaagacggaggaccgtaagggatataaaggtttcactgaaacctactaagagcctgagaaactgcttggctgatttgactaataaaggctcgtctgttatcagactgtatagaggtgggaagggtaaactgaggaattatgtctgacagaaggaaagaaatgactgcggtggccttctcagaccctgtaggaaaggcctttacttattcagtgaaaatgtctatttggactaagaggtattttcgtttcctgactcgggcatgttgagtaaagctaatttgccagtcctgggtgggggcaaatcctcaagcttgatgtgtagggaagggagggggcctgaataatccctgaggagtagtagaatagcagatggaacactgagaagttatttccttgaggacagatttccacgatggaaaggaaatgagaggttctgagaggcgggctagtggcttgtactatagcatagcctgcctttgctggtgtgtggcgattaggcctggtggaaccaccatcaataaatcaagtgtgatcagggtgaggaacaggaaagaaggaaatttggggaaatggggtgaatatcagatggatcagagagatacagtcatgggggtcaggtgtggtatcaggaataatgtgggaggccagattgaagtccgggccaggaacaatggtaattgtgggacttaaagagtgagtacagctgaaggagccatggagcagaaagtatatgtgtcaggtatactgacagaaaatagattttggaagttatgagaaatgtagagagtgagttgagcatagtttgtgatttttagggcctctaaaagtattaaagcagcggcagccgctgcacgcagacatgagggctaggctaaaacagtaaggtcaagttgtttggacagaaaggctacagggtgtggtcccagcacttgtgtaagaattctgaccacactaaccatgcctaggaaggaaaggagttgttgttttgtaagggattgaggtttgggagattaatcggacacgatcagcagggaaagcaagtgtgtttttatgagcattatgccgagataggtaacagatgaggatgaaatttgggcttgactgaagtaatgggggctgtctgtgaagccttgcggcagtacagcccaggtaatttgctgagcctaatgggtgtcagggtcagtctaagtgaagggaaagagaggctgggatgaagggtgcaaagcaatagtaaagaaagcatatttgagatccagaacagaataatgggttgtaggaggaggtattgagggttggagagtatatgggtttggcaccacggggtggataggcaaaacaatttggttgataaggcgcagatcctgaactaacctgtaagccttgtctggttttaggacaggtaaaatgggggaacggtaaggagagtttataggttttagaagcccgtgctgtagcaggcgagtgataacaggctttaatccttttaaagcgtgctgtgggataggatattggcgttgagtggggtaagggtgattaggttttaatgagatggtaaggggtgcgtgatcagtcgccaaggagggagtagagatctcttatacttgtgggttaagttgggggaatacaagaggaggacacataggaggctttggattgggaagaagggcagcaatgagatgtagctgtagtccaggaatagtcagggaagcagataatttggttaaaatatctcggcctaataagggaactgggcaggtggggataactaaaaaagagtgcataaaagagtattgtctatgttggcaccagagttggggagttttaagaggtttagaagcctggccgtcaatacccacaacagttatggaggcaagggaaacaggcccttgaaaagaaggtaatgtggagtgggtagcctccgtattgattaagaaggggacggacttccctccactgtgagagttactcgaagctcggcgtccgtgatggtctagggggcttccgaggcgatcgggcagtgtcagtcttcagccgctaagccgagaagatctgggaaggagtcagtcagagaaccttgggccagagttccaggggctctgggagtggcttccaggtgagttgaacagtctgattttcagtggggtcccgcacagatgggatgcggcttaggaggaatcccaggctgcgggcattccttggcccagtggccagatttccgcacatgtagcaagctcctgggggaggaggttctggaggaacgcctggccgctgcggttcaggcgtttggaagttcttgtgtgctggagatgtggctggggtttgtctcacagtggaggcaaggaattgcagcttttttctgttattgtacaccttgaaggcgaggttaattaaatcctgttgtggggtttgagggctggaatttaatttttggagttttatttaatgtcgggagcagattgggtaataaagtgtatattgagaataagacggcctcttgaccttttagggtctagggctgtaaagcgtctcagggttgctgccaaactagccatgaactgggctgggtttttatatttgatgaaaaagagcctaaacgctatctgatttgggataaagaaaaaggagcattcaccttgactatgcctttagctccagccaccgttttaagagtaaattgctgggcaggtgggggagggctagtcacggaatgaaactgtaagcgggaccgagtgtgaggaggggaggcgataaaaggattatggggtggaggagccgaggctgaggaagaattgggacctggctcggcctggcgaggagggaagaggtcagatgggtctgtagaaaaggaagattagaaagactcagcaacacttggggttgggactgaggggacaggcaggagggaaagaaggaagatttgggacgagttgcactgggcacagagactaggaagggactgatgtgtaaaagaatgcctggacgtcaggcacctcagaccgtttgcctattttacgacaagaattatttagatcttgcaggatggaaaaattgaaagtgccattttctggctatttggaactactgtcaagtttgtattggggtcaagtggcattgcagaagaaaataaggcatttaggttttaggtcaggtgtgagttgagaggttttaagtttttgagaacagaggctaagggagaagaaggaggaatggagggtggaagcttgcccatagtgaaggaggcaagcccagagaaaagagtagagacacggagtaggggtggggggttctttccctccagaaaagcagagaaggggttggggcacggaaataagggattggggcgcagagataagaggttggggtgtggaaataagtgattggggggttcttgccccctaggaaagcgggacttgccgctgagggtgaaggagaaggggttgaggggtacttgcccctgccccaggaaagcgggacttgccactaaggatgaaggaccgaggcaggcatccctgcatggtctgacacccttgaaacgtgagtgtataatcagagaggcgtccctacaatgattaaacaccaagggaaggctgccttcccagtccgtgaccggcgccggagttttgggttcacggataaaacatgtctcttttgtctctacgagaaaatgaaaggaattgaaattaagagaagggagagattgaagtgtggcaccaagattgaaaggagaaagaggttgagggatagcgagggaggttggagaagagagtaaaaagaggccgcttaccggatttgaaattggtgagatgtttcttgggctggtcagtctgaggacctgaggtcataggtggatctttctcacggagcaaagagcaggaggacaggggattgatctcccaagggaggtcccccgatccgagtcacggcaccaaatttcatgcgcgtccgtgtgacgagaccaccaaacaggctttgtgtgagcaataaagcttttatttcacctgggtgcaggtgggctgagtccgaaaagagagtcagcaaagggagataagggtggggccgttttataggattcgggaccaaatttcatatgcgtccgtgtgaagagaccaccaaacaggctttgtgtgaccaataaagctgtttatttcacctgggtgcaggtgggctgagtccgaaaagagagtcagcgaagggagataggggtggggccgttttataggatttgggaaggtaatggaaaattacagtcaaagggggttgttctctggtgggcaggggtggatctcacaaagtacatcctcaagagtggggagaattacaaagaaccttcttaagggtgggagagattacaaagtacattgatcagttagggtggggcaggaacaaatcacaatggtggaatgtcatcagttaaggctgtttttacttcttttgtggatcttcagttacttcaggccatctggatgtatacgtgcaagtcacaggggatgcgatggcctggcctgggctcagaggcctgacagtgggggactgttaatggaaactggcaatcttgaagggttgaatagaagcgggcagagcctgaggaacgctgactatctggccctcgggcactcttttcccttggctacagcagacagaaatacacacacacgcacacacgcacgtgtgtgcgtgtgtgtgtgtgtgtgtatgcaatcatatatatatgatgtgttggatcacgacttattgagagaacagatctatcaactgaaaaacaagaagaaatcacattaaatctatatgctacatgatcttaaagggaaacagagtggaaccaaagcacataaggtacactttataccatatatctcattttatatcttttatataaaacatttatatcttatatacattacatatcttagatcataccaatcaacctcaaaattgggtgtaattctgacagaaatagaaagtatgttcatcgaccatttctcttttcgtgatttccagtacagattgcggacataaaatttttcaagactattactggaaatacatttaaggtgatatcttagttgttactctgtgttcacttccacgtttgtgtcccctgacccaccccatcccaccaatagataattcagatgacaactggcttggtggcatagaggggggctggtgagggaaaacgtaatggaagtgtggttgtgtttgggcatggagatgtgctgcagtgagggaggactcaggccctcggtgctgggagtcttatagacactgacagccattagcagtcagcctctgagagagctgccttgcccagctctccagggtcaccattctgagggcggactacagccagtgactgcttgaggtggaagtacgaaagccaagctatttggccaatgcagcccaatctgaggagccatttgctttggaggagctccctgtggagtcggtgaggctgcatcacctgcattgagtccagcttcttcctcttccttccaaaggtgtgggtctcagaggtgttccctgtttaaaatccgaaccttaaactcttaggctctgcttcttggagaactccaactgccacagctggatctagctatgttttcttttggagcagaggtctgtaaactgttctgcaaagggccacagggtaaatattttaggccttgcagtcctactctgtctttgtagcatgaaagcaaccatagacaatgtgtaaatgaatgagcacagtgttccaataaaactttatttacaaaaataattggtgggctggatttgacctgtgggtggagtttgccagagagttactggttactaagaattactgattaatttcagagaacggcagaattctgaacaattcctgattaatttcttcatgctcaattttgcataaattacagagcagctcattattatgcacgatgagtgctgaatgctggataaagccagtaagacacactcttaacagagctaacagcccacaaatacagtttcagcataagacaaatgtatgatctaatactggaagacacttttagaagttgtcttctgccctgggcagagttacttccctttggccacattggcatgcacttcctaggacccatggagatggagaaagagggctcccaagggggagaatgaaggctggaaatggacattattgagcaacactgagggcccagggctctgccaggacctttgcatatgctatgcacttaattctcacaacactgtgggtattctcatccccattttgcagatagggagagtctcatctcagagaaggtaagggccatgtctttcttggtttgcaaagcacatacaccgtggcattgatttcaaacccagatgtgtctgactctaaagcccgggccttttcacgaatgcaggctgacctgtcaggctctgggcttcgaattgcatgtagttctttaaactctggttgtttctgcctgagagggcttggcaaaggagttggaccctggaccagttcctgtggctatgttcctgggggtcactggaggcttagtttccacatttttgccatcggccagctctgggctgtggcatctgatgagctgagtgtttttggtctgcgtgcctggcctcatggtgctggctgtggtgaatttaacttttcagctcttgcactggactgggaatgagcaggtgaaaactcattcccagtccagtgcaaaagctggaaaggtgtggtgggggctcagcaccaagcgccgtcaccttccttctgtcaggcagctgtcatcgcccccacaggccttttcttcacagcctgttgtcaggaggctggccaactccttgggaaggtgaaagaggaaactgggaggctgagagctggagggaatggtgccatccctattctctcttttctgggatctgatggacatggcaccgctctgacacctggagacctggctgtagcccaggctcagtgcacatccgtgtggccctgggtgagtcctgtaatatcttggaattgctcatcttacccgtgtgagaaggataaacgttgttgcttgctgcctactgcacagtgcagttgttaaggatcgacttgagcgccgcgtgaaagaaagccctgggaagaagcaggacacagtccagtgtcttcacatcagtgtagatggatggaaagcagagttctgggccactccagacttcctcattcaggagatccagggtagggcctgggaatttgcatttcctcgtgcttcaaggctccttttcaaatttcttttccataaagccttctttttcattaaaaatttaaaagttaagaaaacttagctttattgaggtataattgatacacacaaaaaaatcacactcattcaacgtatttatcttgatgattttggacctatgcatacagtcatgataccatcacaaccaaggtaataaacacatctccaaacgttttctttttggtaagaatacttaacatgaggtgcatcctcttcagctactttaaaatgcacggtattttattattaactataggcactgtgttgtacagcagagctctagaattttttttttttgagacagtcttgctctgttgcctaggctggagtgcaatggtgcgatctcggttcactgcatcctccgcttcccaggttcaagcaattctcctgcctcagcctccaaaggagctgggattataggcacctgctaccactctcagctaattttttgtatttttggtagaggtggggtttcaccatgttagtcaggctggtctcaaacttctgacctcaggtgatccaccggccatggcctcccaaagtgctgggattacaggcatgagccaccatgcccagcctctagaactttttaatattgtaaaatgggactttataccaaatgagcatcaattatgcatttcccccttccccagctcttggcagccaccaatctattctctgtttttatgagtttgactatcatagatgccttatgtaagtggaatcatgcagtactgtgtttgtcctttcgtgactggcttatttcacttagcataatgtcctctaggttcatccctattgttgcagatggcagggtttccttccttttaaagactgagtaatattccattgtatgtatacaccacattttcttataaagacttcttcaagcactatagttctagctgctctctctcccctgaactgggatccccaactggaatgtcccctcagttgtatttttgtgtaatggcatttatgaagaacacagcggtggcagcctggggtgctctgtgaggcaggatgctggagccatatcctggcccagggcagagcactagcacttattcatgtacctgtggacagggaggtggtggcatgcatagcagatattcgccatccctgactcagagacttcacatgctctactgtatttcccatgtgctgggcttgtctttccaataaaactatacacttcttaatgacaaggacaatgtcttttactgctgtattttctaataaaacttggccttgagcaaatcactctgagttctgaagtgtcctcttcaatttcagttcttaggactagcacagtggtgccagggtatagcatggccgcaaatattctttgttcaatcaaataataataattttcaattatttcttcaagttttgtgttggtcataaagtaatgaccataaatacgatgcacttttaagtacatttaatctgcatattaacactttcctcattagtttcttaagtccaggcaatcaacaaaccaacacaccaggccttgatttgcagcatctgctgatttctgtggtgtaaatacccccaccctggccaatttcaagccaatgatgtgatgccactgaatacagagttaggaagagaggtacagtagctcaccattatacagtgtttccaccaggcagatacactagacgtaaataacctcaaagcacaaatcattgaaaaatacttgatgagttttgggtacttattatgtttgtttttaatataattcatttgattgtaagtttacataatttgattattaataatggctgtttatagcacctggcttgggtaattcctgaacctttaacaattggtatgatttgcagaaactaggacttttttggttgcaggtaatacaagcttagcctaaactggtctaagccaagagggattattttatgttacaaagtttaatgcatatagaagggtaggagaggtctggcttcatgtcatgtgtcattaggacctattctctctctctcgggttttctgtcctctgcatggtgtcagatgcctgccccagcttaggacttcttgtcctcccaggcttcagtctggcagagaaggagcaggtgcttggtctcattgcctgtcatcatgttcatatttgtccctgaactaggtgccttggccaggaaagtgcaaggctctccttggcaagactcactctgacagctagggtagactcagtttcaccccatgcacctggtctgagagtggagaggggctgattactagaacggtgaatggatatggacagcaaagcaaatgtctattgtaagatctctctctctggacaggggaatagctttctggcttagacggttttggtatcagggaagcctttacgggaatatggctggatcattcattttgtgcaacaagggaaagagagatgaaggaaggatgaaagattagaggtagccacagtccgagtacctctgtgatccggggtcttgccccgctccaaggagaatggcaagacacttcaggcacaaagcactgctgggaattttgagtctcagggttcaaaatgtggcttcttgggtaagcagcttgtgcccaggaatgggagctctaagaaaggaatatctttgctggagaggaccttactaaaaccaagagcgtcttgctgaggtttggtgtgagttttggacttgccagtcatcacttcaccactaaagatctgccatctttaggtcaaaagaaagctcttaaacttggtaggtgaagaattctgcaggtgtctagagaagtgaagtgtgaactggagggtcacaggccaatgtctccactaggaaattgtgaaagaagagaaaagagctggggttagcagtgggcaaatattgccacagcattttatataaacttctgaggaggtgaaggagagagaagcgttgaatgcaaccagatggtggtttatctgttccagaccaatgactgggtcctcagggtcaggcagggccatgggtgaaggagagaatgccaggcgtcctgtccagcagcaatttcaggattctccctgtcctcagaggttgagaagatgttgaccttgtgtcaatccttgtgcagcagagtagggtcaagaagaaccctccataggaacgttggctatgtgacatggagagaatctcctgtacatgctgggccctgtgccagctgttttcacacacatcccctcaattactcttcagagcagtcaatcatcctctgtttgcagaagaggaaaccgaggctcggagcccatggatccatagctggtgagtgccagaactagaccacagcccagatctttctgatgtcagtgtcatgtcaatttctaccaccactactggcgctgcaggtgcagtcgccattggttgggcactaatcctgcgtgcagccatcagcagctattcttgggtggggctgtgtcttgttcacagtcacattccccagggactactggcaaaagttgaaaaaatacgtgattacgtatacttttctcagtaactctcagagtaggcatttaaaaaatgcctacttagagactaggaaactgatcctcaggggatttagataacttttcttaccgctcacagattgtaattcaaatccaggtctgtgtgaattcaaagctggtgatcttttcattacctggtgtatcgtcctccttgacttgccctggtgctactcagtttgtctcccccatgggtagagagtgagacaggtgtggatggggagggagtggtggtgggatttgcatcagtctgggtttagagataagccaagaggtagaccagcacgctggattcaggcccactcctgtgtggttggagtagtccgctttatttttgatatttttttcttaagatttcattttttttccaaatacagtttttttggttggttgttttgttttgttttttgccctcaggaagagactttatgtatagaaaatattatacagagtttctttggttttggaaaattaaatgtattaaagttatactttaaaattcttattattccaagtttagcaaatgttggcaattacttttaaagggacccttgattactaagtgggccttttatagccatttaaatgcctctaagccttttaaactgcatttataaattgaatattttaatctcattttgaagtctttcaatatcttaacaaaataaaccttcccaacttcttaagtaacttagaaatgcaataaaataaacttacatatgtgatgattaagtactcttaactgttccagtacagtgtataaacttagtaagattacacttaaatatacagtaagtcacacatttcaaatagaaatgttcaatgcaggtatattttttaatactcaaaattctcttgaatattacaaatactgatacttccaagtatatacgggttccttcttaatgcataaatattaatgctctaagtttggttctcttaaacatttctattcttaattcttgtttttttttttttctttttgagactgagtttcgctcttgttgcttgggctggagtgcagtggtgcgatcttggctcactgcatcctctgcctcccaggttcaagtgattctcctgcctcagcctcccgagaagctgggattacagacccccaccaccatgcccagctaattattgtatttttagtagagacggggttccaccatgttggccagactggtcttgaactcttgacctcaggtgatccacccacctcgacctcccaaagtgctgggattacaggcataagccaccatgcccagcctctattcttagttctaaatctttccagagttaaaaatgcttacccactcaggacataatgatgctatctcaagcaatttgagagaattcagagattttagctgggattttagcctggattcttgtcagccctatttgtagcctacacatcacgagtggtcagctgtaccgaaaggctgtgcaccctggcgtgggtgcagggctgtttacctctggtatgtctgctgggacctgtgccatacagggtgttaagaatttagggcatccttttctgcttacttccattttatatcaccaggccccatcctgggctagtcaaggaaattctgccttcaacccaggctgctacatgatttgactttgctttcctttgtctacaatgtattaatttctttcccatctagctgcagtgacctttgacattgatggaattctatcttctttccatattctccctgaccagtaggaccacacagctcatgccgttatgaaaatgatatccaattgcatcctgcaaatcccacagcttctgagtgaaaactcctgactattttacaaaggcttcttttgtttaaaaagatgtttttaaacataacactgactggtggaatcttcaaggcttagaagaatgaacaaatatttggggggcacctgctatgagccaagtactttttatgtcctccaacaccccttcaaagtgcttatttttatccccatattcaaatgaggaagcagaggccacatggcaaatatatggaggagctgggacgagatgtttaagattgtttgcaaaatgcagcatccttccaccatcccagttcccatggctttcaagagtttatttccagggtctctgaacaatgaagcagcctcctcacatcttcgctctgactaccaaaacttttaatagaaacctggtaattcccagcaaccacgggctcaaaggcaataatctgttcactaggccccttcccctaatatttcttaagccaccaaaaaatctggtgaagatctccaaagattttcatgatagaaacatgtcctgggcaagcctaagagttacagctacagccttgggtccaggtgccaaggtcagccttgcaaagttctagtcctggcttcagctgagatctttgggcctccttccctctccgagaggccctccaacagttggagacacgaggacttccgcctcccactctcctctgccttctcttctgtttgcccagtgagatctgcttccactgccaagtccccatgtggcttgtggctcacactttcctaggaagggaatgggaaccgaggcctcaagctctgacggctgggccaggtggctgagtctcctttgccatgttcaggcagctggctggcttcttttcatgcacactcagtggtcacctgagaaggaagtagaagtgtatttgatgtcttcatagaaattcattgtcccctgtgctggggtgtgggggtgggtcatgctggtcatgctggcagagggtggaagtgttccagcagagctccaagcagatggcagcattgaggggacacctgatgtggctcaatgccagcctgcagggcactggagccacagcaaaatgatcccggcaccggggatgggtccttgattcctgtcttggttctgtcattgcctggctgcgtgattttaagctaagatattgtcttagtccattcaggctgctataacaaaatgccttagactggatgacttatgaacaaagacatttatttcttacagttctagagggtgggaagtccaagctcaggtgccagcgggttgggtgtgtggtggagatttgctttctgcttcacagtcagtgccttctctctggctccctggctcatatatggagccctctagctatgtcctcagatgatggaagcagcactttggggtctcttttataaagcactaatcccattaatgagggcatcaccctcaaaacctaatcacctcccaaaggctctacattctaatactatcccattggggattaagtttcaacatataaattttggggggtacaaaaacattcagaccataacaactatgaattaaggtcttttcctctcactgctcaacagttttctttaaaaaaggtctttaaaatgcccttctagacttacttacacataagtttttaaaaaattgtacatgcctaagaaaggaaactttgagtaaaatagattgaataaagtattcctaaaactttctcacatttggagtcccacttttctgaattactttttggcttagtcattaaaaaccatattttctctacaatgtcatcctgggtgctaggtaagtctgtgatgacatgttgatgggggtcacaggaagggagggacccagaaatgcccaaggcctgcctcactaatcacattcccaccaagccttctaagattcccgaggcaggacccacttaaggagcagtagttggataggagtagaagcatcacttgcctgtcagcactgataactctgatcaaaatacttagaggccttgtcttgggaggccaaaatgaagatttctacttgggctttaaatctcaattcaggactaccctgttcccacagggtgtcgggtattaatgtgggaacctggggtatctaaaaggtagcactgtctgtcctatgccatgagatgttgccctaccagagcatgaaatcttggttttctggtttcttcatcaaagggttagctcagagcaccatagatagccacaggctatgggaccagatccattctctggactggcatgggtgccgattgctgagccagggacaacagcttgagtctcaattagggggctgggtcagacagccaaaaggagatgcctgaaagggagtcagtgattcagtcgagttccattgttttctggaagaggaaggctgagcagcattaatggccacattcattctgcagacaaaagaacatttggtgagatgattcacccccttcccagccacgcctccctttatcacttcacaggatgctgtacagacagaaggtatttaaacctgctggcttgggcccagtttcccatcccactctagatactcagtgctctctttccttttcatcgtggggaccaggcagggaagtgggaataggcaggtattagtcctgggaagtaatctttccccctaaatcaagaaaggattcaaacttcatattcctacgtggccttgaggaaccttggctatcatttcttgctaagttcccaggaatagctgagaaactacttaagacaagcttagggtgatcctagccatctgtacttatccaaacaaatgaaatgaattaggacaccctgtgaggccaaaaagatatgaatatggctgtatttcaaggtggctatcaccatgggctctggagccacagagatctgagtctgacgcccggctgtgctacttattctgtgattctgggctctgagccctctttaaacctcagttcccatctctagaaggggacaataacagtgcctacctcccatgagggttaactgaaagatgtgtgcattgaagttctcagcccagtctcccagactggagtcccttaagcactcaatagacgacagcagttgttattcccgagggtgggaaagggtgaaggcggatgactcagcacacaattaggcatttagagaagaaattcttgtttcatcctattgccttttcccccatggcacattttgctaatgtctttaaaatcttgacacagtgtggtgtcttgcctaaaatgatataataatgaagccactgttggaatgtggtgagggctggggtgtgtgtgtgtgtgtgtgtgtgtgtgtgtgtgtgaatatgtggtgccaaattggagaataaggataagtttattaattctttggtaattgcaggcaataattgcattactgtgacagtcctaccaggagatgaaatttgccactgtgaggatctgtttttcttctattttctggattaagatgtcaatgtttttaaaggtctcaggcatcttcccagccttaactgaaaccagtaactacagaaataattatgtttctagaaacaccaacaggaactcaatgctggtttctgtgtaagagcctgtgatctcgacttggtctctagcccatctgtgaagggaaatattctaaaactttattaaactcctgtccttaggatgctggcattggagttgtggctaacagtaggtggtgttaagtgtaaagaatacagtgagaagcctttcatgccaaacagcccatcttttgtgggtaaacagtctgctcctgaagaataatccagctagctgagatgaactggaaattcacatcgcagtcttcattacagctgaactcccaattgcattccagagatggcctgggctgggtgagagagactgatattccttatctgaaagttccaacttccattgctgaggccccaagaataagaaaaaaggctttgaaaaaatctaaggaaaactgaaacgccaagaagtttttatcagaaaatcattctgatatcattctttatcagaaaaccacagctctgggagggacctcagagatgagctagtaacctagttcaaagcactgattttacagatgagaaagctaagaggcagagaggtgagacgcttaaggtcagtagagactaggacccaggtgtcctactgctggtctggtgctcttaccatctgaaaccagtcatcacccgtgtgcgggttgcctgctgtgtacaagggtattcccaccttacagcatgaagctgactatgtagttcgacaagcagggcacatatacaccaagtaataacaattggagtcacatgtgatgagtaccatgcctgtgatggagctgaggcagaagaaggtgacatttaatttgcgatagctcagacaagctttaccgagagatagggtttcagggggtgtcaggaaagatgtttgtgatttgggtgagaggaaagaaagtccatctaaataagaaaaacacatcttcagaagagcaagggtaggaaagtaagaggaatgtttgtgagccagtgacattttggtagaagaggtaatttttggccaggcgcggtggctcatgcttgtaatcccagcactttgggaggccgaggagggcagatcacaaggtcaagagatggagaccatcttggccaacatggtgaaaccccgtctctactaaaaatacaaaaaattagctgggcatggtggtgtgcgcctgtaatcccagatacttgggaggctgaggcaggagaattgcttgaacccaagaggcagaggttgcagtgagccaagattgggccactgctctccagcctgggtgacagagcaagactccatttcaaaaagaaaagaatgttagaattgggagagacgtcacagatcatcaagctcaatttcctcattttactgttgagaatattaggtccagaaatttcagctggcttgtccaaggttttatgactaagcatggtagggtggattagaaccgctgcccatgacccctcatccagatcctttttcactacatatgctgaccttaggggaagtgatgacagagacagaaagatcacagaggaccttgcatcagattcaagatatttgtacattaagcactgaagacctttgactctttttggactgggaagtgaaacatgttcagagtggtactacacaaggatggagcttgggtccagttttgagtgatggtgtgtagcatgaatggacaagatggaaaagaggagcagaaagaccagttaaaaaggccccagaactggaccagctatgagaatacactaactagggtgatggaagagaaaatggagagaaaaggttgaatatgacacagacgtaaccgaagggtacaggagagtcgtggcataggtatggcagaggggagtcaaagataactctggaaattcagagttgaccagttgtctatggaagagaccacctgatacaatttcttagaaactgttttatgttttttccctggcttttgctgtcatttccccttagcacttcattcacttattcatcctttcatccaacaaatgttttttgaactctatgcaaggcgttccatattcaccctagccagtaactaactgaacgtgatgattctgttgttttcttgggatctgccttcttgaactcttcttggtcagggttgttggagagaactgaggcgaaataaggagaacagcttggttactgaaaagaaaagaacatgattgtatgggagggtgttgaaaagccagcaagatttcaaatgggaggaggatcaaagtgtcttgggaaggcaggaggcgggctctgtgcacacagcagctcttgggccttggggagaatgaaaagtcccagtgtaacagcgacaaagggactcttttgtgcattcacggtcaggggcctgaaggggtgatgagcagcctttgccctgaggcctgctccagtggatctagactcaggccactgcccccaggagagtggaagggcccttatatcagccattggaatgggggcagatgctgagggtttcttacggcagagggagacccagaggccacagctttggaggactgagcctggctgaaaggctcatgctccctaccatcattccagctcccagtgactccctcccagagacacactgatctctgggttcctttaacaattatggtttgtccttctcttggctattgagactcatcatctatctttattttgaaggtttagtcttaccaaccggactcttgaacgaatgtgacaaataggttaaaacatatggaaaaactgatagacaggctatagctatattgagacgtatcttctcatgcttctagaccaagcagaatgattctgggcatctaggaagttccaaaattctttcagtgagttttgtttctgtgtcctaataataccaacaagaatagcctgaagggaggtccacaaaatagattagggaaatatagtcacaaactctgagttgaatagcttctcattcaccttccaaaacgcgtaactattgaaaacgtcctctggctgcctgccgtgcccctgaggtcaggatggttgggctgcagagctgtgccctggaaccctttctctgccactttctagtgtgtgactttgggtaaatgagtgagtttctctggattttgttcttcataggtatgatatctacttcgcatagttttatgaggagggtttagcaagtctctgtcagagaccaggtgtgtgctaaatggaaaatattattggaattaactctgggttagaccaattcagagtttaggacatggtatctaattctttctgttatctcatagtcatttcctatgtaggattctggaatcaaggaatttcaatttcaaagaaatgtgatcctcgggataaagactatggggataaagatggtgggattgtcatgcgtgaattcctcctggaggtcagcttcctcatcaggctgccttatgtctggacaccaccaacaacacccatttagactctgtgacaggaagcccgagggctgaggagtgggtagttagtgaagtcatgtcccagcaggaaagagtgagtgacttgtgcaaactgcaagttaagctgggaatacaacccaggtgtcctgagtctccctcctatgcctactgataaggccccgtgccactctctgtatctggggctggacctctctggagccaagagagtgataccaggtcattggtgagctcacggtgctgccctggtttggacagagagaagtgtcagtgctccacgggacgggctttgccgctggggtttctcagaggccagcggtgggaacaggttcttccctggagactagaaggagcactgaggtttgaggaggctccacaggcatgggaaggaagaaccaccaaagcattgaaagggaagggacagaatgatttatgagtaaaacctaaatgagcagaacttgctggcctgacctcaacaccaactgaggggcgtgggagagcattctgcaaatatttaagaggcatcgatgccagagaactcaatgactgaacctgggtggaagggcggggagggagtgcaaagttaaggctttcaagaaatcttgctcagagccaccgggggcagggccttgtcccttagggattggtgtctgtctgggcatctccctctggcacagggcttaagggctatgactgatcccaggatgcagaccacgtgagccagagaaataggcccagatcacttctcctgtaagaaatttgggcagaatgtgtaaggaaagacaggcagtgaggacaaaatgaaagaatagccctgtgctgtctttccatggcctgttctaactggttttggggagcagtgttatctattagttctggcttgttccaccttctcttgcttccctctctatcatatcttcccattttatgaagtcaaaacctatatggccttcgcagcccagttcctcctttacctcctctgggtagcccatccctacctcacatggcacacacagtcattaccctctcccacccccggtgtacctcgaaaagccataatatagtttagcatatgaaagattctgtgctgtcctatgatagagacatgttttgaactttgtttatcctaatagatcctaaatcagtttgatcatgaaatctgactttaagaatatgttacacgctggcttagaggctttctcactcggtgatccgtgtatgtgtgactggcaccccctagttacatcctaagtgagtcagtggtgaagacattctgctttctttacaatcctcatagcacacagcaaaccctatgtgttcctcacgtttgagtctaattaaagggcaagaaaagcaaccagaaacaaaatgaaaaagcaaatggcaaaactggaaaaaatttgtaacatacacagaggaatgatactttgaacatagaaaaaacttcgtgtattagtaagaaaagcaatgaatgctgcggtagaaatgggaaaaatcatgaacagtcaattcacaaaagaaacacaaaaagctcatacgtatttaaagtctttaatctctcagcaataaaaatataaaataaaaaatgaagtaacaactaaaatggtaaaagtaaaagatttgggttagcaagcatatagggaaataaacactcctttccatttttgccttttaaaaaagtcagcacatacctattttttcaagatagtactaaaatgggaattgtcttatcatgaatcatttatcaaaaatgtgctattactggctgcataatgtttcataatatggagtatcaaaattcactgagccaccattttatggctggacatttgggtagtttccaaggtcttgtctgctcttacactattaagataaaattttaatcataatgtattagttatatactgctgtataacaaatcattcccaagctaaataaatattatgtaactcaaaacaacaatagcaatgtaatctagtttctgtgggtcaggaatttggacagggtacatctgggtggcttgtctctgctccctaatgtctggggcttgcttcttctggaagactggaagtgtggggcctggaatcacctgaaggctcacttacagaattgacattgatgtttagctggggctgtcagctacagcccttacacatagcctccccacatggcctgggctgcctcacaacatggcggttaggatccatgggccagtgagaagggttttgctgctgtaacaaattgccacaagcttagtggcttgggttggggttgtctgctcatgcagcttactcatgccctcccatcctgctcaggctcaatctcagaaatacaccttccattttatgttggctcatcagctttgtggcttatgtctgatagagcacggctcacctcataatgggcagttccacgtgtgtgcttacttgctgtcctgtggtcaagcattctgtctctaccagggctcaataatatgccaagaactgttctcagatggccttacaccagaatcacagaggcctatatcgtgattttccactggggctcatcaaaatctccatgctgcatctttccccaacatggacactaccagcaccgcagagtctgccagattacatggcctgagtgtcaagacttttggcaccatggtctggacgtactgcagagaactttcctaatctggacccctctcaaggctggcagcctcccatgccatccagtatatggagaagagcaatctttctagatgaggactgtgtggcctaggaaacccaaagaagccagccaggctctgtgcttccatctttgtggcggtggatgtaagatgcagcaatctgtcttttactctggagggcatatcctagtatgcctcttactactgaacccctaaaaacttcattgaagtggctgatctctgaatcttcctggggtttataacctacctctggagtgcatgtgttttcccaaagcccattcttcccaatcaacatgagcttgtgatataatgggtcagtgccatattctgtgagatatctaggcagtcagatatctttggattttattgtgacagggagagggagagttcatatagcctcatggaaaatctgtgaaggaatatcattttctggctcacacaaatgcaaactgtttctaattctatttattttttaattctttttttttaagagatgaagtctcactctgttgcctcagttggagtgcagtggctagtcacaggtgcaatcatggctcactgcaaccttgaactcctgggctcaagcaatcctccctcctcagtctcccaagtagctgggactacaggtgcacgctgccatccccagctgattctctctttttaattggaatggaaaaaatacatttgcaaaatcagtggtcacatactctgataccttattcatctactctagcaataaaatctttttggatacattagctacaatgggagttcctacttgcttaggcctgtggttgtgtacagtcattctccgtggttcattggcttctgcaggggccagactggtagattaacaggagatatcatagggattacaggtccagcattttattgttaatggtaacacttgccatgccatcccccccagggatgtgacactggctgagggagttggggtaacaattcagaaattaccaattaaggtttcctactatgatagctcctatcccataatccagggacccatcagggttactccagctggcaagcaggacaattccaataatatgcttggggatagtgtgcatctgtggaccctgtacgcccaccatgagctgtactgtaggtagacctgtcgtgagccaggaccatacttattacctggcttcagaggtcttagttctaacagaggggctgtattagtctgttctctcattgctataaagaactactggagactgggtaatttataaagaaaagaggtttaattgactcagtttggcaggctgtacaggaagcatggctgaggaggcctcaggaaacttacaatcatgacgaagatgagaggaaggagtcacaccttacacggccagagaagaaggaagaaagtgaaggttgcgggggcagtgttacatactttcaaacaactagatctcatgagaactcactcattatcatgaaaacagcaagggggaaatctaccccccatagtccaatcacctctcaccaggctccttctccaacactgagaattacaatttaacatgagatttggggagtggcacaaatccaaactatatcatggaccattcccatgctgtgggtctctgggtgtcaatgtcaacttagagcctacattcacttgtcctggaaaattctggttattccctttccctgatatacagtcacatgagaagatggctgtaggaccctctgggaatcacatggtatctatcatgagatatttgccatgatgggcaaggtgtttcctcttactaatctagtaatgtctccagtcaatgggtatcagtcaggtctgagaaatgagcaagagataatattttgattgggataaacttcttctgccttcagcttcctcctcctccaattttgccttttttggattataaatattaggcagtactcttaaaaatttctttgatttgtccaaatttatggggtacatgagaaattttgttacatgtatataatgtatagtggacaagtcagagtatttagggcattcatcacccaaggacagtacacttttgttaaccctagacacctttctttgctagtacacattgaatttatttcttctattttactgtgtgtttgtatcctttaacccacttctcctcatcctcctccctcctcccactcaccttccccagtctttgttatctgtccatgctgtacctctgtgtgattaaagtttttagcttccatatataagtgagaacacgtgatacttgtttttttgtgcctggcttatttcatttaagataatgactttcaggtctgtccatgttgctgcaaacaacatgatttcattcttttaaaatgactgaatagtattccattgtgtgtatataccacattttctttatccagtcatctgttgatggacacgaggtcaattctatatctttcctattgtgaatattggtgcaataaacaatagagtgcaagtatccatttgatatattattttcctttggataaatagtagtgaaattcctggatcatatggttctatttttagtttttttgagaaatctccatactatttttcatagtgactatactagtttacattcccaccaacggtgtgtaagagttcccttttctcctcatctttgccaacatctgttactttttgtctttttaataatagccattctgactggggtaagatgctgtctcattatggttgtgatttgcatttctctgatggttagtgatgttgaacatttttaaatatacctgttggccatttgtatgtcatcttttgagaaatgtctattcatgtcctttgcctactttttaatgagattattgtttttgtttttttttcctgttgagttgtttgagttccttgtatattcaggatattagttacatgtcaaatgaatagtttgcaaatattttctcctattcaacaggttgtctcttcactttgttgactatttattttgctgtgcagagctttttagtttaattaagtcccatttgtctatttttgtttttattgcctgtgcttttgaagtctcagtcatacattctttacctagaccgatgtccaggagagttttccctaagtttttttctaatacttttatagttttaggtcttctgtgtaagtctttaatccattttgagttgatttttgtatatggtgagagatacaggtccagtttcatttttctgcatgtggctatccaaatttcccagcactggctgggtgggtggcttacacctgtaatcccagaactttgggaggcagaggcaggtggatcacttgaggtcaggagttcaagaacagcctggccaacctggtgaaaccccatctctactaaaaatacaaaaattagctgggcttggtgaggcgggcctgtagtctctgctactcaggaggctgaggtgggagacttgcttgaacccaggaggtggaagttgcggtgagctgagattataccactgtgctccagcctgagtgacggagtgagactccatctcaaaacaaataaataaaaataaaaaaacaaaacaaatttcccagcaccattttttaaagagagtgtcctttctctgatgtaaattcttctcagctttgttgaagatcagttggctgtgaatatcagttggctttattactgggtctctgttctgttccattgatctatgtgtctattttatagcaatatcatgttgttttggttactatagccttgtcatatttttgaagccaggtaatgtgatgccaccagctttgttctttttgctcaggattgctttgactatttgagatttcttttggttctgtagtaattttaggaatttttttctaattttgtgaagaacgaccttcatattttgatagagtttgcattgaatctgtagagttctttgggcaatatggccattttaactatattaattcttctgaactacgagcatgggattttttttttaataatcaatttgtttaatcagtgtttttaagttttccttgtagaaatctttcacttccttggttaaatttattcctaggcatttaatatatttttgtagttattgtaaatgggattgtcttcttgatttctttcttggctagatccttattggtgtatagaaacactactgtgttttgtatgttgactttgtatgctgcaactttactgaatttatttatcaaatctaagaggttttttttttggtgtggtctttaggtttagctagataaaggatcataatatcagcaaagaggggcaataagacttccccttttccagtttggatgtctaagcagcactctggttgcctctatttctctggagccctttcattctggtggatattaacaagcccagctttgttcctgtctttcctaccatgagtcatgcaggggaaagccaccatgaaggttgccagataaaatgcaagatgcccgttcaactttgaattgcagataaacaacggcattttcaaaagtgtaattcaaaatcttcatagaatatacttatacaaacaatattgtttatctgaaattcaaagttaactggaatcctgtatttttatttgctaaatctggcaactgtcatccccatcaacattctttggatcagtggcccaggtaaagggtgggtctttggggcactcctatggaacacagtcctctggtgggtcttccagccttacataatccatctgccccagcaggaccacttctctcagcctcttcatgccttcctctactgcctgccagggcagcttggacttgtccaacttgatgagtgaccacgatttttccagggttttaaaagccatcccagcagctgtttgtgccatcacctgaggtttttccaacagtgttaaatccattgatcagagaatgtcctgaagtcaattaacatttgcttactaagtctttcattctggccatcaagtgccttcagaatgcaatcccaggagcactccttgctcctgctggcacatggaggctaatgtttgcaaatctttcagtgtacagtttctttcctcccctagtaggtacagtgtgtgcccagctaagttatccttggatttactggactatgctctaagttttggccaagcaaccaggaaaggcaatagggtcagcttctgagggggcacctgttgcctcgttggggagatgcccctgcagcatcttccatcaccaaagtgctagctcttcctagtaaggggtgagccatctctgcaagcccagagggtctgtggaggaggggatgcttacagcattaacatcttccatcaggaagttcctgtaccacattcagagaccaggttttgtccaccagggctctgacttttgcataagaaatccatattcgctaagtacttaactgtttctggagctccgtgactcagagttagacatttggccttccattaagctgtgtctgttcatccactgccagagacaagggcctcaccaacagctcccaaagaggccctgtggctctcacacagccactattggttaatggccctcagtctttatcattctttataatttataaatttataaagggcctctatataatttagcaataattagccaactctgttgtctttataggtattgatctttccatattttaaaaatcctacggcattccccccagctgcaacatttcctatggtaccactggtgaaatctttaggaatttgagccaccaccttgtaccagagactatctgagcttcatctgccaacaaggatggctggatgagccagctcaaatcttaaatccctatataacctcctcttttttcttggaccactcctggaccacttgtgctagcagtcctctctgagaagcagaagccaagatggggttagagaaaatgaggaaggaggtaggaagggctgggagagctatcagcctgtactataggtctatcccccactgaaggtgagaggaaaggaaggaagtttgggtagaaggctcctagtctacattaaagttcgaagaatgccccacaggctgcagggtagtgttcaagccaaagtagcttatcaaggtgccccaagtcttctgggtacaggactacttaggatcctggtatgcttggtccttagcctggaacagctgtgggaagtgtgcgtggcctgagtgcagagtgcagtagttggggttgtcagtcttgcacagctggagacatgggatgtccatttccatggtttccagagaaatcacgcctttgagattcctagaatatgttttgtccagatcagagcctctactagcaccaccttaattctcccagaggccctaacagaagggtacacccttaacttggtcttcctcctggggtccacatgctttattggcaactccctgtatttggtctgtgctataatttaatttggtctaggctatatttgagaatttttactgggtgaagagactgaagataagaattgttttatttgtatttcttctgaattctgtgttcagattgatcagttctttcctaagtttctctctctctctctttttttatgctggcatatctagctgaaagaagtcaactcaggttttcaacactctgtccaagtttacaagttcattagatacatcttccaagttactgctgggtataattttaccaaatatttcaccaccacataacacaaggtgatattttttttcctgacctctataataatttccttggccttttctttagcttctacctactgtcctgtttcaaagcccaatgccatgtagttgagctttctatcgtagcaaaacctaatttccctgtaagtactatcaatttctgagttatttaattattgttttagtaatagtgcataacagataatcacaagatctgataaaatgcaaaccatgtatttaactcatgccttcctggggttagcagtttcaggcagtacccagcgaaggtacctctgctcctggtgtgtctcatttttctcatgggaccagcaggacagcttgatggtacttttcaagaagatgagagaaggcgaatcccataagtgtgtcctaagcctttggtcactttgtatttggtaacattccattggtgaaaacaagtcatgtggccaagctgaaagccattgtgttacaattgcctgtagcaattaccattaccaatggtaattgtaacattactgtgtcataattgcttacaatattcagtacagtaacatgctgtacaggtttgtagcctaggagcaacaggctataccatctagcctataggtctgcagtaggctgtaccatatagttttgttttaatatacctcttggtgttagcacaacgatgaaattcctaattatagagttctcaggacgtatccctgtcattaggtgacacatgactgttcatatgtctgaacaatactctcttcacccttactacctatcatggttacttcttagttactatcatggttgcaaactgtgttttcattttacggtgtggaggtcaattatattttcaaatatttttgaagtagaagaaattaaaattttctggaaaccagaggctaatttttgaaaacacttgtgaggttactttcaactactgtttaagtctctattaattgtctaatattgtaggtaaagagacagtctgcactttatatgccttgagaagcatgtgttcctattgaagatctacacatattaccttaggactgcagacgaatccctctaaaaccctcgaactctatgcagtctttggccccaggaacaggtagacaagagcttgctttcttgtatacagttgctctttcctttttaacattatcacttatggaccacagacctgcctggctgtgccaagtgctgtgttcagtgctttaaatgcagtaccgtatcgaatcttcgtcacgacgctatgagactggcattgttattaccatagtcataatcccttctggatgtagaagaatatgtcccacatctcacaggaaagtcaaagagattagaatttaggcctatctgactctaaaggcagtactcctatccttagcaatactgcctttttggttgaattctgcctctatttactcttccattaaaacagagatgtccctactgcccaagaagtccattatgatccaatggaatcaaagaaactgctaattcacaagaatctgactgtagatgactctcaggaggagtgaaaagcattgggatgttttgctttagcctaacattgcatctccgttaggaagtatagcagcctgctgaggcttggttactaagcttaccaagagtactcgcttccatgactctgtgttgacgaagcaccagtgacaatggaaagggagagagcttccctggccagatgccccttttcctcttggcccttccagtaaatgctgctcaaggaggctccgcattgcaagatgggcaaggggtcacatgaggaggggtggtgagtgatttattttccagttaattaaaggccaagggagtcccttctgaagttttatttggggtctcaggccatctgtatatagcaacccaaggagaaaacccccagccaccctgccggggcaattagttctacattttcttcctctctgctccataatccctacctcactcaggctgtgtcaactgcccagcttgcagtcaactttctagctccatctctgagggatttgtcctcatttctgggttggaagcttctcaccttcaaattacacagtttcttgagaagaaagtgataatggatgtgacagtgctagaagatagatagatagatagatagagagatagatagatagatggatagatagatagatggatagatggatagatagatggatagatagatagatggatagatagatagatggatagatggatagatagatagatagatggatagatggatggatagatggatagatagatcgatagatggatagatagatggatagatagatagacagacagatagacagacagacagacggatggatggatggatagatagatagatagatagatagatagatagatggatagatagatagatggatagatagacagacagacagacagatagacagatagatagatggatagatagatagatagatacatagatagatggatagatagatggatagatagacggatagatagatagaaggatggatagatagatggatagatagatagatggatagatagatggatagatagatagatggatagatagatagatagatggatagatagatagatagatggatagatagataaatagataggagacaccaccaccaccaccaacaacaacagagcactgtccgtcctcatggcccatgcccagtgggcatttatcagaagtaaagacaggtggattggccagaaaaagtagaggtgtttgcaagtaagggggtaaggaatggaaatttctaatttagaagtagcccttctactaagggccagattaattaggaacgatggggaatctgaaatcaagatctctgagagtctatatccacaccaagctgagctccttgcaacttctgatcctgaagcctggggagtgtaatggataaaaggctacctagatcaaccctcacctgctcccaccttctctctctgtctgatgcttgttggcctttgacaacacaatttgccttctaccctctggctgcacacactcagtgatggtgaactcactctattctgagatgtagatttccctccttgggcaggtctgccaacatgtccttccgtgcaccatgttaccatcaccactttccctgatccactatgctccagaataaataagagttagagaattgggagtagggtttgcaggtcaagaatgtgtgcctggtgaatgaggaagaaaagatttgtggcatttccttgcgcagaaggaacagagggaggcaagggatggtagaaagccatcaggtaggagacactcagatgcctgctgctggtggtgtgcgctgcgtctcctgggactgatgagtgagacacgttcatccaactaccctttgaagacgtggcaagccctcagcaagaggttaagcttcccccatgaggatttcccaggtcttgctttggctccagaacagttatttccaatgctcagaagctcagaaagtgaccaggagaaaagaggtagagcattgtggagaaagagagagaggaggtgggagggagtgtgtgtgggagacagagaggaggaggaagaggcactgagaaactgaatgtatcatagaagagagggagcagcagggagtatgcacagagaggaagaaaaatggagagctgagagagtaggggaagggagagtggggacatgccagggagggctggagcaagcagcaggctctgtaaggtatggctgctctgggctctggggtcccacattgcttctgctactgggccaccagactgggaaacttggtgggggtcggggttagaggggtggttggacgaggagggctgtgggaattcccagtctgcactgacaggatccggaggcccagccctgaaagccccaggagccccgatggctccaggaagatgggtgctgggtggattggacctggacagagccactgagggctgcaatttggcagtcgccctggctttattggcagcaagtctgacgggagctgaaggcctccctgctgggccctgcggctgccacgtgcccgcctctcggacgccttgcgaggctggtcccctagggcgcccgggggtggacgggagagcggcgcgcatgcgcaggatgcgcttgggcgaggagtggggagatcccaggcaagactgacacggatggggcatgcaggcgacaggccggggtccacctaggcctgggagtggtcgtgctttctgttctgtttttcaattttaatcaatgggctgggcgcggtggctcacgcatgtaatccagcactttgggaggctgaggagggcggatcgtttgaacccagaagttggagaccagcctgggcaatatggagagactccgtccctcctaaaaataaaataaattatccggagtggtggcgtgtgcctgtggtcccagctactcgggaggctgaggcaggaggatggctcgaacccagcagtcagaggctgcagtgaaccacgactgcaccagtgtgctccagccaggccaccttctgagaccttgtctcagaaaaaatattaaattttcatcagtaaaacttgtctgggaaaacctttcctaaagcctgtaaagctttacattactatccccgtcctcaccaggagccaacaaggaatgtgtcgctgcattacagaaggggagcccatgcaggagcagctcaaagactgcccatgagactccagagctggcgctctgcccactgtggtgtaatagcagctactctcttgaaggcttagggccagctagtcccaggcctttgatggctggggccaaaggggtgggcaggacttggcttttcacttcctttaaaagtctgtccacattacctgtggggcatcatggaataaaggaagaaaagcatccaccctctttgttttcccctccctggagtgaagccgccacctgctaagtacaagcccacaatgaaacatgtcactcctgctggggcttacctacccaggaagcacaccctgggtccatttaaaaacactggagatggcctgctgtcctgagatgcacagggaaatgggagacacaaccagacaccaataacacactgcaagagtgtgatggcaagtgtcctcagaccatcctctggccagtacagccagagctcagtcagaaaccaagaaactgcccgggtaggagctgagtttaaccctgcaagtcttaattttgtgcaaggactgtacaatgagctgtaacgggtagacactgagcaaggcagttcagcttgtctgataggacagaagcagtacatatggaactacagtatctggagggataagtatctggaagtggcaagaaatgaacagactggtgctgtggggatgggaggagggaaacagtcaccttgggctggagagtgagcaatcaggaagggcttcaccgaagaggtgaccatcaacgtgctattttgcatatagatggagctttagtttacaacacttttgcatacattattttgagacacagtgttatggtagcaaatgttggcaagggcgagaaaaagtgctaatccactgctagtgttgagagtataaatgaattaaactaatgtgggaagcagtttgacactcataattcaaaattctaggaatttatgctacgaacatactgatacatacgggcagatatacaaggacaagatacccactataacaaagttattagcagcaaaagactgaaaacaacataagtgttcatcagtaggcatcagttaaagaattacaagttatccaagcaatggaaactgtgcagccactacaaagaatacggtaactatgcgttgctatgaaatggaatctccaagataccatgttgagtaaaaaataaaacaaggcaaagaatgatgtgtatggctaactttcttttgagtgacaattggctgtgtatgtttttatatttgaacagaaaattttcagaaggtgtattaatctgttctcacactgctataaagaaatacctgagactaagaaatttgtaaagaaaagaggttaaattggctcatggttctgcaggctgtacaggaagcatagcagcttctgcttctggggaggcctcaggaaacttacagacatggtggaaggcgaaagagaagcaggcaggtcttacatggccagagcaggaggaagggggcaggggaaagtgccacacattttaaaaacaaccagatctcctgagaactatcacgagaaaggatggtgctaaaccgttcatgagaagccacccctgtgatccagttacctgccatcaggtcccacctctaacactggggattacaatttgacatcggatttgggcagggacacagatgcaaaccatatcagaaggatacatgagaacctgctcacagtggttgctgcaggagaagtagattgagggcttggagtgggaggcaaactgttaaaacgttttacataattgtgaaatgtatcatatatctagaagagtgtataaaacatatgtaccatctgaaaagtaattataagccataccagacaatgtatatagtataataaattcttgtactctgaattttatagtccgcatatagtaatttgttacttttcctactgaaaagagtctctgtgaggtagacaaggacattccttcctctcccatttcctaagtggacggtagggccgagagctcagtgggagggcctgtggggtatccagggacaacagcgggtgactgcagcatgaaatcagagaggaggaggggcaggagatgggaaagccgggctccctgccgagcacaggatggccaggctcagcctggagtttgtttgttagtttcagaggacgtgttaaatgttttggggagtgacgtgatcaaagtcttacaaagaggaagtgaaatcaaatgctgtgatggtcagcaaggccatagccaagcagactagcctgggggttggagagggggagagaggcttgtcttcctttctgctctgctcatcgtggagaataatgagaatggggctcactgatgggcactcacgtgctgtgaccatgttgatggcattgtgtccgtcaattctcacgatgacactgactcacagatgttacatccccattttccaggcgaggaagtagaatctgagtgagagcaaccagctaaaggccatgtagctggaacgcggcgcagatggggtgtgcctccatagcagccgtttgtaaagccagtgctcttgctgggaatctgcgcgtctccccacaattgttggctgtcgggaggactttcccacatgcatcttgctttggggcttgatgtttctcccaccatcctgtgacgttggccatgccactgcgacaaatgtgcagtggatgccaaggtacgcagcgtgacattgggaggcacttggctcctctcgctgcggtcacctgtctcccatcaatcatggaggccttcggtgtgcacgagagtaacgcagggcagtgggccacaatttgagagggaagtctccctgagctcagcctctggggaaggaaactgcccgtgtgcttgctctgctgctctgggaatggtgctgggcaggcccctgtgctcatcgcctggctttgctgggtattcatacacagcaggcagcttctgaggagaagaaggggttaatggccttgctcaggctcctgcccccacaccccagaaacacaccagttatatttttcaatcttgcacaccccataaatgagcaccatttcctggtgtctgacacgatggagtgactctatgggaagatttggccaggatcctgcaaaactaaagaaataccagaatctgcaatatggcctggctctgacctgacccctgggcctgccctcttctgtaaacaggcatgaggggtgctggagggtgctagagtcagtgcagagggtgaggagcgtggctgcttctagggttctggtctagtcatgtactggccacaatgacagttgggtttgcacagggggcgttgtttgttacggtgaatccgcaggttaaaattgaggcctgctgtgttgccttccctttctgggaatttggtgggaagcaccaatgtaataatcctgatttatatttctagccaaaccccaaacccagctccagtccttgacaaaagtaattctcctttggacagtaacgtgcaggaaccatgccagtttagcctattctgtacattcttccccttgacaggccagagctcaatgaatatttcaccttcacagtcttggccacagtcgggggtttgcgaagctgtctaaatctggtttatcagcaggaataaatgccctcagacttaaaaagtgggaagcagaacttggctctgttgggctggtgatttacgaaggaacaccgagctgggagtggaggagcagtgaggggagggagggcaagcaggagtctgtgggattccactcacaacctataaaagcagcaacatgtactctaaagagagatcatattccaagatacatttcctcccatgaaggataaggcatctggcatccatcacttgtcagggacagaggaactggagggaccctggctgcctttggggtacgtggcaggtgtggggataggccccgatcaagcccagggctacctctgcaggagtcatggccttgaagtggcacctccttcccctttgctgtccacagggcccgccatgcttggcttcccacagccctgaggccttgcccttccgccatctggcagctcctgaaggcccgttccctccgtgaatcatctcaggccagcctgcgtgggatatcctctccctccacgattactgcttcagagccttaagtggcctaatcaaaccaatcattttcctatttgcacatttagtcttttgttctgtctgtgccacctgcaaggtcacgccctacttccctgcagatagaatctcaaagaatgagccctgtgtttgggaccttgggaccaggatcaggctgcctacgctgacatctcagctctgccaattaagagttgtatgatttgggtaagtttttttcttgcacctgttttctcacctgtaatgtggggacaatagcacacttacactccctggattgttgggaggatgaaatggagcaataacttagcccagcacctcccacatggttattgttagttatgtggagactcaggatgatggtggtgatgataagacgggcagggcgtcacagtcattgaaaaatactgtgagcaggtgactgctttaaacagctaaggctctgtgtagtttccacaacttggctggcttttgcttttttatatagttttatgataatcggcaccagagtctcttctcagctcctccgtggacacagtgcagtgcaaatatcatgagctttggagtcacacaggcctggagctgaaccataatcatgaataattcacttaatttcattgggcctgtttcctcatctataaaatggggataatagtagctacttcgcatgatggtggggccgattaaacgaggcgttgcgtatagcttgttgaatatagtggtaatgtaatgagtaccccgatactgatttcattcctccacccttgccccataaggctctaggcgccatttattttttgagatctctttgacacctgcctcttccataaatgtttccccatatgaacccactgatgagatactttgtcacgtgttgttgtgttgtttgtctttgattatttcatgcataccaaatttgtcatccaaggtagattataagcttttaaaggcaatgttgtcttaaatgtcctttttcccccttataataaaaacatgcttctgggcacttcagcgcatcataaacagttgaggtgacttgactttcactttaggaggagccagctgctgaaacaggtaaattgggagacttacggcgccaactctctctaaggctgaatttcttctctctctccccctttctctttcaatcactctcattctctcagctcttaggatcaactgcaattccaagagacttatgagagagaagaatgtttggtttttctaaaaagaggaaagagaaaattgagagtggagagggagggacatgggatattcatgcattctgtttttttcatctaacaaatatgtgtgtgattattgtttgccaagcactgtgttaggctctgagggggaaagaaggttatgaagaggagaggataagttcctgtccttaataaatttatagccttgggtcactgagttggagcttccaggtctagttgacctgccaggctggaattccattgctttggtttctcaagtaatgaagtcaatccccttggattcatggagtttgtccagaaaaagttgatgtgatttgcttctcgcaggaatgaggactctttgaaggtggtgtttctgtttaatacaggtctgtgggtcttgttcctagcatgtgacctggcaaagagcatatccagtgagtgttgagtgaacaaaggagaagtggaagagactgcaatgaggagagaactccctggctgcaggcggctttctcgcagccccaggtggaagctcttctactgcaccagccctgtggttatgtcagatggactcaggcctccagagtgtggctccataaacaacaggaaaaaaaccaaagctttctgaccagtctgctgtgtttggattggtgggaggttcccagttggagtcagtgcctcagacatgagtatcagagtccttccatatgagtgagaggaaggcttcttggctcagtccccaactttggtgtggagtatatgggcctgggggtgtgactccgggggtgaggtgggggcaatgcagaggggtaggctgtgtttggagcttctcaggtccttctcagttcctcccattggcccaggcatcctcgcttgtccccatgtggtctggggtcaggacagcaagttctaatccaggccctgctgcttgccagctgggtaaccccaggcaactcatttcaccaacctgggcttcaatgtcctcattgtaaaatgacagggtagattaggcaatccctaaggtgtctcctcgcagttttatgaaattatttttgttaccctgtagctgcagatcctggcaaggaagcactgacatttttgacatatgttgagatggttgaggaagacggaggggtatcgagaaacagggatatgagatgtaccctgaaacggaacctgggactccttttccctggtcttttgcactcatcactaccctaccctctttttatctgtcctttaccccacccccaaaagatgatccttctgggagatgacagcgtgcaatgggggaaacgcagaacatcccagcatctctcggcctccgtttctcatctgcacagggaggctaatgccacctcccttacttggaggttgtgaggatgaagtgaagtcatctatatgctgtaccttgtaaactgtcaaacaccacataaacgcaaggcataaagctggcttggatgggaaaactattataacatgtcaggtagccccttcttacgtgaagatgtttcagtacaagggatgtttcttttgtcatttgtcaatggcctgtcctgttgggttttgcctgccttttggagggagaaacactgctgtccaacacttcatttctttggatgcttttccactagagcagaaagaaaagcattttccatatgatttggtttatctcagtacgcctgtgcagcagcatctctaggtcttaagatgacaaggatttgctctccatctctggagcagagaggaccagggaggctgcgttgggagcgatgccaggaagtggtggttggtgtgtcattttctttcatggccatattagagttgggtccaggggaaagggcactgaacaggactggagttacttcaaatcgttctggtttttgatttccacatattagttgaaagtttgacaagatctcagataacatctagctcagctgctctcttaggcctgagagttagggcctagctgaagccatctagctcatttagaaaggaacaggaactagaatctggtctctggacttggttttagtgctctttctggaataccacaagcatccctgttcttcctccttcttcccacatattccccatcactccccacacctcccttcacctctgctctttgcttccctttcctgagcccttttggtgtaactctcaggatggaaaagctttctgagtttctgggacaggcttactgtttcatagggtggagtgaccttcccaaagcagcttggccatgttctccggatgtcaggaagcagcctgggcaccagctcactgcatgggcctcttctcagatccagatgcaagagtcagagactccacccatgggccccatgcctaaggggtcagagacataacttgtgaagtgggttctgtggtggctggggcccactgtcccctccccgtcccttgctgatgtggaaggaccagtgtgtgctgacctatggtgttccttcctgatccaatccttctaacccctgcccccttacctcccactggggcattccaaagccacgaagcatccacttggcagccctctccagcgtcacccagatatcgctggcctgtgttcaagtgcccatctaagcccaacacggggttgcctggtctaggggaactcaccctggggagatgtcaccctctggcaacagctgactctatttattcagatgagaacaattttctctccttttgcactttcaacaagcttgacttgaggctcccccattgctaggctgccaaaagcaataaaaggctgaggaggaggtggagggagggtgggggtagacgctccacggtaattgagctgtcagctgagccctggggcttcctggatctggggtgtctcacagcccacatgggcttgtttgcagcaatagggaagggagccgtttgacttcataatcactcagagagatagcggtgctcagggcaggtggggtgggcctgggtggaaggcgctgctaaccagactcccatgttgtcggcttccttctggtctgggctggagctgcctcaatagtttgaacaggaaaccgaactgtcacatggaggtggtgggtggggatcattgtggggtagagggcctcaatgctgtgtgctctgtgatgtgccaaaatgagtaagtcaggagacgatgtccaggtacaccccaaatctgagggcccaaagagcagcttggctctcgccagagcatccctgtttgtttttcagttttgctggctttttgctgttctacagtagtgactcttgtgggattattgggctattagttccccgggaggagggtcctggagtatcatttctgccagcctgccaccgtccgggtgtcttgggtgagaagacaggtatgcactctgggctgctctgagtggacctggctgccctggggctgcaaagctgggcccctttcacccggggacttggatggcttgggatgctatcaagagtgggatgcagaggaaggcagtgagcagcttccttaagggagggtcacaaggacccacatcactatcatttggaaacagtttattgtcccagtttggcattcagctgctctgcttgccttccccttcacactcattctcttgtccttccccagtcctcgctcagatccagcatcccccacacctggcaccacaggggcctttgctcacactgccccctctgccatgatggccctttcctcgtgtccaaccacacccatggatcacactctacttcctccctaattccttcctgaaactcctctgagacctctctggcttccctgtcctttcctcatccctcacttacagcaccaagacccctctgtctcctgtcagtggctcaggaatggccctgcgtctcccgctagattgagcttcctgaaggagagattctcgctctctcacgctgtgcctccttcacacgcctagcacaggccctgtgagcaggtgtgcagcaattccctgtgtgggtgagacatcccgcaagcaagcattaacatttgcacatttgcatagtgcatgataaagatggagctcctgctctcggtagctcttcatttggaacagagggctctgatgggggccaatgaataaatgaaaaggccctatgtatgggtatgccttaaacccggtttgtggttgttggagcaggctttctaccaatgctcctggggctcagtgatagttctggatcacccatattgtcttgtcagtctcacctgcaaatttctagtttgaaagtcttgggaagcctgcactagacacctctgtgctaatcctagaggggaaccagcttaagaaataagccaccacctttgatgggacctaagtccctaggtcactgtccagcagcaccacttgattcctagctctggccccaggggttgatctcaaaataaatttcaaatcatagttgatgggaaaaaaaagaagattgagatgaaattaaaaataaatgggaatagcatacggaagtatagggagggcagagctggggccggggcccctgggtgcttaaaggagaaagatgttcttcccatgagaaaaatcatctaagagcatcaaataagcctcttgtgagggatagagactcctctgtccccagactcctcccactgagaaagtgggtggctctagacttgtgctggctcctgatgtagggctcatgggcggggctcagactcagggctagtgaaggaggctgagaacaaccgggacgtcatctcagaacatctttcgcaactggatttagagattaattgaggtaaagggaagagatgcaaatacttctcctcctccttctatcgtctctaccctcatcagcttccaagcttgggaaaaaagtgatttctaaccatctctcttccttgtccaaggctctttggagaaaataagacacacagggtcagagggagggtagcccagccaggcgggtgtcccagcagagactgggcaggagcctggcaggcacaccctgtccaaggcagcctgtgctagcccaggagtgggaggcgataggaatgggggtgctgtgtgctgccctgggctcagggtgacacccctttccctgaaaaaaacgtgttatgttatttgacctgagggaacaccctttaagagactcctgagacccaaacaaagtcctttatctgcaaaccagagaccttctttgggtacccgccagcaacagagatctgagctggctagagagagggtggcggaagcccagtgcccgtcttccttgagtcccagatgggagctgaggcttctaggtaggggtcaagaggcttggatttgccatgaccccatgtggcttttgactgcagagctcagagacggcagcccactgccaggaagaactctcttccaagttcgggctggctcagggccccgaggactctgtccagggagccatggcctgtggaccacagaaatggtcagatgctgtggtgcgtgtgctgttgaatcagaagcattgccagcatgaagaattttcaaagcatgccaaagcattgccagcatgaagaattttctccactgtacaagtcccccttgaattttgtcttgaccctgcccgcattttcttagtcactgacatttatttttcatctctctgggctcagaaaatcaactctcttaggcccacttggtgtttgaagtgggacaggatttccaggacgcctgcaattcagaggtcagtagaggaatgaaggagtagaatctgagcctgaaccccccaaaattcaagggggactttgttacctttttgtagtcggacagacattgaagaaatgcttttatgtcctgggttttccaattgctatgacatgcaaactcttcttaatgaaaattttttgagtgtgggtttacttcaggccctggatcctttgcctggatttctttagattggcttcggagactaaagcacgggggagttactgctattattttcctaaacccatcacagacaggggcatgtttcctgacctcagagagaagtaaagagatcctttctgttttttgaaaccccttctgttccctaagggaatgagactggctgccatctccaagattgcacgtatgcagcaagagagacaggtgggcctgatttctgcagggctccaaaaggccaaactgggactgacagaaagatccagggctggccggggtgaagggctgttaactggctctggaactaggctaggtagaatcccttgagatcttccagagggtatgctgtccccaaattccatctttttccttcatcttggagggtctggcttggcacccctgaacagctttctaggattgaaatttctgcttccttttttgcccttctcctccaacctttgaaccttgtttctactccatgacccactgagctctctgggttttccattttaaaaacaaggcccttatattaagaatgaaaaccagaacctcttctggttgtcacatgtgcttccagaaatagtgccccaatactatttaagaccctgaagtcagaatttccaaggaagcatctggggtggtctccagggggtgaggtgccctgcagtggcctgggagatagctctgccccacctttgggaccacatgctccttgggaagcttggactgtctctttctctgggtcccatctggctagtttgtcagctgagcagcccctggaggatgcaaagaaagatttggcccttaaccgaaccagggatcagcctccgctgctgagtgctaagagatttaaggatctggtgtatcccagaggttaacagtaagagctctgcagtcagacccacctctgcactttccagctatgtgacctcagaaaagttcttttattttccctgtctctaaatcctcatctataaatgggagctgataatatctcctcataaggttgccataatgattaataaagtagcatagaggaaatgcttggtagagttctggtccacagtaagtgctcaatccatggtagtggtcagcacatatacgattacctatagtgatgcttctttctggatgtgcacgaatctttgtaaacaaaataggaaatattggacttgctgtgtctgtgtcacttctaaatatcttgttttgtttcagtgtccagcccaatgccttgaacctaggagattctcactaagtatttgttggataaattaagaaatgaactgctttgataggtgggaagggaggcagcccacagggtgcatctctaactgcttctttggagaagagactataaataccgcctgctctagccctcaggcagtaccatatctgaggagtttgcttagtaagtgctcgcagttttcagcagctagagatgttgctgagcccaagagttcacatggggatgggggtattgggaaacctcaccatttctgctctgccttaacccaggaaggccttgtcactacaatgaagacattcccaagccactcattttgcacatgcctatgtgaatgggcctattgaagttgtgcactgcatagcctgggtggctctatgtggcggccctggatgctcctagcttcgagaataatttagattccttgacatgacgactcaccttccaaaggatgattcattttcaaatggcctgaaagaaatgaaggaagtagaatcatcaaagacaactaaaatatcttctctggagacaggactgcaggaggtcctatcctaggagacctggggtgtcagtggtgtgcacctggagccactcatactagctcatgagacctgacaaagcagatctttttctaactctcaggtgagaacatttacaccacaggaaatggcatatgctacaaacccaggctccccccctcatccctccaccccaagagctggttgttaaacatttatagcacaccactgattttgacagaaagccaaaggtgtccacaagaaataaaagagaggatggtgaggaagaggataggaagaaatcctggggaatgcgtctggacctatgcaaagattgtggggaaatggaattttgcttgctgaatgcagtgtggaaagtgttcccaggcccaggctggtgagaatggctatttttagtttttagtactctagtgcaggaatttgccaacaattctttctggggccaaccttgccttgagagacagggcttgccttggggctgaggcaactgggtttcccaggaagcataggtggagtgagggatgggacagccctgggctatagcagatctgagtcccggacagtcatactgttgcactcagccaccctcacttcttcttttcccacagctgacctttcctttccccttttagcacttgaagccaatttcaatagttaatactcatatagtaatttaaactttatttggcacaaaccttggtacatagtgggcacattaaaaaacaaacaaacaaacaaacaacccaaaacccaaatcctaaggttaattgaaggtttaggtatgctgtgacaaattgctttacctatattacctcatttaagactaagaactctgtgaaacaactactgttattcactcccattaaaaaaaaaaaaaaaaaaaaaaaaaaaaaagaggcccccgagatgcagagagttgttcactggaagtgaagacccaggacacaaccgaaggccttcctgagtccagagcccccatttttcagtgttacacatatcaaggagagaaaagaggaagatacaacaggctttttctaattagcttcatttaatttatgctgtctctgaatcgccctgctgtaaggcatcattttacttttgggggactatgaaagcctctgggaacaactgtgtcgcactaccccaatccatcctaatcacttggatttcagataacattcgctaattcagtgctcctgacctcagtcttcctcctgccactcatcttccatttgtccatccagctactcattaaagccagcttcttccttgggaggctataccgtgtatctctcagtgtgtgtgtatgtgtagaataataacaacaagaaacccagctcctaagccacatgtttcactttgctgcttgttaattttaacaaggcagctggtggtttggactgagaggttgcttttctattaaccgcagattttcctccctatggatttcctgtttgcagttttggaggtaaaaagtcttggtagaggcaagccggaattattccaacctaacaggaacagtttgaagaacccaggcaaagggagcctccaactgggacaaacttggtccttccaattgagaactttttatggtgctcggttatggtccagggactctgctcaacatgggagacacagcagatgaagattaccaacacccccaggagtgtgcaatccagtagtgggaagtagacatgcccatagtattattgtaaaaactgtgctaagcactccgagagtggtacaggctgtggctggtatgcaaaggaaatagcagactctggatctgcaaagtcttcatggaggaagtcagattcacatcgaggggtaggaaggtatgtttatttcttatttttgttatgtttacaagcaagaatgagaggaagggcattacaagcactggataaccctgcgaagaaagacctacaagtgatcagttgtgaaaacaatgactctactggttagaccagagaagagaaattgggagacccaagaatagggttgcaaagtcacttgaaagccagatcatggggtgcggggcacctaaggtcatgtagaaattgagattgtttttcaggaaaatgatggtcactgaacattattgtgtattagagggatatattcagaactgagttctagaaagataactggtaagtggacattagaatgtggaggcaggggatcattttgtttgggagcacacttgggaagcactaagttcagtgggaatggaaaggagaaattgagtgcaaaagacaagtcagggagaggcggggagcagttgagagtgaccgaggctctgaacctgggtgatttggaggatagtaacgcaatgaccaaggaaccaaggaggattcttcatgcatgttgagaaacagaatttttgacaagttcagtttaaggtgtgggtgagacactcgattgaaaagatttaactaccagccagaaatgtgagtatggttagaaagagagcccaggatcaggggatgggttttagactcctctggacagaaaaaaaggagaaattccaaaagaggaagacattcttagaagacagcacaaagggagtgattagaatgaggaagaaaatcaggagagcttacggctccaaagccaagggggacagcatttgctcaagggagtagtcggctagaagctgcagacaggtgagagagggtgagagactgagagagaaaactagatgttacaattaggaagacattgaagagagaagattcaacagggtagtagcctcagaagttaccgcatagaggcatgggtggaaggttcagaactgttgcctacaatttattcacttacaaattcattcaacatgtagtagtcctctcttaactgtggttttgttttccatggtttcagtcaactacagtcaactgaggtccaaaaatattagaagacaagttctagaaataaacaattcataattttaaattgcactctgttctgagtagtgttataaaatctcacaccatctacctccattgtgccagggacgtgaatcatctctttgtccagcatcttcacgccgcgtggtagtcacttagaagcgatctcgttatcacagcaactgccatggtactgcagcgtgtgatttcaagtcgcccttatttgacttcataattggccccaacgcgcaaaagtagtgattttggcaacttggatatgctaaagagaagcctgaagttcttcctttaagtgaaaaggtgaaagttcttgacctagcaaggaaagaaaaagaaattgtttgctgaggttgctaagatctatggtaagaatacatcttctatttgtgagattgtgaaggaaaaggaaatttgtgctggttttgctgtcacatctcaaactgcaaaagttatggccatagtgtgtgtgataaatgcttagtgaagatggaaaaggcattaagtttgtgggtagaagacacgaagagaaatgtgttctggttgacagcaatgtgttgtgccaaaaagcactgaacgtatacgaagattttagcaagagagcccctaaaatgagtaacatcaaggcatcttctgcaagtgagggatgcttgcacatgttcaggaataggtttggactgaaaaatataaaagttacaggagagtctgtgtctgccattgaaggagcagcttcctcatttctggcagagttgaagcagttggttaggaagaaaggataccatccaaagtgaatctttatttgtgatgaaaccaggcgcttctggaagaagatgcacagtagaatctacatttataaaagtgcaaaggaggccccagggcatagaacatggaaggacagattatctctggtgccttgtggctacattgcagggcatatgagaaagtcagacatagtgtatggagcaaaaacccacatgctctcaaaaacaaaataaaaaatatctgcctgtgttttggcaacataatgagaaaacttcagcgatagttatcttgcttgtggaaagcttcatcaatgcttcatcctagaagtgaaaaaatacttggaggaagaagagttggaatttaaagttcttttaataattgacaatgcacctgctaccctgaatccatttactgtgaaaatgaaaatgttgaggctgtatttcaacctccaaatgaaaccttacttcttcagttccttgaccaggacatcatttggtttttcaaggccacatacacccacctgatatttgatcacattcgatcagcaattgatgcagaccctaatctggacataatatgatgctggaaatcattcattattgctgatgcaataacttgcatcaaagctgcaatggaagagttaaaaccagaaactgtaaatgcctgctggaggaattatggagtgaagttgtgaatgattataaatgcttctgaggatcaatggagaacttaggaaaatcattcactcagcaagacaaattggtggagaaagatttgtccatatgcttgatgaagtaaaagaacacattgaaggccattgcgaagtgttagcaaatgaggaattggaagaacctgttgagtcattgcagcggaagaggaagatgaagaagaaactgaagcaaaaccagcagtgtgaacattactggaatatgctgaaatgattcaaattgcacagacatcaaaagacaaaattgtagaatataatcctcagatggaatgcagcattaaagtcacctatatgatcaccaaaggattgcaacctctgcagcaacgcttgatggttaaaaagaaagagaaaataacttttgattacaatgtttttccagactcttttggcaaaaaacaccctattagggatccttaattatcaacatcatctgttcctgacatccagtcatcggcatccttatggctcgatgatccaggatcatgcaaagcagataatcctccttctgatatacggtgagaaggctgatagtagcccaatgttacatcatgatgcctacatcattctcctacttgatgtcatcacgtaggcatgtgacatttcatatcatcgcaagaaggggaagagcagaacagtaagatatgtatattgagagagatagagagaccacattcacataacttttattacagtatattgttatgatcatttattttattattatgtattgttgttaatctctttctgtacattttgtataagttaaaccttgtcataagtatgtaggtgtaggaaaaaacatagtgtttgtagggttcagtgctatctgtggtttcaggcatctgctgggggtctgggaacatatcccctacagataaggggggtctactgtatctactgaacacctactgtgttctgggcactgaactaagtaaacactagagatacaacagggaacaagacggagacgtttctttcttaatagatgaaacaggcattaaacccataattactaaaggattatttattacatcatgatatcttagtctggggatcggaaaagtcttctttgaagaagtgacattgaaactgagaccaagtaggaactaactaatcaggggaaagaggggcagaggagtcgagggaacaggaggagggggcagagcagaaggccttgagatgaaaagggacttgacaagggaaggtcctaaaagaagatacttgtggcttcatgaatgggagagagtggcttcttttaaaagttcgtcagtaaaaccaagacagagatgtgagtggcttgaggcagtgaagttctacgtaagactgtggctatgaaaatggagactcagttttggaggcagaattctaagagagccccatgatgtccacgccctagtgtcataccttgaacactcccctcccctttagtgtgggtggaacctatgacttgtttctagctgatagaatatggcaaaggtgatgagaagtcattcctatgattttgtccctttctataagacttgtcttagcagactagagtaagactctgatgctgatcttgaagaatagccatggactacctctggagacagctatgtggcagggcactacaggtagcctctggctggcagccaggaataagtgaagacaattatcacatggctgcaaggaagtgaactctgacagcagcctgaatgagcttggaagaggattcctcctcagccgagcctccagatgagaatgcagcccagctgatgccttgattgcagcctgtgagacctgagcaaggccccagttaagccatacctgaacgcctgacacactgaaaaggctagataatacaagtttgttgctttatgctggtaggcttgtggcaatttgttacacagcaagagaaaactcatatgctcagtttttttgtaggctaaaatgtaggaggctgtgggagaaaaatgttgggacggggcaccgctatgtggtccagataaggttgtggagaaggcaggagagaagatggagaaaagagaattaggccccttcctattctcaatgactccataagaaatgctaagccaccttggggttggttgtggcaacagtaaaaaatcatttaaaaatgtgttttaagttatgtttatttttcatttatatttcctttgaaaatatttaccttaagggaaattaactacttcaagtccatttgaaaaataactttataagttgaaaacttccttcaaatttctatcatcttaacatctttccagcctcttgatacgcaaacatacctacctctccatagcagctgtaattgcagttatagatatataactataattggtacttatattctgttattacagaatttacacatgtttcttgttgagaaaacatacatataatgtcaatttctcctaccataaacatgtttcacagtatctgttattttatgactgtttagtagtccgtcaaattgaaataacttaaattactttaatatttataggttgcaataattgttaaatttcatagattgtgcttcaaaaccatcattatgcaaataacttctttttttcttttgataaaaaattagaataaattcttaaaagtgggattactgggtcaaaggtaataaacattttatggcacttgatatacatcccattaaaaaaatctaaaaacatagttgaagtgctatacttccttgtcttgtagagtaagcaattatttgaaataatttcttcaggatttatccctatgactgttggttgggaagtgatttaggaaggtgaccccattagaacataaaggtataatttccacagattatccatcagagtatccatttctctatatctaccccctcatctgttcattcatccatccattcatccatgtgtccatacatccattcaatcattcattcatttacccatacatccattcaatcatccatccatctacccatcaattggatccactcacctacatatgtattcacccactaactcattcacccacccatgcatcttccatctatccatccatccattcatccatccatccaaccatccatccatcctccatccatctatccatccaaccatccatccatccaaccatccatctatcaacccatctaacagatatacaataagcatccactattggccaggtacaatacttctaccattattgaagcaaaggttactgtcttccttcatccatatataattctaaagcttttctgacttccttcccctctcaagtctgcttttgatgttcacttgaatcaatcatcctggatttaaaagttttggcagaaatgaaaccttggaccctattgtttgcctcactcctcatccttatattccagacaagtgttgaagatagaatagtattgttttcaatctaaagaaaaacagttcatacgttttacaggaagggagcattaatccatgctggtgatatggtacctctactagtgccaggtctgtcaggaaatatgacaaggtaatctcattaaaacaaggcacattgttttccatgctgtgaagaaaattacaggaaaggcattaactcaatagttcttaagattttgagattcttcctttaggtttaatacttcacataattatgattttcataaacgtcaatatggtaagttggtaccatctttgctgggtgcctatgaagagcagagcttcgggaaggaagtgaagagaaacagaggacatgaccactgaatcttgcaaccagactggaaggtagaccttctttactccctgctttcctccttcctcttttcctcccactttccttacctctctttgtaacatttctggactaagcaataggaattaagttacttgtttcagttagtctcattttcattctcaaagatttctgggcatatatctgtatctattatatatcatctatatcaacatcagcttttacaatattaaaaggagaaaataataagattagcttcttctgaagacttctccctattctactgaccaaatgaatgttttctgacaaaactcacattggtttccattacagtcttccacacgtagaaaaatgactctgtctgaaaccacatgcgttacatgtctagcacaatgtgacctgacaccctccacgctaattgtttccatccttaactagactctagtgcttatttaaaactattattcctcctcccccaactcccctctcccacttgccacgctcttctatttgcctccttcctttcagcttatttcttccttttttttccttgcagcctaacagtttgtcttagccaatctcctaagttgtcctagttcaggtgaagcctcttctaagacacattttttttttttcattcactttttctgcagtctttctttctttctttctttctttctttctttctttctttctttctttctttctttctttctttctttttttttttttttttttgagatggagtcttgctctgtcccccaggctggagtgcagtggcgtgatctcggctcactgcaaactctgcctcccgggttcatgccattctcctgcctcagcctcctgagtagctgggactacaggcgcccgccaccatgcccggcttattttttgtatttttagtagagacagcgtttcaccgtgttagccaggatggtctcagtcttctgacctcgtgatccgcccgcctcggcctcccaaagtgttgggattacaggcgtgagccaccgcgccgggccagtttttctcttttaagtgattctgattgcatatagaagatcattaaatacgcacttgtgtttaggagcaaggcactgtggtgggtattcgtggagaaaccaagatacccccgatacccaccacagtgccttgctcgtaaacacaagtgcatgtgaattgattttcttgcagggtgttcagggagaggacccaagaactcataggatgttcagggagtggacatagatgcataggaaagcttccccctacgccctaaaacaaaccaaaaccaaaccccaaaccaaccaccatacagtttggtgtattcccgtgtatattctcttatagctattccctcattcacctgattcctgtactgtattattgagttctccttgagggtagagaatttcatctctataggttgtatttagcttttaatatactcagtcattgatccagaaaaacctttattgagtgtcttctatttgtcagacgctgtttgaagatagacagcagtaaccaggatggccatgccagatggtcaaactgttatataaggtgtcagaaaaggaggaaagagatccttttgggtgggagtggttaaggaggtagactgtcaggtggacatgaataacaagtagcattttgttatatgggtggagagggccacaggggagaaatggaatgaacaggagcgcagaggagggttgtataacacaagccatggggcagcgaggaggacagcttggctgaagtggaaggtttgtgcttgcattgagacatcccagaagatgaggtagggaaggcaggcttttgtgctggagaagttccaggttactcacccccactcactcctattgctcactttctcacctctgtttaactagtttctatttcttcctggcccctttcatcaattttctgctccattaggattaggctggatttctgcaggcatatcaaattgcaggttataatacaatgtttagataccgtaccttgctgctttcttaatgaaagcatctggcttacctctgcataaacctgtctgctctcgagtgccccgaaccaccgtgtttacagaagactcttgactgctttacgtatttacaactctcagcttcagttctcacaatcaaattccagtcagccagcatctcttagctacatctcataaaaccacatagggtcagagctgggagggattttggaagctcagccacccaaccccttcattgcagggggaatgaaatggagacccccagagggccgtcatttgctcaagtccacattgctgactcgctgatttatcatgcacttgcccatttgtccattcatttagtaaaacatttaagaagtgtctgtaaaggccacatgctgaggcaaatatgaataaggcatgaggaacggacttgaggaacacacatgctagtgcaagagacttagagatgtttagaacccatggccagtgctataatcctgacaagagcaaagcaaggaggaaggaggtaactttgtcttgaggagccagggaagacctcacagagcacatctcttttgacgtgggtcttaaaagatgagtaagaggtcggccaggttgacatgaagcaaaggtgctccaggcagggagaagaacaaagcaagccaagaatcatagacgtcagaagcacatcgtggtctgagggtccccggctgggaaggatgggaggtgagcccacagaggaaggtaggggtcagattgtgaaggtccaggtgtcccctgctaaggcaaccattagttgggggaggtctttagtcaggaagtgaccggatttaattttttcccttagtagatacaaaaacatctatggtggtgtggcagacgacatggagtataaaaggtgaattgtagagagacaaaaaaatgatcaatactcaaatcctgatggagtcctgcattatttgatggtaatggatttgcaggagggggatctgatttggaaggaacacgtgagtagaatgcacaggagttggcaaccaattggttttaggggacgagagagaaggaagagaggatgactaacatttttagcctgatggcatcaggtgagaagggctgcagagggaggagtggatatgagtggagaatggagggggagatgctatgtcccagttggtcacagtccttccagggggagagaggcagcaggtgctggagactggagtctggatgttgaggtctgtgcaatcacaccagaagtagatgtgtccaggctggaaccccaggtgacattcactgattcctagacgtatgttatactccataccaacatgctgctccctgcccttcctctagctggcttccagttctcactggatgctcagtggagtggaggtaatgaactaaatggtttctctcactccagtcaagaccaaggagtctttgttgttgggttttttttctctcaagtcgtttcccaggactgatgttaccccaggactccagggggaaggcctgtcagatggcgtttatttatttaatgaaaagaacttaataatttggttttgtttccctttggttctttatttttctttctacccccttcttcttccctgggctttgcagggcggaaaatgggtcagcagcttgtccaaaacattcttgagtgtttaattcttcagctgttttacaagcctgcctggtttatgtagctaatctctcttctgtttgtccctggaggaatgtgtgtatgtgtgcgttgaggggtgagcaaggggtaggtggctgtggcagggccctgtttggtgaagagaactgaaagtataatacagtgtggagcgcctcctctgtctgtttattcctgggtctgggtttctgtgtacaccctctgtgctttcttgctcagtctggggaacttggcaaggaggtttgtctcaaggtttgctgtgaggtttgaagacactttgaaaggtgtggagagacatgattccagggtttggtcatttgtgggcctccttgtgtccagaagagtctcattttatccaaagcagatagtaagtagctacgtgctcaggaatgagagttattcccaggctgcctctttcgtccttgggagacactgactactatggaattgtctgctgactggagtctccagctccctactgcagttctccaggaagaactgtaaccagctcagacacagcattcttctttattccttggcctaacagtggccctctccaccagcctatccagctaaacattttcactggaactcttgatcgaggtgcaatagaatgggtacaaaagcaggggaccaggccttggaattcaggaaaacatgagtggtgcaggcctgtttgcctctatcagaaaataggatgactgtgagtctgaaggctccccagtgtcttggattttatcttaggaaagtatgtagattcctaatggattgaaactggtaacagagtagctttcatgcttcctaggtgctaggcactgtgaaggctcatacacatcacttaaatttatcaaagctttatagaaatgcattgatcatgatcatcatcatgactatttacattctacagatgaggaaaccgagggcgtgagggttaaataatgtgtccatgaaggttccaagtgcagagctgcggctggattccctcgaccccatgctgccgcacggtgtgatttttacagcattccctcatacacttgcgtatcgtattccccaccacaaaaatgtcaggtcaggctaggtatgattatccccttttgacaagcgaggaaactgtggctaagaaaggttaagtggcttggccagagccacagagctaattaggatatgcagacttagatcttggtctcctgattcttagtccagactttcccctccaagctgccggctccttctcgtcactgctgtactcaatcttattcttgggtctggttttctgaaggttggaaagttcccctgttttaatctccaatcttaaagtgtaacttaaagagccccagagaaaacgaatcaactgctgcgctttccatcaaggctacaaagtctaccccagagttaattggacagttattgtatataaaatgctagcctgattaaaaacatatttattgaagattagcaagtctgtaatagccataaatctccttcttggtcattcaaattttaaaatatgtttccaataacagtgcaattatttatatcataattctggagtgaaatagaattaaatgcatatttggagagtatggatttcaatctgtatcccttacatagagaacctgggattgtgggatgggacaacgggaacaatgaaggtctctttaaataaagggagagtgagcaggagcatgaggaaagtcagcaaggctcaccccctcccaccggagccccagtcccgcctgggcctcgggtgtttccgttgatttttcacacggtgttcacgccaagtattttcactgcatttccagatgtacctaaagtatttcctgggcgagagtcaaagcagaagaggcaaagtagtcagggccagtcaactgggtcacagcaagccggcctaggtggttttccaacccttgccttgcccagccagctcactgtgtcgctattgaagtgatgtacataagaataattatgtaacggtatcgtttttgtggcaacaaggtttaacaacctctgtggaattgttggcatcttagtgacagttttactgtggctgtgatcttagagaacattatttatcatactgagatggaattgatggcaaaatgagctgttcaacagatggtgctccctgcaacaaatgtgaccacgtggttttactcacacactcccatatgccaggtcttacattatttattcgttcatttacacattaagagaacatttactgagtgccaattaattgccgactctgggcagggattataagtgggttagaataagccacaccttgctggtatgattgcgggtatggggaaaagctccgaactgttcccatctacttcttgtctcatgtattcatttactcaacacatatttattgaacacttgctatgtgctgggaactagtctagataccaggcctagaacaggaaacaaaataaagttcctgctctcatggagctcacattcttgatgcttgaaattagttcacagaggagtaaaatgttgcagttgaacaataagaaataagacttaaaaaggtatccatgctaaaaagaaaaaagtaaaactaaatctacttgcagatgacatgatctagtatacagataatcataaggtatctacccaaaccattaaaactcataattgagttcagcaaggttgccagatgcaagatcaaaatataaaaatccattatatttttatacactagcaatgaatgatccaaaatgaaattaagaaaacgattacatctgcaacagcaacaagaagaaaaaaaatacttaggaataaatttaacaaaataagtttaagtcttgcacattaaaaactataaaaaatagttgaaattaaacaatactctaaataaatggaaagacagtttgtattcctgaattggaaagcctaatattgctaagacggcaataccccccaaagtggtctacagattcaatgcaatccctatcaaaattctagctgccttttcttttcctcttttgcagaaatcaacaagctgttcctaaaagtcatatggaaatgcaagggaaaaagaaggacaaaggtgtaggattgacacttctaaattttaaaacctgctacaagggtacattgatcaagactgtgtgatactgccataagaatagatatgtagatcaaaggaatagacttcagagtccagaaagaaacttttacatttatggtcagttgattttcaataaggatgctaagacaatcaatggggaatgaatagtcttttcaacaaatggtgctgaggcaacctgatatccacacgtgaaagaatgaatttggacccataacttatactttatacaaaaattaactcaaaagggatcacaggcctagatgtaagagcaaaaatgataaaattcttagagaaaacataggcatttttgtgaccttgtattagacaattgttccttagatatggcaccaaaagcgtaagcaagtaaagacaaaaattggacctcatcaaaatacaacctttcatgtttcaaaagacattatcaaaaaagtgaaaagagagcccacagaatgggaacatatatttgcaaatcttacattggataaggatctagtatccaaaatataaaaaaagaactcttacaacttaataataaaaaggcaagtagctcaattaaaaatgagcaaaggatttgaatagacattactcaaattggacacacaaatagccaataagcacaaaaaagatgcacaacatccttagttattagggaaatgcaaatcaaagccacagtgagacatcacttcgttccacttggatagctaaaaagtcagacaatcataagtgtgactgagggtgtagagaaatgggaaccctcatatcttcctggtgggggtgcaaacaggtacagtcactttggagaacagcttggcagttccttaaaaagggaaatatacagttaccatatgacctgcaattccactccaaggtatgtaccaaagataattgaagacaagtgactacataaaaatgtgtacataaatgttcctagcagcattattcataatagccacaaagtgaaacaaacccaaatgtttgtaaattaatgaatggataaagaaaatgtagtataaccatataatgaaacattattcagccatgacataggatgaagtactgatacatgctacaacataggtaaccttgaaaatgtgctaatgaaggaagccagacgcgaaaggtcacatattatacgattccgcttatctgaaatggtcagaacaggtaaattcatagagacagagtaaatacttggttttcagcggttgtgggaagcaggagttgggaaatccctgctaatggtacagggcttcttttttgaagtgacgaaaatattctagaattagatagtggggatggttgtacaactttgtgaatacagtgaaaaccattgaatgttacactttaaaagggtaaatgttatgttatggtaaaatttaagggttaagcataaattgaattctagttcaatttaaaaagaattagaaaaaaataaaatagagttgagatgcaaatacccccaagagaagttataaagggactgatatttcacctactgcagtatctgatatgcagtaggtgctcaacatgtgtttgttgagtaaatgaataaacaattaagttattttcccaggaatcaggttctgaagaggaaagaaacaaagagcaaagagaagcttgagggagctcttcacaatccacaggaaggtgggggcatggggagggctgaataatggtaactaagttttttttgcttttcctgattttacccagggctgtctctgcatagtcctgatgtctctcttctctgacctggtttggttttggtcggcagagtatacctagtgcctggaacctagtaagctctctgtgaagacttgtttaataaatgaatggttaaaacctcaacaactcgtctgagactccttggtaatttagggggagctaaggcttgagaaaaggtacagatcctaggtgggacagccagatttgccatttgaaacagggtccttgtattggacagaaaagttgagcctcaagtcctcaggccatctgcacagctatgtacaaggctagggcatgtccccttccttggctcctaccgcgtggtctggagttaagccaaagagggaagaggtattcctgcagacacagatgctgcagttaccggcagacttgttctgacctactggaggggaaggcctatgggttcagtcctgtctctaagcagtgtggttgataaagtcgaccagggattactgtgaggtgctttgtgggagtgttcagagttagctaggtatctcgctcagtcagcagtacacacgtatttatgtacggtttcatacgtgtgtcattaacgaaatttgtgtgtgggagaagcatgcattcatttataattccttacatacctttaaggatgcctttaataaatgtattggaataatgtaagaaggactagacttattttttatcctgctttgtcatttagcaaaggtctttagccatgttgcctgacttctcctgtagaagttcaaagtttcatttctagcctttgaatttgtctttttccacatacttgatggagaagataaggggaaagaaacattaaaactaaagtctttcttacaattattactgaataaaatcaatatgaaatgaagatgaagtcatcttaaaaatcaaggtcataataataatacagatattttactctgctgaaaactaaggcatacacaaggccagaaaaatggcacaaaagaaaagcctttaacttggtctgttccttttttttgagacagtcttcctttgtcacccaggctggagtgcagtgccatgatcatggctcactgcagcctcgacctcccagacccaagtgatcctcccacctcagcctcccaagtagctggaaccacagacatgctccattgtgcctggctaacttttaaaatttttgtagagttgggagtctgtctatgttgctcaggctcgtctcaaattcctgggctcaagcaatcctcccaccttggtctcccaaagtgctggggggttcacaggtgtgaaccaccacatccagccaaaagcctttaatttaactaaagaagagatgaaccacctcggtctgcaatcacgtatcatgtgcagttttagtttttgtgctttttgtttctcaaattctaaaagatgtgatagtagttaacattttaaaaattatttattttctttttttttggagacaggctgtataagactctgttgctcaggctagagtgcaatggcatgatcatagctcactacagcctccaactcctgggctcaagcaatcctcccacctcagcatcccaagtagctgatactacaggtacatgccaccatgcctggttaatttttattttttatagagacagggtctcattatgctgtccaggctggtcttgaactctgggcctcaagtaatcctcctgtctcgacctctcaaagcgctgggagtagagagaggtgtgagtcacagtgtccagcctagttaacgcatttttggtactttccatatgtcaagtgttatactgatattatataatttaattttcacaacagtcttataggtagtatagtattgttttccttttataggcgatgagacggaggcacagagaagttaagtaacttgctcaaggacaacagttagcagatgacagagacggagttcaaacccaggctgtgttcccggcactcctttagctactatactttactgcctgttgttttatgattcaaagacgtgaatccatgaattgagcgtgttgtgtgtgtgtctcccaaaactacagagtaagaagtagggtaagagtagggagtgggctgggtgcggtggctcatgcctgtaatcctagcactttgggaggtgagggtgggctgatggcttgagcccaggagtttgagaccagcctgagtaacgtggtgaaaccctgtctctacaaaaattacaaaaattacctgggcatggttgcacatgcctgtagtcccagctcctcaggaggctgagatgttgaacctgggaggttgaggctgaagcagcattctagcctgggcgacagagtgagactctgtcaaaaaaaaaaaaaaaaggagtggtttattgtaaatggaggtaggactaattcttgaaccatattgtggttttgcaggaggtgagtcagatggcttttggtgagtcagatggcttagttaagttgacccagctattgggatgggttgtgcaaagcccaggcacagggttcagactccatcttctgtgttcttcttaattgacaaactgcaatggctgtcttcagagtcttggttttctatggtggtcaactcctgagttcttatgatgtcgctgggcacagaaaaaataaacggagaaggtaaggtaagaagggagtccttataaaggtggagctgaagggtgttttagggggaccactccatctctctgtctgtcattcaaaggcacaactatgcccaatgacttggagtagcaggtctgaggggcgtttaggttgatccctactttctttctttttttttttttttttttgagatggagtctcactctgtcacccaggctggagtgtaatggtgtgatctcagctcactgcaacctctgcctcctttgctcgagggattctcctgcctcagcctcccaagtagctgggattacaggtgcccgtcatcatgcctggctcatttttttgtattttttagtagagacaggatttcactatgttggccagggtgatctcgaactcctgacctcagggtccgcccgcctcggcctcccaaagtgctgggattacaggcgtgagccaccgtgcctggctgatccctactttccatggttagtttcccaggccttggtttatgagcaataaattctcccatgaggtttgtcttttcgttttattggaggacgttttctcataaagtccctttccaggccatcagaactccccaaactcttgggaactgcattccatctgcatgccttgtgatttccttccccccaacccccaccagtgtatcctcttctctctcctattagtagtcaggatgggctttgcacgacccatctcaatagcggggtgaactctaaataagccatctgactccgtgtcagtctttctctctctctgtccaccctacaccaacttatgatcccaagaaactttgttttcctagggctgccattttgaaaatgttgcttcctactctaggaactgctttatgagtaagagacacctctccattagtccatgaggttaataatataaatctatagagaacttaggtaccatccagttaaaccaggctcttaacgtaaggattgtctttacagtgtttatgtcaagcagtcatctagtggctggttaaacatctccagtgacatggaacagtcagttcaatttttagacaattctgctagaaccctttttgttatagcagaaatgagatatccatagtgcccactaatgggacaatgggatgtggatgtgtctgtaagaatgtgaaggtctttttatgggttttctccattattcaccccaatagtttatttattttgagacagagtattgctctctgttgcccaggctggagtgcagtgatatgatcatagctcactgcagccttgaactctggggctcaagtgatcctcccatctcagcctcccaagtggctaggactataggcatgcaccatcacacccagctaagtttttaattttttttttctttttttaagagacaggggtctcaggccgggtgcggtggctcacacctgtaatcccagcactttgggaggccgaggaaggcagatcacttcaggtcaggagttcaagaccagcctggtcaacttagtgaaatcctgtctccactaaaaaatacaaaaattagccaggtgtggtaatgcgcacctgtagtcccagctacttgggaggctgaggcaggagaatcgcatgaactcaggaggcggaggttgcagcgagctgagattgtgccaccgcactccagcctgggcaacacggcaagactccatctcaaaaaaaaaaaaaaaaaaaggttggggggtttctcattttgttgccgaggctggtctgtgatgcctggcttcatgagatcctcctgccttggtctcccaaattgctgggattacagatgtgagccagtgcacacagtctatccactttctttcttgaggctacatgttttgttctttcaatgaatggttctttatgtatcaacacctctcttgaaggatgatgcctggaagtgaagcaaggaatgttctaggtgtggtccaatgacattaaggacgtggcttctgtgttctgtgtcccagttatatatcctaacaatatgttatggtatttgtttggtagctgcatccccatgtgaaactttcaggaaattaaatctttacatttttctccctaacgctgctatttagacttatgatctcagatgcaataataagctgatgagcagaatgagaataggaccttctttcctagagaaaggcattctctgtctgagtcataactgctgtgctctctgtgcaggcacctggctaggagagtgaaggcttgaagccatgtgctctcatgtgattggctgaattacttggtcaagaaaccagagtggacccttagccaaggtcaaggggctggcatagcagagaaaaggcaacggcttcatcagatggttagcaagttgaaaaatatgtatttgcatttgggtttgaaaatcagggtaaaatttgtcagaagccagagaaaaaatatacgggtagccagagaacaaatacagtgaggaatgagcagagcccaggggctgcagtgccatttgttgatacaaggaaaagaaagttagacataaatgtttcctctctgagctgatgttgtttaacctgtgagcatttggtgtacaacttacagatcttgatacaccctcatccctgaactgaaggcatctgtttggcaattagaagaaaggtcttaagtatgcttagctggtattacagcacgccactgagaaactgcaggggaaagagagacgtggctgtgttcctgaggcccacttcttgaagtttcctcaaaggtgggagacgctgatttcttcccagaatcctctgggcatccctgtggccagagatttaggaaccttgcttgccacagactcaaagcaggaaggccaccacttcctaaccccagggaggaggctctcagttgctagtgagagtggaacagaggctgcaggttcacctgaattggccatagaggggaaggcatggatgagaggggagaagggctggcgtcttcccttctcagtggttccctctccttcacttgcctccttctggtctcctccttgcctcctcctgctgttggagtggatgagctgggggcccacaccagggcttggcacggcgggaggagggcatggagtttctctagaccttggctttaagtaagagtgctgaccaggctcttaaactggggatgtgggctagtccagctcactagagtggagtcttaggtaatattaaggtaatgcatttgtcctgagagcatccctgtttaacctaaccggcctttgagcatcttagcagggacagtgcctggcaagagtctcaatgatgtttccatgtctcatttttattgataaagtctggcttcagaaccatctttcaggtcacctgaccacttgctttcctagcacagtggctggcatctactaggcattaaataaccatgggttattatcataattaaaaactagatcagttttctaaaatagggttaaccattctcaaacgttttgaatctggaggacctaaaagaatctggggtcgcatgagtcaccagtgaggaactgtatagaaactgattttgttatttttgctcctgacagatagctaagcccagtgacttcctgaaaaaccccacagagcgttagcaaaggccttgggagaagaactaggaaccctgcctcgtcccttgctatgttaggcagcaaaccctgctttccttcgccaggaacagcaacccgactgtgctccctctgccagagtggagcttccctgcagagtcaggcaggatgggaacggcagatgtcagccaaatggggctctgtttgagtcacatcctggtaaatgcgtgtcagaagcaggtgagcgatgttaaatttcacacaaacaacaatccagatgaaaggtgagagcacagcagccttgagctttgtctttgtgcccagaccactctctgctgtgcagaaagaaaagcctcacggaactctagaacacccgggtctggaattagggcgatggggacatgggcatgctcctgtgagtcctgcttccaccgatggtgagactttgaggctcaaaagagtcaataattgcacaatgagaatgtacataataccactgaactgtacatttaaaaatggctaaagcatgtgtatttagtaaagacgggatttcgccatgttagtcaggctggtctcgaacttctgaccttgggtgatccacctgcctcagcttcccaaagtgctgggattacaggcatgccgggcatggtgtcaggcgcctgtaatcccagctacttgggagactgaggcaggagaatcacttgaacctgagagatggaggttgcagcgagctgagatcacgccattgtactccagcctgggcaacaagagcgaaacttcatctcagaaaaaaaaaaaaaagttaaatcagtaaatgtcatgttatgtgtattttaccacagttaaaaaaaaaacaaaaaacagcagccaaggtggatagcaaagtacaaaacatgcaacagcaatgacagtagcagcaatgatttgcacccagttcttaagtgcaagcagcataacggggaattaaacagctccctgtcaaggaaggcttgaggagaagaagggcaagcatgtggaagccccctgtgaaggctctccccatgcacactttcatcactagggccttgctctgtgactctgacctctcttcttgcccagcatggtccctgggacctaagagtctgcctttcctcaccagaatacagcccccctccaaggctgcaatttttctccaggggtcctacctgggagcttagctgtcaacaccaccctctcagatgctcaccgcctatggcatcctgcaccactaaagcttgggcaaacatcttgcgctttccttttccttagttaagagtatgatatttgcaaaggaactttactaaaaacaaacaggaatagatgaagaaataatgacccaagttacaaattgcataagcagaaaagtagctctactatattaaacacataatcctacattcatcacaaaattaagtgcttgacatactcatttttaatttttgcaacactctgaaaggacgttgtttttgtgcttctttgagaatcaagggagctgttgctcagaggtcttaggtacacagcaaagctaaaccaagactcgcaccctggcctgactggctccaaagtctttctttttacctctgtactgctcctagggttctcattcaaaggaggttcatagaaacagcagagagctttaacagatgccacaggctccgtgagaaccatgctctaccccttgcttgcagacacattttaggccgtttgcctgcctctttgtctcttagctcctgcctcatcagtaaactcgtgggggtaggagctttcctggcattgctcaaccctgtacccgtaacaccacaaacagagcttggcatatagtaggtgctcataaatatttgttgaatgggtgaatgaatgatgactgatctctcggcgacattacattctgccccagcattcacagacttctctgcccgtttatcttgtgctgctgtccacagacagacgtccactttcaattgtaactcagttttcagaccccacagccttcttttttaataatagtttctgggtgactctattagctcttagttaacttatgagctccaccaaatgagctagtcctttcgtagcccaggttaccttcttgaactctctctagaaccacacagactactgtttacttaggtgagtcataacggtggttgtgatcatggtgatgatgaataactaacatttgtggggcagttaaatattctaggcatcatcaagtgaaggactatgcaggcatcattgcatttctttgtttgtttttgttttttgagacagggtccctgtctgtcacccaggctggagtgcagtgatgccatatcagctcactgcagctgcaacctcccagggttaagcaatcttccagcctcagcctcttgagtagctgggactacaggcatgtgccaccatgcctggctaatttttaaatttttattagagacggtgttttgccatgttgtccaggcttgtcttgaactcctgggctcaagcgatctgcccaggagatcattaccccttcagcctcgcaaagtcctgggattacaggcatgagccactgtgcccgaccatgtcattgcatttaattcttacctcatcgttggtcacgggtcctataattatccccattttacagatgagagaaactgagactgaaatggcccaagtcctgcatatttatttctgcttccaaaacttgaaactactttgtactttgcaacctgaaagttttctacctcctacctcacaaaatacacggtcttagaaaaagctgcactcattacaacagacctgtgatatcacaatgccctgccacactctactacgaatacaccatctgcaccacaaaaatcagcacccgctctgtaacaggtgggatatccttttacagtagatggaatgccctgcttggttgataaaattggcccatctttcctccttccaggaccttctaccagcatcgcatttcctaaatcacttcctttgaaagaacacagtccttccaaaaagctctcaagctgtataagttttggctggaccccattcaagaccagtattttacacttaatctgcttctacatggagcaatcaggataaagaggatttatgaggagtgctttcccggagcctgacctttctctcatgttttaccatttatttatagtctagtgtcttcagcaaagacatcctggggcctcccgctgtgtgatgctatcagatcacccctcgctgctggagccggtgttcttggctatgaaaggaaggggttggggcaaaggccaagtacgaggccttgaagcttctggcacctctgggatgacttctcagtgacttgctgtgaactgctcccccaccacctgccttgagtagactctggcattctgtgggcaattttttcatgatccctagagcccagccctgctttccttcctacatggatggctcacctgttgatgaccagtgcttgaatttagccttggagatggagagggagtgatggaggagaagagacgtttcagtcccagatgaattcatttggaaaaataagcctccagaatttgagtaaatctccatattattctggaagagtttcgggtctttacaaaacccaggtaacatctgtggatgccccatctcttcaaggtcaaacactccatgattatagagtgaagggtttcccgtgcagtctctcctaagccccacattcagagaggcggggctgccctctgtgtaccttcctggtgtcacccctcagagcaactggttctttcctcaaaagagtgttttcttttaaagttcacagtgttcacttttttgtttgtctttctgtttatgtgctgcaaggagaactctgaattctgattgcaatcctaccagttagatagttttacattcttcctgaaattttgcagagttgcttgtagcattgggaaaattggacaccagaatttttagatccctgggccaacaaagggcatgggcagggagtaacctggtcttcagagcactcacaacttcccttttgttagcacttgcagactttccccctttttgcaagctagtagtgtttatttttcaatgaaatatttcactcatacaaacagaaaacataatgcatggatattaaataatataaaataaatactcccagacccatcacccaacttaagaaatagaatgttccccagatggtgaagcagcttctgtgcccccccattggtggtccctccccgccaaggggatttatatttattgtttgaaagcatacttagtaaaataaatgcattttagaaatttgtgtgcatttgaacttcatatgaatagtatcacatagggtaattctttggtgtcttatgcttttcaggctcatctgaattgacgcaggtagtcatagttaattaatttttgccacagaatagtattccattatgtgactatgccagccattacttaccattccccagccagtgtataattggttgtttcccattatgctattaaaagtcaggctgctataaatgttcttggccatgtttccaaggctggtaggcaagggcctctgggccacagccctgcattttaaccatcttctgcacatcctcttcttctccacttgggttctctccttcttcagtgactgtttctggttattatcctcagggactgtgctgcacactggtggtacacatgccttggccacttccgctttagtggaataactaatgctgtcattcatgttgatgacctggctgaaaccctgacaccgaattcctgcaggtcagctgacccacagtgcccgatcttccaccctctccgctggaccacccttcttccctgcctcgaaagcactaccctctcctcctttcctctgccttttggtctctgctttctaagacaaaccttttacctgtccttttgattctatcccatgaccaaattcccaactacctttcccatctatgtactttcagtctgtcatttcactacaaacctgctaaccatggaatgatatccccatctctcccaaatctttgtttttttaaaccttaaacaatcatctcacctctgctttccctggaaaacctctgtgctgcctttctcgctgatacccaggacctctcatcatttgactctcccccagccctctacagaaggtgcctcctgggagctcacctgaggcctcccaaggagcgaattcacagacttcttattcacctcacttgctgaatgcaccacctgctcctaaacgcctcctccggcctgcacagcatgtcactgctctgacagtcccttcgaaccccatcatggttcgtcctctcttcctctgtgtacttcccctaaattatacgtcagaggtattatccttccattttaacctggagaagtggggcttgtctgggaagcctgctgggaccttagcaaaggacagggtaaaaagtcgtgtcatactcaggcttgatctgcagacattccaggggagaaatggcagctgggccgggcagcctcttattcagatggctaagacatagcctcaggcaactgatagctatgtgggtgagggtgccccagccactctgaacaagaccccagacagtaggtggaaggtctggggctatgggcctggctagagctgggcagtaagtccaagttctgatcaagtaggctggtgttcaaggcaggccgtgggctgagcacatgagccaggggatcgcaggaggaagcaagaccccactgtctagtagcctcttagcatatgtgtcacagtcttcattaggactggcgtggaaatagggcagatgagcccggcatttccagtgccagcagcatggcttacaccctgaacttcagtgctgtcaatttcacgtgggtgatccgagccctggcctgcctgccaggctgcctgtctctctcttcctccctctctctttctccaacttgcagaaaatttgcaagaacagtaaaaagcacctttctttcttgcggttgtttgagagaaaattggtgacacggcgcatcatcaatcatttcacacgtattttctgcaaatgaggacgttcttttttttttttttttttttttttttgagacggagtctcgctctgtcgcccaggctggagtgaagtggcgtgatctcggctcactgcaagctctgccttccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccggacgttcttatctgtaatcaaaacaccaccgtcaaacccagaaaattaacagttacggagtactgtgatttagctctcagactccatgtgagatttacctcctgtcctagtgaagtattttacagcaatgggttctaaccgagaattagtctcctcagcctttccctgactttcatgatcttgacagttttggagataacaagtccagttattgtgttgaatgtctcttaagtttgatttgctgatgtagcctcatcattagacataaggtgtgcacctttggcaggaattggtgctgcatccttcttgcctacataggaggtatacgattgcaatttgtccctttactaataaggttgacttcgatcactaggttgagatggtgtctctcagaggggaaaagttacttttcccttctttgtaattaatgaatattttatggaaagttactttgaggtattgtaagtatcctgttcatcatcaagctttccatttatttccctatttatttatatcagtatggattcatgggttcctgttttattcaacaagttataatccattgttatttatgatcattatttattttggtgcttaaattgtccaagatttggccagtgagagttccttcaagctggcttttgtgtcctctggacttgcgccatcactctttgtgcttttccttattttctggcaaaaagaaagattgtttcagggtcatcttttacttttcctacctcgccctggaattagccattttgccaaggaatcatggttcttttcagtgaaaaaatggcatttggaaaagaaaacctgagtgctagatgagtttactgccgttgggatgttactgttcccagccccctctcggagggcagagctagacaataaaaaaacacacatacacatatttatatctacattgcagctaggtaggtagatagatagatagatagatagatagataactatgagttcacacctacatctctaattcaaatccacagggttcatcctcactttgtcttttgctgttgtgagaactgtgatgattaattttatgtgtcaacctgactgggcagatatttgattaaatattattctgggtgtatctgtgagggtgtttctgagtaaagtggatggccctctctgatgtgagtgggcctcatctaatccgttgaaggcctgaatagaacaaaaaggctaagtgagaattcaccttttctgtgtgactgtctctgagctagagcatccatcttctcctgcctttggactcaaaatggaaatacaccgttggctctcctgggtgtccagcttgcctattccagatctcggagcttctcagcctgcatatctgtgtgagccaattccttataatacatcacatcctatctatctatctatctatctatctatctatctatctatctattatctatctatctatctatctatctatccatccatccatctatctacccctctacctatcatctatcacctattggtcctatttctctagagaacccaggttaaaaccataacccagcaaacagcctggcttccctaattctcaatatatttacttatctgacatatcctcctctgtgttaacaatttcctttcacctgcatcacctggctgcccctgcatggagaccctcctcacctccctgaggctctggcagccattgcatggggccacattcctgcacagagggcctcttgtggagcctgggccctgggacccctcagaaggccagggcaccctcttgtgctgacactgcctctgccggctcaggctgttgtgcctctgctctgctgtgggagtgcctaccttgctgcactccaccaaagcttaggactgagttgttcaggaaagaaagggaaggggagagaggggaagggcagggaggaggagtggtggggaagaaaaagaagaggaacaggaggaggaacctgatttttcttttcaaatctagttccttccttcccaactatttatttgtcactacctttgatgtatcctgtaggtgctttagaatctacgtatctgaaactgctcacatttcctctagtaaaacctttctctctttactttcctttgctgctggtgacagtataagttaatttgattctttctgggggacaattttgtttcaaaagccttaaaagcccccacatttcctttgacttccaaattacactgtcagggatttattctaaagaagtaattaaagatgtgtagagatatttagcttcaaggatattaattataagtaaaattggaaccctgcggaatggttagcctcagggaacagacagagtaagttgtggtaaattcataaattagaattctaagtaatcagtaaaataatgctgaattacaattattgatgtgaaaaatgtatattatatattgttgagtgaagaaaagtcgtaaaatggaataatcccaattgcaattaaagtattagaaatatataagcatagagaaagaaaacagtataccaaacaggaatagtagcaatgacattatggtcatttatttttatttcccttaatatgttttcagatttttcttcaacaaacactttttgtgtatacaataatcaaaagctacaaaaagaaaaaaaaacccatgtttttgtcttgactttgctatttctgttaatagcacaggcattcttgaagtcatggaacccttggcatgaacattgacagctccctctcgcctgtcacggagtcctgttcacgatattccttggggcatacctttctctctgtctgcgggccgcctctgcagctcaggcctcgcagcctcacacctggactattgccccggctcccattgcattaccttgactgagctttctgctccaccctgacccaggcagccagagtatcgccctggggaagttctttgatcacagcttcctctgccgaaatgcagaaacgttagtggatctcccttctttctgaatctgggctgcattccttagcccagccctctatcgcctggttgcagccagtgttgccttgtccttgtttcacactcagactctgctcccacaaacgtgttctggcttctctttctttggtttgacattttcctccttctctggtctgctcaatcactggccgttctggagttactttccctccgcccttgctcctgcctcattcttcagtgcctcactcaaatatcatctcttatgtgatacctctccctgtagtccccactgggtgcaattttcccatctctgaacaatgtagcactgtgtgccactcccattttcttcctatggaataaagatgtaccatcttcggctctctcttttttcttttgtttaggccagctctcttcccctgtggcacagtctgtccactccagaggccgagtcttcttccttggaattccttatccttggctcatcttcctgtccatttcatgcactaatctaggttggagaaaaccagacattgagatcataaaatttggacctgatcttttaaatttttcttgaaattgcctactcctcaatccactaaagtctagtttctaaccccttagatgctatcaacattggactagcaaaggtcatcaataaggtgatgaaaaaaaaaggtttctgtttgttaaatccagcagactcatgggtgttaggggcacagcccaagtgggcttcctctgccactggacaggctagagtccaagtcccagcctccccttgcactgtctctatcttgtgcaagtcacatacgttcttcaagaaccagtttcctcatccactaagtggagataaataataatagcacaatttttaataattgtaaaaattaaatgagacagtgttcatagaatgttcacacagtgttgaacgccatgaagtgctctgcaaatatgagctactgctattatcacaaccataaagttaaaatcgttatactggcctctgcctaccctttaccctcactgcgtattgcagccctttcctcctgcgtatccaaggcactttatgcttcagttacagcaagatgcagatagcttcccaaatgcactcactctgccccatctctgagtctttgtgcttgctcttcctttgaccaaggatatccttcccccatcccttacttgcctggtagactcctatccacctattccttccctcttttgaaaccaaattcatgtgttgcttcctagcaaaagccttcccttctcttccccgagaatgggatttacttcctcctctgtgcaatctttgcgccttgtaaatatttccattgttgcacttatcacatgttatgaaatcttatgtgtttaccttgtcaccctccaactgtaaaatcctagactccgcttctgtttcggtattcagtatctaccacagtgcacggcacacattaggccctcaacaatatttgctgaatgaaaaaaacatgggaggaggcaaaactcagaagtggcagagccaggaattaaaaccaggacctcttactcctgaccccatgttctcccgcggacatcccccaagagtcacggacgcggtgagacaattttgcaggttgtcttctaatgtctcatggtcttggattgacctgagagtgagatttactgcccagtgataggaaagcttcagcctctagctcatctcaaaggagttgcacagggaagggactaaagcgcctcagaaaacagtgggcatgtggaaggctctgaggctgcaggcaggaacctcaaagaccccatccaaagcaaaatgaaaactctttgtaaagctcagtaaaaaaagagagacattaaaaaaattgatattaatgtgatctccaggcggtgtttattgaaacaatcttaggttcataatcaaaacaatgttttatcatttcccctccaggctggtcacaagctacaaactggatcatttgacacatctctcgtgcactcgaaactcaaattgaaactctgccattttaaccgtacaaagtaaaataacttttcaaagccccacatatatatttttctgattcatccttttgatattttacttggaccaaaacccgaattcacttggtttcctccaagcacatatttgggctacttccatcattgttcttggaaatgatttttcctttagacatagtgtacactggatatacaacctggtcaacaccatcacaggccacagcagtgactccctcgtgggctgtcaggagcatccttaaaatattatgtctccacaaaggatgagcaactggttagttgtgcaatgttcaggaaagcgtgtgtgtgtgtgtgtgtgtgtgtgtgtgtgtgtgtttatgtcagcaggagtgagctttgtgtctgctggggaaaatgctgggtaagcatgtttttcagagggtttgcagaatttctgtggcttgtttgctgatatgaacgaatgacagaatatgttttgggaagatatgtgggtatgttttcatttatcttagggaggaatcctaagtacaggagacttaacattgggagacgttgtgtctcctgggtggtgttggcaggggctatttgttaggagaatatgaaaagctcatcaaaactgggcaaagttttactttattgtcttagaggaagaaaaatcaacttgttccactggtatgggatttgaccacggcagcttccaggaactgggatggcctgtctggggcaggagcagggagaatggagccagctacgtggattagtccattttgcattgccataaaggaatgcctgagagtgggtgatttagaaagaaaagaggttgatttggctcatggttctgcaggctgtacaagcatggcagcagcatcacttggcttctggggaggcctcaggaagctttattcccagtggaaggtgaaggggagcaggtgtgtcacatggtaagagagggagcaagagagaggaggaagttccaggctcttcaaaacccccagctctcatgcgaacagtgagagctcactcattcctgtgaggggggcaccaagccattcgtgagggacccactcgcatgatctagacacctcccaccaggcctcacctccaacactgggggccacatttcagcatgagatttggagaggacaaacttccaaaccacatcactatgctttcacctgaagtcaagctgccaaactctttgttgtccctggtcatctaacgagtccactggcatgtaccccactccttcgtgtaccccatttctggcccaagctccctcacatcaggttcccacctcctcacctgcctgtggctgatctttgccccttctcccttattcttggtcccttctttcccagttttctctctctttgtggttggtcctggctatctgcttctcctctcattgtctgctccactgcaatccaccccatgcttttttatttctgccctgatttttcctactgcttcctacctctgttcatcttaggctctgccttccccattcccttacctcccttcctcccccaggctctgggtctgtgtgctctaatgggagcctaggtgaaacaccgacaggggaggacgaccacagtaaaagactcaagtaaaagaaacaccatgggcatggtggctcatgactgtaatcccagtgtgattgggaggccaaggtgggtgggtcgcctgaggtcagcagtttgagaccaacttggcccacatggtgaaaccccgtctctactaaaaatacaaaaaaaatgagccaggcatggtgacacacacctgtaatcccagttactcgggaggctgaggcaggagaatcgcttgaacccaggaggcagaggttgcagtgagccgagatcgtgccaccgcactccagcctgggcaacagggagagactccatctcaaaaaaaaaaaaaaaaaaaaagaaagaaacaccatggcgacaggcaggagcaactagaatcccttgaaagaattcaagttcctttaatgtagactgttcctaatacacaacggggtgatcagagccagtgaagccatactgctgcctctggctcattgcagtccgtttttaataaaggctacagctggacacagtaagcagaggaactcgaagttccgcccagtgctgagattctatggtttgcaggatattacagctgtaatattttaaatactttaaaatcatgaatacgtatcagttttaattgatccaggcctaatcttagctagaaggaagaaggcccggccactatctgagctctgttgagctatttgacaggcttgcctgtcctcttggcactgctgccgccggagccagggaactctagcacacccagaactttcacggaggccagagttgctgctttccaattcctcccacagtttagggaggcgatgagatatcggtgctctcattccatgttgctgtgacttccaaacatcataaagcaaactgagaatggccctggccgagccgtcagccccagccttgctgtacttctggtccggaagagaccggatgggaagcctccaggttctcagctagggtaggtcgtatgcacctggatgtcagcatctcctctagttcctgaggggcctccttcctaggctcttccaccagaatccaagttgctaccaggcacagcactgcatatatttcttggcttgactagcttttgcccaagtgtgatggttaatttttctgtgtcaatgtggctagaccaccatactcagctattttgtcaagcacatctgaatgttgctgtgaagatatttctcagatgagattaacatttaaatcactagactgagtagatcacatgaaaatatgggtggacctcatccaatcctgtgaaagccttaagagcaaacacactgacatccccaaggaagaggaatctcagcctccagacgaccttcagaaacaagactgcaacatcgacttttcctcagtctccagaatgccagcccatcctgtagctttaggacttgccagtctccactgtcctgtgagtccattccttaaaataaatccccccaacgctgctgtgagtgcacgcatgcatgtgcacacacaaagacacacagacacacacacacacacacactatttgctctggggggctaatatgccaggtgaggcccaatctagacacagcacaaggtggtctttctttcattgtttaatttattgctgccacaagatccttaaagcaactcattgagtgtccaggattaaattagctcttggatggttgactgctggtaactaggagctatcggcctttagggtgaccaacatcctggtttgcatgggctgagggatttcttgagctgtgggagcttctaggggtaaaactgggaaacctaaataaatcagtcaacccaaccacttcagcaatttgggcaactgggttttttccattcaaatgcctaaaatttttgagactgcacctctggtgtacttactaagaaactgttgtgcctaacgtctccagatcttggttgttgatgcaacaagcacacaacccctgtcacagacatgccattttaaggccctggtgttgcatccaagaaccactcagagccttacataaacatatcttctaatgtccccaaagcactttaatgatgagtgtgcctcttgccagcaagcacatttacatgctggctgtggagtattcttaggattctcactgctggctgccacaagccacggccgaccctgcttaggttcttttctgtgcttgggagccacagctgtgtatctctgaacccttctttctcaaatgctagtgctctgtgacttccagttttctggcaaattcaccgttgcccggcatgagccctccaagtgcccttcttgtggttagctccaaagctgaatgtctgtgtgcaagccccttaatagaatctagacaagatcaggcctctccctctgccaaacccctttctgtgtggacacagtttcttgacggcccaatctgtaagactggacaatggagaaagtcagcgtttaagaggttaatgcccctcgcccgattgccccacttctctccttcctgggtggtgtgagttggggcctctcagagactgaagtctagagggccctcaggcattcaggccctccgagcccaaacagttccacatggcatgtgggttttgatgtgagaagctgcacataggagatgagtgtgttgctatttatcagacactaaactccttgctcagaaaagccaagcccctgcactctcgccccattagagttgctgaccatgaaacatactcatccgcggagccacagataactgcgggtggaagttgagaccctcgatgacctctgtggcaggtactgtgtcaggcactccactctgggcagtagataacaccaccaccattttaccaatgaggaaatggactcagattaagtggtatgtttggtgtcacagtaagcaagcagtgaagctaggctttgatcccaagtttctctgactcactccaaagaccagagtccttcctctgatgcttcacagcttaacaacatgcagatacatgacatgttccaatctcaacttcatcctctgtggactcagaattaggatggcgtgatagattgttaaatatgaccacagattcctcccatccccgtgtgcatgtcctgtgcacggcaagtttgctgtttctgccaccatgaagtggaggcttacttcactccttcaaactgggcttggccagggagctagttttggtgaacgtgatgttagcaaatgtgatgggacatgaggcttgccaggtgcttgtgcattgggacttgccttctcttgctgctgcagacccttcctcccccacagagcagctagaggcataaagcgtaggcagcagctagcaccaactgccaggagggcagatgatgccatcttagaccagccagcccccagctgatcctccagctgactagagctgcatgaatgattcaggagagactaggagaagaactgctcagctcaacccaacttaattatgtatagatttgtgagctgataaatcactgggctggcttgttatacagcaataactggtatggagggtaacaccctcccttgggcataggaactgcagaggtgcatgtgtgcgcacacacacacacacacacacaccatcccatgttgatttagctacttggttgatttcactacttgggagaaggccgaccactaaacgctcagagagtgccccacctggatggctgtgcctttgtttcctatctttctgtcacttcccattactttcttgtttcagactctttgtgccaaagtccctgtgttggcggggggttggggagggggctggtgatcgagggggtggcactcagcatttcgctgggactcattgcccctctataggataatgggataatggattagttctctcgctcattgttgggccttgcacattctagagcctcagaccttgcaagaattcactgtttttccttctttccgttaagctctgggttcagcggtttttgctgggttttggggaggagaggatagtgggagtgacaggaagatagactctgatttccccatgaacgaggatgagatgagctagaaaatgatgaagaacttccactccagggtagagttgatttgtctataagaataaagattaatttctcccatactcattctgccctctgctcatctagttttttttttttttttttttttttgagacggagtctccctctgtcgcccaggctggagtgcagtggcgtgatctctgctccctgcaagctccgcctcccaggttcacgcgattctcctgcctcagcctcctgcatagctgggactacaggtgcccgccaccacgccaccacacctgattaatttttaatagagacaaggtttcaccgtgttagccaggatgctctcgatctcctgacctcgtgatctgcccgccttggcctcccacagtgctgggattacaggcatgagccaccgcccccggcctgctcatctagtttttaagagaagtttgtattccccttatccttatgaatgtaacataggccttatttcttatgaataaaacccttgtctaattaagttttctgtctggtaaaaacaatgccaaaggtataaatgtcccttccctcccaataatagacctgttgattgagtaggtttattgttgttattattatgtgatgttaatgcacctaagcagtgtcttagattgtccaaagaaagcatcaacgtatctcagattatccatgtttcgtacttttttaaaaaagaaagtaagacgtggtttgatatttttgctgaaatcacccagcaaccatctacaacaagggatggtgaactttctataaagggaaagacagtaaatattttaggcctggctttcatgtggttactaaccgaactactacactgctgtcgtagcatgagggcagctgtaggcagcagtaaatgaatgagcatggctgtgtttcaataaaactttattcacaaacactggcagttggattggctttggcccagcagtttgtagtttgccaacccccatctagatgtggagattctgagctatgggcatacagtctttggggttgtaagtcagtcttcccaagatgagcttttatgtacactgggaagctggtgttgtaaggggcctcagataagcctagactggtatgaaatctagtcccaccctctcattttacagatgaagcaatagaagctcagagaagtgaagcaaatcacccagaatgaggcaacagaactcatgctcctgacactgagccagggcacagcagttgctacatactttctttgagtacttccagtatgtttccaagagctttaacaataataacacctaacatacagatgtttgccagtttatcatttagaatggtgagaaaatatatcttgttttatatatgaacaaattgaagctcatagactttcagtgacctgccagtggattcagctagtcatggatctagacacagacccatgcctttggactctaaggctggcactattgtgctgtagaaacacgttctatagataatgcctcagctgcagaacagaagaagtagagagaaactggtaacttgccattgactcggtagctttggttctgaatgtatttctgggtagagcaatagaggggatccctcttggttccgtctttgaagatttgatgctgtgaatttggacctggcctggcagcagatcttaaagtgacccctgctcttgaagttaaggatctctagtacttcctggtgctgccccattaaatgcaagaatctggcatctacgtaaaactttttttttttttttgcatacgttttcagggattagagaatgcaaggcacttgctgaatagtggtcattaggtatggaataattcaggtagacaagctcagctttagagatgctccctgcagcttttttcctcccgggggagagaggtggagagtaactgtgtcttggtggtcaggtacacctagcacagtacagggtgcacagacagcaggacactgcctggtttatatcagtcccaccccttccaccctctcagtgacactcagtgacactctgccagggcaatggtgcctggcgacctcttcccactcacattcctgagcactgctgaacccagcccagctaagcaaagcctgccaagcaactcggcacacagagtgcagtgaactgcctagaagaatgcagggactgaggccaaggtctgcttggctttgttatcatttattttggtgtatttatttaattgtatttgcaatttcttcttcattttccttctttgctcttggatggcacgtgacaaggacttcctggcatcacatctaattatactatttttaaattttcccttcacgccccatcactggcaaatgtttttcaaaaaacttgatgagattaaaactaaattgaccagatggcttctttgcacctaattaacacagtccactggtgccagatttccagggcacagggacccattatcctcatgcttacttccttgagctgcaccactctgttctgccttgtatatttatcaactctggaaatggatttaaggaaatgcacaggtgttactgagctaagaggagtcttggggctttagggtttggcagagaaatgcagcaaaatgtgctgggaagagtccctaagttgcatgaaggatcatcttttcatcttccaattctgcttcctaaagcccagctaacaaggagagtaaatggtctagaactagaaagctagacctgggtttcatgttctgtccctgttgtgttcattgtccaaatttgttagagggtatgagaattttctggttaacacttagattcatgcatccatcccatattttctaagttcctctaacataccagacactgaaataacagctggggatatcattacaaataagacaggcagtctttgccatatcagaacacatagtctatttgggggaaaatattaaaaaaggtagttcaggtgttgttgcaaccacttcttttccttcaaatggtagtattccataaactataaggcaattaagagatttggagtatgtctctgcaatatcttctccggggcctacagggtcataagcctctctattgttgacagccgtgaatggcccagcatccaaacctgcctatggagctgcagcccacttctccactggatccaagaaaggaatacagaggagcactcctttccccacgcaacacaatgggttgtggtacatacgtgacgttccttatggaagagttgtggtgatctcagaaggaaacattccaactcaaaaggacaaagcctgaaactgtacttagaacttcctattttattacacaaaggaaagagactttatcttgggccttcacaaggaagacatccttctccgacctggctgtcaggttcacttttatattcatgtgtatttcttctttaagcctctcaatctgccacctctcaaatgttttctctggaaaaatacatttcctccactggctgaggctctaggttcttcctttcaatcttcagtctcaattagcattaactagatgagcacagatgttcactgactctaagtttctcaggctacacagcccatgagtgagtgtgtaagtagatcctgtacctaccagtgaaattgtgacctgctggttcccgacttaagtggtatgttagctaaagatatcactctaagataaacataagcttttcttagtgtccagatagttaaatcccatgatggaaaaataatatttctgtattagcaggcctttctggcttagtcccttgggaatgataggacctcattagtgggtgaaagggccccaggctctttcctgttctgatcaagcctggaagaatcacaccacagtaacttcagtttttaatggttattctatttataatttgggaaataattacagttctgattaaattatgttgtttttagtttccctcaaatgggaggaggaagactgcaaatttgtctcacttcaacaatttgtacaaattatttacttaccgttgttataattaacccagaggaaaaaatacagggttccatgatgtgcacagctggggacatcagacatgatctggcaagaaagggagaaggttccttaaagagttgagatataaaaagtaactaagcgtcttccacttccagtcaagatggagtaatggggattggatttaccctcacacttgacccaactacagcactggacaaaatgtatgaaacaatgacactcaggacattgaccatcaagtgacaaaggaaaagtaggaggggagccctgtgattactccagcttgcaacctgcaaaaaatattcaggtcacagtgcaggtaagaatcagatgtttccttgagttgggaagacaaaattaggagtccagggaagccaaggcagctagaatttccacagaacaaccaccataaatgagagatccaggcagagagaattccagagatattcaggagattcctgtcaagtactccgttgagcgtgaatcaggccatgcatgtgagaaattatccaaggctggggaaagaatcaccttgagaggattagaggaaacagtaaccgaatgttacagacagtctgtttccaaaagccacagttgaaaacccgatttaaggggcatcagctacaattctaagaagtgtcttacctcaatagtgggaaaaattatccctaggctaaatgcagctctggtcccagctaacgaagtttaaagcaagtcctgaaaagaccaactgtttttgagtaacctagccacattctagaatcaaacttaaaaattgctcaatttttccccaaatctgattaaaactgcaaagccacaggcctaagaagttcaacaaatcctaagcacaagtaacacaaagaaaaccacataaaaatggttaaatgttaaagtgtttaaattttttaaaaccaattatgaagagaaaaattttaaaagtaaccactggagaaagacatattacatacagaggaacagggtaaggatgacagatttctctctggaaacaatgcaagtcagaagacagttgaaaagcctctttaaagtactgaaaggaaaaaaaagcccccctagaattctttacgtagcaaaaatatcttttagcagttatggaaaaatacaaaccttttcaaatatataaaagctgaagtaaatcatcaccaacagaccagaattataagaaatgttaaaggaagcccttcaggcagaggaaaagtgttactagattaaaaacctcaatcttcacaacagaatgagtatcacaggaaatggtaaatatatggttaaatataaagactatttaaaaaagtttagttatattcaaacacagtaaaccatttaagtgaaaaacaagaacactactttggggttaatgacatgtaggacgtatataacgtgtagaaaatatataacaaccacagcacaaaaatgagatgggagaaatagaagaataatgttgcaaagttttcacactacacttgaagttatctaatatcacttgaaggtagactatgataagttaaaatgtgtattataaactccaaacaatttctaagcatgatgaaggattattttttaaaaagaaaaaaaaaagagactgggcatggttgctcacgcctgtaatcccagcactttgggaagccaaggtgggtggatcacgaggtcaggagattgagaccatcctggctaacacagtgaaaccctgtctctactaaaaatacaaaaaattagccaggtgtggtggtgggcacctgtagtcccagctacttgggaggctgaggcaggagaatggcatgaacccgggaggtggagcttgaagtgagccgagatcttgccactgcactccagcctgggcaatacagtgagactccatctcaaaaaaaaaaaaaaaggaaaaaaaaagagattaaataggatcaaaaaaataaacagtctaaaggaaggcagaaaaaactgggacacatagaaaacaaataaatttaaatctaaccacacaatcaccttaaatataaatggcctaaaccctgtaactcaaaggcagagaataacagattgtataaaaaataaggtacaactttatgcttcctagaagaaactcattttaaatataaaaatacaaacattaaaactgaaggatggaaaatatatgctaacactaatcaaaagaaagctggagtactatattactatcagattaatgtatatttcaaagaaaaaaaatactacctaggataaggaggattgttttatgacaataaaagggccagttcaagaggacatcagaaatctataaatgtgtatgtacctaataacagagattcaaaatacatcaagcaaaaactgaaggtagaagaaatatacagtacatgaaactaggagaaatatacaaatccaaaaataatagtcagctatttttacacccccaactgttaatagttgacagaacaagtagatagccgtaaagaagacttgaaaaacagctgtaaagaagacttgaaaaatactattaaccaacttggccttaaaatttacacttatagaacactccatctaacaatggcggtgtacacctcaaatgcacatagaagatttactgagatataccatgtttgggaccataaaacaaatgtcaatttatttaaaaggattcagttcatgcaaagtattttctagggctgcaatcaaatcaaattggaaatcaataacagaaagatttctggaaaattcccaaatatttggaaactaactaatatgcttctaagtaaccaacgggttaaaaaaaaagatatcaaaagaaaaatcaaagagtattttaaactaaataaaagtaaaaacaaattatcaaaccttgtgggatgcatctaaatcaatacttttaaggacatttatggcaataacacccatattattggaaagaagaaaagtttttaatcaatgaccccaacttctacgttaagaaactagaggctgggcatggtggctcatgcctgtaatcccagcactttgggaggccaagacgggcggatcacgaggtcaggagatcgagaccatcctggctaacatggtgaaaccccgtctctactaaagatacaaaaaattagccgggcatggtggcatgtgcctgtagtcccagttactcgggaggctgaggcaggagaattgcttgaacctgggaggtggaggctgcagtgagtcgagattgcaccattgcactccagcctgggccatagagcgaaactctgtctgcggaaaagaaaaaaaagaaactagaaaaagaagaagaaattaaacctgaagggaaataataaagatcaaagtggaagtcaatgaaatagaaaacagaaaactatagagataaacaatgaaaccaaaagctgtttaaagtaatcaataaagttgataaagtctagccagactgactggaagagacagagagagagagagagagagagagagagagagagagagagagagaatgttatagtatcaggaatgagagagatgacaccacaccagatcctatatgtattacaaagatagtagacaatattatgaacaactttatgtcaatgaattaacaactcagatgacatggataaattccttgaaaaacataaatatccaaagctcactcaagaaaaataacttgaatagccctgtatctattttaaaaatggaatttgtagctaaaagtctcacgaagaacactacagaggccaggtgtggtggctcacatctgtaatcctaacacttcgggatgctaaggtaggaggatctcttgaggccaggagtttgagaccagcctgctcaacatagcgagaccctgtctctacaaaaataaaaaataaattagctggggttggtggtggtgtgtggctgtaggcccagcaactcgtgagtctgaggcaggaggattgcttaagcacgggggttcaaggctacactgagctatgatctcaccactggactccagactgggtgacagagcaagaccctgtctcccttaaaaaacaaataaacaaacaaacaaacaaattcttattatttattagccttatatcctgcaaagcacaaaataggtttgaaaataaactatatttttatgttgtagcaatagacaatcaaaattaaaataaaaacaccatttacaataaaatcaaaatacaaaatattttgggataaatacggcaaatgatgtgcaagacatgtactctgaaaacacaaggcaatgctgagagaaaattaaagaatactcaaatgtgccatgtatcttgtttataggttgggagagtcagcattgttaagatgttaattctccctatattggtctataaattcaatgcaacccaatcaaaattccagcaggcttttgtatagaaaatttcaagctgatttaagaattcatctggtaatataaaggacctagaatagtcaaaacaactttgaagaagaacaactttgaaataagccttgaagacacattaaagattattataaagttaaaacgtagcattgaactcaagggggacaaataggctaaaggaatgtaatagagtctagaaatagatccacacatacatagcatatgcagtcagttgatttctaaattttattttattattattattttttgagattgagtctcactctgtcgcccaggctggggtgcaatggcgtgatcttggctcactgcaacctttgcctctcaggttcaagagattctcctgccccagcctccctagtagctgggattacaggtgtgcaccaccacacccatctactttttgtatttttagtagagaaagagtttcaccatgttggccaggctggtctcaaattcctgaccacaggtgatctgccagccttggcctctcaaagtgctgggattacaggcatgagccacagcacctggcctagattttatttattaatatatctttttttaaagagaatttttaggcttacagaaacattgagcagatagtgcagagttcccataaacctctgtactactttccgctcaccaccctaccagtttcccctgttattaacatcttgcctcagtgtggttcatttgctacctctggtgaacctacactgatacattattatttactgaagcccatagtttatactaggcttcactcttagtgttgtatgttctatggattttgacaaataaataatattatgtatccacagttacaatatcttacagaatactttcactaccctaaacatcccttgtgtcccacctattcatctcactctccctccccctgaaaacctcccctcccctggcaattacttatttatttatttattttttaccgcctttacagttttgcttttcccagaatgttatataattggagtcatacaacagatagccctcttagaatggatgctttcccttagaaatatacatttaaggtttcatccatgtcttttcctagcttgacagctcatttctttttagtgcgaatagatgtgccatggtttgtttatccgtccgcctactgaagggcatcttcctgtttctggcaattagaaatgaagctgtgataaacgatggtgtgcaggagccctactgatatggtggtaatatgttggggggaagggaaactttctattatcctgtgactggatgtcagtcattgagagtctgtgctgctgaggtgtgacattcaggggtgcttctcaactttccctttcccgtttggagaaacaagaaggctagaggaggctggagctatttcccttaccccacatagacagccacagggagctggtgttggggacatcccttcccacaggcccatcaggatctgataaaacccccagttatgccccagtagaagaggttcctttgggggcaggcctttgttaaggggaagagatcaccctgaacatatttcaaaatgattgctcctctccccttgctggaaacaagaggagattttctctaattttcactctgagatctgggtggggctcctggacgtaaaacttatgaaagtgtggggctcccctaagaatgggctgctaggactttttagtccatagcttggtctccagcaatgagtcaattattgtttaggtgttcctaccacagctggggcttctgctcctgtaagctctcattctgtgcatctacctttctctcagtttttggggtagtagcatggcctgtgacctttctctgattgatcaaagaagagttgttgattttcagtttgttcagtattttccttgtgaggctggaagtgatggcaagctctttacaagtggaagttggaagttgtcaattgcttttgaacaatgatgcaaagccagtccatccagtgaagaatggatggtctttaaacaaatggtgctggaacaatgggacacacatattaaaaaaaaaataaagaaagaactttgatccgtaccttgtaccacatgcaaaattaactcaaaatggatcaaattgatcctagaaccaagcataaagcccaacaccataaaacatctaggaaaaaagttaggagacagatctttacaaacttaggttaggcacagattttttagatacaacatcaaaagcatgatccaggaaataaaaatcattaagttggacttcatcaaaattaagaatgccaccatcagggaaaaaatacttgcaaattacacaaaagatttgtatcctaaatataaaatctctataataaggaaacagacaatccaattgaaaaatgggcaaaagatttgaacagatgttttaccaaagagatacacagatggcaaataaacatatgaaaagatgtttgacatcatttttattagagaaatgaaaatacaaattaaaaccataacgagatacaactataaccctattagaatgtctgactttaaaatctctgacccctacccagtgtatataaggatgtggaggaactatttcccacacagtattggtgaaaatgtaaaatatgcagcccctttggaaacagtttggcagtttcttcaaaagtgaaacatggccaggcgcggtggctcatgcctgtaatcccagcactttgggaggccgaggcggttggatcacctgagatcagcagtttgagaccagcctggccaacatggtgagaccccgtctctactaaaaatacaaaaattagccgggtgtggtggcatgtgcctgtaatcccagctactcgggaggctgaggtaggagaatcgcttgaacccaggacgcagagaggttgcagtgagccaggatcgcgccattgcactccagcctgggcaacaagcgacattccgtctcggggacaaaaaaccaaacaccgcatgttctcactcataggcgggaattgaacaatgagatcacatggacacaggaaggggaacatcacacaccggggcctgttgtggggtgggggaaggggggagggatagcattaggagatatacctaatgttaaatgacgagttaatgggtgcagcacaccagcatggcacatgtatacatatgtaacaaacctgcacgttgtgcgcaggtaccctgaaacttaaagtataattaaaaaaaaagaaaaaattgaaacatacgggtatcatatgacacagtcatggctatctaatgatatctcattatagcttaaatttatagtcgtttgtgaagtgaaaaaaaaatttaactactggaaggaaaaaatgaaagaaaggagtaacagatattcattcacacatcagggccggtcgcggggtgcggggcagggggagggacagcattaggagaaatacctaatgtaaatgactagttgatgtgtgcagcaaaccaacatggcacatgtatacctatgtaacaaacctgcacgttgtgtccagttaccctagaacttaaagtataataaaaataaattaaaaaaaatcatttggccatcctcttcccctaagttgaggaaggatcttgtaaaagtcctccaaggataagttgaaaggatgttctatgggatagagcctaaagaatatttgcctgctaggttgtgttttaacaatgcaattgcaatgtatacagaagtctaaaaagtaaaccctgcttttaaagatcattgatatgtatataaatcattttctaaaataaatggggacttgaactttcctacctgcaatctccattccaagatatggttagaacagcattgtccaaagtgtattctccacaattcttctgctcataggtgttattaaaaaaaggtgaaatctagtaaaactggctcgatgagaagtttgaatataaataatcatgagaaaacctaggggaagcacgtattatgcaagaaaatatacatattctaaccatgggctctctctgtttttagaggcattttctcagactagtgttccatgaaataatctttagcgatgccaacctcaatgcaatttgtattctgcaaatgcaatttaaaactgagaccagaaatcaatcagacgtcagggaatggttaagcagggttctctactcaggataataatgataaaaatgcttaccttttcatgttatttcttaactttattaatcagctagaagagcaggggtcttgggtgttttgtcagcagtcagggtcaggcatggaaacctctctatgtgatctgagagggggtgtcttggagagaagccaagtgagaaagccaggtagcctgcccatgagaaagcctcaggcagagaggaaggagctgaatgtgtgtgcccgtgggaggaaactgcatttctcaacatttttcaaagatgctattgcctttctactattggacttagaaattgcaattgttctacatcagtaggagcaaaggtgagaggaaaaacttagaggagctcccttggtcaatgagtgcagaggtttgcagctctttatggagacgagagtaggggcaactatgaaaggtggccctatatgaacatgccctttccttcactttgtaccccttttcctgagtggaggaggctgtgctctccctggacttacccaaaagaaggccttgcttggctctgagtttctacttctcaagtagaaagcagagtctgttctgtttctggccactgttctctcaataaaccatatgctatggtttgatgggattttgcaggggtccagcatttctttccctgtagattttttttttttttttttttttgagacggaatctcactccgtcacccaggctggagtgcagtggcgtgatctcggctcactgcagcctctgtctcccgggttcaagccattcttctgcgtcagcctcctgagtagctgggattataggtgcgtgccaacatgcccagctaatttttgtattttgagtagagatggggttttgccatgttggccaggctggtctctaactcctgagctcaagtgatcccgtctcggcctcccaaagtgctgggattacaggcgtgagccacctcccccagccctttgagtagattctaatagcccatcctctaatgcttaggctatcaaatcgacaagacaagatgcaagaactctacctcattgcttacataggaggatttttgatttggtccacagcacacactgtgtttgctggttaagtccgtctcaaaacaggttttttttccacctatggcgtcaggtagggatatcatccaattagatcccaagccctcaggacaggggctcttcaaagttgccattcagtaagttctggaagatagctgagatgtcacatgggccaaatggctttcttgtgcattcaaaatgagttgagcacatttagaagcccatcctccactcatcatttttctagagacaaagttgtgggtgcctctgagcatgaatttcataaaggctcatcctgcacagagctggttcaagagattgtaggaagaggtggtggtaaagaatgatgactatcttgagatctgaatatgcctggaagaggcaacttcttttgtccctccaacttaaaaaaaattacgaagttcactggggcttatacagggagaaggaggatctgcggaggtccccgctccagtgtgattttaatatattggtgtaggtgcagagcttgtggaatgcgtcaatctcacagccatacacatcatgtgaggatatgtagttcttcctcctcttcctgtccctcctcgtcttccttttcctccccctcctcctcctcctcttccttttcctctttttctttctctttctcttcttcctcctccttcttcatctgaaactattcttataggcaatctgatggtagacatctcatgggaaacagtggacagtgttattaaagagacttatgggtcatagccatctgtgtgattagggataccatggctggcgaataatggctaatggaagcttctccagccctcaccttgtggcttgaagcagattcttcctcaacagtgggtataaatgcctagtttattttctggagtccccttggactgggtgggtggggatccagccaagctaaatcaggactggaactatgacttctttaagttttactacactgatatagagtcagaaactaatgatcctgaccttctctgggatgcagaaaacccttcctgtggccaacaaattaggtacaatgcaggcaggagcagcttccctggcaattgggttgtatctcattggatatggcaactttggatagagtggcctattattattctgtgggacaggcacaactgggcatctgtgggtaatgaaggagggtgccagccgtaggagatcccttgtctccctggtctggagggctgcgggactgtagagggcatgagctcaggagctcaggccagctcatggtgcaaggcctctggaagccttctcaaaatggtatctgatttaattaagactctggctgagaatccagagtgccagggcttggtgggccacacatcctctcttgcagcctgtgtgtggcttttctggccacctccaggctgtcagggagtgctgttagacttttagccgcagcctgccatctggaggaaaggaattggccacttttctgcatttcctgccataaatgggaaaaagtatgacagaattttgaggttttttttctaccctcatggggtagaatgttttaattttgaatacttgcacctcattctacaaagaatctgaggtggcttatacaaatgcacacaatacaaatgagtggaaataaataattgaatgagtcagagtgatgggaaatacagtgagtaaaaggaagccaagggtaatttattaccccaaaatgcacactccatggtccttggtgtgtcctgtggttgggccatatatttccacctagggaggaagttaaagtcctaaaattttggtaaaagcaattttaacaaaagagtaaactcatgcagtccttaaatccagaagtctgtcttaattaggatgaaaaaaattgtaactctaagtgcgatttttttcattttttgtattaattttagtatgctatttgagactatttataatatgtgtaagttacaaaatatagtatgatgaacatttctgaacccagcagtcaagcaaaggacaagtccattcccagtaactcgtatccaccctcacttctgctcctaacctccttctgtgtcctgcttttcttttccgcacagagagaaccactatcctgaattttagaattattcttttgattttttgttttgttttatcccaaatgcatgcatatgtaaataatattttgcccagttttgcttatttttaggtttattaaaataatatctattaggttgatgcaaacgtaatgaggtttttgcaattacgttcgcaccaactgaataaatcaaagtcttctgggttctttccttttccattcaacatcatgtttctaagattccttaatgttctcacacatgtgtgcaattcatttttttctactgctttattatgatacttttcatggatacattgccccttatccattctctgctgttgactctttaggttgcctttagtattgtactattatgaacaaaggtcctgaagtcacttttgaatatgtctcctggtgcacatattcaagagtttctctagggtggatacctaggagtagaattatgtggtatgcttcacaagataatgctgaaatgttttccaaagcaattatacaatctcaccagtaaagtataaaccttttcaaatccttatttgacattgtcagatattaatttttgtcaatctagtggcataaaaactatctcattgtggaaatgcaattgcgtacccttgactagtagggcagtgaagaatcttttcatgcttttttttatggttttcttcttgtgtgaaatattttaaaaatgtattttgcacattttattgggtttattgtcattttcttattgattcatgacaatcttttagatatcttctcttaggccaacgtttcattctgtatctcaggcaggccattttatttattgtaatggcttgaatttctttctgtgtattgattactcacaaatctaagtattcagcccaagatgttcttctgagcatcacacacatgaatccaaccagacactcaacacctttatgtgaatgtctcacaagattgtgaggctcaatatgtccaaaattgagttcagcatctttccacccaggctgaattcctccattttgtcttctatcttagaggaatcaccaccaaaaactcaggtatccaagctacaaacttaagtgtggtttttgactctagcttctcctttatatgtgatgtccaatcaataaccaggttctatggatagtaatttctaaatgtcccttgagtctattcttgtctctgaatccccaatgctgttcctttattcaataatcacaggcaccccaaattgcttcaggaccctcctagttggacttctggtctgcagtcagcatactggagccgtggagatagctttttaaaacatgccatgtggtcaagtcactcccttgtttaaaacattttaatggttccccagggggtggaggctgcagtgagttgagatcacgccactgcactctagcttgggtgacagagcaagactccatctcaaaaaaaaaaagttttagtggttcctattacttaccaaggtccaaacacatcatggcttaaaagacccttcatagtctgaccccaggtcatctctcattcctcatccactgtcatgtcctctgcgtgctttgtgcaccagtcggacccagatgtggcagaagctgcagatatggcagaagctgcagatatggcagaagctgtcctacctgaaaagattaataaagaaatgtcaagtaaaaaaaccacataccacctgttctcacttttaagggagcactaagcattaggtacagtggaaatcaagacgggaacaatagacaccggggagtccaaaagaagggagggagaggggcaggagttgaaaaactacctgctgtgcactgtgctcccaaacctcggcctcacacaatctatccacataacacacctgaatctaaaactaaaaaaataaaatttggttgggtgcgatggctcacacctataatctcagcactttgggaggccaaggtgggtggatcccctgaggtcaggagctcgagaccagcctgatcaacgtggggaaaccccgtctctactaaaaatacaaaagttagccaggtgtggtggtgcgtgtctgtaatcccggctactccggaggctgaggcaggagaatcacttgagcccgggaggctgaggttgcagtgagccgagatcgcaccactgcactccagcctgggtgacagagccagactccgtctcaaaaaatacaatacaataaaataaagaattgttaaaatggtaaaagtcatgttatgtatattttgccacagtaaaataaaaatggatcaaaaacaaacttgggtaaaacagggaatcatacaaaaatgacatatacatgtgatatgtattttatttcaactcaaaacacagaaatccatatttactcagcaatgtcttgaaacagggccaagacttcttcttagaatgtaacttgattggtgtttggaatcatcttttttgcataaaccacaccaataattgattatttatggtttctaattacaaatgaatcaagacttaagaacacttatgaagcaatgtaagtacataattcttctacattttaaaaacgtttccccccaaaactattagagttgttttttccatatctagtttgatagcattttctttttaggacttagactcatgaagtctcttcaaagcattctacctaggataaaaatagcaactttcttttgtaatcatgtttcatgagtttatataatacctgcttaagtcctataattaaaataacattaagtctggcataaacagttttgggaacaaatacagctgacccttgctaagcatataactcatccgctggagtggaagtacacaggctcaccggcctcgcacgctcctgtgctgtgtgtgcactcgtcagtattttttttttttttaagacagagtcttgctctgttgcccaggctggagtgcagtggagcaatcttggctcactgcaacccccacctctcaggtacaagagattctcctgcctcagcctccggagtagctgggattacaggtgcccaccaccacacctggctaattttttgtatttttagtagagatggggtttcaccatgttgaccaggctggtctcaaactgccgacctcaagtgatccacccgtgtcggcctcccaagtgctgggattacatgtgtgagccactgtaccggccttttttgaaaatgagttaatataagggaagggtagttgagagaatgtctgctctatttgcagttctttaaatgttcatctccatgtttggcttatgtaggtccttctgctcgagaacctctttcctaattatgtttcctgctcattcttcttcatgtctcagtgcactcatcactccatctgataagccttctctgaggctccgggactcagatgcctcgctttgtgctactgtgtgtttctgtcactctctaggttttcccaacattttggggcagatgatgctttttggttgggtctgttctgcgccttgtaagttgtttagaagctggtctccccaagatgccactagcacccttcccccagttgcaacactcaaaaatgtcttcagatattatcaatgtccccttaaggaacaagatagccctggttgagaatgaccgctgtagatgacagatgttcattgaatgactgaaggaccttagttctgggattgctgcagaactgatcagcaacaaagcagcatataaattcaggaaagtgctcacgtcctttttagaacagtatctccatcctgtaaaatatatttcagtggatttttattttggctcagtgctaataatctaggaagctgtttttactgcctacaggagaagagagttagtggtattttatataacttactctgtctccccttcacctccatttgccatctgccaaaatctttggccctcagagtgggaaaaatacactctaccagccaactgagatctaccaagtgcatcatggccaagtaaatattgaactccctgctcctgacgtttttgtgagaattggtttatataaggggcagagctgtggagtgaggagggatgggtttgaagtgcaattagactagcatcccttcctatttaacagtctttctgtaccccatgaaagtaaactcaccaaacttctaggtgggaaccactttccatgtctctgctatctatgggaactttacttatttgtttaataaatatttttgggcacctaatatgtgtcagacactggcttaaatactggtcaatatgcatatgttcacgtgatttgccaaaaaatcagtttcatttatacggttcttggccccaccttgagctccatgctgggctgaatcctccctgtcatccagtttatggctcccacaatttgagaaaaggttgggaggtgattcagagacaaagaagtggttaaaaggctggctgtgtctgttgaggaattacagagaacacccactggggctgtcttctgagggagaatcagcatgaggtgcatgtctcatctagaaaaagggtctcatacagattttcagagcttggttctccaagtccacgcggcatagagaagtgtcaggcgtgagggaaacaggtgagacgtggcagagcacttcctgacatacctgctgtctcccaccgagtgaggggtggttcccggacccaccctgtgaccgggcactggctgccttgccatgtgtgtgctggcaccttgggcttcagggcctggggaattgtcatggcaaatccctacctgataaaactgctggggggaaaacaggctttgatgcacattcccaggactcactgctgaggattgtgattttttcctgtgagctgttggcagaagcaggctctatgactaacctcagaagggcaagggagctttctgttaactgatcgcctgcagaggatcagagaggaattcctgctggactccctgctctggtccaccctggcctcgttttccatctctggatccttccagccgtgcaaacatacacagtgttgccatggcgactctgggacagacacatgcatgagagaaaagcgtgaggcaaaatctctcctctgatgatttgctgggagggaaggaggccttgaacaggtttcaaaagcaccttgtttcaccccctgattttcacatgagagcggctaccccagccataaacacagtggcctcttttcttctgctttgcttgctgaggcgactgcagctctgggagacctgaagaggctccaggatgaaagagcctcccacccttaaacccacccatagaatgggttgccagtcatcaggtggggacaccattggatggtggatgatcagggctgtccctggttattaaactcattatgctttcaccaggacccctcacttgtccttgtgagtttctgacatggtcctcctctgtctcttcctcgccagcttggctgccacccctcgggctggggtcactggggcatggcccaccagcggcctctccattctggcccagctccagccgtcctgtgagctcaggtggactcagctttccaggtcatcttggagggatctggtcatgaccacatcactctggagtctggcttatttccagcatttttcccaggtgaaatcaggcttaaatgaatattatgcagtgacaggaaaaacagctgctgcctgaagaacacacacagcagaagagaaatgatggtggcgatggaggtggggtagatgttcagtgggaggccctggaggcgggggtggggttgggggaacaagggtagggtttgtcagcccccaccatgctgggtgtgtcccaaatgcctgttctgactacttggtaatgttttttgggtgctgtgctgagaaagcctgcgaggctgcatgaggttccgcagtagagagccctggtgctccatgaccaatgcctgtgactggtgcagcaagagggacgttcctctgctgaaatgaatgagtgcatcttccctgaaggtgggtgtggagaaagtccatcaccagggtcctgtttggaggagaagcagcagatctgaatgaatcaactttcatcaagtcaccccatggttctaggagagccagtccactttgtcatcaagctccaaattccctggctggcactttcggcctctgctttgacctggctcagagaaatttcagctcctgttctcagcatgcccctcctgctgtggtagggcatgttgccttcttggtccttgaaggtagcacccaacacctgtttccatgctctagtccaaggcctgctctccttcctctggcttcctgacatcccttgcattgaaggccaagttcaggaccatgtcctccacacaccttgtggacagctccacccgtggtggtctctcctcttctgcccttttctctgtagtctgtgcattccagatcagcacatgagctctctcccctggcctcctttgtgttaggcacagatgggaatccagggcagagatgatgttctgcccttactaccttgcagcagacaggatcagacttgtgggacctgcttggttacctaccacctgctgagattctattttcttttataattttatattgtacatgtagcacactcttggttgcttacccagtgtgcgttcctcttctctgccttggtcacagaacccaattttatttcagttagtgtgatgccccgttaaaaggtatcctttccattttattataaagctaagagttaacattgaaatgtgagcaaacatggacagagatggatgtgttacacatgttttctcccaatgtgtagcttgtcttattttcttaacaatgttttccaaagactaaaagcctttcattttgatgaagtccaatttatcgcttttctcttttctaagtcatgttttctgtgtcatatctaagaagactctgtctgacccatagtcacaaagattttcttctagggtttttgtagttttagcacttagttgtaggcctatgatccattttaagttaatgtttagatatggtgtgtggtaagcatcaaggttcaattctttttcttaatgtattattgttattatttttgagacagagtatggctttattgcccaggctggagtgcagtggtgcaatcacagctcaccgcagcctcaacctcccattgtatttttgtttttgcagttgttccagcacgatgtattaaaataacccggagtttaacctagcattagagacctctgtggatttgcttagggagctccagaacagttgaagtggcatggaactttttgtgtgtatgtgctcgtgtgatttggggatggaaggatggtggaagtggagatgactcacagctttcaccagattctggaagatgccctgtctcccagaagcttaaacatctccactgtaatgtaacaaggcctttttcttcacctcactgaacaaagggagctacagaggggagaaagggatgtcaaagactgcgtgtgagctgcttttgagttcctgggaagaaaacaatatgaactttggggagtaagcctgtacaaacatacacaaattattcttaataatagcattaaagccaaggcagtaaaactttgttaaatctgatactaggcatctttcacacagcacataattcaaagcaactccatggctgttttaagttcattcttctgggctgctgtgttttaaatagatgaaccttactgagcaagagagtttaaaacctaagttgaaaatgaaattttaattaaggggattttgtgactatggctagaatgagtactctgcattcaggatcttatagtccccaaatgtcaactaggtctaatcaccagagatcactggccccctcactctactggattggtcacaaggctctgaaaacatgagctgcttaactcccagagctgcaaaatgtcggtttccctgggctagagcagcagcagccacttccccacgagggtgaggaaattcaatatcttcctgatgggagacagagccagactcccaccggctgttctttcactctagcagctgcttgccccacattttccacgtttctggtcaggccgcccatcagccgacccttccaagtcaccgcttcctgagagccctccagtgtgactcagaccaatcccatggggctcccttgagccgtggaaggcgcagaaccagagagctggaaggaatattggacacgagctgctctgagccctttcatttccagagaagaaaattgaagcccagagaaataaggccagttgcctgaggtcacacagttagaggtagaactgaaactagatgctgggttatcctgacgtgaggccaacattctttttatgatagtcggagtagaaaaatggaaaaaagcacaaacttagggctcagacatacctaggtttggattctgactttttgttcacaatctgtggaactctgtgaaaggcactttacctttctaagctttagtgccctcactggaaaacagagataaatatgcggcaaatattaagttccttttctggactggcacatgctatttttggttctgagtacatagctgggaatgaaacaaaccaagccccttggcccaaggcatagaacttacatcccagtgtgtgaaggataatatcagtgcttctgaggttattgtaaggattcaaagagacaaaaaatgtgaatgtaagcccagttcctggcagagtagatatctaataaatggtaacagcaattacaattattactttatgttccaaatgtcagtctccacaaagaaggccaactcctggggtataagggttccgtctcagtttccttaccagtaccccagtatataggacccccaggaagccctgacaatctttggtgctcagagtcctgccctaacctactgtcaaacccttagttcttgcttctgaattcatccgacaacctattgactgatctgtatgctacctttatttctctgctgggactcctttggagagcctgaaaggtggtcttgctgggattggagaccccctgtcagcccactttgtcctgcagctcggatcatcccagtggcctgcttagctcctttgtgctcccctggcttctgagccacagccattagatactggctctggcctgccatttggctcctgacccctcatgtggggttggttttctctctcctgcccagccccagccctgcctggcccctcttgagctgccaatgattcaattcctcttaatagtccagcaaaagcccttagagctggaagcagttataccctgccttggtctcaaccatggcgaagcccatggtccattctgaagtaacaagactcacacgtagggagagaagcccttgacttcaaggaaccacccactctgtactcttcccaccctcccctcacatatgaagcagggtgagccatgacttgggttgatgggtgtcatggcagcttttagaaaggagaggaaatgggaatttgaatgacccatgtacacatagcggaatgctgcaatcacatgcctttcctctcactgccaaatctcagtggtgttcttacaaatttttcctaatatattcctaatatatccccattcaactcccaggctctccaaagcagaggatattgggactggaaaatgagcaatatatgtttaagggagtatgtttctgtataagaagccgatttctgaatagttcatccctcctcgtcttctctttagtaaagataactgagactcaggtaatgatggccaagaattatgaagcactcagagatcctgttctaagtagtttacatctattaatttatgtaagcctcaaaacaaccctatgaggtaggcactatcaacattcactttatttcagaggaagaaaccaaagcaccaagagcttaagtaattcgtcttaggacacagagtagggataacaatgctggcaacctggctcctgagccattatgcagtaccacctatgatctactttctgtttagtagcccaaacaagagaaatgtcttttatcttatctcaggcaagagcagtaatttaacacgagtatgcattccagccacattttgttgtcagaaaccgttaccaggggcagcaatggaatgtgaggcatgatggtatgtgccaggctgtggtttctctccctgttgcatcaggacacctcctttctctcttcccttggaaagttaggcagcagcctgctgtctctcctcagtggcagcctctgtgcatccagctggggaggccctctctttgctcagattgtctcttttcaaaagaacttggttcccagaagatttgtaaatcaaggtgtacttgaaggggaagcaatcattctgattggtaaatcggggatcaggaactgagcaagcgcagctcagcccctcccctctcttcatgctccttgtatctacctgaggcactaacattctgctctgcttctgcagcagagattttagagggtaggttctgcttttgctgatgggctggaactgctatggctgagtggttaagtctgttgaatttcagaacttggtgttaggaagcctgttattgctgcaaatttaggttacgttttcgaacagttttgtcagtaattaagttgatatttggatcttccagtctcagttggttctaaacacagacaaagaaaagagcaggtaattattgttcacccctcattcctaaccatttcctttcctatcactgcagttggctgaattggtcaagagatatagttcaaaaatacataggtacatttacacaaatatatgtagagagctaaaaaccaataatcacaagtatttcaaggaaggttgcatgtggtggtttcattacttctatcagctgagtctactgtgtttgaaagctaaaatctgagaaggctgagtgttccaaagtaaattatctattgtctgtggggctaagttgtcttttaaagctgtcttttcaagtaggcagaatggattgcagaaataggaaaagagcagtggtagtgccaaaagaatgctggtcttgggtcaaaaacaaatataagctttgattagcctagatttggtgaccccataacttagcacacaggaaataattaattagaaagataaataggtatgtgtcatttaaaataatgtgttcactgccacaatttatataaaataaataccatgttcccaggtttctatttataacaggcattttcacattcaccacctcagttattatcatgaccaacattttgaggaagctgagaggcagagattgaggttaagggactcatatagaatcatatagcaagacaggagatctgaactcatgtttattcatagcagggtatatcgtctttccattatatgatgctatggacacaaaattgcattaagtgtggacatagtcactagttttaggaaacttaacacttgaactgaaaggataacaatacacccatgataagaaattaacaaccaaatatgttcaaagagctaaaggaaaacataaacaaaaaactaaagaaaatctggaaaacaatgcaaaactaaaatgagaagatggaaaatatataaaggaacaaaacagaaactctggagctaaaaatattgtaactgaagtaaaaattttaatagagggctttaatagcagatttgagcaggcagaaggaagactaagtggatgtgaagataggacaattggaatgatcaagtctaaggaacagaacaaaaaagaattttaaaaagtgaaaagagcctaagggtcctgtgcacaccatcaagtggaccaacatatgcactgcgcgagtcccagaaggagaaaagagagaaattaatagaaaggttatttgatgacacaatggctgaaaatttccccactttgatgaaagatatgaatctacaaatccaagaatctcaacaacttcaagtgcaataaactcaaagagaatcacactgacacgttatcatcaaactcttgaaagtgcaagacagagagaatcttgaaatcagcaagagattgtgattcatcattgtattagtccgttttcatgctgctgctaaggacatagctgagactgggcaatttacaaaagaaagaggtttattggacttacagctccatatggctggggaggcctcacaatcatggcagaaggcaaggaggaacaagtcacatcttacatggatggctgcaggcaaaaagagagcttgtgtagagaagctcctgtttttgaaaccatcagatgtcataagacccattcactctcatgaaaacagcacaggaaagacctgcccccaagattcaatcatctcccactgggtccctcccccaacacatgggaattattggaacttcaagatgagagttgggtggggacacagagccaagccatatcaatcatgcacatcaagtcctcaatagaattattagctaattttttattagataatttgaaggccagaaggcagtgaccttaaaatgctgaaggaaaaaacttgaaaaccaaaaattgtgtatctggcaaaactgtcctttaaaaataaaagggaaattaagacattctagtaaacaaaatctgaaggagctcatttaaactagcactgcccaacaagaaatgctaataggagttctttggaatgaaatgaaggaatgctaaatagcaactcaaagctgtatgaagaaataaagatatccagtaaaggtgaatatatgggcaaatataaaagctgatattatcatcattttgactgatatttttactttttattttctatagaatttaaaagacaaaggaataaaataattgtaaatttcttaattagacaatacataaagatgtaatatgtgacatcaataacataaaagaagagggcagagctacataagattagttttggtatgtgattaaggttaagctggtataaatctaaattaaattgcttcaactttaggatattatatatgactcccatggtaaccacaaaaaaatgtatctgtagactatacaaagaaggaaatgagaaaggactcaaaatgtgtcactacgaaatatcagctaaacccatacaaggcagtaatggaaaaaataaaagacagaaagcatttgcaaaatggcaagagtaagttctttctaatcagtaattactttaaatgtaaatagattaagttctccagtaaaaaggcacagatcagtagaatggactataaaaaaagattcaactatatgctatgcgcaagggattcactttagatctgaggagacaaataggttgaaagtgaaagaatggtaaaagatattctataccagtagtcaccaaaagagaactgggtggctgtattaattccaggcaaaacagacgttaaatcaaaaattgttccaaaggcaaaaaagtatgttgtatattgaaaaaagagtcaattatcagagaaacataacaattgtaaatatatatgcatcaagcatcagtgttccaaaatacatgaagcaaatattgacaaaattgaagggagagataaatagtgttactccaacaatagttggagacttcaatattccacttttaataatgggtagaacaatcagataatcagtaaggacatagaagacttgaacaacactataaaccaggtagacttcacagacatacatacaaagaatatcacccaacaatagcaaaatatacatttttctcaagtatacctgcaacattctccaggatagatcatatgttaggccccaaaataagtcaatacatttagaaagattcaaatcatacaaagcatcttttctgatcacaatgaaaactagaaacagaaggaaaactggaaaacagaaggaaatatgtgtggaaactaaacaacacacctttttttcttctaacccaagagttcatcacagctttattcacagtagccaaaaataggtaaaaatccaaataaattttcatcaacaggtgaattgcagtccatccatacaatggacttgttttggacaatgaaaaggatcaaatacagacagaaaacaacattgatgaatatgaaaaagatggcatgctgagtgaaaaaagccagacacacaaggctacctcctgggtaaatctatttacacgatgctcaatgacaggccaaactaatctatggtggagaaaatccagaacagtgggagccagtggcagtgaatgtggatataaatgagatggagcatgaaagatcctcccagatcaatgatggacacacttgttagctgtccatgagaggtacaattatgactgaaggatgttattgaatgcaaattattaaatagccattaataaccattcatcaatagtggcaaacactaaatacaagcaaataccaaatactagtaaactaagttcaggagcattttttaaacttttcttttaaacatgtacaccaaatcccagtgacacgcaatttacctatatagcaaaactgcacatgtaccactgtaccatgcagtttcattatataggtaaattgcatgtcacaggggtttggtgtacagattgttttgtcacccaggtaataaatacggtacccaatagaagtttttcaatcctcacccttctaccaccctctactctaaagtaggacctggtgtctgttgtttccttctttgtgcccatgtgtactcaatgtttagctcctacttatatgcgagaacatgcagtatttggttttctcttcgtatgttagttcacttagcataatggcctccagcttcatccatgctgctgcaaagggcagaatcttgttcttttttatggctacatagtattctatggtacatatgtaccatattttctttatccagtctactgttgagcatttaggtcgattccatgtctttgctattgtcaatagtgctacaataaacatacacatgcatgtgtctttatggtagaatgatttatattcctttgggcatatatccaataatgggattgctgggttgaacgacagttctgttttaagttctttgagaaattgccaaattgctttccacagtggctgaagtaatttacactctcaccagtagtgattaagccttcccttttctttgcaacctcaccagcatctgctattttttgactttttaataatagccattctgactgctgtgagatggtatctcattgtggttttgatttgcatttccgtaatgatcagtgatgagtgttttttcatatgctggttggctgcatgcatgtctttttttgaaaagtgtctgttcatgtcttttgcctactttttaatgaggttgtttgtcttttgcttgtgttacaaattttgtttaagttccttatagattctggatattagacctctgttggatgtataatttgtaaatattttctctcattctgtaggtcgtctgtttactctattgatagttacttctgctgtgcacagtctctttagtttaattaattcccgtttgtcaatttttgtttttgttgcagttgcttctgtcatcttaatcataaaatctttgccagggcctgtgtccagaatggtactttctaggttttcttctagggtttttatagttttaggttttacatataagtctttaatccatcttaagttgatttttgtatgtggtgtaaggaaggtgtccagtttcaatcttcagcatatggctagccagttatcccagcaccatttattgaatagggagttctttctccattgcttgtttttgtcaactttgttgatgatcagatggtggtacgcatgtggctttatttctggttctctattgtgttccattggtctatgtgtctgttttggtaccaatatcatgttgctttggttactatggccttgtagtatagtttgaagccaggtaatgtgatgcctccaactttgttatttttgtttagaatttctttggcttttcggctcttttttggttccatatgaattttaaaacaatagttttttttataattctgtgaagaatgtcattggtagtctgataggaataacactgaatctgtaaattgctttgggcagtatggcaattataacaatattgattcttccaatctatgagcatagaatgtttttccatttgtttgtgtcatctctgatttctttgagcaatggtttgtaattctcattacacagatttttcacctccctggttagccatatacctaagtattttaatcttttatggctattaagaatgggattgtgttcttgatttggttctcagcttggatgttgtttgtgcatagaaatgttgccgatttttatatattgattttgtatcctgaaattgctggagttgtttatcagatctaggagctttggacagagaccactgggttttttagttacggaatcatatcatctgcaaacagagatagtttgacttcctgtcttcctgtttggatgccttttatttcattctcttgccttattgctctggctgcccattcagtataatgttgactatggatttgtcatagatggcttttattattttgagatatgttccttcaatgcctagttttttgagggttttagcatgaaaggatgttgaattttatctgcatctattgaaatgatcatgtgctttttgtttttagttctgtttatgtgatgaatcacatttattgatttgcatatgttgaatcaaccttgcatcccagggataaagcccacttgatcacagtggattagctttttgatgtgctgctggatttggtttgctagtattttgttcaggttttttgtatctatgttcattaaggatgttggcctgaagttttccttttttgttttgtctctgcctagttttggtatcaaaatgatgctagcctcatagattgagttagggaggagtacttcgtcttcaattttttttggaaatagtttcagcaggaatggtatcagctattctttgtacatctggtataattcagctgtgaatctgtctggtcctgggctctttctggttgatagacattttattactattcaattttggaactcatgattggtctgttcagggtttcaatttcttcttggattaatcttgggaggttgtatgtttccaggaatttatccattgcttgtggattttccagtttgcatgcatagaggtgttcataatagtctctgagggattttttgtatttctgtgggttcagtggttatgctcgtttgtcatttctgattgcacttatttggatcttctctctttttctctttattagtctagctagtggtctatcaatcttatttattctttcaaaggacaaacccctgaatttgttgatcttttgtatggtttattgcatctcaggagcatagtaaaaggattatacaccttgatcaagtgggttttattcctacaatggaaggatgttccaatatctaaacatcaataaatgtaatataccacattaatagaatgaaaaaatacacataatcatcttaatgtagaagaataatttgacaaaattcagcacactgtcatgataaaaaagactaaaagctaggaatagaaggaaactattagtaaaagccatatatgaaaaacccataaataatgtcatactcaattgtgaaagactgtaagcttttcctctaggactgcaggaagaagacatggatgcctgcttttgttatttctattgaacatagtattagaagttctagataagcaattaggcaagaagaagaaataaaatgcattcagattggaaaaaaagaagtaacattatctctctttgcagctaatatgatcttatatgtagaaaaccctaaaaattccaaacacaaaacagagctaataaatgaattcattaaacttgcaggatacaaaaccaatgcataaaaatcaattccatttttatttactagcaatgaagaatccaaaaagaaacgaagaaaacaatttcatttctaatagtatcaaaaagaataaaatatttagggatacatttaaccaaggaggtaaaagacttgtatgatgaaaactataaatcattgctgaaagaaattaaagaagacataaacaagtgcaaagacatttcatgtccatgaatcggaagacttactattgttaagatgacaatacttcccaaagaaatctgcagatgtaatgtaattcttatcaaataccaatggcaggtttctaagaaatagaaaaacccatcctaaaattcacgtgtaatctcaagagactctgagtagctaaaatatttttgaaaaataagaacaaagttggatgagtcacactttctgatttcaaaacttatttcaaagtttcagaaatcaaaacagtatggaactggcaacagaacagacatacagatggatggaacagactagagagttcaggaattaatcttctcatatatggtcaattgattttcagtaagggtgctgagaacatttaataggggaaaggacagtctttttaacaaatggtgatgggaaaactgtatatgcacatataaaagaatacagttggaccctacctaacaccatatacaaaaattaactcaaaatacctaaagtaataaacatctaaatgtaagaactaaaactacagagctcttagaagaaaacataggacaaatcttcatgacactgcattaggcaatgatttattggatatgacatcaaagcataggtaacaaaagaaaaaaaatagatacattggacttcatcaaaactaaaaccccttgtgcaccaaaaggcactatcaagagagtgaaaaagcaacccacagaatgggagaaaatattcatgaattacatagctcatgagggattaatatctagaatatataaagagcccccacagcaacccaattcaaaaatgggcaaaatatctaaatacttagatatttctgcaaagaatatatataagtggccaataagcacatgaaaagatactcagcatcactagacattagcgaagtgtaaatagaaactgcagttagtccacttcatataggagaaatgttatttaaaaaaaggaaaaataacaaatattgttgaggatgtagagaaattggaaccattgcacattgctagcatgaatgttaactgtcacgtgtgctgtggaaaaccatttgttcctcagataatttaacataaaatcaccacatgatctagcaattccactcctagatgtatacccaaaattactaaaagcaggaattcaaacaaatgcttatacaccagttttcattataactttacccatagtaaccaaaaggtggacacaatccaaatgtctattaatgagatggatggataaacagtatctggtatatacatacgatggaatattattcagccttaataaaaaatgaaattcagccaagaagcaatgggtcataataactcattcaaattctttttttcttttcttttttttttttgtttgagacagagtcttactctgttatccaggctggagtgtagtggcatgatctcggctcacagcaacctctgcctcccaggttcaagcgattcttgtgcctcagcctcctaagtagctgggattacaggcatgcactaccactcctggataatttttttttttttttttttttttttttttgtagagactgggtttcagcatgttgcccaggctggtcttgaactcctgacctcaaatgatctgcctgtctcagcttcacgaagtgctgggaatacaggcatgagccaccactcccggcctcatccaaattctttttcctcattctcctctgtggtcaatagcatctagagtcttggcaagatggccagctgagctttgtggtccgtatgtgaaatcacatgtggattcatatgcataagccttagaaatagtatgctaagtgaaataagctagacacaaaaggacaaatactatatgattccacttatatgagtttctagaaaaggcaaatccatagagacagaaagtagaatagaggttactaggggctgggggcaagggttaaaaaaatattgggagttattgtttaatgaatatagggtttctgtttgaaatgataaaaagtttctggaaatagtggtgatgatttcacatcattttgggatgtccttaatgccactaaattgtaaaattgtacacttaaaagtagttataagggtaagtgttatgtttattttaccatagttaaaaatctcaaaaagattaactatcacttaaaagacaactataatgttatgagtaatattttaatttgtattttctgaaaaacaatggatcatccaaattctttcgcctgttctcctttatgatcagtagcatccgtggcctttgcaagatggccagctgagcgttgtgggacagtctgtcccatatgtggggcagttctgtcattccctcaactccccacctgccatatatgtgagtctagcatacagatatttgctttaaaacatacatatatatatttaggttttgcaaattgggatgtggacaaacagtacatatatataatgcagcagcaatttttaaaattactccctctgaaaagcaagttaaattgaggattcatcttataattagtgatatatgtaaattaaaaagatatacttgtgactccaaaatatgaatgatatgtgaaggtcataaaggactaacagaaaggaactaattaagaaaacaagtaaggaagacttcttggtgctaacttctggggctggctaggaagtggcacaaattagaagaaaggagtgtttgcctttcaaataaagagagtagattaagtagagagtatttctatacgtgtgtcaagaaataatgtcaatcagcactaagatctttatagatgttcatccataaccctcctaacaagagtataaggtggatattatcattaaccccactttacagatgaagaaattcatacacagaatgaataatccctacaaggtttcacagccagtaagtggcagagctgtgatttgaacccaggtagtctgtctagagttcaccctctgactactactagctctacctgctttgggtaggagtcattaaaatacaaacagaaaaagaaagagaaaggaaatatgtagttactggatgcttaaaactaccagcaaattatcattgaaattatgtacaagacactgactattcattgaccaagtccaacacattggcttcaaagacactactgcttggggatattgagacaagtgaatactaatataggaagtcagtgtcaatctgggaatgcattagaggtgttacatgtagaatttagcaaggagttagtctgagtatgccttattgtatctttggcaataagatgaaaagtttagagtgtagttaatgaatttataatggtcaaacaccacagccaagaagaataaaaattcctattaccatgagtaggctaattcttatgggtatattttgatcaatgaacagtggaagcactgttggacttcaggccagtagtaagtgaaggtgcctccctgtgtgtatgtgtggcggatctctccagatggaatgaatctcagtgtgttttgggtgtggggatatgagaacgtcttggatatgcaggagttattatgtagtcataggtgaattattaggtgcttactttcatgattttcactttcaaataagaaaattgaggcttagaaaaatgaagtaactctcccgcaactgccaccccagtacaggtctgtctgacttgaccccagtgctctgaactgaagttaaggcagtctgagtgcttagccagacatatttctggagcttttctccaaaaagcttggcaagttttgtgttgtgctttagtaagggaggtattctcttgttcttttatgtgctgattaatgctttagagtcattccaaagggaggcctccagggatataggacttcctgtgttacccacaagcttgatacgtatatcttatatgtcttcatataattagctgataaaaatgttgaataagagatggccagaactgagtagtatttcaaaataacctcaaaagactggaattaagggccaaaatcaataagatgaaattcaactggtaaaatgtcaagtcccgacttggtttaaagaaaaaatcagtttacataagtatcatgtggtaaagacctggtttgaaatttggttgactgcacacttaagataaacccacattgtgaaataatgaagaaaatagagcttgaattcttaggttgcattacaagcagtagtgacaagagcaggtgaaatggcagacccattgtacatggggctagtaccccatctaaaaattatattcgagtctatatagagagaggcattgccagccagattctggtcaaagggagagggatggtgactgttgaaaaaatcatgaaaaataaggaataattcgggaaacttgaggtagttatagaagggtctgaataagagaagccttgagggtagataaatcacatattttctcttggagctcaccagaaattctgaatatctccctagccagcaggcataggtgtggagaatcatgaggaaaagagaaaggaaatggtagaggaaaaggaaagggggctatctcagtccatctgtccctttctaaacccacacatcatgctgccatttaactatgtatgtcttggggcagtgaggccttcacatcctggagtcccagttggaaatggggctcaagctccttttgctttcagcttcccactcggtccatccaccgccagtattcttttgcctgccccaccctgaggccaagacttgggtaggcattggtctcctgacagaaagaacccatggagcaaactgtccagatgcctgtgtggtctgcgcattaaggtattttgtaattctctatgatccaagctgaccacatatggtttctgatacttacagggagtgttcagaatttagagagtatctttcttctttcaacaaagtctgttgtccagctgagaacccaagaaagttatctttgatgctcattgcatctttgttctagtagatagatacttgcctctcttcaaaagcaattggttctataggtgggaagcttaagagaacaatcatttaaggaaaataaaaaatgcattggtttaaatattattcctaaataataaaggtggtaggtaatgtaaggtggggaaagagagtggtcttggaactgaggaacactagaccaaagtgaagtgttgcaactgagctcacatcttagaatttttaataaagagttgataaattaatgaataagggacaagatttttctagaatcaatacatttgttccaaagatcagaaattttttatgtgggcccccagttaaagtcaaatgctggaaaacaggaagtacttgataaatgtctgttgcagacagaatatatttaagaacagaactatttaaaataatttcaacttttgttttagattcagagggtacatgtgcaggtttgttgcaaggggatattgcgtggcactgaggtctggggtacaaatgatcccatcacccaggtagtgagcacagtaaccaaaagtcactttctttttcttttttttttttttgtgacggagtcttgcccaggctggagtgcagtggcgcaatcttggctcactgcaaactccgcctcccgggttcacgccattctcctgtctcagcctcctcagtagctgggattacaggtgcccgccaacacacctggctaatttttttgtattttttagtagagacggggtttcaccgtgttagccaggatggtctcgatctcccgacttcatgatccgcccgcctcggcctcccaaagtgctgggattacaggcgtgagccactgcgcccggccccaaaagtcagtttcttaacccttgctccctctctctctccacctctagtggtctccagtgtctattgtttccctcttaatgtccatgtgtacccaatatttagctcccacttttaagtgagaagatgcggcatttggttttctgttcctgcgttaattgcttagaataatggcttccagctgcatccatgctgctgcacaggacatcatttcattctttttaatggctgtgtagtacactatggtgtatatgtaccacattttctttttccaatctactgttaatgggcccctaggttgattccacgtctttgctattgtgaacagcgctgccatgaatgtctgtagagctgaactattttgtgtagaagatatgcatactgggaattaaaagaatgcaaggaactgtgctgcagctgggaaagtctcactgcacttggataagggattatggtgaacattcctgaattaactgttaagaggtccatgtcctttatcatcaccaaactcacctttatttttgtgggatttacatggaaaaattagattagtcaagaggttgaattagccctcaccattagagattagacatgatcccccattacctataaactcacctgtatccattcctgtcttcattaactttctcccagccttggagagcaacgagtgctttcttaacctttttgtgctttccacacaccgttaggttaaaagactcgaatgtgtctataacaccagcaaataagtataggggaatgactttattagaaaagcaatgcctcggtgtgtataaaaaaaatctccaatgatcatctctccattgccttccattagcatgatgttactgtttgagtattcactgccctaactacattcttttacatactcttgcaaagctctagcacctttaaggaaatacatgatccttcttttgcgctaggttgacactatgcttggtctgtcacttcttatttacaggatgttggacagagttgctgatgtaaaaaccacagccttccaaaccttttcattcagcattgtgcctggcagatgttggcaactgtaatatgcataattgtatctcatacacagatcacagtctggtggcacactggtttgcaaggcggagacgaaccctccctccttcagtgcaggctaatgcatagattgtgtccttgcccagttccctcctgatttcttcgggacttcattttatcttgcttttctctccctttattttcaacccatacacctctcgctttggcttgagactcttaccttcaccctgtcctcactcagtcccagatacctgtgaatctcttttccttttactaatttgaagaaaggtcacggaccctcattctgcataacccattcattcttcaaaccactgcagcttggcttcgaggaacatctacggaaatttctgtcaatgctcaccttctaacttccaactctttccaggactctttttagtgtcaatttttactgaaatcctgctgcatttgctcatcctcatcactcctcctttgcaaaatttctattcccttgtcttttgttccatacctctgacatgccttctctttccctcatgcggttccttgcctttgcctgccccttaaatattgatgtgtcataggttctcattcatgaccagcttttcttcttatcctaaccctctccggggtgatttaatccacctacaaggttttaaccatcacttatatgtggatgatgatcaaatctaaatttccagcccacacatttcttctgagattcaaatccaacctgcctgaagtggatctcctcatcctctaaaatacacctgaaattctctatctcatttgatggcacaaccgtccgtatggtcaaccaagatagaaatcatatgtagttgttgactatttctactgtttttcttttctcagaagctcttgaacggtcttttcttgtctatccctacagccaaagttttatatcagatcctcattttttttctgcccagataatagaaacagcctcagaactgaccctgctgtgtccagatccattcccctgcagttcactttctgcagggcagtcagagtgacctttttaaacttaaacaaaggacgtcaccacccccagtgatttctcctttgactacaggctccatgcaggcccgcgtgtctctccatcaccttcctctccagtgtcacctcccatcacttctaggcagagccctttcactccagtaatgagcaatggtagtagagatgttcccctactcattctgctccgcaccctggagccccagcccctgtcttccctgtcgctcccaactctgacaaaagcttgcatgttcctccttcaggattccatacatactagatccaccagatacaattcacaccctctgcctgaccctgcttgcgtgtgttcaggggaccaggtattcttaagtgctcaaggaagatcatctgaagacatacatcactcattatactgattttgcaaacttatttttcctataacatttattatttttaaagtgattgaaatgctataacatactcagttcagaagacttggaagaataaacgtcactcaccatcctactagtcctagaaacttcattattaaaatatcaacagtggaaatattatttccatcacttttgtgtgtgtacgcatacacacagatttttaagtaatgtggtgtcattcaaaatatattgagcatttaacatgtgccaggaacaggccctaccctcattgaactatagtctagttggagagtcagacattaatcaaagagtcacacaaataaatgcaagttacaactttatttatatagttgagaaatgctaagaaggcgaggccatggagctctaaggacataagatgaagagaactgacctcgtaggagatgaggatgaatgagttcagatttaaaagaaactaggagttaactaactcaggagggttgtgtattgttgaatttctgcgttgaaagcttcttttcttcctttaggatttgcacttagcaataaattgcaaacattttcctggtaaaaattcttttgtgacatacacgtattttaggtataatattcaatcatatggatatattgaagtttaataaatcccctaacatcagatatttaaaagtttcctactttttattatgaattatgctgcaatgaatatttttgcacatatgtatgtctttatgtatgtctccaataatttcctaaggatatatttctacaagtgggagtgctatgtcaaagggtgtgcatattaaggtttttgcaattggctgccaaattgctctctggaaaggctccactggtctgcttttccttccatcagccacagccgggaatgcctgcttctcgccatggtcaccagcactgcgtccttgcttcctttggaatctttacagattttaattacccccaaaatcatatcttactgaagttttagttttcacgtctttgcttcccatcgaggctgagcttttaaataaatttttggcagtgcaaatttcttttgctagctgcctattttgtcaccatattattttcaaattgtcatttcagatcatcattttaaaattgcataagtgtttgtttctcaatagatcactgagggcagaggctctttttttgcccagtatattactttcggcatagtaagtattaataagagtatttttgaaggtgatttggtttctgtagcatcaccagttacctgagcagaacgagcgtgcggaatcagggtcgcttcagtctcgttatcccagacagttaccaagattagagaatcaatgccttctttctagatcacgtgattcaatcatatgtactatttttgcttctaacactgtataactccaagtacctaatcttaaagacattctaagtataagaaagaaccaagcttagtggtctacaatatctctttaatattgtcttctcctttaaacctctggctccctaaaggtggtaacaaagcctgtggttcagggcaccctggctcttcccagagaagggcaatgggaagatattgggtagctgatggctctcagctgtggacctgacatctctaggggctaggaataatcagtcttcaatgcccagaagagaacaaggatggctgaaaggatattaaagcagatgatgaaaggaatgacttaaagatctgtgggtgtttagctgataaaacaaatgatttcaggagtgagaaaatacaaaacttgtccttaaattcattttaattataacacaaatttgtcttacataaattggatataacactatggattaataaaggacatgatttactttgcacccgttactattgcttataagttggttcattcactcattcaacaactatctagtaagttcctaacaggagccagatactgtgggaggtgttacaaactggaaggagaacaagacagccattacccctgctctcacagagcttacagtggatcaggaacagaaactggctgtgctctgggaggacacaaagtgtcatgtgtaacacactgactttgtctgagtgccttcatttatggtaacagtggaagagaagggtctagaagaatttgtgaaaacactgtgttaatgacagtgctggtgccaataggaaccacagggaaagatcttttgataaaaggtaaatgcaaccagatgctggatttactcagtgacgtttaaattttaaaacagtccacttaaaactatgcatctttattgtcaaaatgtcttcatgaaacaaacaaaaaacccattttgttatcttgagtctaaagttctccatctttaatttttcccttccttttgaacacattatttgcgaaggcaggtgttcctggcatgctgctaatgaatgaagggacagactgcattggaactctatctcttgttctgcatgccaggtgggaggaaagaccgatgactgactgcaagctgcaggaaagtagtttttggttcaacattaaggtgaagaattttgtaatgaaggaaaaacagaaaggagttttttttttttttcagaatagtagtgagctgtctctctgataataatgacaatgctgcaacagcagtgactattttactgtacacttactacctcccatatgtgtgctcaaaggtttgcatgcattatttcatttgatcctctcaaaaatagctaagaggtattacaatccatttatatagacgacgaaaccaaggatgagcgcggctgaaatattggcccaaagtcatgaagttacaaagtgtcggcaccagggtttaggcatggaagcatctcctcccgaacccctgttctcaattactgagctagtctgtcaggttttcatcactggaggggttcaagcataaactggattattgcatgaatgaaacaataaagagagaattcaagcttcagatgaggatggaggtcacagggctagttaacagcaaagtcagtagttccaaacatttttagtaatggattttgttgagaatttgacaacaatctttgggctttctcaaaaaaaaaaaaaaaaaaaatacatgtgtgcacacgggtgctacccattacaatgtaaaagtttgaagatgctcatgaaccttttgataccatcttggggttctagattgaaagcccttgcttgaaagacacttttgctctgagattctatatgcagctacatgcttttggaggtgaatttccctccaagttatgactacaggtgttgagatggtgctatcaccttgtggcactatcagcaaaacaaaacactgagacatctcccttccagaagaaagagaagccttcattccacatttctctaagtaggctttgtgtgccactgaaaatctctcccttggctgttacaacttcaggtgcattcagaatgactcagaaatagggacccaaaccatatgtacagtctccattcatattattatttataaggcacaggagcctgtctctccccagcaaaccccattgccaataaagaagtgaagggagactggggaggaggggcaagatcatggagtgaaagtgtctgtgcaaggcaatatttttatatgttgtttatttctggttcctgcctggcctgacagcgcatgtgtttccaattgggaacgaacacgtaagctcagtatctagagagaggcttattgggtgaaagaccctcctctcctaccctgcattccactcccacctgcactcaagcacatgggaactctggtactgggagtttggaaaacatcccacagctggcctgggctccctcagtctggcaccatctcagaaacatgtatgtgtgtgtctgtgagtacatgtgcattgtatgggggttcacttaaaccttctcctttggacatttgggttgcagccgtttctgggagattatggatgcatgttagggccttctgggtctgctggggaaggccatggtgtttatcctctcctccagcctaccttctcttttaatgcattgttacatgcttaactgctttggcgctggtccttagagcagctctcagcacaggttcctgatgattcctgcagggaggctctgtggggaggtgggtttgccaaacaggagacaggaggccaagggttgtgcagaaaacaggtttttcctctggccctgcttctgctctgcttcgggccctcttatctctcatctagcctgtgggaatagcccccaactcctttctctgcctccactcttgctcccattcaattcatactgcaccccgctgccagagcaaccttttgtcaaaggcaaaagtttcattatatggcttaaaagcctccagtggcttcctggtatcttgttagaaacaataatcacgatatcttctaccagttttggagccctccctccgtgccaggtactcagcaaaggcacttgccatgcactccctctgataatctttccaacgaccctgccaggcacgatttattgttctccgcactttatggatgaggaagctgagattgcgagtatgtaactaacctgaccaaggtcacaaaactgggaaacaaagacgttgtataaggttgcggggcttacaccctgcccaagggcacccagcagcgggaggcctgaggagttaactccagccaggcctctgctggccaagccatatgcctcggagagaagccccttgtctaaattgtcctgttctcagggagcaacacgaattcttcagctcttgactttccgccacctgctgatgctgctctccaggctattccttttggtgctggtgtgacgtgagctgctagggatacagagatcatcaaatatggctgctaatctctgaaacttatagttttgcactgagggcagatggtcacagatagctctgggggcagatggtcatggatagctctgtttccataggttaagaataaccatgaactgtgaaaaatgcatgggagcgcagaggccagccatcttatccaccttggactgggagtagaagaagggtgagaggtccaggaaggcctcctggaggaagatgatacttgggcagtcttaataatgaggcctagttagtcagatgagagtagaggtaggcaagaagagggcatttgaggcagtaggaacaagagcaaagcaggaaggtgtaaacgacatggagtattcaaggctctgttttgaaaaacaaaaatcaaagccttggtaagtaaatttgcagtggaaagattttacatcttaaggcaaaacttggttggagacttagatcacagtaaagttatgaaaaccttctgtacaaaatttcaggcagggcacggtggctcacacctgtaatcccagcactttgggtgtccgaggcgggaggactgcttaagcccaggagttcaggaccagcctgggcaactagggagaccccatctctacaaaaaatttaaaaaaaagtagccaggcatggtggcaagcacctgtggtcccagctgctcaggaggttgaggtgggaagatcgcttgggcctaggaggttgaggctacagtgagctaggatcacaccaccgcactccagcctgggcgacaaagggagaccctgtttcaaaaataaaagattactgaaataaggactgtctgctaaaggccaatgacttttgatctgacttgggctattctgaatagcagtcaccatgctgtcagacttgagggtctccctttgttgtgggtctgatgggaggtggtgaggtcatgaggcttgtatgaaggcgatgcaccattcacaggccttcgttgcattttttcctccattctgatgtcttgtgcctttcggatttcacctcacctgccttcctcttgccagatcccagtgatacggagacttggatgattcagatggaaaaagcatgagttgccagcattaagctgcacgtgatttctgggcaggtatttcttaaaccggggctttatgtagccttcattttgctcactctgcacttggtgcaaaagcccatcctgcccgcctgactatcacacctgtccctgctccatttctgctccaggctaacatcccttcacttctttatccccagggcatcactatatgaagattcactctcattatgccttttcttttcccttctgttcttgccccacttaaaaaaaattaaccaaagtaatgcataaatgtaaagtgtcaaacagtgttacaagacttacgacaaaaaaaccattccatgttccaccttttctcttccctaagtcctacccctgagagggtgtcagttcaactctcagcttttttgcttggtgttgcttattatttcttgttttttcattttattttaaggtatcatccattggcctcctaccatgggagatgagaattttagttctcttacaatctgcccctgcaatatacacaggctttccctccctacattccataattatgtcacaaggttggttaaaccaatactaaatttttgtatgactatggtaatataaatattattaatacctgagtcataaaatttaattacatttcttgttttgtaatttttctggagttatttttctttattaactattccatgaatctatcaaagttttgcctcaaactcttacagacctcaaagtctgctctccacagggtcagaagcgccatgcaggtggttgactccctccttggtcccttgttgagccgtccctagtgcgtgcccttccttctcttgctgtgagctgcactgctggctccccacacctgctgcatctcctacaccgtccttctaggaattacctttgctgtcttctgctttcagccccttattcctgaatacttgctacatagagtgaatgtttgtgtctcccccaaactaatatgttgaaatgcatcctcatagtgataatatcaggagctgaggcctttgggaggtgatgaggtcatgaaggtggggccctcatgaatgggattagtgcttttataagaggaaccccagagagctccttcactctttctggcatgtgagaaagcactgtctaggaaccaagaagtgggctctcaccagacactgaatctgccagcaccttgattttggtcctccagctcccagaagtgtgagaaataaattactgttgtttataagccactcagtaggttattttgtcatagcagcctgaatgactgagacaatagtacctttctttctctcattttattctttccctccctgactcttttttggtgaagaagtagcttcttgagaaagggtagatgggagttaaattttcaaagaggtccttattgtattctcacactcgactgaaaattaggctggctttagaattttaggttggaaaaaaattccgcacttaattttgaagacattgttccattgttttttagcttctattgttgctcttgggaagttcgatgcaattctgattcctaagtcattccacgttaattttttttatctttctctggaagctttcaggaccatctcattatcctgtccgctgtaaaatttggtagctccatttctttatgtggatctttttcatccttcgtggcctcttgctttctagaaattcactttacttttagggaaaattcttgtattatttctttaattatttctttccttcaattttctatgttccctcttactgcaaattagatataatgttgtctagatttgccttctaatttctgacctttactgtttttcattctttaacttttggccctggacaattttcttcactttaccttccaatcccttaatggctttttggttttgtacttttaacttcttcagcactttcagtccccaggatctggcccttgttctctgaatctgtccttcttctaatcacatcctgttcttgggtcttctcaccagtatgaggatgttcagaaagtttacttctaaagttttttctgctccttctgaccctgttttgtgtgtgtgtgtgtttaatttttctgtttattttagtttctgtcctcatgctataggctttcataaaatatttagtgacctcaactggccacgattattttagagagacgcattgaaaaattcactggaagctctggtgtggggtctcagtttggtgactggggagtttcactgtaaaattcttttggtgggggaacaggaggtatctgcaactgattgtaggtcttttctttcagaccggtccatttacccagggaagagctcctggctagagaggtgcaggccaccttctcctggcctgagtgtttcggtgcggtgtgtgagctgggcggctcactctgagcctgtagactttctcttcattctgcgctttcactgagcatggtacccactgccctctgttatgcatggtatccccaagcccacaacctccctgttcccctatttcctgccggtattgggaagaaacagtcatctgatctgcagggtagggaaaaggctgggggaggcctctcactcctcctaatacagattctcaacacattcttgaactttattctccaccttcagttcaccaggcgctacccgtttttgaatccttttgaggttctgtgacccagatggccttgcttcttgtctcctgtgctgcagtttcacccctctggtaagtcagttcccattcattcatccattttctatcttccaaagtttggttgtgtctctagtctgttgccatcttctctcattctctttgtcttctcatgagttcaaaattcctacttccattttaataccatttcagaagagaatgtagattgatgattttcatgctgccatattgaactgaaagttattttatcttctttttttcttctgacttttagtccttctcctaaaagttacttacaacagcagtaacttccttttgaatacattggtactgaaaagcttgcatgcattgaataggtagaaaatagaaaattcatatattccagaattgagcgtgagagaaactggccaaggctttggtgtctgaaataaatccgaggcaatacaggttctcaactcccaaagaaggcagtgtggtctcttggagcgtgacactaggccggtggtcaagagacttgcgttcctgttccaattccaatcttcctactagttagctctgcaaccatgggcaggttagttctctctgggactccatttcctccagaggacaattcctcccagttcttgacttccatgcctgtgttcttaagttcttgagatttagcacttacctgaggaatatcagttgctgggatgaaatcatgtgtgaaggcaaacacctataaaaagggtccttgttccaatgtagtctgtaagttttattaattttcctctatgtagcctcaaataacattcttttaatttaaagaaaaatatcttttcctactgtctctgagtaattcctggctttgttttgaaattattgtgatctttgctaaaaataccatattgccgggtagtgggtgctgacacaggcagttctggccacccatttggatttgaccccttaagagaatccttccccagcacatgcctcagggccctctcatgtgctgatccccctctctggaacactcttccctaccctttgctttgagtaactcctacttaccctttagtcctcagcttcatatccacttctttggacaggccttccctgactctacagacccctttggcatatgttctcctacttccttatctcactgtttttttaatagctcatttcaccttttaaataaatagtgccacctggatgtagctgttgcctcaattcatggtaggcactctctctattttgcctcttatctgctgggtacaaagtttggcttctttacaagtttccataagaaattacccacaccgtggatgctagtagaatttactcaagatctggaggacgtgtctgtgtgttaaacgctggaggatgggccctcctgcccttcctcaacctccctgtctttcctccttcctctcttccctcatggatgccctcggcagctccacattctattctcctgcgcagcggctcccctttctttgcagctttggtgtcagctgacttctgggcagaagagtcttggtttccacacacataagaagacaacccttgaagatggaagggagcatggctggctggggggacacaaggccacactgtgtgcaagggcttgtcagattcttctgcaaggtggcacctttcaaaggcagctgtggcgaggaaaggaagctgcctgagagcacagcttggtgcctccatggctccgtgttcactcattcccaaggccggaggcctggagcccacagaagctgctgctcttggaaactctggtgagcagtgtccttggattcccaagctcttcaaatcccagggaatgaagattagaaaaggcacaaagatataggcagtgtctatcatgagataccaagctggtaggggaccacagaggagccactagggtggagacaggccccagaaattcagctcagctctctagtcccctactccaatctaccaggtcatgcgtgaagataatgtaaacataacaatggatgcttatgatgatgaaaataatatgatgtacagaatgtattttgtcacagaaatatttatcaagtactacagaaaatgtctgattctagccattttgtaggctcagacatgtgttagatattatctctctccccaagaaacttgagtctaccttgtgagagaagacacacatggaaagctagtcctgcaggtcagcacagggaagaggcagcacgaagcagtaaacctagcatggcatgcttggtttcaacctttttacttgccctatgatcttagctttgtctttaaagcaggaatgctaccattaccttatagtttattaaatattaaatgaagggtcaggtgcggtggctcacacctgtcatcccagcactttgggaggccgagacggtaggattgcttgagcccaacggttccagaccaagcctggacaacatggcaagaccaagtctctacaaaaaaaaaaatacgaaaattagctgggcatggtggtgcatgcctgtagtcccagttacttaggaggctgaggtgggaggatcacctgaccccaggaggttaaggttgcaatgagccatgattacgccactgcactccagcctgggcaatggagtgagaccctgtctcaaaaacaaaagaaaaaaaattaaatgaggaaaaaaccatgcaaaacacctatgtctgtatgacgcaagtattgagaccttaatggccattaaatctaattttaatacataactaataagtggttatgtttgtttcccagggctgccatgacaagcaccataaaccaggtggctcaagctatagatcttgttgcttcatagctctggaggctggaagtccaagtctcagtgtcagcagggtgggcttctaccaagggctgtgtggggaacctgctccaggtctctctcttagcttctggtggtttgctggcaatagtaggctctctgccttggcttctactgcatcaccctgatttccgcctgcatctttgcagggtgttctcctgtgtgtgtgtctctgtgtccaaatttcctacttttataagaacactagtagtggattagggacccactctactccagtgtgacctcactttgactttattaattacatctgcaatgaccctattttcaaataaggtcacatttagaggtactgaggttataattttgacatataaattttggaagacacaagtcaacccataacaatagtaaaagaataaaaatctagaaaaggtaggagagatggcaacagatccctagtacccagggcggtcagtggaacctcttagatcacctggggctgaatccaggacggggcagttggcagaaacttggtggtggtgggcatgggggcacagcgagaagaatgtgacaagcaaggacacaaaagcagaaatgtgcaggcatgtttgaagggcagtgaggaagccagccaggctggactagagagtatgggccagggaacactttggaagcctttgactcatgaaggaaggagtttgcacttcaggatcttggcacaaggcagacagtgaaggattatgatgcatagcactgagacaaataagcagttaagacccgaaggtgtaaatatttgctttagttattgaaaatgacactagagagccatattactagtgcattcactgtgagttactttacagtagtgagattggattgagtggacttgttctctatccaccctggttctctaggcatatatttgccctcttggctggttgaacgtagaggtacagtctgatcagatgagagcttatctgtgagccaagtgacctgatttatatggagatcagtccaaattaagagcacacacagtgttctcagagctgaagggaggataacaacagaggtctggctgtctgtgttcttcaggaagtgctggcaaggaatagggagctctaagagaggaataggtggtctgctgaatggagagatggtagaagacacaagtagcagtctccaaaaactcaggtttatagattactacagctcactgcgttcatccttgctccattaggatctcaacacctaggttatacaagaacaaatgtctcatggaaaagtaaaaatgtatccaaccaatcaattgtctggtctatgtgatgccaactaattcaagggaaactactgtttaacctcagtctctggttgcggtggcagtaagtcggcactgtcctgatgtctggcacatctgacacatcactcagcgtagcagcaacatctggctcctcgcaattcttgtgggcaattttgcagtcaccacagacagtgtagactcataattaacttgtcaacactccccaccaggaatttccactggtcctggagggcctagctcagggtgtgagccatagcacaggaagagtttctggtcctgactcctggaaccaagcctggcagttgtggtgggtgagtgtgctgggatcaagtctgcgtccactgcttttctgtatactttcaactctgcagagttctccttagaaggaatctattgttggttgtttaaaggctgctactatagacctattacagggagaacccatactcaaagccaatgaaagctgacaacactggtctaatgtgcaagtactttgattttgtatgtaactagcatgcttcactgcatgttgaaatacatgggtgctccccacctgggcttctttctctaaggtcgtccactcacttgagaattggatgccacatctgtctcctttttaccatgacctttggctctgactgtcccccagcattgagatgatgcgtggaaagcccacttattactcagcccttgatatacagcaagctccaaataaacggtagataaatacaacaattacagccacccccacagtgtgctaattgttgtatcagcaaaggctccaccagtctaggaattaccttctgtttgggtttcttatgaacagtcaagtccaaactgcagcactgactggaattatcagggaaggaagaggtgttggcttccctggtgtggccagcagtcatggaatcagctgtaagtagtgctccacgaagggagtcggtgccttccagatatggcagggattggtgatccctcttgttttctttatcagttctaagtcattcactagaaagcttgaagaaatccaaagctagaagattttatgggtagtagtagatagttgctagtttttcccatttgaaaaaatttagttagaggaataatcattcttcattttgtttatgacttagtgcctttggtgttgtgcagtgaaagacgggaaagacagaggacaccgttcctatgatcagaagtttaccatctagatggataaagaaggcattcatacataaacgcaatagctacaggaaaaggttttcaaaacttcccaggcactaccccaaaggattcacagatttagtgcaattcctctcaaaataccaatgatgttttccgcacaaatggaaaaatctaccctaaaattcataaggaatctcaagggaccccaaatagccaaaataatcttgaaaaataagaataaagttggaggacttattcttctgattttaaaactttctacaaagctataggaatcaaaacagattgaaagtggcacaaagatggacatctataccagtggaatagaatagagagctcagaaataaatttttgcatatatgatcaggtgacattaaacaagggtaccaaaaccatcaatgaggaaagaaaagtcttctcaacaaataatatcgggaacactggatacatgcaaaataattaagttggacccttacctaacaccatatacatgaattaattcaaaatagatcaaagacctaaatttaagagctaaaaatagaaaactcttagaagagaacataggggaaaggattcgtgacattggacatggcaatgatctttaaaggtatgaaactacaagcatagtcaacaaaagaaaaaaacaggtaagttggatttattaaaatcaataaattttgtgcatcaaagaacatgatcaacagcgtgaagagacactcttcccccatggaatagaggaaaataggcaaatcatatatctgataggagattaatatccataaaatattaaaaaaaaaactcttacaactcaatgacaaaaacaacccaattaaaaaacggacaaaggatttgagtagacgtttctccaaagattatacagatggctaataagcacatcaacagatgttcagcatcactcatcattagagaattgcaagtcaaaaccacaattacacaaagtcattagaatagctattatcaaaaataaaaacaaaacaaacaagtattagcaaggatatggagaaattagaacccttgtgcattgctgctcagaatgcaaaatggtgcagtgctatggaaaacagtatggcaggccctcaaaaaattaaacagaattatcctatgatccagcaaatctacttctgaacatacgcccaaaggattgaaagcaggaactccagcaggtatttgtacatcaatgttcatagcagtgttttattcacagtaggcaaaaggcagaaacaacccaaatgtccattgatggatgaatggataaacaaactgtggtgggcatatgcatggggtattactcagccttaaatgacaatgagattctgatacatgctacctcctggatgaacctaaagatactacgctaagtgaaataagccaggcacaattgaacaagcattacatgattccattatatgcggggctggaggaaaggaagagtggaaaactgttgtttaataggtatggagttcagtgtgggaggatgaaatggttctgcaggtggatggtggcgatgtttgctcaaccatgtatatatatttaatgccaccaatctgtacacttaaaatggttaaaaatgtcaaattttatgttacatttcttttaccacaatttaaaaaaatttcctgagaaatccaaatgacaaaagtgatcagcctggggaaaatgtaaatggatggctccctgggggagcagagtcttcagggaagtcatgaccgcagagggaagacctagggatgcttgtcaaaggctcacacacagctctgcatcagcttgtgtgtggacagcgtagggaggcctggtctggcaagggcagcaggtgttggggctctgggtgaatgacgctgggtgaacatggggtggtggcaaggagtctgcaggaagagaagggccggctggtggggctgggtcagagcccagacaggtcaatgggaagggctgtgtgctggaagagggactggtgctgctgtgttatcagaacaatctgggagagagacagcaagggaggaagtctgggtgaatggctaggacctgtggcagcagcccaggcctgaggtatcagggcagggggtggtaacagtggggacgggaggccctggcaagccttagcagtcaggcatgattcccatattgtcttcctggtcaccagtggatgcccggatcctgtgccttgggaaggtcagggttgaaacaccaccaccctcttctttttgcaacttttctgttcttcttgtgggctccttttgagttaggtgtgtacaaggaatagactttagggtttatctggggagtttcttcaagtggttctctcatatagtaaatgagaaagttgggttagatgacagctacagctctttcctgcttttaaacactgtgattcatttacttgattgataattgctcagttctttccatgtgccaggcactgcgtgagcccatagctcgtacaaccgtgaccaagagggcaagcatctgctctcatgtggctgcctctcctgcctttgtgccattcctgttaaatgaactcgtgtgtgccatggtgcccggctcatacctggagagagtagttgctacacatggtacctattgtgctcactgcttctcctggctctaggtcccacatcaactcatccttcatcacattgtcacttctcatgtgtgctgtttgcccacacacctttcctttctcttttcagttgttataatgctaagtccagattaccagcagacaccaccacagcatagccgtgagctcaccaggcttgaagcaggcctagcattgcttagcaactgtgaaaatagcttcagcaggccccacgggacgctcgagaacctcatctctggggtgtgtgggaacggaagagcttcagttgaaataaagatgcaaacaaaccgaattggtccccagacatcacgcttcacattgcctgacactcagcggaatgagatacttgtgtcccactctctcaagcaccaagtaagcagtcagggctggagaatctgcaagctgtctcttagggatacacacatagcttcacacacagacaaacaacgatgtgcaaatccagctgcacatgcatacccggttcgggctgacttcctattccatcagtctgcatggagtcaggttgctgtttgcatgtcagagcccatgggtcatcgtgagtgtttggattagtgaatgaggacaaaagtggcttctgtcagagatgttatgcaattacatgtgatggatgctcgcttccctccctggttcttctccactgcgcaaactttgtaataggtgggaaggttcaaaacccttaaaggccaaatgccacaccaagtggggaggtagggtgggtgttaaggaactaatttctctctctgcaccaactggtgcttctggtttgcttctggagatgccttaggtgctcagtccctgtaaaaggaatgattttaaggtgatggaaagagacgtttcagcaggagagctatgctgaggaattttctgctatatcaagagtagaaacagggctgagtgagtgattcggtgacctcatgagggttgccgccccctgaggcccccagctgtggaagatgatatgatcaggagaatggcacgttgcactgacttccgggtctatagaggtccagtctccacctctgattgttgatttgtcacagcagggaagagtgaggttggctgggctcacatcttgcagaatggcattgcaggccctgggtcaagtggcttgggactgaattttggttctaccacttagtggctgtgtggctaaggcaagccttcgtatgtaaaatgagactaatgatagctcacaggggaggcgagagacattttggggctgtatgcatatggttaaaagcccggactctagccagcaatgacttctgtcactataacttatacccaacatggtgtaagtttctcatgcccctggactctacagccagctcacctcgagtgcttctacctggccaggtgtcactggctctcctgttgctcgaccttgatggctttactgctgcttgatcacatcctgtctttgggcaggttctttaattccccctccttgctcctcttggcttccttcacacctccttgcctcaattctcttggcatcaagttacctctattttcctgagcttgtagttgactcctagctcattagaaaattatctatgtagaactctttaagataacttaatattgcaaggtttaaaaaaatattgacccaattcatatgagcttagacttagtgcttctacttctccaatcatttatcttagtcttgcggctggactagagccaggatgctttgcttccaatcttctgacattttcctcctatggaactgaggtgagaattagggtgaccctgaatgtgttgtgagccagagctaacccaggataagtctggaatgaaacagggtctgtagaaatggctgtctccacattcttacctttaattcactctgtatttcactccaatttggcttccactgtcaccagtttactgaaatagtttttgctataggcaataattatgttgccttcccctatgaacattatttgtcttttttctattctatttttaaagtcaacttatagctattcaaagtagaaggtatatttaattattcaaaatctttgtggctgatacaagcattagaaaaagaatgcatagttaataattgtgagtatgggcagtttcacagattaatttactttctggaaatctagaatctctagaatgtattaaagttataaagaggttggattaactcattttattttggtaagaacacttaacatgagatctttccacttgaaaagttttatgtgcacaatacagtattgttaactaaggacaatattgcacaacagatctgtagaacttatgcatcttgcataatgaaactttatacccattgaacagcaatttctattttggctaaatgtaaccacattaaaatacttgatattgtctttggtcatgaagcataaatgtataatggtagatgtattttaatcctaattcaggaatgatatttaaacaaaactctcactcagtaagatatacatgactacattaggaaaatcacattctaagttttatagaacactctcaggtgatgttaacagatcaaaaaataaggagaaccaatgctgtcttatacatatttaagctgggaagtttctcaagtagtagagtcatattcaggaagtaatatttaaaatataaactcttaattgcagtcgcttctctgttaagtccatctctttcagattcttcggttaacagcaatactctaaaaatcaactgtaaaatcttagcttgcaatgttttgattttttcctgaattttgaaacttttaaagtgctattacatgtcttataaatgaaataaattaaacatattctcaggagactacaactcaggagcagctggatgagatggaagagatccccagagagagccagtgtgggaggcaggacttccatgccctctcctgtcccaccgcctccccaaggtgcgctcaccaacctggaagcccacgccactcatctttcacctcccttgtccacgatggggttttaagctccgctgaccattccttccttcttggaatgctctgttgaattctgggactccacactctcctgatttgtctcctacgtctctggccattcattccctcagtgttctttgagggatcttttccttctgcccaatctttaatgttaaagttcctcaggttttgatcctagaccaccttttcttcctactctacttccatctgggagatctcaaccactttcgtgccttcaaatactctctgaagatgatgactgcccgtcatgcgtctctagataagacttgtcttctgacctccacactctcacatgcagctcctgttggctctgtcagccccctcagttccatccacctctctccctcctcagccctactcctttgtccctcacctggacaattatgatggcctctaagacacctccctgcctctactctgatgtcttctgcactcaactgctaaagagattgtttatcaatgcaaatcggagtctgtcattcacctgtgtagaactctacagttgtgcatcattcttagggtcaagtctaatgttattaacacggcctggtgggccctgaatgatctgactcctactcattgcttgggcgctttggctttctttcagtttcttgaatttaccaagtttctatccctctcacattccatttcctcaccaggtgtgccctttaatacggtcatgagtgccatgaatttttcctttgaggcacttgtcacaattgccactagataattatttgttctttattttaattttttttcagagacagagtcttgctctgttgtccaggctggagagcaatggtgccatcatagctcactgcagccttgaccgcctgggctcaagcgatcctcccacctcagcctcctgagtagctgggactacaggtgtgcacaaccacactcggccaattatttatttattgtccgtctctccagtgaaatggtcctgaaaattaggtatcatgttttgtttaactctttatccttatccttaatgttagacactgttttatttgactcaataaagacttcttgaatgactgaataaaccagtgagggaaaagggggtgtcaggatggggagatcctgacattgagctttagcctgaaccttgaaggtgtttgttcagattggtgcctgggaatagaagtgatgcccaactttctgccagatgtagatcttagactcccacagaggggactgtctgtatcaaggtctccaggtggtccagaggatagcattgcgtataaaaaagcccaatgacaacaactctgtgagcctctgggctttcctgttgggatcaacagaggggaaattgtgacctttttttgttttgacatgttattaggtcatagtatgatgctgtgaaaagagatgagtttaggctcaagcaacaaataaacctcctttgaattctgactcaacaagctaatagcttgtaaaatcaggtgaattatttaacctctctgagcctattttatagggctgttgtgaggattaaatgaataatccatgttaaatgctctgctcagtgtttggtacctagaaagaactgcctaattgttgctgttgttgttgctgttaatattattagttgtcccagctctctaataacaaatgatttgagtaggctgcttcctttagctgtaagattatcatctttttgggacaagatgacctctgcagtctctccagctctaggattcaatgatcaggggactttgagatcacccccatgctggaactctttgaagcatttccatgggaaaggaaagaatcacttctctttgcagccatgctcaaacggattgtcctggaagataagcaaagatgacacatgtaggagaggaaagtccagttcagtctggctcagaccctcctggaatctggtacttttgggtgggacaggagacagatgttccatgacagccaacatcgtgtacttcagactttctgggaatgatggcaggagaggaaccagaagagcaggatgacttgaatttattttcttggaaagactattttgttggcaagacttatccctggcctcataaatggaccagaggctaatggactaggaagaactgctcttgagccgctccctccctgctggtcaggtccaagaacattgcctccaagagcatggaccctcaccccaacccacacttgccttcccctgaggtcgcaggctgcctttctgcccctttggtgatctgccattaatctgatacatgtgtaatttgaatccatttggatgaaattgtagaggaggaaaagaagagaatgcagaaaggaacaatgatgctaagtagcatggacaaagaacagaggcatcttgtgcaatagataggcctctatccaactgaatgacagaaaccctaaattacagtagtttaatcaaagttaagatttattggtatctcacattaaattgtagggaggcagatgagagttgcaattgtgactctgcaatcatttgtgactgcccttgttctataccactcctctgccctcttcaatatttctattttgtggcccaagacagtggctccaatttttgtcattacatctgcattctagccagctagaaaaagaaagaaaggggaggggaagtgcatgtgccttctctttaaggacacttcccagaaattgaacacattgcttcaacttatatcccactggccagtacttagtcacgtggctacatctagctgtagagacactggaaaatatgtctttattccaagtggctgtgtggtcagctaatttttatatagttctattattttttaaaaaggcaagaacaggtatcagaagacaattagcagtctctgcctcccttggaaacaagagtggatattacagattgatgtcataaaaattgccacagtcagccttgggtgtaatctctagatccaggcagcaagggccgattggaattttattccgaccagatgctagctgggcaatgctgggcacattgtttaatctccctgaacttcagctttctcttctgtaaataatagtaataacaaagacttccaagaattgtaaacagaacaaaatgagtgatgtgtgtagagtgcttcgtgccctttttgtatgtagtcatgggccgcagtagatattgaggatcactctatttgttctggatgcacagcctccctgaggatgctcttttcctcgggatgctcttttcctcgggatttctagtatcatcattcttgtgactactatccacacccttcagaaaagccatcattttctcctggattaatctctttcttgaattttgaattcccctaaaagccaaaacctccattctgtcagggcagaacagagccccaatgtttctaaagaaataacttacaaccagaaagtatcagtaaattcccttttccatgttgcttcattctctcaagcatgcatgaaatttagccttaataagtggttattgtccacttactaataactgcttatgaaaaccatgcctggggtctgcggtacaggcatacagccccaagaacagctccaacctccccttcaccttctcctccacctgctacctaacagccaaagtctgtgcttctccaagaggactgtaggaaccgttatcattgcaggaaaggagcctgtctaggctgcttcttccaactccatcccagtaatgaacttgaccctaagatgcaaggcgtctaatcccttgaacccgcttgaacccgcttgaacatatctgctggactgatgtcttctgcaggttgcagatcctgaccatgggctgcatgtgctgccggatggaggcagggccatgccctgagtgttttcttcacatggcaccagtagcgttgtgtgtgatttctgataaaattgtagaatagctaatgacatttgacatttgttcagagttttgcagttcacaaaacattttcatatgtcagtaaaaatagcgaggataatactaaccatgtattgaatatgtatactaagtattttgtgtacataatctcaaaattttacatcaagtattactgagactattatctaccagttttacaggtgggtaaattgaggttcagacagtggcctctccaaggacacaaactcataggaggcaacttttgaaagtggcaaacttgggacgttgcgcatattcctgatgctggtataatctttttgcctccgaaggaagctaactaagtagaagcaagaagaggacagatctgggccatatgaatgttaggaaacacttcagaaccacagctgaatggttgctgtaggaagattctgcaggctctgagcagctcaggagctgctcattctcttgccttctccaggcttctttaagagctggggtttgaagtttgctggctagaaggggttggagagagagatgccccttcgataggacagtccctagctcagcatgattggtcacttgagtttagagctttgcaaacactgttttactgatttctcacagcattcttgcaaggcagatattactctctattttacaaatgaggaaactgaggctctcagaggttaatgctcaaggatgcttagctgattcgtggtagacccaggatttgtgtcctggcaaattagtcagattctgcccatgcatttaattactgcactaaatgcaaataaagttcttaccacggtgaattgccaggtgaaaagctaggggactggaatatagcaagcactcgataacttgtaattattatcttatcaacagaatttcagctcattgcaggcagggactgaccattttgtatacatctttctatgtctctaagtggacagtgcaggacagagctgttgatgcttaatactcactggccatgattacttcagaagtaatagcatccgtggagaagggttgacggtacgagcacagcacagctcacggcatgtgatgtggacatgtttggtgatgattgacagctcagctgtcccatgggaacccagctggccaggctgagagtctaaggctctccagggagtggaagagcctgggaaaatctgtgacgaggagccgaagggtcatttccagctgtaaaaattctaagatttggtttccagagaaaagagagaggatatgggttcactgagtttggagacctcaaagtaaccacagggttttcttaattctagcaaccagccatggattgcagcaagtcaaggaggcagcagggacgcaggagagacacagaaagcattcgatgcccctttagggagggagtgtccaaaaatgattccagcctaatctccctcccaatcattgtagaaaacaactatggggactcaaaggaacaaacactgcatgtttggacctgacgtcctccagcattggtggcagcttcctcccggagggcacaactatctcctgtctttacagggcttccctaatttcagaccaactccagctcccagcttgctcttggcccctcttctattgggttcacttgggttcactctttttttgtttttttgttttgttttgttttgttttgttttttgtttttttttttgagatggatctctctctgtcacccaggctggagtgcaatggcatgatctcggctcactgcaacctctgcctcccgggttcaagagattctcctgccttggcctcctgagtagctgggattacaggtgcctgccaccacgcgcaactaatttttgtatttttaatagagacagggttttgccatgttggccaggctggtctcaaactcctgacctcaggtgatctgcccaccttggcctcccaaagtgctgggattacaggtgtgagccaccatgcctggcctgggttcactctttaacaaaggggaactcctaacgaatcaacactttttgccaaataccccataggtcagacatcacttttgtcatgaagtatgcagacaacaggtcaaatcagaaaacccgggcaactttgaacaatccaccttagccagagagggacaagagccagcattccaggcaaacacagggcacatgaggtccaccgagaaacgatttatttgcttttggtaatgggccttctccgtctttaaatgctagcagctagagtgagtgaaagggatttctgaaaggtttgttttggggtgggtttgaaagctcccctctcttgctctgtttttctttttaggcagctttgcacaaggggcaagtctcctgccaaaaggcctcgtaatgcccctctttagggactgaatttatccgctcagctgtcccttgtaaatttattcctgtgtgagattttccccaaaccattcattcctccgcttagctcaggcagctggaatgcagaaaaaaatacatttttttcccccaagaatgtgcctttgtgtgcttggaggggctgggctaaggagaaaagaaaacaatcatgtgcaacgatgcacacacacacacacacaccggactgtgatgcacacacacaccggactatgatgcacgcacacgcacacacacacacacacaccggactatgatgcacacacacaccagactatgatgcacacacacactgggctacaatacacatgtacatgccaggctatggtgcgcgcgcgcacacacacacacacacacacacacacacacacaccccgagctatgatgcccatgaacacactgggctatgatgcacacacacacacatcgatttatgatgtacacacgcatgctgagctatgatgcctgcatgcacacatgtgcacacacacacaccaggctacgaagcacacagacacacggggctacaaggcacatacacacacatagggctatgctatacacacacgcaccgagctaggatgcacacgtacatgccaggctacggtgcacacacacacacacacacacacacacacaccgagctaggatgcacacgtacatgccaggctatggtgcacgcacacacacacacacacacacaccgagctaggatgcccatgcacacactgcgctactaacagcgccgccggggctcggggctgccctgggcggtgagggcggctagggcttcctggctcccagtgcccagtgtgtctgtggtgtgggctgcgggccctccacccgggacgtggccagagcagcacctcgctggttgtttccacagcaacatcacagtttcactagaatggaaagccacagcggtttggagccaggagaggctttccagctgcatgtgtgcatgagggtctgtggggagaggggcgctgggaactttgacttgatttttccttgagtgattatggtatcccaggcaggtgagggctgtggcaggagctggaggtgacatatgtgcttaaggaattcaggctgcctgaggggcagggagaattttcctgcaagccacgatgactgaggagacctgggagacttggcagggatgtgagcccactgacctctccatcctttgcgcggccatgatgtttctctgccacgatatcccagcacgtagagatggttggaagtttagcagtgatggcagaagagtcaaggacaggagtttgcccattttctggaacaacaacagcaaaaaccaaccatgtgccacggagcaaagagattctgcgggaaggtctacgagcaagagatgagaagtccgggtgtgtggctgtctgttcctccagctgcagtccaggcaggcgggattcaccccagcaccccagttacagattcacaactatgtccatagcattttgcgagggtttctgccaagaacttctgccctgccaagaatccaagtattctctgaaaaacaggcaaacaatttgtagaatcaatgagcctacagcagccatcattttctgcctatggagtagacacactttttgggtgcaggtgccacctttttttttttttttttttttttggaagcgaaggtctcactctgtcagtcacccaggctggagtgcaggagtgcagtggtgggatcatagctcactgcagccttgaattcttggactcaagtgatcctcctgcctcagcctcctaagtaggcaggactacaggcatgcaccaccacatctgactaatttattttttattttttgtagagacagggtctcactatgttgcccaggctggtcttgaactcctggccttaacagagcctcccacctcaggctctccaggtgctggcattacaggtgtgaactgccggctaacaagtgccacttttatccctgcagcacaagaagatttggggaacttaaaatgttgttctgatttttcttatatttccaagcgcctgccatgagcctgctggccagagctaacccgtgtggctgtggtttcaggaacacatcactgcttctagtttgagctccttatttgccactgggttgatgggatccgattgactgtaggctacgcccaggaagaggcaaaaaagaaatggatgatgaagactttgtctttagggagttggctgtcttatggggaagatggtaggagctgaaaggcaacatcagactggagaacaagttagaaagtggtgagtcacaggtttcccaagcttcccggacctgttcaggaaatgtggtgtggctggggttccgcctttctcataagctccgagtaaagccaatacagctgatccactggccactctgaaaagcaaggagctagaacagtcacccaatgggccagggaggcatttttgcctccctggagatggcagaatgggtaatactctcaatataactttcctgccattgttcacgggcaagatggtagcttcttttttgtaagcctgtctttccgggtcttgccctcccggaaacactaagcagttcaaatacccattgtcaatttcagcatgccatcccttggaatgaatgggtttaagggcaactacagtttgttcctgaaactgcagtatcactaatggctaagagcacttgacattagtcagacctggatttgtcctggctcccccacttatatggccatgcagacttgaagaagttacctgttctcctatcaacttaatttcctcaactgtacagactaaatgtaataatatgtgtgaagcattcaattaacatcagctattatcatgactggttgtgaaataattgatgcatatcataagtcatgagctgcaggtccaggggccacatctgccattccccagatgggtttaatttggcctgtaccgtgttttaaataacgttgagtttgttgccaacattttaaaattgggaaatttcacataaaaatctgaatttggggcttatattgaaaaatcattagctctgacaaacctggcaccaatttcttgcgtggtaacagtgggttagcactggggctgagcagggctggaaactttccatggcatctgcacctccagttcaccatcgcccagtcctctctttgtgataccttctctctgtggacatatgtccttgggtcccacatctatagggtcccgtatgactctagaattctagctatttcggctcactggtatgtagtaacggcttctggaactcaacaagaaaatgcaaggattatcttgccaacaatgcttctactgcttaaatgaaagaaatctggtagttcttctctgagatccaacagagccggtgcatttattgctctcagtggtatgtctggggaccagaacccgctggctctagaaagtgcccctcgcccatccctgcccatgggttgcatcagcagcgtgtcttctttgttctctccctgaagggtaggatgctcatgaccttggccttgcagtttgggtgggtgcacctcctgtcctggtgctgacatctggatgatttatgaacatcattaccctttcactggactcttactcttcggagtcttcagagctgcctgggcctagcgcccaagaagtttgctccttgcatcaatggcgatgctagacatattctactggctgtggcccaaaggtactcctggtgcctgtgtgggaagggccacgatgggaagaatgctccttgctcgctctcattctcccagctttttattttttataggctggaggtggaactgtaagagcagagaggaggagaaggctcaccatgaagacaaaagaagtcctgagccttggattttcttcctctagggctttgtggacccacagattggtagaagttctgtgagggctgacttctccccatctgtcccagatggatcccttaaggtgggtgagccctggggaggtactgggtctgcttgtggagagaattctcaggggtcaggcctgaaagagctcatgcggctgttcctgcgggtgggtcagtttctctggtgcataatgaataatgctgcatgggttctggactgtccccgtccccggtggagggtttcagtattcttgcaggctcttggttgtgtggatagtgagaaacagtgggtctgctcttgggaaatgtgctctaatgactctttacctacatgtcgaattctctaaccttggggacagatgcaccatgaatttggttttgtaggtttgtgtatgaaggtggataacagacttgttaaaagagctttgaaattcctgccataacctctaaatagtgggagtagagcaaccaaattctctgaagagatgaggaaaatacccctttgggcagagtcaagcttgctattctttaaattccttcagctggctcaataggagaggaagggacagccagaagtcataggtcgttttctggaggtttgatagcctgaaggtaatcctctcgtgtgttccctcacctaaagatgaagaattttcgtgtactagaagttgggtttactaatcctgtagctctggaaatgaatggccttgccttctctaactgtccagctacctggcatcatgtagacaggcccttcaggtgactgagggttctggaactcagttgctagaggcacacacgaagagcctgctcagaacctcctgtgtttcccacagcctcaagagacgggcaaggcaagagccctagagcctgtctaacccatgtctctgcagggcacaggttctgtcacactgagtgtgggtagttttccaccacaaactctgcgccagaatcactggaagcttcatgaatagagattcttaggtgccaccagtgcaccgagtcagcactctggaactgagccggagattgcacttttaacaagcaccccaggtgcctctgagctgaagaaccgccagtctcacgtgtggactttaaaatctcatgcagagaatgtttctcattgctcaatttaaaaccctttttaatggtgtctctgcttagagtggagacattccaggaagagaaaactaagcacagggaagctaaatactgagccctggaggggtcaggatatgggcctcatcatcatctggtgctgtttcacactgcgctcgggtcaggtgcgtgagagccccattagctgggatgcccgctgtgcaggagcgtctataatctcttctggatgtcccagctaagcctgaattgttttcttaaaggcttgacccaaatgcaccctgattccaggtggaacacattttcacgtaaaccatcaaatgctggctctgaagggaatttagagatctattccagagcccttgtgtgtgtgtgtgtatatatatatatatatatggaattataggttagaaacagacaaaaaaagtgccatgatgataaattcctgaatgtacattcaaggagcttcgtggagagaggaacttgggagaacaagcaactaccagattcagccaatgactgggcagcaatggcctctagttccctgagaatcccttcaaggtgggggctgcactccaggcagggactctgcagctccacgtcctcactgggcttctcctgcctatggcccagctcgcccagccccaccctgcctgggcaggaaacttccaggctcttccaccaagaaatgcaggcaccctaacttgcatggggtaggatttattctgtaaatactgagtgccgattctgtgcgattaacaggagagatgggagccactcttgcagagcttactatcttattctaaacttattaaattctgtttatgtgtttttaattgtatagtttctgcctgtagagaaaatgttggtgctttgggagttggggtgggggtggtaaggaagccttttctgaaagggtcacaactgaagtgagatttgagtgacaaagggagctgttgagagataaggcgccggggacagcaactgcaaaggccctgagcaaacttggttctgttccagaaaggcaaaatgcagcagtgagggtggggaaggccctgaccatggagggccttgcaggttgtggaaggggttttaaactatgaggggacctgatctgactgacatttctaaaagttccttctggctgttttgaagagaatagatagggtgaggtaaggacaggagcaggaacagcatttaggaggctcttgcacctgcaggcagagctggcaaggtctgaagcctgagggtaggagaggacgtgcagaggtcaggtgagagcaggacatgtttaggggaaacagcagaaagggtttgaggacagaggtcttcttacatgaaaaccctggcgagagtatgacatacatatgggaagactgtaattttctagtcacttcagcataagcttcggaagggcaggtgccatgcctactgaatgcagcattgcatactgttggtgagtcacctcttcctctgaaactgcagtttcctacactcacccaggcaccccttctccaggctcaggacacctcagaggactggtgcatgggctgcagccagcctgacccagctctataaagaagctcaccctttacagatgccccagagaggcccccatcctgccctgcagccagcttcctgggcaagtgggatcaggtcagtacatgcgcctgtccttccctgagcgtaaaaggggagtgtggagggagatggtatttgaaacttggcagtggggacccacacagacatcaagaacaatccctttggctttccatttgccaagttgtttcagggtccagggtttgtgactcatcctgaatggaaacacttgtacagcaccacgtggctcctttccgcccctggccgggcggcagtgacccaaccagctctgcactttctttcttcccttttaatgtatccataggcactcggggtctccctcctccagggtttcctgaaacaggatgcattcagcccttgtagagttgctggggaagtggaaggaaaacagaggtgactcttgaagccccaggagctgaccttagatcttgacactcctggtgtgtgcaaaggtctgaggagacggccagattgaggtaaagcagtaaaaatccgtgcttgtcaggaaagtagcaagagccgagttctacactaaccattggctggcctggggcagcctgcagctgcacaactgcctcgtacaatggcatggacaagcagtgtcggtgacgtagcaggccgctggggacctgggagacatcctgctgctgcaggagtcctgtgcagagcagaggagagagcagtttggcaagtgcaggggtcccactcttcttttggttggtggcagggagcaggtggggcctaacctgggtggacagtgtctacctcccttctgtgcattttgcattggccttaattggttctcccgggatagtcacgaaagcccgacctttgttccaggtaaagtgctgcatgtttcatgtgtacagctcatttaatcttcacaggaccttatgaagtagttattatatctattatcatcacagaaaagaacactgagcctcagagaggtcaagcaattggcccaagatcacacagcctgcaagaaacagagatgggactcagaccctggtctatttggctcccatgtgccttactactatgttatacccacccctccaggtaagattgggaaccagctgtggaaagactttaataacgggatggagggactgccaagctctccctctggcaggattgattttgcagagactgtgagcttaatgagagcaaaactcaggtcttatactccttcatgtgccctgcagactccagaagtgctaggatgtaagaggcagacaaaagagtgatgttactgctgtgaactttcattaggatgtgtagagttctgttatatgtttggaaaaaaatccataatctcaagaggctatataatgctcagaacagctttagaaattctctttggaaattgctttctgagccccaggcacataaataatatttttatatatatcctcaatcaaggcaagccttagtccttcgagggtagcttggaattccataggaatctgaaggtaactcagagccaaacttggtgaagggggtgaagtgtcaatttcagatttgcagttttgttcaaaaacatgttgataaagcagcaggctgatggtcatgagcagctcactagctgattcagaagacatttctctgctgcagccagccctgcttctgtgacttcactcacactttccatccgagtggaatagctcacccttgcctctttcacactcagtcccgtccatcctacactccaccctttccccaaattcctgttcattgttccacgtcctccccaagggttagtgaatggcctcatagctgaaagtgctttacttgaagcgagtcctgattctcccaatccgaaggccctgctctcaccctgcttttcacccgcgctgctccctgggctcttcagaggcgatttctcctgccttgctgtttgtctgtgctctccactggaccatgagctcgctgagaacagcgtctgagatactgtagtcccaggatctgcagcctttgctgaattgacgtggataaatgtactattttgagtacatttgcaggaaagggtgaggtttgtcctggagagggaatagggccagagacacacagtgtcccaccattcaggaattcgatgcctacagcaggtgtcctgtggctcaccgtcctacacatggctcacccagagtttggtagcttgattttggaggcatacctagaatgtctagaattctcaattactcagaaggtaggatttggaaaaaacagagagtggagcatcagaaaagtgagaagagaagagactcaggaccccaaacccatgcacctcagctgacaaaaccaacggactctcactaacctaaattctaaaccctcaataaagagaagcagcaaaggtctgcagctttctcacctgctgggttggtcaatgtggtgctggtgtggatgcagccaagcgtttcagctatgaggccattcactcacacttcacccttatttcactctgcttgttatggtctgaactgtgtcccctcaaaatgtgtatgttgaagccctaactcccaatgtgacccttaaagaggtaatgaaggttaaattagaaccttaaagaggtaatgaaggttcaattggggcccatgggtgtggtcctaatgcaatatgactgccatccttattagaaaaagagacatcagtaatgccagtggacaagcccaggcagagggcagctgtctgcaagccagagaaagaggcccccaagaaaccaaccctgctggcagacttccagactccagaattgtgacagaagaaatttctgttgttttagctacgtggcctgtgattttgttttggcaaccccagcagacatcgctgctttcattttcttctccatccttttctttttcctattgttttattcccacctgctcaatctctatcttttattatttatttctttgtagaaacaacaacaacaagagtataaactgatttggagactgtggtttagaattctaccagatagataaaaatcagcaaactggacatgtgggtttctgtagttacaaatcttccatctaaaatcttatttcccaggcatgagttccattaggaatttttttttctatgcatataaacatacacatatgctcacaattgcatgcaattttcatcagtctgatgggtacacccttcctgatacaattctgggctttcactcagttctaatgtgactggaaactaaatgattaagaaatatgaatgaattcagccctccctaactcaagctgggggcatattttccactctgtctcttgtgccctctgcccaggaatttcaagtcccaagaaatggcctccagaaggaaatcctttgccatccccctaacttgagtattcagtgatttctggaatagaacttgcctgttacagaaatgggaaaaatatgaagacacatgcaataaaaataaaaactaaatttagaatgaagaggagacacaacctaggtaaaatttaattttcattttggctcataggtaattttatcctgaagtgtactagggataatgatggcatgctgtttcactagagtaactgagtgaaaacataataatgatgaaaataatgaacataattttttaaaaattcaccttgtagctttgttatctatagatgatgtcattaaaagttctgagaaataaatattactaattcaagtttacagatgagaaaaaggaagatcagaggagataagggatttgcccaatgctaatcaatgagtaagggaaatgaccagcgttggacctccgaatccgagtgtaatacatctttctctgcagaactttgactcctttttctttctcattctctattctttgccttctgggatgccaattgcatgtttgttagaccttctctctgtgttttgagcatctcttataatctgctcatttctttcttccatatgccgttcaatatacatatttttttctattggcatgtcttgaagttcagggatttgactgctgctatgttctatccactgttaaactcatctagggagttcttactttcagatattgcagttctagaatgtccatttgcttctttttttttataaattccaatcctctgtcaaaattacttatctttccatccgtttttttcaaactttcccttatttttttaaaaaaatattttaaataatttccttcaaatccttctctgctaactctaaccattggatactttgtgcatctgctttattgtatgtcttcccatttattgtgggtcacattttcctacttcttgcatctcattacttagggttgtttgtcagatgttgttgttgttatgcataaaagacccgcagctactgaagttgatgttcttctccccgagaaaaagtttgccttttccttagctaggcagacagtacagggggtatcactggatgctgtgaggaagtgaactagatcacggctgggactgcagctgggtgtaactcactctggttttgaccatctcctgggggacacatggggcacaggtagcatggacccctttctctagtgcaggcttgtccaacctgtggcccacaggctgcatgaagcccaggacggctttgaatgcagctcaacacaaattcataaactttcttaaaacactatgagtttttttgcaaatttctttttttagctcatcagctactgttagtgtattttatgtgtggcccaagacaattcttcttcttctgtagtggcccagaaaaaccaaaagattggacacccctgctctcaagggactttgactcttaaggaacatgatactgagggggatttgactcatctctcccagcccagcccccttcctgtataaaccagcctctatcccaaaccttcaacaaagctgagtcaagttctcctaggctttggattgagctcctattgtgtctctgtcacctcttccccgaaagctgagctctttaacctccacatcatgtggattcaaaatctgccaggtgttctgattggggccccgctgggtgtggttgtcagcctcttcttctactgtgactttgactcctaggcactctgaggctatgggagatttcacaattcctggctggctcatcccctcagtgttctgtgccaccccagatgcaataactgcccagcggggaaggtcagccatgctttagggacttctggatgttccattctttgccagcctgcagggccctgggtctcctctctcttttcttctgctcgcagtaagcccactctttagatggcctcagcaaatgccccttggaaagaaaactgccagcacactcatttcactctgcgggagctattcccctctggaatgttcattcttttagtctcttttgcctctatgattctccatactgtttataaaaacatgatttttgtgatacatcatttttccccctagctgttgcagtcagaggaatgccttgctaaatcttactcaaaggcgcaagttggaaaactgacggttaatttattttttcatcagtgagagcacaccgagtcatattttttgccaatattttattatgaaagtttgcaagcatacagcaaagttgaaagaagtttacaatcaacaactcacatacacagcagtgtgtctgtaaactggctctctggagggaaaacaaaaaatctgatttgtattgtttgctgatttctgtggtgtgaatgtttttgtctttgctaatttcaagttaccaatgtgacgtgggggagatttgtgcaatatcagctctggggagcgtatgtgagccagctcaggcccaccactgcctggagccatcacttagaatctgtcaccaacatcttagggtgcttgttgagtcatgtgtgtatcttgccctctatccactgtcaatccatcttatgtttaaaatgtatttcaatgtaaattacagatataagaataattctttcttcttcaacattaactagagttggttcactatttgtttttcactaacttgcttttactaattaattttttactatttgttttgatgtaaaatgaaatcttagtcttaattgtgcattcactgagttttgacaaatccatacacctgtgtaatccagtccctatcaagatatagaataccattactccagaaatttcctttaaagcttggccaactaaaattttcagctttttgggacatggactgttactaaacaaggcctccttcattatacttgaccaaatgatcattccaccctaaatgcatgtctttataattgttcaattttgcactcaccaggatgaatgatcagaaatttgctaatacaaaactttgaaagtagatgcaccataataggctgaaagcttcagtacccaaagtgtacacccatgttgagtcatgccaagaaaacatcacagacattaaacacagaccaaaccctcagtccccaggaaacaaggggacgtacaagcaacctcacatccatcccttctgattctctgaagctccagctcccacacaaagtacatgtgaatcattctgataataatcccatgacatagttgtcatcccaaagaacaagcctttccaacctcctgccctggctgattcggacgacacctcacttggcaatatatgcatttggcttccacctgccataagtcaaggaaaaatatcaggcaatggtggaaaacaaaatccaggaaaatattcaccaagacaaaggagaaagcaatcatttgccttcagttatggggaaggatattttaggctcaagtggtgagaaatattggacagtgtttcagttctcaaccactaaaccatgttccagatgaagaaggcaggtttggagaaaagcaaatagaatctctcacctgatgggccaaactagaaaacattttcaaaaacaatttcatatatttgagatattaaccacgacagtaattgggacataggcctgtcttttattatttgagagctgctaagattatgataccttgcccatatgtcacagctgatgaagcttttgtgcttcgctacttaaattctaccactgatatctcactcaccagacctgtgagaatggatgatgcagatttgtttaaccattagagctgtgtaataattaaatggtttattgctagaaggttccatatttcatgacttcatgaccacatgactctctagcgaccagattttccaaggtgagtttgggtcattttcatttgccaaataaaaatatgatacccagagataaagaatattcaagaatgtgttattatttagctcattcaacaaatgtgtatatttatatatttacttctgatctctttttcacacatcaacagagttatgctttgtagaataatgatttgtgaacaataccatttccctgctattgcacatttatggtgtttccaatttcttcatacgacaggtattgccacaataaataacaaggcatagaaagcgttctctgtatattgggttattacttaagcatagatcgagggatgtaaacctttttaatacccttgagcaacataataaaattcccttcctaaaagactgtataaatttacaaacctattttaaaaagtctctgagcgtccatttcactgcagccttaccagcacagagtgatggtaatatattgaacatgtcaagtttgagtagggcacgcagatccaggctggatattaccactccaactttggagaatgttctgaaacaggccctgatcagtagacttagctgggtgaactttaaggtccctgctaaacttctatgattatatttgcaatcaaattttaattatgacacagctagttatactatgattgttttaataatacagcaattattttccataaaatattactaaaaatatgcagaaaatgcctgaattagttcatatgatagatattggtataatcttttggttttcaggatattttgaagactaaagtgggcatgcttacaattaattgatttaagatgcaaattatttttactgtttaggtatatatatgtgtgtatatatatatctaatatatatataggtgatatgtttgcttgggctgccataacaaaataccacaaactgggtggtttaaacaatagaaatttatttctcacagttctggaggctagaggtccaagatcagggtgccagcatggatgagctctggtgaggattctgttcctcacttacagatggccaccttcttgctgtgtcaatgaggtgttaaatgaggacataataaaaggagagagagttgaagagacagagtggggagggttggggagagatagacatatcttataaggccatagtcctattggattagtgttccacgtttaggacttcatttagcctgaatcacctcctgaagactctttctccatatatagtcacattgggagttaaggcttcaatgtataatttgggggaaacacattttaatccacagcagtatgcatctccaataaaaatgtatggttgggataatagttgaacaatactaaagcatatctttttgagtataaatcgtcaagttgattttgttttcagtctcaagtgtttttctatgacttcttgtcaagtctccttctaggtcaccagctgggatgggaggccaactctccaaatcagaagaggtaagcagttgttactgaggagttgacttccttcccattttgttcccttcagatttgggatttatgttaagaccttgttatgattatctagtgctacataacaaatcgttccaaaatttagtggctgaaaacaatggcaatcattttactatctgttacagtttttctgggtcaggaatttgagcaggacttgcctacgtgattttggcttgaggactctcacatggtggtaatagatggaagttgaaactggagcagaggagcagaagtggctggagtggcaggaactggccaggcatctcttcctctctggatatatagacactgggcctcttcatcgggtctttctgcagggctggttgtgcttcctcactgcatggtggctcagggcagtcagaccacctgcgtggtggctcagcactccagcacagtgtcccatcactcaaggtagaagctgcattgtcctctagggcttagcctctgaagccatgcagcgtcacttcctgagcttccttgtaaccacttcctgttggttataagtgaggcacaagcccatccaaattcaaaggaagaagagttagactccatcacttaataggaacgtggcaagattctagaagagcaaatgggataagaattattgttgcattcatcttagaaaaatacaatccgctacaaagccccctcatggagcacccagatctgagaagggggtgctttccactaaagtctctgcctccattttccacttcctctgcttccttctccttcttgtgttctccatgagcattaaaccaaaataaacagttctgagtaccccttttaatcaagatgtgtgaaaaaatgtggaagctcatccttggaagaataataatagaaactagctttatttatcctgggtaagagacgtaagaggagatgatgggatcactatcccagcacatgtgaaagacgggaacaggcttgtcctgggctgctccagagggtgggtggtacaggatttttcacagtcctggagaaactcagaggcttccttggctgaccacttttttttttctctttttcagctttattgaaaaacaaatgacaaataaaagttgtatatattcaaggtatacaatgtgatgctttgatacattgtgaaatgatgacctcagtcaagctaattaagatatccatcacttcctggaggtacctttgtgtctatatgtggtgagaatacttacaacctactctctgaaaatttgaaacatacaacccattgttattaactacagtcacctgatggataagagagctcttggctagtataaatagagcaagtattttccataaaaatatggaaaataagcaagtgttttccataaatagagcaagtattttccataaaatatcactaaaaatatgcaggaaaggcctgaattagttcatatggcagatattggtataatcttttggttttcaggattttttgaagtctaaagtgggcatgcttacaataaattaatttaaaagtggtatcagttttatatgttctgcatacaattttctttttaagagtaccctgtgggttaaaatatatttacagagcaacctctcctaacaaaagaaaatttcagaccattaggcttggtcagataaatgaatgttagaggggcaaaatcaggtgtagcaaagattagtccattgcagaaagaaactaggactgtgcctctccaaataggagagtaccaaagagggtacacccctgtaccccaggggtgtctagtagtgtgcctttgggtcctagaagatgtagaataagtatggtacatcatcacaacaagtaatttaggactgttttgcaataaaacaatcaatatttattatgcagttgatgcaatactcacatatattttaaattagatgctctatgagaattttccagttgctaatagctaggcaggtgaccctcctacattcccctaggatactgtgtagacaagtttgtattgacaaaaataagaatgtagactgaagagcaaaactgttgggttcaaatcctggctctgtgacttactagttatataaccctgggcaacttaacctgttcatgccttagtttcctcatctctgaaatggagatattaataataataatattcacctcatggggtgattgaaagaacaaaatgagttaattttagtgtttaaaggagtgccttgcgtgtggcaagtaccatgcagatgctcattaaataaaagcttgagaactatgaatgagcctctccgagaaggtcaagaatgggcacatagtctgggtgatcatgagcagaggctggaagtgatgcattctgttgaaggaattgttcatggggtggccactccttcaaaaggaattataaaaatctaagacttgaagctgagatcccccacctgctgggtggtgtttgatggtctaaactgggggtttgcaaactctttcagcaaagggccaagtagtatatcctttagaattgtgggtcatccagtctttgtcacatttgttcaactctgccattgtagtgtgaaagtagccatggatgatatatacctgaattaaatggactgttgtgctgggctggggccacagtccatagtttgctgctgcttgtctagatcctgcggggcctgagcaagtgagctggaaataaggtggctgttgagggggctgaggagcaacaggaagtgagaagggaagggagatgggtgcagcaccactacaatgccacttccttcctggggtgaactcacttagactttgaataggttctctgcagagatgactgagacacttggagccatgcgcctgcagagacacagtgggggaccatgttagaaatgggagtaacaagtcattcattcttactatatgtttcgttattgcatggcaaaggctttgaaaagaaagctgagtcttttattttcctgtgaatcagctccgagcccctggaacaatgttgttcattctgcggatgctcagcaagcccttgctgactgtctttatttcttcacctgcaataagatccccccaggcccatatggaaacgtaaatgttcttgagggactaattcagtgagactcttccaggggaagttcagtcctcctgggaagtgattacacactgatggaatttttgcacactggatggaaagatgatctttgcctcttggctgtgtcacagtaataagtgggagactgattatttctaagagtgcagctcttcccggcactgataagaatggaatgcagcgctaccatggagattcgggtcactaattagtcccagaagcctctaggccttgaatcactgttatattaattatgcatcaaattagaatgtttgcaaaggctcagagccaactgtactgcagaacccggtgacagcatggagagatcaaggagtgtcccgcccagcacactgcagggaccagcagacaaatccacgcggcctgcctgagcgtgcagtgaccccgcctgatctctgatacagctgttcgcaactcctgccagagagcttgttatcggcacagggtggacaaaagaaggaaaggaagagaacgatggcttcccctcagttccataatctaagctctactgcggtaatatccagctgagaaaagacacaggacaatcatttgggcactttatttccatggtaacaaatagaagattcttccagatgtttgctaacatcgtggaggtaacatgtctggaccgttgtctgatattcagtttttatagctggggagacatggctttagctttgggtaaactattctatctcttcctcctcttcctctgcctccttctccttcttgtgttctccatgagcataaaaccaaaatatacttgatgctttgttgtaaaataaacagatgataaatagcagtctctgtgactgttgggttataattccatcgagggctggggttgaagtcataaaccacaagaagtgaagcatgacccacaaatagccttcaggatggaattacagccccataattcagagtagccctttgaaaaaataattcctaaacctagctataatttggggaaagagccacgacagtggtgacgtcttctctaatcagttcatcagtagacaaattactccccttcgttattctgatgatatttattaacgttggggtgagcacccaatctgttttctaggaggttactgttgaaaccaggtagcagtcgcccaaacagaaccaaagaaagggaaactggagtctcacagtaagaaagttctcaccacagatgaaggtcaatgagcatgaggtgagaagagacattcattactttggaactgatgagaaatattgattcctgaccacaggagtagtggccgagtttgttttgcgtggagtgtggcataaattccgtccctgttctgcatcttactacttctctaaatgtctttgctattttcaaaactgattctgcttgatctcataattcattaaagcaagttgatctcatgcaccccaagagttatgagaagctttttcatgatggttcttgcatgatgaaaataaattctcatttattacagagaaaataaaccgaacccaacaattctgtagaaggtgaatgtttaaatggcagtttcttgtgatcataaattaaaccatcaaaatcccataaggtttctctgcagcctagatattaaataaaacaacaaacatgcaaggactggcaagtggtaagggcttaatacatggtcattcactaccataatttgtaccataaaattcagaaattctttacatgctttgtgtgttattatctactttgtcaatgacgctgaagacatgaggagaacaagggtctcatctgacgcattatgcctttccacatagacaatgtagaatattatttaaaacagagtctacagcatgaagaaaatagaagcaacagaaaacaacaagctaatatataaactattaaggcaaaatggacaaagaatatgatcatttaaaagtcgagcttattgaggtataatttgcagatatgctttgtgtttaatttgctccttctttcctagtttaaggtggaaacttagatcattgatttgagatatgtcttctctttcaaacacaaatatataaaagtgtgaattttactctaagtactgttttggcaacaacacacacattttgatatgttaggtttttatttttgctttggttcaaactattttctaatttttcttgtgattaagtttgagaatttaacaatagaaaacagaaaacaaatacttcgttattgatttctattttaattttgttatgatcagaaaacatgctttgtatgatttaaagtcctttaaatttattgagccttattttttgacccagatatgatctttctttgtgaatgttgtgtctgcatttgaaaagaatttgtgttctgctattgctggatggagtattccatagctgtcagttaagacagtggttagtggttccatttatcttctatgtttttctgtatgcttgtatatctgagaaaaggatgctgaaatttctaactatcactgtgaatttgtctgtttctccttttggttctgtcattttttattttatttgttttgacattgttaggtattattaggtgcatgtacatttggaactgttatgcactcatgatgaactgagttctttcttgttataaaatgtctccctttagcctacataataatatgtgttctgaggcctactttgtgtgatatgaattacagccattccagatttcttttgattagcttctgcatggtacttttttcatcctcttcgttttatctatatatttatacatattgtatatttcttgtagacaaaaataggtatgtcttgctttttaaaacccaatatgacaatctgcttttttaattagaatgtgaagaattttctctaatatttcttataatataggtctgtagtttatggatcctatcagcttttatttgtataaaaatattttctctatttctaattcactctctattttgccttcatttttaagagatatatttcctgggaatcctatgatgacggttctttctgtcagcacttttaagatattcatccattttcttttggtcggcatattttctcataagaagtctgctgtcatgcttgtctttattactctgtaagtagtatgtcttttatctctggctgcttttaagatttgtttatctctgatttttaacaatgggatcatgatgcgttttagcatatacgtctttatatgtattctgcttgggtttcatggagctttgttgacatagttttcattaaatatagataaacttctagctattattatttcttcatctatcttccctcttcctttctgggactctaatttcacatggtagacagccttgatattgttccatagatactagatattatttttgttttcgtccatcttttttgtttctctgtacttaattttggatattttctattggcatgtctttgagttcactgatctcttcttctgcagttccaaattggccacaaaactgtccagtatattttttgtttcagatcacataattttcacctctatcagttccattgtggtacctctctctcttctttaaaatatattcctttctgctcctcatagtgttgtttttccctccttcttgagcatattaagcgtgtttatgatagttatgatagctgttttaaaatttgtttctaatttctgaatttctgtcatttctgtttcacttcaacttattggccttttctaggtatgggccatatatttctgcatttttgcatacctgataagtttttatttgatgtcatatattgtgagattttacattgttgtgtgtggattgtgttatattccttttgatagtgttggactttgtcctggcatccagtcagaacagtgattgcctctgggaagtggtgagattgatgttcaaggtaattgaatggctctgtatctagatctgggtattggttacatggctgtgtgcttgctacaaaactcatccatatatatacacttacaacatgtgcattttactctaagtaaattacactcaaaaatattataaaatgttatatatgaccatttaaaaaatttgaaataatacaattatataaagaataacaactaaaagtcctatcttcctccatctcaattgcactgcctcttcattattccttctttcccaaaatcttaccattcataaaccagttaaatccttttctatatcaccttcaaaatctttatctatggatttacacctgtagcatcatggttaagaccacaggctctagaaacaagactgcttgggacagaatcatggctctactacttagtagattcattttgcctagttttgaacatcatacaaatagacagaaaaagtaggcatttctgtatttgacttccttccctcaatgtcatatttttgaggttcattgatgttgcttatgtcaatagtttattcctttttcttgtacccagttatatatatcattttataaatataacaccattttcttttctgttctctgactgatagacatttgggttgtatccagtttgggctatcatgataaaagctgctgggaatattcttgtacaagtttttggtggatacgtgtttttatttatctagagtaaatatttaggagtgaacttgctgggtcatagggtatgtttaaatctatttaaaaaaacctaactatttttatttaacattgctttcagtaaagtatgagagttccagttcttctacatcctaaccagcacttgacatgggtcagtcttttacattttagccatctaataggtgtgttttgatatcttttgtgactttaattttcgtttccctgattactaatgatgttaatattttcatgtgcttatttaccatttgtatatcttcctttgttaagtatttgtccaagtcctttgcctattgttctgttaaatagtgcagtgtaacacagataaacccataacttattggcttaaagattagttttaaattttgtttatcaatcttccatttgggcaggattcagtttggacagctgatttctgctccatgtggcatcagttggaggagctcgactggggctgggtgttctcccatatggcttacgtacatgcctggcaagttgatgctgtcagcaggaaacttcgctaaggctgttagccagatgcctttgttcctcttcacttgagtctgtccatttgattgcttggacttcctcaagcgtgggggctgtgttctaaggatgtgtgttttaagagaacagaagtgaatgctgtcaatctcataaggtcttgacttgggcactgggttagtagcttcacttccatcatactctgttggtcaaagcagtgcagaattcactcagattcatagggagaggacatagactgtttcttcgtggggggaatgagacaacaattaatccaccatagtccatcctctgattggactgcatggttggaatgaatgatttgcatcaatcccatgtaaaaaatagaatcagttcctcctaagacctatgaaaattttacaccttgtctctagctttcatcctccaatcaaacttgaagctcttaggaaaaagccagttaagtatggatctcatcccttaaattttcttattattaaggtaatatcagctccatttctgtttgcttccagtactcttcagtgttttcaaacaattgatttttatattttgtacatagtttataattgcttttggcaagattagcataataaaagcttctcctcctactgttgaaaacagagtctctttgtataacatacaaaatacatttttaaaatatttataatgaggcagggcacagtagctcatgcctataatcccagcacttgagaggctgaggcaggaagatcccttgaggcctggagttcgagaccagcttgggcaacatggtgagaccctcatttctacaaaaacaaacaaacaaacaaacaaacaaacaaacaaaattaaaaaaaaaattagccaggtgtagtggtgtgtggctatagccccagctactcaggaagctgatgggctcacttaagcccagtagttttaggctgctgggagttttaggctgatgggaggatcacttaagcccagtagttttaggctgcagtgagctatgaccacaccacttcccaccagcttgggcaacagagcaaggccctgtctctaaaaatatatatatttaaaatgaggaaaagtaaaagtaaccctaaacaatagtatataaaatgcaaacacctagtaaaaacaacaaaaaaaaattcacatgggaaatgatttctagtcttgaacaatttactgattatttgacatcaaagaacagcattgaatgtaacataagcaggttgctttatatgtttgggctcagatatttatctgaaggacaagaggtttagatcagacaatgtaaataatcctttagatgtttgaggcctacgattcgaataaccttataattaaatgtagcatttgatttccattttggtgaatgtaaagaaagcttaagaatttacaatttatatggtcagtatgacatcagaatacagaaaaaagaaattacctcaaaccgtacaattatcttttcagatggagcttacagttcctttcttctctaacagggttcacaagctcaagaagtacctgaaattgggctaggaaatagtcacagagtaaacatggcttgttttctgagggtatcaattttaccttataattttgagtaaaatcacattcataaatcatattgcataaaaataaacttagataacttatggtataaaatacaaatattatataaatatttaaagcttaaaatagaaaaaaagtctatttggagagaaaccttagggcaactatttcagttgctggaggagaaagactttgtctcttctggtattgtaatagaaaagtttgagaaatgctataaattcactgggcgttgggcaagaagtctaaaatcctgctctttatttaagatctgcaaccatcattggatctatgccataaatatgttttatttacccagacatctgcactatttatttagctttagtcactgaacgaacagttttcattctgtatgaggtgctaccctcaaaactatttgtctgtttctcagtacgtttttggttgatggagtttggatgaaatatctgtttctctgaccctccacttaaggcaaaacatagcagcctgcccttcctttccaggtgcagacagaactgagattagcatgaaccattccttccagttgactaccaaggggtaaactatgaagagttttgcattgtgatttaggggtctcaattgttctcccttccaccatgggctgtgatagtgcctaaagcaccagtcctctgaggtaggacagagtgatcttgataggccaatactatgaaagatgagagggaaatcctctctcaagccatttgtcatttctaaacaccttgattcaagctagttggccataatttaaaaataagcccttaaattatttaacactcttcctatttaaagtcagactctaattcctcttcccctgaatatagtccagccagtgacttgctttacaagaatacacttaggctgaactgatgctgtgtgatttttttttttttaaactagggtagggaagacaactcaattctgcccagagagctctttttcactcaactgaatacgcactgggagccataagccaacatgtaaggaattcagctactcagaagctatcatgctggaaagaccatgtagaaaacttacagacatagaaaaagttccttgagggctccagcccccagctatttgagaattccaggtccatgcctcaggcctataagccaggagctttcagatgattccagtcttcaagccatcccagctcctggtaaatcgagcagagatgagccatccccgctaagccctgcccaaatggcagattcatgagcaaaacaaatgctcttgttgttttaagccactgagttttgaggtggtttgttggtttgttaggtagtaatagaaaaatggattctttcctattacctagtcaaattctgaggaaatgggacataagtaaatcatatttgttttcatatacatttcctgttttaaaattgggttgtttgtagataaaaagagaaaggcaaggagagttcagaatcacaatgcactaaaagaaagagttcagagaggtgggaaatgaaatactttcacagatatctccaataaatatgcatgtgcacagaaccttgaaagttttaaattggcagggatcttaggaatcataaaactgaacctacttttcaaaagtaaagttcaaggaattaactcatttgggcaggattccagagccagaatagagcccaagattccaaacctagccactgactgcagtacctcttttctcgaggcatgtataataaactccaccaatttagccaaataataagggcaagatcaaataaacaaaaaagcaatagcaacaacagcaacaattctgcataacctaactggctatttctaaaagtagttgtctttgctctgcctgtccctgtctattgtctccttgtggaataagtgtgtccacccctgggtccttgacattaaagggtttgggaaactgctacagaattcgcagttctagttctccaggcaagggagttaatggatctcagacatgcttatgttatttcactacacacagcagtgtatttgtggagtgcttaccatgtgatagcagctgtactaagtactttatgtacattatttcattttatcctgctttgaattttttataaatcaagtttattgtggtataatttttatatactaaaaagcacccatatgatagtttaaagagtttagacaaatatatagaccgtgtgacacctagcataatcaacacacagaaaattttcattcccccacccccaaaaagtttctttatgcttctttgcagataatcctcctcctgctgtgcccaggcaacccaaagtcctttccatcactatcgattttatgcctattcccaaatttcatataaatagaatcccacattatgtattcttttgtgtctggattcttttgcttggcataatgtttttcaggttcacccgtataattgtgtggaccaggagtttgcaactttttattgttgagttttattccattgtatagatataccacaatcggtttatccattctccaatttatggatttttttttccagtttggggctattatgattaaagctgctatgaacattcttgtataagtctgggtagaaatattttatttatttatttattttttgagacagagtctcactctgttgcccaggctggagtgcagtggtgctatattggctcactgcaagctttgcctcctgggttcacgccattctcctgcctcagcctcccgagtagctgggactacaggcgcctgccaccacgcccagctaattttttttttgtatttttagtagagacggggtttcaccgtgttagccaggatggtctcgatctcctgacctcgtgatccgcccaccttggcctcccaaactgctgggattacaggcatgagccaccacacccagctgaaatatgcttttatttaattatcttaggtcgatgcctaagggcgggccatatggtaagtgtatatttaactttgtgagacactgccaaactgttttccaatatggttgaatcatttatgtttctatctgccatatgtaagagttccagtttctccacagatttgccaccctactatgtgtgtagtggtatctcactaaggtatcaatttgcatttttctgatgtctaatggtgttgagtactgtgtctttatttgctatttatataccttttttgatgaagtatcttttcaaatacattccccattttaaaacggggctatttgtttccttattattgaattgtaggtgttcttcctgtatatattctggatacaagtcctttgttagagatatgtactgtcaattatagatgctgtactgtaaaagtctgtcacttgccttttcactttcttgacagcatctttcaaagagcaggaatattaaattttgataaaacctaatcagttttctttcctttatggatcatgcttttgatgccctattatgttaaagttttaaagttggactgttgagagggaaaaggagccaatctgaaaagataatccaaggcatgactaagaaagcattagttctgaattctgggattacatcagaatcagcaggtgatttaaaaacacctgtctaggacctagccccagaaattccaatttagactgatctatggtgtagcctaattgtgaatagtctttagaggctcttttggtgatcctaatgtgcagctatggatgagaattatcaaaaaagaggtaaagtgtgtgcaaaatatgtgaaatttatttcagcatatataaggctttcattaatggggtattttgtataattctaaaggagtcacatgttaaagtgcacaactgaaatctagtatgtaataatcatttgtatttatacttttttgagacaaaggaagtagataagcaacacccctgagtttcagacatcacaatgccatagtgtgctttatgggaatatagagatgcaaggaaaagtgtctgaaaaagacacacacacacatacacacacacacacacacacacaagatagtcaagatgcttttataatcattttaagaggtcttcatcatgaggttaaataagtcattaaaaaaagcaaaataggcagaaaaagctttttagcagaaagtttataaaaattgctggggagtaacaaacaggataaatagggaaaatctacagctgatacatgttgaagtaattgacttaaaaggtttatttagaggaagtattttgctatagcagagtgagaagtttagcaatgcttcttcccccaaaaaacaagtataaaattggaaaaactatttaaaaaatggtctcagggctctgaaaatcaaccaaagaaaaataacaacttgagaaatggttattggtgaaaaatggctagaaatgtggataagaaaagtgtagattctatagagatctacagccttcttgcctaggactatccctctcccttaactcctcctaaaacttggttagcgcgctagttttagcaaggcaggactgactatgaaaaccagcagtactgctagagggggttgacttgatttgaactggaggttccaaacctattcctggcagcattatcaagaaaagtaggatacatggtaggaaataaatggggaatttttacagctctgctaacctgagtttgcagtaccagttagggctagttatgggctagtcaaactcttaacaggaagtttctggaaatgagagtcatataagggctagataagctctctgtgcctttctggctggatgagaaactacgtttacaggagagctatgtaaagtaaaagctaggacagacttgaaaagtgcctgaactttgaatgcgtcctctctcctgtctgccccacccaattcacacacagatctattagcagaaggtggaaaccttacaggcttaaggtatttgagcacaacctcttatcaatcactgacaaaccagcagatacaggactacacattggaagctaggcaaaaatgaatgaatgaatggagaattattttaaactgagcagagacatcagtggcagcacatctcagagaaacagattctgtaaactaggttggagtaaattatctaaaggaacaactatcttgtgggaaaatatcatatcccagagttgttacaatattaatctaaaatgtccagttttttttctttttaagacaagttttggctgtatcacccaggctggagtgtagtggtgcaatctcagctcactgcaacctccacctcttaggctcaagccatcctcccacctcagcctcccaagtagctgggtctacaggcacgcaccaacacgcctggctaatttttgtatttttttgtagaggcaggttttcaccatgttgcccaggctggtcttgaacttgtgagctcaagtgatccatccaccttggcctcccaaagtgctgggattataggcatgagccaccacgcacaaccaaatgtccagttttcaatgaaacatcatgacatagtcaaagaaacaagaaaatgtgatccatagtcaggaaaaaaacagtccatggaaactgactttgagtgcacctaaatatatttagcacactaagacttcaaaacagctcttgtattttaaaaattaaagtatgatgataatgacactgtaataggaatgctcagtagagaaacagaagcaataataaggaaccaatggaacttctagaatttaaaagccctatagctgaaataaaaaattaaatgggcacatttggggtggcaaaagaaataattggtgaacttcaaatagatcaatagaaattaaccactctgaagaacatggaaaaacatagattgaagaaaaatgagcagagcctcagagacccatgtggcaatatccagcatacctactaacacgtaatgagagtcccagaaagagaagatagagatacatgcaggaaaaatacttgaagaaataatggctaaacattctgcaaatttaatgaaaaacatgaattatacatctacaaagctcaacaaactctaaataggataaacattaaaatccccatctatacacattagagtaaaattaactgaaaaccaaacacaaatagaaaatcttaaaagcagcaagagaaaaccagttcatcctaaactggggaataacaagacaattaatgcctgatttcttatctgaaacaatggaggccagaaggcagtggaaggacacatttaaagtgatgaaaaaaaaaactgtcaaccacaaattctgtgtgcaaaacaattcttcaaaaacaggtgaaataaagaaactcccagatgaagactgagataaattattgctgacagatacagcttccaagaaattctacagaaaatgaaaggaaatgacaccataaggcaaatccacagggagaaatgaagagcaccagaaatggtaactacgtgggtcaatatataagattgtataaacatgtattttctattttttttaaaacacatcagattttgtgaagcaataattgaaacactattgttgagtttataatgttatatagatattacatatgtgacaataatagcacatataaggagatgggatgaaattaagctatataagagcatcagtgttggattttgctgaaagtaaatcagtattaacatgaattatattgataaattaagagtacaccttaatccctacagcaaacacaaagaaaataaagaatcaatagaataataaagtgatacaccaaaaataattgtttaacctaaagacagcagtaaaggagtaacagaggaacaacaacaaaaagacataaactatatttaaaacaaacagcaaaatggcagacataagtccaattctatcaataatcatattaaatagtccgttaaatcaactaaacactgtaatgaaaatacaaagattggcagatgggatacaaaagaaagattcaactatgtgctgaccacgaaagacatacttgaaatgcaaagatacaactaaatttaaagtaaaagaagtggaaaagatatattatacaaacagtaatcataagaaagctggagtggatatattaatatcaaacaaagtagactttcagaaaataaatattactagagattcagagggacatttcataagcataaaaaagtcaatacatcaggaagatacgatgttattagcaccatgctctaaccaactgagctgaccagccatcacatgatcttaaatatatttgtacctaacaacaggattctgaaatacatcaagtaaaagcaaagggcattgaaaaggcaatgtagatgatttaataattatagttcaagattttaagacccttgatactgacagagaaagtagacagaaaattagtaaagagaaaaggttaaaaaaaacgattattcaacatggtggtttaactgacatgtatagaacacttccccctgcagcagcaaaaaatattctttcaagtgcatttggaagtttcttcaggacagatcatacgataggctttaaagcaagttttcggccaggtacggtggctcatgcctgtaatcccagcaccgtgggagaccgaggcgggtgaatcacctggtgtcaggagtttaagaccagcctggccaacatggtgaaaccccatctctactagaaatgcaaatgtcagccaggtccacacctggacaccaggtatcagtcacctgtaatcccagctactcaggaggctgaggcaggaacatcgcttgaacccaggaggtggaggttgcagtgagccgagatcacaccactgcatgcactccatcctggatgacagaacgaaactacgtctccaaaaaaaaaaaaaaaaaaaaaaaaagcaagttttcataaacataaaaagattgaagtcattcaaagtatgtccttcaatcacaatagaattgaattcaaaatcaatgacagaatcttgaaaaatcctttacaatatctggaaattagataacacatttctaaataactcaggatcaaagaagaaattgaatgtaaaattaaagaatattttgtactgaatgaaagtgaaaagacaacatatgaaaatttatgggatgcagctaaacagtgcttagacaaaaagttgcagctttaaacatgtatattaaaagttgtattcaccgtttaggaaggtaattgttacaaattagaaaatgttttattgtatgcacaaattttagacttcgttggtttaatgttggagcctcctcatcaaaggtttttaagtctttaaatacatagcaatacattatatatatatatatatatatatatatgcatgtatataagtgcatataatatactgttaaatgctttattcagaaaagatcttgtagataatcaccaccatgtattgatattctgatatagtttgaacgtatgtccctaccaaatctcatgttgaatttcaatccccagtgttagaggtagggcccagtgggaggcctttggatcataggggtggatccctcatgaatggcttgggccatgcccttggtgataagtgagctcttactctgagttcatacaagatgtggtcatttaaaagtgtgtgtcacctcaccccgactctttctttcttgctccttctctgccatgtgaagtgcctgctcccccttcaccttccaccatgattggaagcttcttgaggcctccccagaagcagatgctggtgctgtacttcctacacagcctacagaaccatgagccaattaaacatcttttcttataaattatccggtctcaggtatttctttatagcaatgcaagaattggctaacacagattctatccacttgtggggcactgggctaagcactttatatatacaatttcatttaatattcacaatcctattttcatgcgcgtccgtgtgaagagaccaccaaacaggctttgtgtgagcagtaaagctgtttatttcacctgggtgcaggtgggctgagtccgaaaagagagtcagtgaagggagataagggtggagcccttttataggatttgggtaggtaaaggaaaattacagtccaagggggtttgttctctggcgggcaggagtgggggtctcaaggtgctcagtgggggtgatttttgagccaggatgagctaggaaaaggactttcacaaggtaaggtcatcacttaaggcaagacccgggcatttacacttcttttgtggtggaatgtcatcagttaaggtggggcagggcatattcacttcttttgtgattcttcagttacttcaggccatctgggcatatacgtgcaagtcacaggggatgcgatggcttggcttgggctcagaggcctgatattcctgacttcttatattaataagaaaaataaaacacaatagtgttgaagtgttggagcggcggaaatttttggggggtggtatggagagagaatgggtgatgtttctcagggctgcttcaagcgggattaggggaggcgtgggaacctagagtgggagagattaagctgaagggaggtcttgtggtaaggggtgagattgtggggatgttagaagaaacatttgtcatatagaatgactggtgatggcctggatatggttttggatgaattgagaaactaaatggaataagagaaggagtaaaacagatataaaaggtctaagaattgggatgactcaggatatctgattagagagtgcctaaggagattcagcatagtcctgccagcagagattatttatttacttcaagagttaagagtggcagtttggggatagcaccaggagatatcagctgtgatggcttggaaaaacagtgtaaaccggcagtgtaaacaagaacagggcatgtatgagtagttgagaacggtgaacaggagtatgactagacagaagatagtagggatgacaagttttttggggcacagtctaagttggtctggtgtctggaatgaggctggggcctaataaaaaggagcatctatacaggagcttaaatgggctgtaccctgtagcattctgaggacaggcctgaattctgagaagggaaagtggtaaaagtattgtccagtcctttttaagttggtggctgagcttggtgaggtgtgtttttaaaagacctttagtccattctacttttcttgaagacggaggaccgtaagggatgtaaaggtttcactgaatactaagagcctgaaaacctgcttggctgatttgactaataaaggctcatctgttgtcagactgtattgaggtgggaaggctaaactgaggaattatgtctgacagaagggaagaaatgactgcggtggccttcccagaccctgtaggaaaggcctctacctatccagtgaaagtatctacctagactaagagatattttagttatctgactcagggcatgttgagtaaagctaatttgccagtcctgggtggggcaaatcctcgagcttgatgtgcagggaagggagggggcctgaataatccctgaggagtagtagaatagcagatggaacactgagaagttatttccttgaggatagatttccacgatggaaaggaaatgagaggttctaagaggcgggctagtggcttgtactatagcataacctgcctttgctggtgtgtggcgattaggcctggtggaaccgccatcaataaatcaagcgtgatcagcgtgaggaacaggaaagaaggaaatttggggaaatggggtgaatgtcaggtggatcagagagatagtcatgggggtcaggtgtggtatcaggaataatgtgggaggccagattgaagtctgggccaggaacaacggtaattgtgggagactcaacaaagagtgagtacagctgaaggagccgggaagcagaaagtatttgcgtcaggtatgaggaagaaaatagattttggaagttatgagaactgtagagagtgagttgagcatagtttgtgatttttgagggcctctaaaagtattaaagcagcagcagccgctgcacgcagacatgagggctaggctaaaacagtaaggtcaagttgttcggacagaaaggctacagggtgtggtcctggctcttgtgtaagaattctgaccgcgctaaccatgcctaggaaggaaaggagttgttgttttgtagaagatgcttgggtttgagagatcagtcgaacacgattggcagggagagcacgtgtgcttttatgagaattatgccgagataggtaacagatgaggaagaaatttgggcttgactgaagtaatgggggctgtctgtgaagctctgcggcagtacagcctaggtaatttgctgagcttgatgggtgtcagggtcagtccaagtgaaagcaaagagaggctgggatgaagggtgcaaagcaatagtaaagaaagcatgtttgagatccagaacagaataatgggtagtagaggcaggtattgaggattggagagtatatgggtttggcaccatggggtggataggcaaaacaatttggttgataaggtgcagatcctgaactaacttgtaaggcttgtctggttttaggacaggtaaaatgggggaattgtaaggagaatttataggctttaaaaggccatgctgtagcaggcgagtgataacaagctttaatctttttaaagcgtgctgcgggatgggatattggcgttgagcggggtaagggtgattaggttttaatgagatggtaaggggtgcgtgatcagtctcaccaaggagggagtagaggtatcttatacttgtgggttaaggtgggggggatacaagaggaggacgcaaaggaggctttggattgggaagaagggcagcaatgagatatagctgtagtctaggaatagtcatggaagcagataatttagttaaagtgttttggcctaataagggaactgggcaggtggggataactaaaaaggagtgcttaaaagagtattgtctatgttggcaccagagttggggagttttaagaggtttagaagcctggtcatcaatacccacaacagttatggaggcgagggaaacaggcccttgaaaagaaggtaatgtggagtgggtagcctccgtattgataaagaaggggacggacttccctccactgtgagagttacttgaagctcggcgtccgtgatggtctagggggcttctgaggtgatcgggcagcatcagtcttcagccgctaagccgagaaggagtcagtcagagaaccttgggccagagttccaggggcgctgggagtggctgccaggtgagttgaacagtccgatttccagtggggtcctgcacagatgggacatggcttaggaggaatcctgggctgcgggcattccttggcctggtggtcagatttctggcacttgtagcaagctcctggaggaggttctggaggaacgcctggccgctgcggttcaggcgtttggaagttcttgtgtgctggagatgtggctggggtttgtctcacagtggaggcaaggaattgcaacttttttctattattgtacaccttgaaggcgaggttcattaaatcctgtgtggggtttgagggccggaatttaatttttggagttttatttaatgtcgggagcagattgggtaataaaatgtatattgagaataagacggccttttgaccttttagggtttagggctgtaaagcctctcagggttgctgccaaactagccatgaactgggctgggtttttatatttgatgaaaaagagcctaaacgctatctgatttgggataaagaaaaaggagcgttaaacttgactatgcctttggctccagccacctttttaagggtaaattgctgggcaggtgggggagggctagtcacggaatgaaactgtaagccagaccaggtgtgaggaggggaggcgataaaaagattacagggtgcaggagcggaggctgaggaagaattgggacttagcttgagctggcgaggagaggagaggtcagatgggtctgtagaaaaggaagattagaaagactcagcgacgcttggggttgggactgaggggacaggcgggagggaaagaaggaagatttgggacgagttgcactgggcacagagactaggaagggacagatgtgtaaaagaatgcctggacgtcaggcacctcagaacatttgcccattttacgacaagaattatttagatcttgcaggatggaaaaattgaaagtgccattttctggctatttggaactactgtcgagtttgtattggggtcaagtggcattgcagaagaaaataaggcatttaggttttaggtcaggtgtgagttgaagaggttttaagtttttgagaacacaggctaagggagaagaaggaggaatggaaggtggaagcttgcccatagtgaaggaggcaagcccagacaaaagagtagagacatggagtaggggtggggggttcttgccctccagaaaagcagagaaggggttggggcacggaaataagggattggggcgcagagataagaggttggggtgtggaaataagcgattggggggttcttgccccctaggaaagcgggacttgccgctgagggtgaaggagaaggggttgaggggtacttgcccctgccccaggaaagcaggacttgccgctgagggtgaagaaggggttgaggggtacttgcccctgccccaggaaagcaggacttgccgctaagggtgaaggaccgaggcaggcgtccctgcaaagattaaacaccaagggaaggctgccttcccagtccgtgaccggcgccggagttttgggtccacggataaaatgcgtctcctttgtctctaccaaaggaattgaaaggaattgaaattaagagaagggagagattgaagtgtggcaccaagattgaaaggagaaagaggttgagggatagtgagggaggttggagaagagagtaaaaagaggccacttaccggatttgaaattggtgagatgtttcttgggctggtcggtctgaggacctgaggtcatagg

SEQ ID NO: 381 - DNA, 99995 bp, Homo sapiens
tttcatttgtgattcggatgatgcagctctaggtggattgactatgaaagggtgagccttccatctccttaccttctctctagttggggtgcctgtgaaaccggcaggctctctccaaatgcctggattctgctgggggagtaagaagtcaggagtagtttgtctgatggtattgggatctgctttgcaattgccaagcgctaaggcacaagctggcagatgtgctgcggctctgctacgggcggctctgtcgccttcagtcgcaggctggttctttgggggaaagttgtatccaatattggtgactcccgggaatagtctgtttgtgtgctacttaatggtctctaggcttccttgtcttgtagaaccttgttagaaaggagccttggtgattaagaggctatggagtacacagccttgcttagcagatgagcccttatccatttcccgtttccttaaaaacggctaattgatggatgctgcagaaaacatgcactctgctaataagatgctgatgacaaaataggtatcaggaaaggcatttactgcttatgagcaccatcagctttctttcgagtgagattgtggctttgtagtaaagtttttttttaagtaatatgctaatagttttattctaaatcggccagcgctgaatatcttcaggaaaatgggttccatgagaagtgacatcctcctcgaatcaaaaggtaaaaattcaacatttttaaaagtgcaattttcaaaccgtttcctctacttcttgccagtagcattggaaaactgctctctaattataattatttaaaatttgattttttaaaaatattaaaggtttaaagagaagagcttagagaatttgattgttagtcattttctgaagattggctagctttggtgataaaatgcaagcaggtgctccctctgtttcccttcagccttgaaaataagcagctttttatttctttagagacaatgatcattttggagatcaataaaagtaatatttattttatgtggattttatttctagaactagtaaattaagaaccagggttaggtgatgtcaaaaggtctcttctggcttgaaaattctttacgaagtaccaattttctaaaggagccaataagcatgcctatattattgtaatcgcacttattcaaccaatgtttagctttctttagtagagcagcagcaaaagttccatgcttcggcgtacaagtaatcattgtggcttgaagtaatttccaaataattgatttttgaaggtattaaaaaagccctgatatgttagtgctttattaactctggggttttacagagctcaacttgtggctcctttacttgggtttcttacttcaagtcctcttgaaggtaatattttatataagtggttaatttcccaagatttaattttaggtatttggagacaagtactcctcggtatgtatctattatgtatatgaacacattttaatataaagtgtcttataaatttcacattgtgttttgctttgctgttatttcaaaggatctaagtgaatggtggatagtgctcaatttcctgaaatgattaaattcactctctgaagaatctggggaaaaggcctgtaatgacattttgatgactttcattttaaggtgtaatagaaattgagtaaaatgttttaatagctgttctctaatatctcgttccaaatacaatgtttttattgctcattctagcttacaattttctggtgataataatgttggctggtaattgtttcttgtatagaaatcattttatccttatgtaaaagttatttcagaaaagtcttcatgcatttatctcagctcaagcaattgcattgaactcttgagataaaacagtgagtatttccagattgcgcctactttaatttgacacttccttaggagaattaggagtgtcttaaagggaagaatatttgatatgatagtttgtagtttaaggagaaaaaccaaagaggcatgcaagtcagagaaagctgagaaaagaaggaaacaaggagtaaatactatgagtgattttactttgcttggttttactttgtttgccagatgtcatatatattttaaaatttaaaattggactaagaaataaaaagtgcatgtaaatatgctgttgttatagctatcttctttattaaataggtaagtgcagagatataaacgtgataagattaccgctaatgttaccaggaacatctttgcacctcaattctttcaggagatgtacacacaagtaacgttaatcacatagcttttaaagaatcatatcttttgggagctaaagttatgacatattagatcaattttcatgtaagtcaaaatgaaatcctgacatcaatttttctgtacaagttacacaaagccaatagcttccagactgcattgttataaatgctaattagacaaatttttatacaatttaacttgattatagtaaataattagtcagaatataatattgctgaattaacacaccattagtgtaattttttagagaagtaaaattaagctctggcatctgattacattatcctctcctgatatgtttactacatttctccaagtttgctttcttcttgtcattatgttccttttcaaataccactattacagaccagctattataatacttacttatagtttctttctgcctactataattctgcctttgtctttgtgctgtgccattattcttatctgtcacctagaaagttgtattgaatttgatgctatttatctgacccatttgcctgaatttgggagaggcgggggaaaggctaaaacctggttcattagaaattgtgtatgaagtgctaaaagatttgaattggctttggtatgttcatgggattgatattaggatatggattttcttagtagtagccagttatttgtgtaattcaataaaatctttttttcagctatcttggtttattttccacaaaacagagcatcatctaggaaatttattataaagaatgcactgccagggaggggccctcttagatagctagtaaaaatatcactctgagttactgttctaccttgttggcaaggattcatggtaaagctttatctacaggttttgtatttaatcatctttgtgatccaacagcaaattttcatttgtttcactatcagttggatagctgttgtttaaatgctaccagaatgatttaagaaaaaagttatcctaaaaagcttaattacacaatctaggactcactaataatttattcagattttaaaatatgaacattgtatttgcttaatggtgtttataatctctttttcaagagaagggctatatagactcgttacgtccctgaatccttctaaagttgctagactttatgatcctataatactacactgtatattgtacaaaacctttttgcatccttactaatatctctaagctgttcattcatgccctttatgttagttgacattatttaagcacagtgttcttgtgatttataagtctgtgaatttcctgtgtttttctgacaattgagttcatagttcaaatgcagttactgaagtatactagtaggttagtagtttccttagagagatacaaggtaacacacagtggtcaggaacatatggtttgtagttaattatcacgatctcaagtgttttaatatagtttaccgtagagatcctaaaacatgcagaatttccagaaaatatttaaagaagaattcaatttgctagaaattggaaacatggaagtcaaatgaattattttaaaaatctcctcccatatggatttagaaagcattcatttattcattcactcatgcatcaaatgttggttcagtgcctaccgtgtgccagacactattcttgtggctcttgatttgtcaccattagttcagtatttaatatattttcctgattttgtagattatgggaatcttactagtgatttatacatcatcatgaatcacacatcgcaatccaaattattttggagcatatatttctcttttctactctttaaatggcttaagatatatatattctaggcatatataccaatttagtaaaaggggaaagatttatacaatctgaagagaaaccagtgtgtgtgtgtgtgtgtgtgtgtgtgtgtgtgtgtgtgtatgtgtgtatatatatacacatttactatatatataattgtatacaatatatataaatgtatacagtatatacaatttagaagaagatattggtaaaacagtcagaatgtgcttcaagaagttatcttattgatatgtatttagaaagtctaaatttatcccattttccttattattcaggcccactctgcagcagacactaaattggttttactgtttttatgcttccttccaatgcttcctgtattattttaagggatttctaattctaattatgaatggctaacatttactttctatatgccagacagtgtgctaagacctttaccttcattttctaatttaattttctcagtcactttatgagaatggtatcatcattacgtttgtttgtagatgaggaaactgaggtttcgagaagttaacttcttcagggtcacagagctaacgagcagctgagatgacttaaaatctaggtccttcaggtgccattaatttttcttgttattcaacacatattattgagcctctgtaatgtcctaggcttgttcaagatgttcagaataaagcagtggatagaacaggctttaaagccctgtactttattgcccaagtcaacgtccttagaatacaggtacctcacaactaccttgaggcttttattatgttattttcttctgcattcaggaattccccagagccaataggatacaattttaaaatgtcaaacctttttagatctcataccatttggcttcagtccttctttccaactgtatcattgtctatttctaaatagggatggtctacactgtaaggctgatttgctcattgcccccacaaaatttgtcttgcattttctctgttcattcctgcacctgaaataattttgccactgccttctcaaagccctcaaaccttcaatgtctgggtcaaagccgttggctcccaggaagcctgttttagaaattaaatccccaagttcttttatctgcattgattatttaacacctgacagttgcaacaactaagatgatttgagcgagataatgctccacattttttaccgtgtctgtgtttgtaggtgtgcccaactgacatactggctaagagttcagggtcccagcagtgaaataagagaagaatattaaaaagataggacccgaagactaggaagtaagagcctccactgcctagcacggtgcctggcatagggtatgcagttcatacatgttttaggccaggaaaaaggagaggaggggagggaggaggaagagaatgacaatggaggaaagcttgcagggaaggagaaaataatactcctaaaatcataacctaaggcctttaaagatctttaaatatttatattagggttagagatatcattaaggaatatattaatatatgcaatacatttttgattcttcctggaatagattgtcacttttatctatattaatacatttgatatagaatggactttctggagtttctaagggaaagtgcaattgtgttgtgtttgtgtgttttccatcacaattcaggcctacaatgctgttaactctaagttgattttgttgttttacactctaagtgattatttttctgtttcctgggatatatttcagtatcataaaagttgctgaccacccaccactccccaaaaaagagccatttccttaaccatcataaagttttattagctaatacctcatgttgggtttttattttcaataaaagccgaattcaacattcaaactcctagtgcaaatctcctctatcaataaacagtacttgtggttaattttatttatatttttgcttgattatatgcaaaggtgtagcctcgaaatcttaagagagatacgtgtctgcatttttatgaacacgcaaaccaagttattaagatagaaattttacttcataggaaaatccaggtggatatttaaaaaaatcaagtactacatctgacctctgctgtaaggctgttttactggctgtaagagtcagattaatgtagatagatataaatatagatagggcttccttcaaggaggtattacttttgcataatatatgtgtagcgtgtgttaattttcctgggtgaagcaagctagaaaagttgcttcttaaaccagtgactgtaacaggttgtgtgtaccctctaacttatatgggaggaccctgctgaagcagccccattctttgggaattcctacctgctagtggagataagtgagcataaagctttggccctgaggctttgagctgtcctgcttttaagaaacaagagatatttccacagtctgtcttgtagtagtagtagctgaacagcccgtgagagttccagaaatgaactgtgctccaaatgcttatcacatgctgtgttgatgtcggtaaaatgcagaggatgagctgggctcccctttaaccctaactttctatggtgatttcattttgacactaatttcaggcataaaccttggcccttagctacagtgtgtaactgttggcatctcactgccacctgggtgcacaatgagaatagcaaatggagaacaatatttagcctctgtgatttgccataagaacgcacaacatgcagttggaaagggaaatatttaatcagccacttttctcaatgcagtcgccatcagttgagttggttgaagattttttttcctccatattaacggcttgttttgtcactgtgaagatagatcctttggcttcctcttgaattcttattatgcaaatttggggacattgcatattaatttgaacctacaagcataaaggagatattttatgccaaattcatagctcactttggtcaaaagatttttttaaaaagctcctggagtcctctgttttgttagttggccgtggacttaatatgtgaaaggctgtaagtgacgcacgaataataccattccatttttaggcatgttgtatgatgatgctgttgatctttaaaagaaattccatttggtgacatttacagaaatagttttgtgttagcagcttttaattttaattttaaaaaatattgagaatggtgtaactttcaagtggtgaggaagtcatctagaaggtacatacttacgtaatggaaacgggagacatacatggactctcatcagatgttgtgcttatattcaatccagggaaacggtttgacaagtaagaatatggtatagtgcagaatgccagtataaacaggcagatcgccttaaagactcagatccattttattttaagcctgatgtttttaaagtgctaggaagatccgaatccagagtcaagtagtcctcacttgaatcctgctgattcagtgcaatgcagtccagtccgtgacaattaactcagttacttactgattggatctctaatatttataaacactttaaactcctccagtcaattatctctttgagaatattattttatcttttggttgggtaactaaaataagataaatgggtacatatgacaaagaatttctggttctttcccacaaaagaaaatatttcaaagagttcagaatttctacatggtttggaaatgtaatttttcattccaaattgggtaaaagttggtatagtgtacaatcttttagactaaaatggttttgctttgaccccaataatcacaattattattataacttcggaaagattttcaatcattcattcactcaatcattcaattggctttttttcttaattatctcatctgaacagtgttgctaatggcactgtgaaggattttataaaaggagaaaatataatcgttctctcatcaactgtagtagaattggagagaaaagaaaaccttgaagaactaattgaataatataataaaattactgttagcaatcatactttagtagtgtgaagggaaaagctatttctgcacaggtaggaagcagtattaacaatcaaatacaacttttaggctcagaatataggttcagattatttgttgtgagaataatgagaatattcagaataaaggctaattcttggaaatggattttagaattttcaactgatttcatcagcaaaaacataaggctttcatttcataaaaactttaaaaaatgtaactatgtcatcctgttagtgattaattcaactgtctaaaaattacaaatattttactttattgaaggtttatagtaaaatacgtgtgtgtgtttcgaaggctgggggcttggtggatttattggtgcccttattcaactttgcaatagtcttccatagtttggacatgaatgtaaattgaactgttttaaaaatagtttacatcattgcttgtgcctatcttttgaaatatgtcaacttcctcactatcttgagaagataggctaacacattctatgtgatggaaaacttttcaaagctgtctttcacatcccaggatgtgtaaagccctgcccatagcttcattctctggcagaaatattataccatttacccacatagataaaaacactattccaaataaaacttaacattaagcaaagagctttggtattggttcaattctcgctttctatctcaaataggaaagtttactattttaaggaaaaacaactttgtatgcatgttcataatcattttccaggaaagccaaagattagcaggccaaaaagaattggaaaacttcactttaaaagccttgacatttttgcccttagttacctgtgtgttgaaaagcaaaggcctagtaatgacttaattattctcttcttttctctggtggagtttgtgttttgtagatgtagaaaaaagagccttgactatttctggcttctctgcccagggaagggaagaattggctaaaaaaatacacattcctagtagacatttcttattgacagtgtacggtattctgtgagctggggaagacagatacccttttattgggggcagggggaggatgtagcaaaggaccaattttcctggagatcctattacgtgaagggacttatactggacacatcatggagaaaatcagaaagaaggctgcttaataagacccactcctggatgcggccactctcaattctcagtgtctttgggaagcaaggttcgccatccacttgtctaaacagatgatgatagcagaggtgctgcacaccttctccctgtgacttgtgaatgcctttcgtgctcccaaataaggaactcctctcactgctgtctgctctgagctgtatttcattttgatagccatttgcaggggacacctttgaactccatgcaatgtaaaagatgtggttgagaaattcttcaatggaatttcttccccttttcccccaccctcattttcctctgggtgatttacagcttgaacattaggtacttagagacagtatgtctgacctacctttaaaaatacacattaagacacacacaatttgaagaaaaaagaagccaaaaaaaaaaaaaaaaaaaaaccttgagaaggacaaaggattatatattgaggaaatatagtatatggttaaattcagaaatcagaagagttgaaagaaaatatgtggaaaaaaaattgtttttattgaattacagattcagctattcccagtttcactttcacttgctggatcataatgtccaatgtcttcttcaaatttaattttagtgtcatgtctctaaagtaaatatgtttgagagtaggcatactcactttgttactattaggagacgatacacctctttggtacatctccagtgtactcattcataataatttaactttgacataaattgctcattgccttctgtcttttccccaataaagtagccaaagtattttgagtaatgttgcttccgaaaacaaatacaacttcttagctttcatcttgaaatatttaaacgtgaaatctaaattgcagtgctacatcaatcagtgtccagcagcacaaattgattgtcttgtccatatcttgtcagtaatcagtgagtttctacttctcaggtgcatgtttacttttctaggctacattgatcagtcatggtttcagccatttttaccttggagtttgtgccctgtgatttgagggcattggaaggcttttgaaggtctaatattctagtatttgcgcatacactttcaagagagggtgattggaacacaggcatctatgtctgatggcatttggaagatcttctcagctgatgtcaccttttctttctcaccttggggctgtaagagaagcagcaacctctgtggtaggaagagtacagcctttggagtcaaaccaaattagattaaaattccagacctactacgaccatggaccaattgcttagtatgtttgaaacacagtttcttcctctgtaaaataaggattataataacgattataatacccaccttagtatctttttttttgttttttttttttaccatttcccacatgtcaggcatcattttcacatggactaaaggcaaacattatgatccttcacactttacaggttactatacagaggtttagagaggttaaaagaaaaaaacacccaagaacacacatagttgttaagtagtgggtcctcttgttgattatcttattccagtagaatttgtttttaggaaaggacatgcaggtttcaaaaatatatacataataaatatgtttcccaaatgcgatttagtttaagcccttggttatgatattagagatatactaaagtattaatactacagtgttaaagctgtaatttctatttcacccacgttgctgcatcacatactgacgttgtttgagagtgtgcttttaagtggctgtggaggactatatgctatgagagctgctttatgcttttctttttgaagatgttgatggtgctctcatcttgatgagcacaactccttttcagtaaagattctggataaatgtctgttgcatggaattgaatgctagtctataaggcaatttttataccttagatgaagagtggatgccatttgcagaagagcttgacattctcagggagtcattttatagcctaaaagaattttatatttgtgattatatgactcttgataaagaataaaaaaaagagaatgatttactgggaatttaaaagtttcattctactgtggcttcatctgctgcccatttgcaggacactgataacttcagcttcttctcctgcttcatctgcaggctcttgaagtctgtgggatgcccaagtgtgtatagaaactcggaaatagcacagtccctctggttaagaataacatgtcagttttcttctcttgcttttgtgtgctctctggagctcacccatgcatgatgttccagtggacttcaaaggcaagtctatggttggattagctccacaggacagagagcaaggtaagaaataggcttagtgctatcaaggcccactggggagctgatagagccgagctatgtggtttccaaaatgatttgttcattcatgtcctcatggaagaataggcaaatttgcataatactttctattttattatcaccattaaaatttctgcattttcaaaatggtgtctggacagtactccaaaaggctgatttatagctatataatacctgcacttgaggggttgaagatctaaaaaaagagatatagatataataaatttggaattagaaaatactactaaagtcataaagacataaaatattcaaatcatagggtaatttgggatattaagaaaggaatggaggaaagaatggtgtgtacttcagaaattgcaactaagggatatttgctttccagaggttgctagcaaagatgggcttcttatagaattctagagccaggcattactgaggaaaggaaggtggaagattaagtgatttaaagacttaggaaagactttaggggaaggtttagaaataaaataggaatggttagatgatgagggtacggaggtgacttgactgagaagaatatggcagactaacgagggttaagagacatagtgcatggggcagagtcaggtgcccacatgcgctttgaagttaggaaagccagcaatataaaatatcaacgtggaaacctaaggaggaagtagatgtggtgaggtccatggataagcagtggaagcaaacctagcaatcctgctgagcattgataataggctttttcatgaagacttggagccatggaaaggcagatgaagaatcttaattttcagaaatcaaaagaccagataagaaaggccacaataatccaggtgacagtgcaacagatccaggactgaaactatagctatgatgtgaaaaccaaaaagggggataaatttaatagttgtaaaaaattatataaaacaaaataacaacaacatcagcacaatttaacactacagagaggaggattcagaaacattaaaggatagaaaaaaattaaaaactggtcataggttttgcttctgtgatagaaaagctactcatagagcaggactgagtaagaatacgcaggatcccagcaaacctttaagggaacaaacatacttaatgcatggtttttcctctgtctctgcaatgaggaagagaaaggataaggttatttctttgcactgtgatttattccattttatcttcaggatcacaagtatgtgttgcttaactttatataaagctaaaagcactttttaattgtgtagttcccctctgccagttctttgaggtcattttattcagcattgtctagggagacacggcagagagaaattgcaatctgtgtggtaaagaaatccgtagacttggtatgactgaatgtcaggttgaatctcagctgtggttatatccttctaagtgaatagagcagaaacagaaatgaattatttgtctccagaaattgtctttctgtctttgcttttggagacagtggcatatgtactaaggctggaacaattctgctttgatttgtcatcaaacacttggtattgggctttgaaagggaaggaaaatattgtgtaattcaaatgagcttttcatttgaaaatggaaggctctttgtatagctatcgttcctaattatcagtagatatttctcttctaagatgtacaccataattttatgacctgagaactactcgatatttgcttcagtatctataaaacacattttgatttaatttcttacatcgtagaaagtataaccagattatctgtagtcttctcttaactgaaaattctggtagaggaaaccatgaagtggaagcatctcatttcattgtcgtaaggaaggctgaacttggaaaaaggacttgtttaaggtcacacagctaggtagtgacagagccagggaagtctcaaagctatttatacccagatgagcctcctttaacttatggtgtactgtcccttctcagtgtaggagattctgaactgtagacaaacaccagtgagtataattggcattccccaataaatcaggtatcagtttggatgtttcatagtgtgcccatacacctatcatacaagcattattataaataaagtgtaagcactctgatagtgactgacagggcttaaataggagttaaaaaagagacttttagtgaacactaattatttaagaaattgccttttgtctgatttccttaggagatttaacaagaaaacaatacatctgactccattttattccatgttttgcttgctgtagagcctgccatcctaggaccagggcaaattgctcccaaattttctcaaatggaaaagagaagcagagcagcctctagtagagctgtggtctgggttggcactcgggcaccagtgctccgtggctcaagtgcatccatccatcctcatgtttcttttgtcccaaatgccctctcccttgtcctggtccctctccattattattctgatcgctctcctcatctcattcaaacctcttgaaaatttggtgtatctgtactttgggtgtttccttgtctttgcttttttttttttttttttttttttgagacaaggtctcactctcttgcccagcctggagtgcagtggcacagtcatagcccgctgcagcctcaaactcctgggctcaagcaatcttcccacctcagcctcccaaggagctaggactacaggtgcacacaccactgtacctgcctaattcttttattttattaatttttttgtagagatgggggtctctgtatgttgcccaggctattctacaactcctggcctcgagttatcctcctgccttggcctcccaaagtactgagattataggcgtgagccacaatgcccagtctttactttgttttacaattcccagcatctggcttctgctcctaccttactactgatgaaccagtagttcctgaattgctaaatccagtgggcttttaaattatttcctagatctctctgtgcatttgaccccattgatagctccctccctctgaaagttgcccattcccctggcttccactgtaccataccctctgggtggtcttctaattatgtctttttgcctccttcctggacttcccttcttcctcttcccctgggttcatcctcagcccgttgctcttgccctgtacacttttcctcagtactttcatccaccatcatggtttgtagctactcagacattttatttgtagtccagtctcttgtctgcagttcagactcaaatatccaactgcttgccatgtccaacaggcaccctccaacctaacgtgtgcaaactaacctcatcatcatcccccttaacgtagtttctcattctatgctttctgtctcattttgtggcactgctgtcgactcattcatctaaactagaaacccaagaatcacttttggctcttttttgcccacttttgttttccatatcaaacccagtaccaggaactgctaatttttcttttcttttcttttcttttttctttttttttctttttttttgagacagagtttcgctctgtcacccaggttagagtgcagtggcctgatctcggctcactgcaagctctgcctgcgggttcatgccattctcttgcctcagcctcccgagtagctgggactacaggcgcccaccaccacgcctggctaatttttttgtatttttagtagagacggggtttcaccgtgttagctaggatggtctcaatcttctgacctcgtgatctgcccgcctcagccttccaaagtgctgggattagggaactgctaatttttcacactaaacgtttcgtgaatccatctgcaaggctcacgatcactaccactgttgtagttcagaactactgctacttgtgatgtttcatctcttgcttggacatctgcaccatacaaatgacctttcttccatcagccttgtcaccatgcgatccacctaacatgcaacccaaagcagacctgctgtgtgcaagcttaaaaccctctagtgtttccctactctgccagataaagcacaaaatattcccaagctaaattctagccttaaatctgctgcttcctccctctttctagtcttatctctaacaatttcctgtcttgcactttgctttccagctacatgcaacagcttggaattctacacatgaaccatattatttctttgcacatactgtctactttgcctctaagtctcttctcactcttctttcctggcccactcctactttttcttcagtcaacacaagtgtgtcacctcctccaagaaactttcccttatgtgtcctgtccccacccccatcccaactatccttagccttatcaataccccgtacataatccagtcattacattaattatatcagtatccaatttatgttaacctgagctatacagttcattgatagctgttagcaacttattttcttcaactaaattcagacttccttgaataagaatttggcacagaactggaacgatctttgtctgttccactgctgataattgagtcatgaagttgttcatgtaaggatgcatttatatattttttaacttttaattttttttctttcatttcttctgaggaagagcaaacaagtcacagatacaagtatctgtcctcttctcttatgacatccatactttatgtatattttactccaaaaagaggctaaaattaaggaagatgaagttattggcttgcatggagcatcatagtgtcaaagtgtcacaagaatgtgttttctgtttccagaacaatcctcttactattttattaccttgtttctctgtgattttttaaacatttaaaggtctattttatgttagctttattcagtcacatactaagaacacggatttcccagggtggccagttaccatgccaaagaaaggcttttaaaagctttatttatccacatttcagatatatttttttcataccgagaaatagcatgctgagctttgctgtccccaaaaatactacacatgctattttctcaggaagaagagtgaggtttattttttgttaatgaaatgccaaacaagcctggccggtgtgccaggcagaattaaattgcagcatctttggcagtagtcttcattgttccatccgtgcaagtgttttatgaaaatttagctgaagcattttaaaaaaatgttttggccagattctttttagaataaagttgggacattcagaaatttgggcagtactcatgatattataaatatttccaagactggctaaataagccccattgtgatcttactcatttgattcaggctgctctttccacatccatctcgaaacttcagcccttggccaacacgagcatgaatgtagtggcaaagttcagatttacaaacattgtttgtaaagccattctatttttaatttaaattccctcaacctatgttttacaacactgtttattcactgtctctttttgttcctcctaatatcagagaaggaacaaacatacatgccttaaggaatccctttggaaaccaaagtttccaaaaagcacacatcaaaatggaaaatagacaaaaaatacattccagtttttaagtacattgtccagtttttattaacgtcttggggattggcaaacttttactgagctagtttagtgagcattttagtttttgtggagaatatgaggtctattatgaatactcttctcttctgtggtagctcgaaagcagccagagacaatacctaaagagaagagtgtgactgtgttccagtaaaactttattgacacaaacaggcagcagcctgggttgggccactggtaatggtttgccagccctccatgtagcttcccattactcctcattacttccattagtaactttttttgttttgattttcgacatcatggaaataaatattaatgctttacttccgtcacgagtaaaattgttggttatatcaaagaaaaatgcaggaatttctcaaagattagaaaaaattgatactctttaagattttaaaatttatttattatttaatttatttaatatttaatttatttattatttatttaataaatttatttatttaatatttaatttatttattatttatttaataaataaatttatattatttatttattaaataaatttatattatttatttattaaataaatttatattatttatttattaaataaatttatattatttatttattaaataaatttatattatttatttattaaataaatttatttatttatttgtttatgggggtgattagtgcagaggaacccagaagcccctcatgccaagcaccacccaagattttttctatttttgaagttcctgcttacacaactgtaagtttcttgaggggagcaaatagctgagaatttgtctcacactttcaccatgaccaggtgcacggctcacgggacagtcatattttcaaatgaatgaatgaatgactaggccactgtatgctattgtcagtttgataatattgtagacaaaatatcagacccgaatttttagtttcttggccctttgtgctctgttatttcaaaggttcccatattagttgcactaataaagggctaaagaaccacgctgttgatgatggtgaaagtgggatgtgctttcgcttaagcccatgctctgaaacagctactcatagaggtttttgtggtaagcatgtatagataggttttttaaaagtagggtacgatttttatttctagtgctttaaatctgttcagttaaaaacaagaaggaacattctttttgtggtaaatgtgggctgacagcaagatggatttactagtattttctattcttcagacttgaggttaacatgggcataatgttctggatgaagctttggaagtacttgtgaagggtaagtggccgtaagccagaaaagatggctatgtccctccatttaaaaatgttcattttacagaacaatgtgaccaacagaaattggtaggctcgatgatttaaaaaacttgtaattacactcagtgttctctatgtggaggtgttatgacttatatctcctttgtttctttaaaaaatacttgtaaaaataatagctatattgaaatttaaatagtgaaaaggagctgtacctcctccctccccaattctacttcttttcccagaagtattaattgattcttgtcatttcacacttttttctgtaagtacacttgtctatgtgtgtatgtaaagcccaagtgggacaatattatacttaacgttctacaaattgcttttcgacctaatgtatgtaatgtatcattccatgctagccaatgtaaacctccttcattctatttattactgtactgccctttatataaccattttatacttttctttctttcttctttaagcactatggactgtgctttgctaatattctgaagatacttgtattagttaattaaggagatggaaacagctcttcttcttgtggtggggaaatgaatatttacctttattaatctagttctacttttaagtgatttatgaatgattgttgatggcgttgtagagttttatagccctctgtcaaatatgtcctcagttcttacagtgatatatttttgtataaatgtgtgtgtctatagcaatacaaccataagagctatgcctgcacatgcacgcacactcacatatgcagatttatttatttcaagtagacagttcagatggccaagctcagaagtggataccattctgacatgtatctgtcttttgtgacaatggcatcctaacagatatagtgtgcagatgctgagcttttagaatattctaccatcctacaataattgctacatgcttttagtcatattaacaacagcatctttagcttcctatgtgccgaaacccttttactattcagagacagctatttttaaaatttcagaatttgcttgcagccttattctctgcaagatcttcccatctatttcaactgtgtcaaactatgataaaaacagaagaaaacaaggatagactatacatgtcactcatgttggctgagaaataagctgagagagcaagaattggatgatgaaggaataaatgtaacatcatttgaaaaagagctcttctctttcaagctatatataactcttccattgtaaactaagactattaataacaataattataataataccttagacttctctagtgccatataatttacagagtcttccttagcttttaattcctttcatctttttgacagtctcatcaattagtcagcacagagcttattatttcctctctacttcccctttctgcagttatttcttgctgctctttccacacctggtgcatcagggtcagacacgtagaagacttcccagccttgaacactacccacaaggcattatgtttgggcaacatgcttggtgatatgttagaatgtggaaatttgtgctgaggttaacatccccttaggagaatacaaatcatcaaaaagctctggtcagataacttagaatgattgaagtcatgctgcatttttgaaatagagacctgtgactattaaaaatggatagcatggattaattccaaagatttattctcagttataccatagagtcatttgcattccatccatttctctagtaaattagccactgataatcataattatgacccttaggtacaataagacaatgaaatgcctcctgaattattaaaaagtattaatttatgtctactctatatgcagtttttgagtattttactgcatttccactcactgaaaattggttacctgtacatatgatagatacataagattaaattttactcatggtaatatttcattagaagaaattcctattcctagtgttaagcaaatgtggttatgttatacacagatttcctctagatttctgtttgatatccatgatcttgactgacttgcttgttagctttaggtaattacttaagaaaaataatgccaagcatctgcctgataatttgttatgagccgacattgtcacatacattattttatttattatatgagcccccaaaggcattattaccagcattttataaaataagcctcaggaagcataaacggtttgctcaaagccacatagctaataagtggcaaagaggagacacagttccatctgtccaagtcaagaactttttccatcaaggcgcagccatcttggaaactagtctctcagcatttacatcagggcatttcagcaagccttgggcctctccacatgtaggcccacctggcagtgtgtctttttagagcttgtccaagcaggtaatatcagccaacaagtcagagatccagaaagcttgtaatcctgattatctgtgcaaagggataatgtttcccataatacattgcattccatcaacttggagataggtacgcagaatgcatccttttgtagagactgctttatttattctacaatactagcaagaccatgatagagtaggaccctttgtaatagtcttttaccataggtaagaatggtaagctttgaaaaaaaatacaggtatagacattctccatttaccttggatacaaaacaagttttccgcctttgtctgataaaaagaacaggcagtgcccactctaaagaggcaatgtgaaataagagagaactctgaatgggcttgataatcacctctggctttttaaaaaaattctaatcagaaatctgtttttaaacaagctgccctaatgtgaataagtgacatggctaccttgaacatgctcctatgaaaagcagcaaaagcaggtgagggccatctttgaggaagacagacctttgccattaatattaaataattatttgtaagaaacaaacgatgtctgaaagtagggctgatctagagaaattggaaacattagagcaggtttcaactttttcatgagatattactgatactgaatgtaaatttcgaaccagaataaagctgataacaaagcaatactacattcattcattctggaatattaaatagaaatggcttctgtatatattaagccacttataattatttctgacatgttgagtgtactggggacagagagaatagagggtgattgggagaaacgaatttttaatgggatgtcagtctttaaagatttgaatgagtggtcccagaaatgatcattctttaagtatgacattgccatttaataaacgaacagagaaaatattgaaaggaattctgtcaacattctggaacgactgtaattttgcacaatcaagcaaaatgacaagatcaagcttgatgtcatgctatacgacttgtaattgtgtgaaattataaaacttatgaacaaaagggaatgagaaatgtgtagcattggcattgggagcagcagggagatgcggagcctgagattccagttccgtcccctctgaccttgctgatatgcaaattgtttcattatgtaaaaaatagcaggggtgaaacaatcaaggtttcctaagaaaagaatttccagtttcaccacagaaaagataagttttgcatttggaacatctgagagcatctgaagtgttgtctcattaaaatttatgatcatcagaattaattcacattcatttctttaagaaccaaatcacctgggttggatttgtgtgtggaatcataaaaaaaggataatgagaaatgacagcaggtctatggagtagccaatgagagacactgggtagatgtgagcttttttaaactttccatttgatatttggagattatttgttagacttcgtatatgatatgaaataaggagtatcctttccaaaacttaagttaaaagatctaaatgtctttaaaagagacctaaacatgcaacaataagaaaaatgaaactgccacaagaaaataggaattttgtaatttgttcagaaaatctgaaaagcacgtttgatggacctcaagcagctggggtggagagagtggggtatggagtagcagtagtaacagctgcagctaataatgtttgttgaagatactggagataacgctgtgactgacactgtgcttaagtaacttaaagatgctctcagatagaaagtctgaacatcagataacttccccacatagttactgcatgagtccattcccttggctagggaagcctcatcctctccaatgaaaccaggttgccatgtttagctcctcgcagtctttgttcttcacatcccccggttgtctgtgccagtaattcacggttgaggttgctgacgtctcttgccagtagaagtcatttgtgtctttccttgtgtttccattttcctcctaatcagttaattgctatgaagaatttatttcttctctaacacttcaaccgtctccttctacccccacggattctaattctaaaactgctgctcactctgtgagactttcggcagaaggctgtctctgggacatgccatccccatctagagacctggagactgatgatagctatcccatttcaggatgaaggttttctggccaggcacagtgggtcacacatgtaatccagcgctttgggaggctgaagcgggtggatcacctgaggtcaggagttcgagatcagcctggccaacatggcgaaaccctgtctctactaaaaatacaaaaattagctggtggtgcatgcctgtgatcccagctactcagaaggctgaggcagaagaattgcttgaacctgggaggtggaggttgcagcgaggaacctaggtgggtgcagttgggattcacattgagacacattgatcgtgccttgttttcagtctactctctttgtcccagatgaggctacacaccaacccctttattcaaaactttaattcttgaccaaggcactacctatatacatcaagactttctttctttgaggattgccaaagaatatctggtctctgaggtactgggaaatgaggcaaaagtgtctctcttcactgctagctccttggggaccagcaagcggctctcaagttgcgtggtggcccaactggaaaaaaggcagttcggtgcatcctgggaatatccaggtgaaagtgtgagatttacctagaatagcttctgggcctctggggttttcacgctgtctctggtgaaggtgtccattttagaactgaagcaaaaaggtttcaatccgttccgttttctttgtatagcacttacccagtagctccatacaagtgagcactcagtaattaattttctcctagtccttgcattacactttctttgggatggaaatttctattttatgctccagaatagccatttctaactcacccatatggcctcaaagagttgggacttaaacataagcctataagcactcagattattgagaagtatgcataaaaaatggacaagctgaagatatggacaattttactgatgtttaattgcacaattgttaaaattgcatcactgccatcgaggtcaatttgacttaagtaactctgtttagaaatatgaattatgatataaaaacaattaagcaagcaatacttttatgttatttaaaaccttgctgtataggaaaagctacttttaggccaggcacaatggctcacacctgtaatcccggcactttgggaagctgaggtgggaagatcgcttgagctcaggagtttgagagcagcctgggcaacatagcgagacctcatctctactaaaaatacaaaaaattagtcaggcatggtgtcgtgcacctgtagtcccagctgcttgggaggctgaggcaggaggatcacttgagcccaggagattaaggctgcagtgagctgtgatcgtgccactgcactccagcctggatgacatagagagtccctgtctcaagaaaaaaagaaaaaaaaaaaaggctacttttagcttgttaggtgataacatcgtaaactctgatgactttttaggtggttctgtcacaatctgtaatttgtctattttctcaaaaatagggggaataaaattacttgtgaaaatatgtctcagtgaatttttaaatccaaattgtccctgtgctgaaaggatttcctgtgagaagaaccaatttttcttaaatatgtgttaatactttcacactacaatgacaaattttaattgttaatgcttagttgcagctgaaggctagtctatataaactaaatataataataacaatagttcatatttatcaaatgcttgatatgtgtcatgcactggggtaagcattttatatggattaatttatttaatcttcacaatcctaaactgtagtactattttcattcccattttatagacagtggaactaagtcataaggaaataaaacaacttgtctaacttggaataggtagcatcaggatttgacctcagtaggcctgatcccatgaggttacatttaggtacatgctctattcctaggcccaatttaatcatttttattcttacagttcctttcttatgtgatagttttcacatttacaaacatcttaaaatgtaagttttgaaaggtgtaaaggaaatcctgaatgagatttagaagaatgagtgagaaatagaagaatgagcctggcggacggacagagtagtttacagagtaaagctctagttccaggcatgttaattccactcatataggaaggaaagagccaatgtaaaaacaccactttttaatttaaatctctatgcataatgatatgccagtttcaacactgtggctaggccaagcacggcaccatctaagagaaaacagacactggcgccagactgcacagattcaaatccatctctaccatttactaactatgggatccagggcaagttacttgctgtctctgtaatcctgtttcgtcatctgttaaattgggctaatagcatctatcttacagggttgttgggggattaaatgagtttctatacacaaagcatttaggacagtgcctggcacatagtcaagtatcataaggatgtttgctatttcattatcatcaccaccacctccaccgccgtcatcattatcttcatgtcactaaaatatgtttggcaacaattttatatttatatttagacattctcagggctttcatatagaaaaagaagatacaaaattcaacttatcttggatgaacttttctaaacaaggcaattagagcaactagatttcttttgttttataatttgaatggtaatttaaaaaactaatcagccagatgttgtcatgactccatctgaagttggaagtttgcacccagcgaaaggggatttgatgtataaattgcacaactatcaaactgcaacagagtgactgaacacttatcttgaaaatcttaagttgggattggcaaaaaaagaaaaacaatgagctactcccatttgcaaagtccaagtgattagggaaaatgggtttgagtttgacctaattaatttattttggggtgatgttgatagaagtaagtgtatgtcatagataacagttctgatagattcccacacagttaaacctttgcttctgctttcttcgatgaatcgaaatgcatgcactctgaagccctctgagagcattcacaggggtaagacaggttttattcctccaaagcaatttggtcgaactctgcagctcacctatggggaaggctggcaaaattccaaaggtgattagtgtcgtttctattatttcacagggtggagtgtgtttgaatggatggaagggaaagtctataatttcatggctgttagtagaacatttctgctaaaccactttttatctaaaacattccagatgagtcgagggcacggtactgtcaccagaatcgaatgcacccatggatgttactaaatcttaactaaacaagtcagaaaaatgtaaatatttcctccaaaatgttgattaccttttaacccgtttgtgtgtgtgtgtgatcacaatcatctttttaattatttaaactctgtggatttctctattaatataagattagcattgcgagcttaacctggaccagttgggaagaggtattgcattttaaaattgtgccaccattgtcttgtttaggaagaatgacttgggcaataccaaatgttgagttatcaagtatttcgatacccatatgcatcatctgctgtaagtgtaagcatcttctcattcttatagattctttgaattacattataaatgactaccatgtcaatagattagaacaacaatcgtgtcatggcttttttgtcgtcatgggtcattttcatcaaatgttcagtaatttcattgcactgtgtaattaggtgaagaaactccacccgagcgtccatgggtcagctatgtggactctagctgccaaaggcgcttctccttctgaacagagcgctttgctcagccagtgtagacatggcctgataaacaatggaacttctcccttgagaactggagtttggattgatctaattccttaattcaaaaatgtgcacaggtttgatgagtggttaagatgcctgccttttagtgaaacaagagcttaaattgacagtactgtgaagaattcagtaatttataatgaacttgaaaggcagtagcactcactgttgcaaaagctaatcaagggactatcaaatcaaagtttttacatgagcttaaatatctgtgacagggaggttgttcgtgcaggtttatatctgtcagatcttaacactaaacctgccagagtgtaacatggtcctgtcacttttaaccaagatgtcacatatattgtgggaaacacgctgctctgcattttcttttctaggattttactaggaaaagcaaatgtaaaataaagtttttttgtttatttgtttgcttgttgttttttttttaacgctacatttttattttgcagattctcaggatgatggagtgagtgatggaataggttgccaactgtagttactccactcagcacagaatggctgcggggaaatataatcagacatgcccaaagaagtctgcttagggtgaaacaaatacctttgaggtttaaatcaggtgtgtaaagaatattggaaacatgacttgttttgtttttgtttttgcatttgtgtttgtcaagaaaagtagaaaggctgatgcttcttgcctgtttttccaactcttttaatgctataaaatgcaccccaaatttaacccattctctctcctaggatttgatatacccagtttactcccttgaaggtcctctatctcatcaaagctttagattttaaaagcatgattgtatatttttattttcaaaaagattttgattttggagatattttaaaattggaaattgaactcagataggctttaccatttgtctgttttcttagaagaataaatgctatttgcaatataagagttagctgccagaaacctaagaaagttatgttcaaattatttttacaaatagatgttcacatcacctttaaacagtagtaatggctcagaaaaaatcaagcaaagttaacatctttaaaaaaatacaaaccacattgctttacaggatgaggttgtgcttaataacgtatgcttaattcattcagaaactacacgatttttgttgctatattttgttagaaaggaaggagagactgtttctacaggtgtcatacaaaaatcaatactgagccaaggattattggatcccatagaaccacggagacttggtagtgaaattcttccaaaggtgagtaggggcattgatttcctttcccatgcctgcagaaatatgacacaattaacagaggctaagtttagacaggaaataagtctgatttgaaactgtactgtaaaagaattagtgatacttttttcaaacaaataaatgagaaaatgtaagtagaatttcaacatatacatttctcttatttattttcttagattcttttctttattctcttgggtacttttgaaaaataaaccaccaaaaatggactccttgactgacattttatctgtaattcagatcctgtgatttccacgtggaatacttgcattatacgatataaaagagtctctctcttaaacctataaccaagaatgcagcaacccgtcagtttccaagaaaaagcatattatctacataatcacaatcacacttacaaatatgagcccatcactaaccttccttatttaagctatgtatttttccagctaatttgtgctataatttttagacacaaacttgtttgtttacatattttacagttttttctagatttcttaaagctaaaaaactatacataacatactgattgtttgactgcattacttagcattccatccgtgcaggcagatggtgttcctaggtttggaaatataaatcccatgggaagtcagctgaagaccattttatgcatcactcatcctgttagagccctgtgctgttctgtctctctataaggtaagagatttattgtgaattggcttccagaagtagaaaatgttgtatgctaatggatgttccttcaaagtggcttctggagctcatacagaaattgttttataagcaaaagaataattggaacaattcaagttacgcatacatgcatgttcatctgtccccaggtagcatttggttgttctatcctaggatccacattctataatattatcttcttcatgtgaagtgagatggtaaattgttaatttttataatgaatttgagcagagtagaggattaaggaaaataatttaggcctcaaagtagaaaattgacaaattaccatcttgctttgtctggggatagatataatttgagttttagtaatttgtgggatcaaaaatggattataagaaaattaatccgggtgcagtgactcacacctgtaaacccagctacttgggaggctgaggtgggaggaccccttgagcccaggaatttgaggctgcagtgagctatgattgtgccactgtactccagcctgggtaacagagaccacatcgctataaataaaatgacattaaaagacagttaaaatataaaattcctgcacattcacagtaatataaaaacctcagtatttttttttagattattactttttgctggccagtcaaaaattcttacttttttttcttattctgaactttcagactggctgaaaccaccacggttgtttacaatttatgctctaactttggatcacctagttaatactctaactccgattattaccaaagacaatgttctataaaagatattgtctattagaaggatgcttctgcattattaataaaatcacagggaaaatgcaacattttggatgtcacatctgataaggtaagattttatcatgtctcgtaagatgtgatttcatacgattttacttatgactatcctagccccaggaaagttttcatttatccatttgatgtagaaatctatcatataaagcttcatatacaattatttaaactgtgacctaaaagccgggctactgaatatcttttgtttatgtgtaagtcacattatttttactgtttttttcatcctttgcagcttagaaaaatataactcagtacaccatacagcatatttaaattaaaatataaattatgtacatcattattcttatggggggggagccgctgggaaaggcatgctattctataaccctggacaaaatttgacttttgatgtgtgaattcttaaatgtgcacaaaccaaagacaatggcatatatactttgacacattctgaagttaaaagaggacatgaggattgtgagataagtggcgattgtgtctactattgtaataatataatgtctgcatgacaagaaaaaaagtaaaaaagcaatggcgagatgatggagaagctgaacataagtaaaattccaggtacctgttgatgcaatatgaggatactaaaatatctagccttctatgtatgctatatatactgtaatccatcagaatggaggcactgtcttcaagtccaaaaatattagtgtgttcaacactgctaccctgtatactatactaaaatccctcataatatataaaatatatattatccatgtctgagcaacgtgatacagccattctctctttgggttaagtatagcttatgattttcctaaaatgtcgcaaagataagcatctactagataattcgtgatttgtaaatatcatgactgtctgaggggaagtggcaattaagggaagcataattatcttcaatgtgaagaaggtctgggatgacaactttggggagcacagtgtctttggctccttagcattttcttgacttgctttgttgtcgtccttctggttctttctggatccatctctcttttgtttccatttgaaacctctattgtattccagttggcagttaaagaacagaaacagcaataagactgcgtggctacattttcccagtgccaccaactgggatttaagctgactaacattttgaaagcccagcccatttcattcacagcaggatggcaggtaaaagcatttctgtattaaagtatacactttgtttcttcaggttctcggtctaatttctcttgtttgccagttggggggagaaatgaaagtaggttggggatgaaatgcctggggtatttaatcaaatgcccagcaactcctgattataggatgcaaaaatttcacttttgaggattaactatggtggatttttttcaacccaaatgggtgtacccttctctccagcatgttatggggctactttctaccactgccaaaatagaatgtagtagaagaattagaagaattccaagtagttttaataataactcctgggttattaaaaattaaatatctggggtaaaaaaaatcccattaaatatacatgtttgtgaagtacctcaaacatatatgtgttttacaaaattttacgtgtcattatttgctcctattagaacaagaaattgagaatgggtttcacagtgttctgttaatttgattactgtgtcctaagtggtaagtataaacctccttatgtattttgtgaagctcacttaatcaagcaaatattataaaacacactatcatatcactatgctgatccttgaccttttggcttgtcactctcttgtgttggatgtctttttctcatgtgcatgcacatgaagcttggggacagaaagagtgaggaaaaacattagccctgctccctgaatagtaatgggctgtggaattgtctttttggaggggacttcccctgggaacaatgaaattgggatgaatattatcagtttgcattgacattgaatgcatttttaagggagcttagatcactctgtaagagtcatcttggataggtgaatggaatacacagttgcagtaggaagactaaagttctgagatgtgtcagatgacagtgataatatcataactcattttatgaatgaatcaaaaagttcctcagctagtgcccacatactcatatattgaaataaattttacaaagcctcttctttccctggagtctgcacatatcccatcttaccatggaatataaacctgctttgcttggttttgtattctatgaccatcctctagatatttcttaccagattaggtcaacagttaacagagaatacagtggaaaagtaaaataacattttcaaagttttagcaagaaaaatatgaataattaaaggtgaatgcatgtgcatgctatgactgtacctagaatcttttcaagggcttgaggtccctctgtcttagtaattagacaaattctgtagccagtttggcctcaccctgacaaagattttctatctataaatgtcctttgggcccatgaggaattttggaccctcatttattttctaaagagaggttcaagatcaacaagttcaaaatatttcaaagttgccatgcacttctctgtttaagtatagcagcattgctgtggatataaacaaaataattcagacactgaccagggcaactccacggcactctagtgcactaaatgaccccctcattgtctaataacatgaggccttacgtttgtttagtgctttctggttttcaaaaccctttcccatgatagtcatgaatgaagatacgatttagagaggtagggcacaaggatgatttttttttttttgcctttctttttctaacttgttaaatgaaaaatgctagagaataaaatgtgttttgttttttaatcaaagaaacacatataatgtgaattagagcataattgtcatggtgaggagatggggaaggaggcagtcacccttccgctactgtggtttgtaggggtccgctatgctatgttaataagtttacagctcaaaagaaggctgtaccatttctctctaatgtgacgtaaagttaatagaccccttgaacagattcatcttgaaatatgaagatcaatcatccatggttcaggtcaaatacctgctcacacatatttactgagcagactagtccaaatttttcaacaaagtaataatacaaatagaggaggggagggaacaaggactccttgggtctaggggtgtttccccaagcaagttttaagcaaaaccatttttaattggaagctttgtgatttagcttagaaattcactctattctgttagattattttactattttttaaagttttagtaataaggggctttggcttccttgctacggggatctagaatattgatgttatgtatgaatgtgggtgatatgatgaaaatattaccaattaagtttggtgcacaaatatggtggttgaaccagaattggactggttcgcatttctgctctaccacttattagctgtataaacagtttctaaacccgcttcttcacctacaaaatgaggaaagtaatcatccccatccccatagagtggttgtaaagattaaacaggataatgagtataaagcctatggtaaggggttgacgagtcttagcaatgatctttaatattgttgttatttattgcctgtctttgcatgtatacacatatcttctatatacaatttttctgtgtaatgcattatgattaaaaaaaatgttgcctaaaattacctgataaaaatattaaagaaaattctgtcaggcaatcgtggtaactacagaaactaggaaaatcgtgaaaagccagtaccttctgtcagcattaccagcctttcttgagaagtccttatgggctctgcctctctgtttttctctactgctaagacctcctttcaataaggacctgaaattcatccacacgaagatctagatgactgagaacatttgaggtgctgcccctgtgaaggtcactgaccttttattaagggtcagatactaagctgatgaggtttcaggcatcggtagcagctggagacatttgtctgacagtgtgatctacccctggccttcaggagctctcctcagagtggtaatggttaagtgggccaatgggtaaggttagttctgctgaaggtgcccgctggggctgtctatggggtttgtctgacatcctcaaaggctgcctctgtctctaagcctgggaccatttaggaatgtctgtcagctttttcgatttttttttcttttctcacatttatatctgtgggttttgtatctagttataccttaaacacaaactgtaatcctttgaacattttttcctaatattctttatttttggatatacatcaatttttttttctacccacatcctatccatatactcgttcttgcttgtccattgtatttctttcagagatctgtattcataattgtttttcacatatccgactatttttctgagatgttctcctgtaatattcttttttaaaatgtaacttgttttacctgtattttctgcacccatgttttgggatttgaacgattgggttcaaatttaagatatgccttcactagcaatgtatgcttagaaaaccatttaatttctcagctgagtttatcagaggtggaaatagaaggctctgcccatagtattgtaaaaatcaaataagatcaaagtgttttgtaaactctaaaatgatatagagctttttatgttttcttctttttctttttttttctttttctttttcttttttctttcttttttttttttttttgagacagagtctcactcactctgttgcccagactggagtgcaatggcacgatctttgctcactgcagcttccacctcccaggttcaagcaattctccttcctcagcctcccgagtagctgggattacaggtgtgtgccaccactcctggataatttttgtatttttgtacagatggggtttcaccatgttgaccaggctggttttgagctcctgacctcgggcgatctgcctgccttggcctcccaaagtattaggattacaggcatgagtcatcatgcccggcctatgtcttctttttactcattacaactagcccctcatgcatgtttttaaaaagatgggcatgaagagacacatcatgtttaataatttgtgaaaggagagataggatgatctatcttttgacatttttccccattacctgaaagaactattctgtgcattcccatgatatggctgtcaattgccttctcccagcattatatcattcaacgcagagaggagaattttctccgatgtaaatgtaagagaagaaacgtccgctggtaaacagaagcagcctgtcctgctgctttgagccacatccacaaactgtttctcaaagagttcagatccttttggagagcatcagtgtatgacatggtcatatactgactgaatcagtcatggatttcagtccacgattcatggactgaaatcaggaagcacgagtgcttcaggatcctctacacaaatgagggatgatataagttaatatttatcaagaacctactgtgcataagacacttccaataataatgactgctgacttgaggtttttgctagacactgcataggcactgaactacagattttatccaagttatttgatccttaaaccactctgtgacactggaattattacatccacttaacagttgaagaaactgagggccgtctgacaccaaagccaatattaactggattttcccctaggatcctgggatgccgatattatgatatgcattttgcagctagagccattgggacacagagtgtttaaataacttgtccacatagctctatgtggaagagctgcaatcccattcaggtcagcccgaccctgaacactccactgcactaacttgctgagtatctctaatcttgggaagaatctttctttcagttttcttttaattaacaatcaactatggattgatactttcataaaacagaatacaattgaattactagaaaaataaaattaaaacccagacatacaagacacaaactcaattttctattattagattcaacaaacataaaattactctgccactttgctataggtgtttctaaatgattgctcacaatgtctgtgcctattttgtggtggaccagtaacaaaactgctggactcaacagccagccacagacaaggctttgaggagcacttgtctaggactgtggaatatgacctagctgaagataaggcagttttcttattcattagcagaagtcttgtaggcatggatttaatttcaatatttaccagtaaggccttgggtgataccaaggtaggaaatagactaaaacacagttaaacgttaaaagtcattgcccctactttttgtgcttttttatctagggaaagttaaatggaatgtcttaacaatatacccacaggaattaaattaattttgtatggaatatgtatttgaaggcctactgtcttgtaacctacataactgagaaatgtagaccattgtaaattagcttatttgataaaataggtataccactatattgcaggtatattactttttctccagaggacaggctcattgttgtgttgattaattaacattctcacccaccgtatccaagcaggttacagaaattaaaacttgcaggatgacaaagccagaaaagcaaacatttctggttagttcccacagtgacactacagaaatgcctgtcacctgcctctccttgctgggcagagcaagttagctcagcattggtccccttttcagcatttgtcaaagcagatcttagaatggccatgaaaaatggctggttagtgtcattcaggggagaacagggactatagcaggtacctgtctccacctgtcgagaaatatccacagaaaatagatgagagaacaagccttaataaatagatgacgcaaaagttgctatttttgtgcttatttggcaatattatatgccagatttcaagacaaaacttagtttatcttgtttcctggcccaccctctcaaagcacattactgctgcttggaatgccgcactaactcagtattagtatgagttacggttgataatgattggactttaactttaaggaagaggtactagattagaagatctgtttggaccaatcattgcattatatgtgttgtagtcatgtcaatgtaggactttttctgcaatcagtggaggtaaaaatagtggcagaaagtagaaagaatccttgtttgtcttataatggagactttcttggccattaaattggtgaccttagtgtcctgaagttcaaatgaaactgcttcattcttgttcttaagcaatgctttgtcttggtgtaaaatctattatttaaatttaatgtaataattcatgcactgattattcatttatggagtgcacacttatgcaccaggtcctgtgggagattgctagatcttggagataaaactctgaatacttgatttttccctcaagaagtttccaccttggttgtggaggcacacagaggcagacattgaaaatattgtagcatctgctataataaatgattttttttgagacaatctcactctgccaccaggctgcagtacaatggtgcaatcacagctcactgcagtctccactttctgagctcaagcaatcctcccacctcagcctcccgagtagctcagacaacaagctcatgccaccatgcctgcctaattttttcttttatttttaatagagatgaggtctcactaagtgcctaggttggtttcaaacttctgggctcaaatgatccacccacctcagcctcccacagtgctgggattcccaggcatgagccactgtggggcctctatgaatgtagaactgacaagctctggctgtcaagtcaggaagtgcttcacaaaatagttgacttttagcctagataaggaaaaataaataagagttctaaatgtagtaatagtaaacacttatattgatattcttgtacaatgtgacttccttgggctcttttgattcatgacctattttcttgggagtcttggtctcccaatagagcacctgttttcatggaatctttcatgttatttctctgcttttccatgtcatgttccttgtgtctgggcaatagctaaaagttagtatggctaaaagcaaattttgtttatgctttccatatctctccactgcctgtctttaccatattgatttccagcagcttccttctagtttcaaaaacttagcatctgttgattattttaatttccttcttctcctatagcaaaattcatcaggagttaacaggctcccaacttttaaataggactttagccttacctgccaggatctgcaatacaaggcacacctaaatagcatttaatttgtttaaacaaaagcttatactgactcaattttatcgacgtgaactttgaccacatggagactttagtttgaaaaaattaaaatgggtaaattatctatagtgagattagagaatttcaaaaacactccctttctattattgtttattttttttaattccaggaaaaaaaaaaaaggtgggatgcttattaaaaaaaaataagcactttgaggactaatgactgtaaccatgcactgctaactggcaaaccagacgaagtccacagacaaaaaagataatgtttaacaatgggaaaaattccccaagtgagccaaataggcctcctcgtgatgtctggctgcaaattagacattggtgaatccacccaaacttggagtcattaataaatgccaatgctacagtaaatgtcagctaaagtgtgaagggagcaaatccctgcatgcttcaggaaagtggaaaaagtccatctcagatcttatttttgtacagacacactttctattcccatctagaatattgcagttcagacatggataatgactaatgcatcttaagatgctcacagtcactgcttgataaatatatgtcactattcatttattaagaaagaccaatacaattaaaacttttttttttcttcttttctgagagagagtctcattgtgtcacccaggctggagagcaatggtcccatctcaactcagtgcaacctctgcctcctgggttcaagcgattctcaggcatgtgccaccacgccctgctaatttttgtatttttagtagagatgtgttttcactatgttagccaggcggtctcggactcctggcctcaagtgatggctcactcctgtaaccccggcactctgggaggccgagacaggcagatcacttgaggtcaggagttggagaccagcctggccaacatggcaaacccccatttctactgaaaatacaaaaattagccaggcctggtagcacacgcctgtagtcgcagatacttgggaggctgaggcaggaaaatcgcttaaacctgggaggcagaggttgcagagtggagagattgcttcagtgcactccaacctgggcgacagagtgagacttcatttcaaaaaaaaaaaaaaaaaaaaagaatgcacagatgcacaaactttaatgaataggtttaatctaaatcttaaatactaggtttcctaaaatacgtttcttattttatgtcagtattttcatcataatattataatattgccttaaaagcattattagctcaatgatctacatgtgtaaagagtatgatatcataaaaccttaccttttactttttggcttttgtattaccaataaagagggattctgagaattgtatttatttttgtgaacatgaagaaaaaaggagtccttagaaaaattagatttgcctgaaggggtcacttacatttattttaaatatttgttttcactataccttggctatcctaatgcatatggtttcagacttcaatttgttttatatccaggataggaggatagggaaaatgagtgagttctctttatgcattgctctactgagttctagcctttggacacatagaaaatgactcttggactttctctctctgatgagagaaggaaatggtaaagaaagtaatataaaaaggattatcttcctggaaaccttggtcgcccctgttagagagtctctcattttaatcttcatgttatgttcacttttatttcactttgctagtcatggcttatgaaagattttaattgaaaaatatttgattcttattttctctctgggatttatactttgaaataagtgaaatttagtgtctgacatgcaaattattcagcagtgtctaaagcaaaatcaatataatggtttttcttaaggcacttgcaagagcaattagaaatatattaatagttaactcactatgcttacagaatcacaaatgagcatcaaaacagttctgatttaagaaagtctcggcaatcagtgatgaatgccagtctcgtcaaataagtggctgcttgaaaagtatttgggttttgacaaaactttaagcaaaaattgacagcagcatagggctatgtttagatctcttgcatggtagcacactagcagatgcttggttctgacaacaaagactgaacaggtttacagtgaaaactcagtaacatttgtgttctgcagtaatgaattctcactgtgaatcacaagtggtttctttcatgcaaaccgtaaatataaatggtggcaaagctatgcattacatgttttactaacttcagtcattcttatccattaacttacaaaacgcacatatttgctattgcatattaataatggtgtggatggtacacaggtggcttctgttttactaagatcacttttattttttatgtttctagagctttcaatataatccagagagaattttagagctgggtttaagttttgatatcactgccatgacaaggtgcttaaaatgaatttaagatgtctacttataaaatccttgttaccaaaaaaattcaagatttcaatttgtacattttcagatggatggaaagaaagtatggttagatcttagtacctgaaaaccagtttattatcttatacattgccaagaggatgaatatacaataaatgtaatacatgcaggtgtgaacatttaaaatattaatattgacttctgtataaatgaggtcaattaattattctaaaaacccacatattttaataaaagtagccattataactattgtaagtacatgtaatgatacattacacttttaatatataaaccaggtaggtagattgaaaaatataaacattcgtgaccacattagattttatattacagtacaattaaaaggcgtttattagcatcaaactatcttttcaaatgtccaaatttataacataattaaaactttatagaacagctcaaaaccctatttcttttatgactgatttatctaattcataaaactaatctgtatttaacatgagagacatattgaaatcaaaataatggtgagcctctttccctatgtgaaattccataattatttttcagcgattaatataaaatacttatttatcaaaaatatttgtcaatatgaactgataacctcttatcttccaggcactgtgctaggctcaaagatagagatgaatgagataaattatctgtcttttaggacatcgtcaagttgggatgagaggaaaaatcaataaattgccagacaaagtagagaaaatttagtgtcagaaaatccctatgtggtaactgggaaatgtgtcacctaaaaaagatgacatttaagctgattgctgaagcatgcggattgaagacattagggtaatctgtttttttttttttttttttttttttggagatgtagtcttgctctgtcacccagggtggagtgcaatggcgcaatctccgctcactgcaacctctgcctcctgggttcaagcaattctcctgcctcagcctcctgagtagctgggattacaggcacgcaccaccactcccggctaatttttatatttttagtagagacggggtttaactatgttggccaggctggtcttgaactcctgacctcatgatccgcctacctcagcctcccaaagtgctgggattataggcatgagccactgcgcccggccagaggaatcattctaagcggagaagataacacctgcaaaagtatgccacagttatgttgggaatttcaatatgatggagctctgagtgtacatgtatgtgaggaaaaggaggtaaacaaggagttagaaagatgtgatgagaccaggtggtgatggactgaatataaagcaaagacatctggatttttaattctgtagggaatagctgaccaaggtatatgattacatgtctgctttttaaacagctttgtgatttgaaatgctgggttgttattgttttttttttgtttttgtctttttttttttaaaaaaaaaaagatggctaactctgccaaccatagacaaatatgcatactggcatgtggagaaagaagacaggaattgttagaaagatttcattattttccagcctccaaaataatgaggtaattttaggcatagtaataagaatgaggaagacagactagattcaataaacatttttgagttagtatctgcagatgttagtggccagttgaatgagatggagcagagagagggagaagttaatgatggcagtgaatgttctggttgaaaataccacagtggatggtcgtgccactatgacttataccagaagtaggccaatttaatggggctggagagggagataaatattgtttaaaatgcctctaagaaatcctggtggagatctccagaggttagtaatatgaacatggaactcaaaatgttgtgagtgtttcattcttattttgtatgtcttgagacagatgagtgttgaatggaggaggtagtatttgtgaggctgtagaacctcttttttctcaacatctaacctgggagaatgaatgaaagcatggaagaacactgcagctgggcacttggcaagccagctcacattaaaagaaagtatagaatggaagagtctgtcaaagtagacacaaggaagcgagagacactcagaccagagtagccctatggaaacgaaggcaaaaatggtcttgagcagaagaaactcagtggtatcaaatttcacaaagtggccaagtagcataaagacagggtggagtagtatcagacttttgttggaaaaaatgtttatgattacctcagagagagtgaattagtgggaatataagttatagtataatggatgaattaatacgacttgaggaagttcagagtcagcaatggtaagaagggaaataaaatgttatctataagaagtagtatgaccaaagtaaggctttcgagaaagtgagagagttgagcacattagaagggaaagatgtttataatgaaagaaaagaaaagaagagaaacactaatgaaacaactcctgggggaggtggaagagagtgcaagccagtgctgtggagagaaaaatgtatacctccctcctccaagattagaggaaagaagctaagcatgattgtcaactggtaaaatgagatttcctcctcctggggtcctttattctttcagaaggaggaagaaaggtggtcagctgagagtggacaaaaggagaattgtagagatttgtaatagctggtttgaagactaggacaggaagctgagaagatgcaagtgaagggatttctgagaagcagtgagatgctaagttaagactggaaaccatccccttatactggcatcagtctgcccagggtgtaacttttttgttgttgttgtgttttttttgtttttgatttcttttttagcatcattgagtagcttcagagcagtagaggaaatctattgattaatttacccagagtaggagattaattcaggagtttaacagaaggacaggaggccaaaatataaatgtctgaaagtagtaacgtagtggggtagaaactagacggtcaagaattacaacattgcttctgctttttactacaatcgtggaggtttaggcagaaaggcttaatttattctgaggcagctttaaaagaagacaaatatttagacagaaatcagcttctctttttaccagattcatcattgctgaagacagcataaatggaggaaacctagactcactggctaattttcttgaggttttatggtaaaatgaattctcggaaagttcatcctttgactaggattttaaccaggagaccgttgttactttgtttcaacagctgtgttaccactttccttctcccttgcattctagttagtatggaataataaaagattgacctttagaaagggagcattatcaatttatttataaagatttcaccataggcatacagctgatacttgagttcctctgatctgttgatgtcttaagtcaaacctataatttactgttattgaaatttgttgaagtctgccttcaagtataaaaagctttttcattaattcgttatatgggatacggcatagtggactatatactgaattgcaggccaggttctgccctcagccacttaagtccaaatacatcactttatattttagggcctcactgtaattagcataaaaagaacctctttcctctgaggttgagacaaacagcctgccttgtaggggaagtcaccttataataaaattcccttaggtggacaactaagtgagttctacattctctccttctctctctttccccatctctctccctcccctgacccttctcctcccctctcatactgaataaagtcagaatattctggagacaaatacgagtaagatcaaacatcacctccttatctctcactccagtccccagtacaggagccctggattgatggaggtgcccctctgttttcctggtgcaaatgtaacttgttcaattatacagccagtcaacaaatatatattgaatgtctgttgtgtgataggcatttttttgggtgatggtgacatcagggaacccaatactctgcagtactatttttatttcactgtgttaaaattttatgctcatttttatgacttccccactagactatagctacctggggaaaataattttgccttatttcctcaaatctcaatggtctagcacaatgtttgacacatagagggtggtcaataaaagactgctggataagttaattattagctaatagattaatatacatgtacactcatttatactctgagatttataagagaggaagcatttatggaagacatagtaagtatctgctatgtttcattcaaagaaatacatttaattaacttggtttgttctgtgaccttagaaatgaagcaaatgtaggattttagagaaagttacagttaaatttctctaagaagcgttttctgaggtgccaacaatagatagaggcatagaaaaatcctattcataaaaaccagaggggcagattaagcccacagagaaaataagatctttggttttcattgttagatctaataagtgatttccatgagtcacttatttattttgtaattgagcaagtaataaaatgaattgagcatccacagctttgctacaaatgaagatggaccattacgtgctcttatttaatacgaaagtaaattttcatgatagtttaaaaaattggtacagtgtgtgttcataatgctattattcaaagaggtgattatccagttcctcacagtagaatcttagttattctatttgaaaggaatgttttcaccaaattgccaaattcttcaattcattagtcaaagttgccataatctttgatcacatagggagttacttcttggttacttcctgaagcccagtaggtgaaacagcatttgtcttgcatgttcactctatgtgacatccaccaaaatagtcaaaaatttaaaacaattcaattaatcaccagtctattttgacccattcccaccaataaagtcgataggctgaatgttattttccagtcactttttttttttaagttgaactgagtagttgatttgtcattgtgcaaacacaatttattcacatggagtccataattgggatcttgtttctcctctctgggatctttttattgtttttcacttcatcaatttctgcagccacagttacgaaaatccaaaatttgacttaaatttcgaagttgaaatttgtgttattatttttgtttgagactggagcagaggagggaaattacttcagggaaaatgtttagtgggcaattataataaactctctgggaaattgtacttccttcttttttttttttttttgagatggcgtctcgctctgtcgcccaggctggagtgcactggcacaatctctgctcactgcaacctccgtctcctgggttcaagtgattctcttgcctcagcctcccaagtagctgggactacaggcacgtgccactacatgctgctgatttttgtatttttagtagacacggggtttcaccatgttggccaggttggtcttgaactcctgaccacaagtgatccacctgcctcggcctcccaaagtgcatgagccactgtggcctgtacttctctttattagagcaaatacaaattaccctagagagtttctctttagaaatttcttgctattttttcctttcatattctctttcaattttctaaaaagaactgcataaggtagtgaaaggaatataggatttgaattctgaagtatctgattttgaatcctggccctggaatttacttttggtgtgacccacagcaagttattaatcttactatgcctcagttgcctcatgtaggaagtaagtactattttgaagagtaaatgaaataactaattacagcagcattaaaaatggaatgattgatctacagagagatgtttactttgtagttgaaactagggggtatgaaaatggcaaaatgactgagtccattaagtctcataggctaactagggccattactttatagcaccttttatacatacaccttcatgtgtatacctgttggtatagttttagctattggaaacaatctaaatcaacaagacaatattcaatagttatgtgtccggaattggtgagttcttagtctcacttcaagaatgaagccgcggaccctcgcagtgagtgttacagttcttaaaggtggcgtgtccagagtttgttccttctgatgttcagatgtgttcggagtttcttccttctggcgttcggatgtgttcagagtttcttctgtctggccgagtctggcggattcgtggtctcgctggctcaggagtgaagctgcagactttcgcagcgagtgttacagctcttaaggtggcgcgtctggcgttcctcccggtgggttcatggtcccgctggcttcaggagtgaagctgcagacctttgtggtgttacagctcataaaggcagtggggacccaaagagtgagcagcagcaagatttattgcaaagagagaaagaacaaagcttccacagcgtgtaaggggacccgagccggttaacactgctggctccggcagcctgcttttattctcttatctggccccacccacatcctgctgattggtagagccaagtggtctgttttgacagggcactgattggtgcgtttacaatccctgagctagacacaaaggttctccacgtccccaccagattagctagatacagagtgttgattggtgcattcacaaaccctgggctaggcacagggtgctgattggtgtgtttacaaaccttgagctagatacagagtgcccattggtgtatttacaatcccttagctagacataaagggtctccacatccccaccagactcaggagcccagcgggctttacccagtggatcccgcaccggggctgcaggtggagctgcctgccaatcccgcgccctgcgcctgcactccttagcccttgggtggtcgatgggactgggcgcagtggagcagggggcggcgtgtcggggaggctccgggctgcacaggagcccacggaggcgagggggaggctcaggcatggcaggctgcaggtcgggagccctgcccagcgggaaggcagctaaggccaggtgagaaattgagcacagcagctgctagcccaggtgctaagcccctcactgcctggggcctgccggccggccgctccaactgcggggtccgccgagcccacgcccacccggaactcgcgcaggcccgcaagcaccgcgcgcagcccgggttcccacctgcgcctctccctccacacctccctgcaagctgagggggccggctctggccttggccagcccagaaaggggctcccacagtgcagtggcaggctgaagggctcctcaagtgccaccaaagtgggagcccaggcagaggaggtgccgagagcaagcgagggctgtgaggactgccagcatgctgtcacctctcagttacaaagccctatatggtttttgtattttaaaaatcagtttcatgaatagagaatggaagggctctggcttgtcaaaaatacaaatacgcaaagatccagcagctttaatggactgatttattcctacactcatttctaaatatttattgagtagagtgcctactatgtgctcgatgttgaagatggagagggagagtcaacaaaacagaccagagcttctgccttcatagagcttctattctagtgttaacctgtaaatttaaccctaaacaaatctgatgaagctgttgtgaaagagaaagagggaattagctcttatattacctatatagacgcagtttccaactacagtaaattagaactgcaatgagttttatttttattttaaacacacccatattcttatgtttatttttggtgatgcaaatcaaaaggggtatggatcaattggagtgtcttgggaagataatgccatgaatttttctgaagaccatgtgctatggtaaatggtgtgctatgggaaatgggtgaaggaactgtataggttatgtccagaaaagaaaagggtcaggagaaatgatagctgacctcaagcagtgaagagctgcctcaaaggaaaggcaacagatggagtttactttgttccactgtaggactggaagcaaacagtggcagttttttatgaggtagatgttagctcaagacagaactttccaattataagggttattcttaaataagaggttgtcaaggagcaagaggtcaccagctttctctttgcagaaggtaactcagcagaaactggaagtacaggggcaagagtcaagtcttggtaagagactggcaaagtgtgctttggattctatgactctgaaacaccattcttgctctgtagttaattactgcaataattcatagcctacgaaagctcagaggcaacatatttccagatgacaacatccttatgggtttctgacctttaaggtttcctagaattttgcaactctataattatctctgtacctggaaaattctataggaaatgacaatgaagcttttcttacttgtcaaccatgttcaagaaatgttttctgagcatatggatttcacttttgttttccaaaatagtgattggagatttgcctgtttaaatccccccaatttttagccaggattgaaaatgacaggttattctaatgcccaaatattaatttctatgccatatctatatctatatatttcattggccaatcttctttaaattttctggatttcgattagttcattctgaactgttgacaagctaaatttagctaacaattcattgcattaaatgcctgttcattcttggaaagtatattgttttttttttttcttagcaaagtgacaaataccattttcatgacaataatagagattgattacattttatggaacacagagtaagagctgatcttagtgagacaaccttgggacttataaaagggaaaaaaatcatttgaattaataatgaagttaatgaattcatctgttgctgatgaaatagaagtatttagagaaaaatgaaaagttctgctgctacacaaacactgtcaagaattaagaccaatttcagtactttggaggtgctggttttgtgaaacctttttttgtgtgtgaaaccttttaaaaagttaatactcactgttttcaaagctaaagctatgatattgatctctggcttacctaagcatactgcgtgatagtaattatattgaaagacatttttcaattaagttaggaaaagagtaaatcatgatcaatgaaaactaaatttgaactattaagaagcctatggggagcagtttatgtttctgatatgatttatgctctaaaatttcactagtttcctttacactcttaacttttcatagttaggcctaaactaaaccaaatattcatgtgctttattattcttccttgcttctcagtatcactttccttatcacctaaaaggcattattaaaaatcaaaaaacaaaaaatctgcacatctattatagtctgaatgtatgtttttagagaatagaaataagaaaaaagggaggtatttaaaatgttgaagtaagttgtggcagacctggaagacaatgcatggctaaagtacagaattactttctctgaaaaatctttaaaacaaggaaaccagttcatgtctgttcagggaccttgccaatttcttcatctttcatccccatcaccttagcattgtaccaaacatagtatcaaacacacagtaggagctcaataataattaagtgaataaacatgttttcccaatagggaaaataaataaaaatcatcatagcaatcaatgtttgttgagctactaatttgtgccatagaacttatgtattttatctctaatatttgtaatttttacattgttatagggtgataagtcccaggggtggggtaagaataaaaaaatgagcattgatgaagctgaataatatttaaatagcttctgaaaatatatgtttatgtatttggcatggttatgaagaaaaatgaccatgcctgaggatttgagaaacaccagagaacttactgtggatatttttaatctatgattgtgctattattttaaaatattttccaattgtttcacatgtatatattttgtctcttctataaactctttgttggtaattttttctttttggtctttcctagatgctctctgtatcatctaactacaactttgtattcaaagagtttctaaaaatcataggtcattcctatgatgaatctccagtttttagagatgtatgatacagaaactatgtcaacagtagttgactatttctttttatcatatatcttgagaaatcctttatattattttttccttttattggaattgtaattttacattatggaaggaatagttttgctcaagaacctaatgcttgctcatattgtaaaccatggctcagtttgtaaaccatggctttgaaagtaacgtaaataaaacaacaggtgtagggtgtgctaattgccgtcacattttgtaaaaccctgcagtacataacttattcatcatttcctatctgaataggtttggcaaaactgttcatttccctgtaacatacacagccagcaagggatacatgtatatcagtggtgctattaaatatttgaaaacttgattcaatgtacattgaatatatctttataatttataaaattaaaatttacttttttcttcatatttcttacaattaggagtgaaggtagattacaacaaattgctgaaaaattcacaagtaaaccctaaaaatacataaatcttcctaattatatagagaaattcatgatgaagttatgttctttctatggtgtttgaaagttcaaagaacttttctgactcaaaagatttatgttagttttgtgttaattgctttagaaattgctatataggctatagaaaaaaaatccatctttatattacataaaattagtaatttaaagagcatctattgggcatcattttgaaaatgaattgctgtaaaattacttcctgcatattgcaagctacaatattgtatgggaagtaaatacctaacatttacaatattctatgggaagtaaatacctaatagtattattatgagttgtatagtcttatgaaaggtatctaatgaatgatcaagtatcataattacataatttagcctataagttctagtattatgtgtatgtatttatttcagactctactctttaaagattagatattataaactctcctcttatcagatggaaagattgatagatgaataaaaatggaaagctttttgtaacataaaagtcaatacatacatcattcacttttctgaatggtttttaaagaccgtaatttcacttaattttgagaattaatcaaacagaaaggaagccagcttctccttcacaccatcttcaagtggcactattttcccaagttatttaaaatcttgggcaagcatttaatatatttttcaaatattatataagttaaaattttaagtttattaagttatagaagagttttactcattgttaaaaaatctgagtgatacagacatgtaaatcaaaaggggaaagccctatcttcacttctttttccattctccagatctgccagttaaggtttttctttaaagaaagaaaaacatatatatatacacatagaaacactgcttttttcattaaaaattggattattctatatgtatttttctataatttgcttgttcaaatcaatcatcttgagcattatcccacaataacaggtttttcagaatttgagatcataactgcatagttttccatactacacatgcactttgatgtaactatgcctttgctgatgttcttgtaaattgtctcacactttttttctgtaaattaataattatatgaacatctgtgtatgtgtctctgtgtgatccttctatttatcatcatgggcttctgtagttacttttctaagctagactatagtcacttttttattgttaaggaatatgtgcattaaaatttttcttacgtattaccagtggttccttgaaatggtgtatcagtttcaactcccataaataagtatcaattgtcctcttcacaggaccttcaccagcactgaatattacttagtctcttaatttttgacaaatatttcagtatttatggatgatttattaatttttctaataattatccaaacttatttttatttctctgaatggttagaattgagtaagaccttctgaaaatggatacttgaagtagagttatcagagataaagtagagcactttttaaaagttttttttaaatagaaatgttttattgaaattagttcaatttaagtcattcttaaaaaataaattggaatactgatacatagaaaaatctgatgagatttgggattaaggacttctgtttttaagagaactgaaactattgatatttatttggagcaaagatgaatattattaccatacactttggttaaaatttaaaaattctgatttgaacttcttgcccacagtttcttcctgctctctcaaccctcccttcttaaagtcctttaactatatcctttagttcacttctcccaaaatgctttaaaggtttctcactgcctcatagagattaacaataatatcataatttgtgaccttgttcaaaaatgcaatttccaggtctcatctctgaagattctaattctcagtgtctggaatgggtctgataacctgagttttcaataagaatgttaggcgattctcaagactatcttgagacagactgaatcacacattccctctcaagttctctcagactggattctaggttattctgtctctgttctttcctcctggaaaaccaattccctcctctctacttctgtctttaccttatcaagtcctaagtcaaatccaaccttttgcattttttagaaaaaaggtctcgttctgtttgttgtccaggctggagtgcagtggtgcaatcatggctcactgcattctcaaactctgggctcaaggatcctcctgcctcagcttccagagtagctgagactacaggcacctgccaccatgttcagctaattaaaaaaaaaaaaatgtttttatagagatgaggtctcactatattgcccaggctggtcttgagcttctggcctcaagctattgtcctgccttggcctcccaaagtgtcgggattacaggcacgaaccactgcacccaaccaaatctcacctcttcaatgaagaattctatatctttatccctcaatggtcaacttctgcattgtacatcttcatcacacatttggtacttagggtttagtactgttacttacagctcatgtataattcttctctttgtctctgacagtcccttatacataatgaacactgtaaaagtgtgttggttggttgactgagtgataatgtaattagactatgaaggagcaggtcagagtctgtacgtcaatcccaggaaatcacttcttgacatttggtggcttgttttactccagggagatttcattgctatctcttcaaattggatattgcttgttttggtgactacaacaaaagctaatgcttaccatttgttcgagtttattaattgcatatttgaatcagtctacatcaagtgcgtgacaaattttatccataccaaagttagagttttaaaattttatttgaaatttaatgttccacaatcgtataattttttccccagtagatctatgttcccaaaggcctagcttgcttagctctttgaaagtagttcagctttcttaaaagaaaattgtttagatgttcagaatcggttcttatcagtagctacaacataacttttttgtgaggtcattagaataaatacaacatttctcacaggcacagaatcctaagtgcctgtgctatcttcttactatagttatagaaccagcttatataatttggttttgctttaagtataatgtggcaatgtgttcataaaaattgaaatacacttcatgctactaaaaatgataattttctgagaatggaaaacaagactagcatgtatttaccaatgttattcaagattgtctcaagaaaagcattattcatttggaaaaaataattgatcacgaggtaggcacactgaaatactgttttaaggaacaggaaattttgcactatctacttctcttattttgaaagttcaagcgcttggtaaagtcaccttggaaaaatggaggtgatttattaatttattgtttgtctggactgacagtgtcttgacaaataaaaagatatccatcagacatatctatttctttctcttaaagctaacaatttagtacaatagtggaacgtctttggccatcctggtctcctgtaggtttggctgtggaggagcaggtgcgagcttccaaagtgtctttacaagtgtcgcagtggggcttccctcccatgcctctgcaggagacagctcatctgtttaatccgtatgttttagtcaacctttcttattatgcagacagggctctgagcctcagctggatttttgactctctgaatgaattgatggggctctttgatcttaactgtgtattgcatctgtttcatccttcctcttaatgcagtcttccatactcttattttagtgggtgctcctaaattaaatttaaaattataattaataattatacaaacaaataaaaattgccattataaaacctaggcacaaattccacttttcatcttggccttttatttttctttttggcatgcatgataaactttcttgaaaaatcccccaaacgatttttaattctcttgctttataagggactaccagacttgagagtatttaattaggttcctatgagtgtgtatgtgctttgtagggccaggtttgcataaaaaatgggaactgccaatctttgcaatttagtcaattttatgatagcataatatctttttaatagaccatattggagcaaaaggcatacaacctacacagaaaaatctaccatggaaacataagaatcctgctgggcagtgttcctctgtttgataggagtgagaaagtctgagttgcagagaaaatcagttagaatcagaacaaatccatatggagaatccattctaggtcatagggtgctaaaatataatctttcttgaaacaaatctttaaaatgaaatgtatacattcttatgtgaggtgggagagaaggaatattgagggaacagtgaagggatattgtttgcttacccacctgtaatcatttagagttatgattaattgagccagaaagtatctgcttttatatgagtgacctttgatattctaatctggtattttggagacttgtattaattatttttaactctctatgaatcttcatttatctttaagtataccatgatcttgtgatgataacgcaatgtcaaagctgtcagaataatttcagctgagcataaaactgatgttttctaagagccaaaagcccttgagagagttatgaaaaagtctctctccaagaggaggaatattgtgataatgaccttttagtttattaaacatttactttatcccaacatatatatgtatgtatgtatatataatatactaataaccatttaggaaatatcagaatacattttttccttagttacactgagatataaaataagtatgtaaagaatttaatttctaatcataactctataatactgctgttttaaaaacattcagataactttctttcattcaaaagtatctctcaagcccccgcatagtactcaatcctgaactggggagattttcatcactatttttgtacttcccatatggaatctgagaataactgtgcaggaaggaaatgtgaaaggttactcaattcttctttaggcagagcctctctgaaaccccctaaagataattttaccccccaatattcagtttgtctatctctccacaaactgagatgtgactttatttatttattttcccagttaacacttcaatttgaaagaaagcatctagaaaccagccaaggaaacatagttggtttcagtgagcattttacttagattccctgattttgtttgttttagtttcttatctcacatacttgattgctgtgtttcttctattaaagtgaaatgaaaatgtctacactcttagtctatgatgattttgtgctacttgtacttgtgaaagttatgatctggcctcttttgcataaagtcgatcaacacacaccattttatttccatgctttcttgtgatttataagtccctaaaagttccaactttgttaaaacatgtctatttgctccattgatataactcccaggtaagtgcatgttactatatgagaattcatttaaaagatgttaaattgctccatgtgcatttccttgtattcatcaattctgacctatattcattcttaacttactttcttattacttcctaatagtaaataactgggtgagtaaatttacctccatgattcttcctaaatgtgaaaagtgattctcttacattactcttcagaaacagtaggagagaaaacacataggccgtgtgggttgagatatagtttctagctatgaactgccattaaatgcccttatgctctctgatcatgccttttgctttatggtcacatgtggcctcacttcttgaccatctcctatacctataaaatttcagagactcaaccttgggttccagaaattgcccaaggccgtgttacttttaaactcagaagtttgaacaacccattaatgggtcatgaaatcaacttagtagatcataacctaggttaaaaaggtaataaaaagattagaaatacaaatgcatttcatgttagtaagggtattatttcatgaatatattttatcaaatatatttcaagtgtgtgtgtggtacttggttgtatggtaaatattttcttaccataaatttcagtcaaaaaagcctgaaaaaacaaaacatcgagtgagatcatatagcctctaataagcttttgcgtggattatgggctttaggattttgaggattattttaccatatccaaatttgattattttttcatgggttatcctccagaaaatcaagggcattagctcacagcaataggcaaataataatggaaacttagtaaatgcttccagaattgtttgaagctaggctgtatcagcttcctgaaggtaaaatattgttactgattgaaccatttagtttcaggtagtcgtataagaaagagacacgagcatttagttgcacaaacgaagcatacagttcacagaaaaaggattttgttaataccttatttggttgttgggccaagaagagtgaatataaactatgactgtatacttgtgttatgacaagaaaggaaataataattatcgctcttttaaaatatctgaagattaaaacctttgcctttcatttaaaaacagctttgtaaatgtgaccattgtttttattgctaataatatgtggggaatagggagagattagtcaagggggacgaagttatagttagataggaggaataagttcaagtgttctgtttggttaacaaccttgtgttgtatatttcaaaatagctagaagagaggattttgaatgttctcacctcaaagaaatgacagaggtatgaggtgatggatatgctaaatactaatttgattattatacaatgtatacatgtattaaaacatcacactgtactccatgatagttattacatgtgaattaaaacaacaattaaaaagaatgatacaatttttttttcttgcctctgtatccaccagaagttagcatagggaggaaattctaattgtgctactatcgcacagcttgcatcttatctcatgactgagaaatatttaagtgctgttcagcaaggtaagcatgagaaagagaagataagaattcacataactggccgggcgcagtggctcatgcctgcaatcccagcactttgggaggtcgaggcgggcggatcacgaggtcaggagatccagaccatcctggttaacacggtgaaaccccatctctactaaaaatacaaaaattagccgggcatggtggtgcgtgcctgtagtcccagctacttgggagactgaagcgggagaatggcgtgaccccgggaggcggagcttgcagtgagccgagatcgcgccactgcagtccagcctgggcaacagagtgagactctgtctcaaaaaaaaaaaaaaaaaaaaaaaaaaaatcacataactgtatggttgaatatccattgtgttctttacaaagtatgtcattctttctgtaacatccgtggtggaatataaccttagtattacacaaccaccatcagcagcagcagcatttgagagcttagcagaaatgtagaatgtcgggctccatctcggacctactgaatcaaaatctgcattttagcaagatctccaggtgatatacaggatcattaaagttagagaagtcctggtatacaggataagtcttaccaattgctgtatagacctatgttcacttcatggataacatttgctctagaaaagaaaaattaaccagtagagagggccagcaactgttcataccctagagctgtgattggccacctaatagtgtctaaaattatgatgctgacaatgacactgctgctgctgtggataacacccattatcaggtgtttccaagtgttagccattttgtctaatatgtcaactaatctgtttaactatcatctacctcctgagttttatgctcttttacagacaagacaattgaggcaacaggttgcctaggatcaccacccccttgtaaatacaagcattctgatggctagcctcaggtatgcccaaggtagagtctgtgactgggagctgaactttttaaaagtaagacagactatttgtttcaaataggaagaaactatgacacttgaaagcttcctatgaagttgtcaattgaaatttgtttagataatatttgtaatgagcaatgtgttctccaatttgcatatttgaaaagataaggaaagccttctgttttaagctcatatcacatgttcaggctatcagatcacaatttattgtgtattatgtgccatgtggcatcttaagccccattagaggcccttagccctgggcattctactggcatctaaaggatgccttgagagtgagctgcttttctgaggacaaatatttgtacatttgtaacatggggaaaggactccttacttgaaatggctttagaattgtagagaacatagaaatgcggtttgtctcttgtgtgctaaattaaatccttttaaaggaagacatcctttgagaaaggagatgcaggaataccaacattttgatgtttattgggtgacaaaaatcaactcaatcaacaaatggttttgaaaataacattgaaatgtgaattggaagcaaaaggtagtgaggtcatgttatggtgcagaaaaacaatgctgtgtgtactgctgatcaactaggtaggcattagcgggtggatcatggccactagcatgggaaagggaagagtttttataaatgaactagaatagactgcatattcaagtaggaataatgactctttttaaaaattattacatttgttcctggtttaaaaggagagctacatatataacataaatttatacaacctcaaaggatatactgtgaagattagtttcttctcctcttctgtccccagacccaagtttccctactgacacaaccagtgtgtgcagctccttgtatatttttcagaaatatcctccaaatacctcataaagagttatgaaatatcttcataaataaacagtatatgcaaaagccttgttaaacaaaagggtaatataccaggggcccctaatcccctggccacaaaccagagcacaggtctgtaacctgttaggaaccaggctgcacagcaggaagtgtgtggcctgcaagtgagagaagcttcatctgtatttacagccagtcaaaatcacttgcattacaacctgagcttcgcctcctgtcagatcagtggtggcgttagattctcatagcagtgcgaaccctgttgtgaactgtgcatgcgagtgatctgggttgtgcactccttatgagaatctaatgcctgatgatctgtcactgtccccatcaccctcagatgggtccatctagttgcaggaaaacaagctcagggctcccactgattctacattatggtgagttgtataattatttcattatatattatgatgtaataataatagatataaagtgcacaataaatgtaatgcgcttgaatcatcctgaaaccatcccccaccccacttccggtccatggaaaaattatcatctgtgcagctggtccctggtgccaaaaatgttggagacagctataatatacaatacccattgttctgcaccattcttcttttccttaaaatgtatcatagaagtactttcatatcggtactcctacttatactttattcattttaatggctgcatggcattctacagtatgaatataacatactttatttaaccagttacctttggtgactttttagattagtctcagtcttttgctgtcataaatagtgctgcaactatgatccttgtccatgtattatcaagcatatgtgactatatagatgtccaggtcttcacattcaaagtcctgatttatttttactaaaactctctaagcaatggggaaaaaataaccaagtagcataggaggcagggtaataataataattgaaaataatatttgctatgtggtaagtaatttataagtatacatttaattcttaaaaatctagaggaagctatttattactattattattgttgttgttattactgatttgagtgagaaagctaggataggaattcacccaagatgcttgtctttggatcccttgctcttgtttgctacactgtactgtttcttggtgattctgttgctactttggcaatgagagtgcatttattggatatctaccatgtgctaagcagatgacatgtgttagtcacagtcttcataatagcaccatgagatgttgttgttgttgttgttgaacagattcttggtaaggtttactaacttgcccaaagtcccagagctagtaagcaaggagctaggaatggcctggaagcaggatgtctgactcttgtgactcacgacagagaagggagtttcaggtattgattctacatctaacaggctggaaggcagaaataaaactaatatacatatgaggcttaattaaacgtattgaagtgataagagggataggaagggctgtcacaaggaccaacggaagacagttggtggggcacaaagataaaaagcatctgtagcagagaggagccgtgtggatccagaatgcactcttctctatggagaatgtttccaaatctagattgctttgttctcaccaactgcttcaaccgttaaaacattccacacctgtacattgcatgtataccttcaacaacccattgtcattagaatggcagcaatgagaatggaacatgtggtgcttgcatgtcctagagaaagaacagccttaggtgactgctccgagttggactttgtggccacagggagcagaaatcagcaagtgccccacattagaaaataaaagtaagagtgctaagaaaagtaagagtgctgagattcttcaaggcaatgccaatttctccaggtcagcttctcctattttaatctgtttccagcagttctgcatctttgtaggtatgccataagcagccataaaaaaggcaaaattgtacgatctacaggtctagtaaaattataagtcatgtaggtcttatagaaattataattttaactgaagtcctccatatctattgttttattattattgctgttactattttataaatcaattttactatgtagaccatgtttctgtgtttggtttcttaggttttgaatactgagttttcctgtttcagagtacctcatttaatgcagtgaagttctggtaatatttcacagaaaaaaaataaaaggtgtagcacaaatatgtcagaattatttatatgatggttataataaaaaataataactaagatatataatgagttttcctgtaggtcagaaaatatgccgagttttatatacattaactggtttaatattaagcacctgtgaggtaagtattacaattattattgttgttcccattttacagatggagtctttgattctacattttgagattaacaattagaatggcattaaagcaaacttttgtaaaagaagaaaatgctttctaattctacaaaacatattttcgattttaacacttctccatccagtctttcttcaaatatactcagtaatcaatatatgtacaattttgtattctgctttttaaattcagtatagtcataaaaagttggttttatcagtctttcttattaccatataatgactgcctatgattaattgccaaatttatttcttgatttccttctttggagacattgtttccattctttcttatagatactattgcaatgaaaaaacattgtgtacatagcattattttattctctgggcatttcctaggaaactgtcccctcttccactcaaagagtaaagatctttctgactcattctaactccctgaatcaaagtcattttcataggaacaaatagtgaatattattaatgcttattttaaaatcttaagagaaatgtctactttgaactctttaggaataaactcttttcagtattgtaaagatataagtttgaatacatatgtcattaatatatgggtaatccatataaagcctaaagagtgaatttttgtatcatttaattttaaaagtaagtgagtgggctgaggaggatgatatatgcaaggtaagtatttattcttcatcgacatgtatttcttgagaaacggctatgtgccaggctgtacagcagttgccaaggctatgataatggatgggatagaaacagcttatttccaaatagggcatcactgaaagtcatatcacagattctttgtccttgacgttgtgccacaacacactcttgtcctgttatttctgatttttttgttcttttgcttttatggaatctgactcatttcttactatcagcccaagacacaaaggataaagagtatcttactctcagcaagatatctatatctatatagatatagatatataatttctaagaatttctgaaatcatattttctccctcccatgccagttctggtgggactttagaaacctttttgtcttcccagggtgaaaacaccttgctctgtagtttcaggaatccctaaatcatctcatcctcatttttatatcttaggttgcatctaaatacatttatcagtttatctttgcagcactttaagctaaacagagattttgggccctccatggcaggagtgttctcatgtaaaaataaaatgtattttaggatatgtgtcatgaattattaatatagtgcaccacaactgcagttttcacagagagagataaaacattttgtgttgtgttcggcagccaaatatacacaattcttaggtaaaattaacttcagaatcaccttttaacttttccctaaatttccccatcccagaaagacctactaatttattgataaatataactttattactttatgatatagaattctctttcaaattctgctgcgcaaactttattttgttgatactcagacattttcgtggtaattctttggtaaaaattgcatcaagataacggcttaccatgtagatcaagccctttgctcctccattggatgctacgctctgaaaaatattgttacatcattttgtaggaatgcttctacgcattacctaatatatattgagatttcagtaaattcatgatgcaagtgttgtgtatatcaatcgatcaatagatacacactaatatatgatttcagtagacagactttttgaaggaaaaatttgtattaaaatgtaattgtatcttcccccagcttaaatttgtatgttatttttagctgacatgcctaaattagttttctaatgttattatataaaaatatgatttgaacttttagcaaagataagtttcaggaattggaatttttagagtattcgtcttcatgaaaaagggatagatggagataatttcacaatgtcagaatactgattccacaggttgacttgggctacctcgttgtaaagctggctctgctgggtaacagttgactcataggcatcaccaacatagcacagaggtagagaagaaaatattaatacaagggcatctgaaaaaggagctgtgatcaattttctaaaactttccttaaatttctaatatcctgtagccttaacattgggattgcagtcctccctgttgcaacttagcacataccctactgtctgaactcaaaaccctaggaactactgtctgagatctgaatgtattcttggttccaaatcaatcttgtcactcctcggaaagcaatgcaagataataagtagtattcacctgattgctttcctgctccgagacagctggtgacgcatgtcttcctgataaccaggagtttcagatctaaggcagggataaagggaaactggaagctctcggaatctaaatgtgacagtcgatggctgaggagagggtcagaaggaatagaatctgtgacacgtatgagaaaggaacaaaatttatctgctctggttgcaatgattagatgtctctttgtctggctttccttgcagtgggtgactgatcgtacccgccagctggctaatgtcataattaacaaagttgctactacatctgcaaagtttaatcgaaaaatttgccagtgatatgatggccttgtcacagagatcacaagggacacggagttgacttttgctcaaggtggaacgacagagctgtgtaggcaagatgagaaattgcgaacttgttcggccaaaggtatgtttctttcataattccacatcctaggttttcttattaagatttttgtttgatggttcatgggttctttttttgtttcttgaccgaaatgattcagaaaaagatccgtatgcttttcgggcatttatagcatattctctgaaagcttttttttttttttcctaaatctgtaaattcataatataactaaacagcttttgatgatgaaaatggaatataaagcaatattttctctgttgagtctaactaatctttatcagttttcagaataagtatttggtaataaatatcaatgggacatttatattgtgtagcgttggatttattttgctcaacaatgtaaaagccgttgctctgctattttctattgtgtcaactagttctaggaaaggaaaaaaaagcaaagtgtagttatagaatatgtagaggttctattttcgtttcaagacatgctcaaaggaaagctaaggtcttgacttaagtcgcacaacataattggggctttttaaaacaacatttataaagacgactatctcttgaaattatgttctattttccagggccagtctggtcatagactatttacgtgtattttctttttactgtgatttgctttgcttgattgaatatttaagatttgaggagtttcccaaatgatagtcttcctgtattgctaattaatgagcgtgaatattgatgaggaagggcatgtgcctgtgtgtatgtggctgtgcacttaatctaagtacaaagagggaggaagaggtctcaaaaaatatgcagaaggcaagtttgggttatttatgctgtgtcacaccaccattacaatatcaaggcaatcaatttgcaatataatcggggacgtatattaaggttctttccctccatggttatctgggccactatatcatggcaaaatgcaataatttgtcttttgcccattactattgtcttttgtgttaatagcagtttttaaatgttatgaaattacattttggaaacaaattttgcacagcatatctattttaataagctcatttaagctttctcatggttttatttctaatcatgggagacgagacattatcaatatattcattttaaaatttgacaatcacattttatattctcaaataaaaatgaatcattttatggcattatgaattttaaagcctttcagtgtccagataattttagacactgtttatcaaaattttggtggaaatttgacttaacagatttctagtcttcactaaaatttaatttcatcagtaagaaaaactgaaagtggagatttaaatcattattttattatattctggacaccatgtttacaggagaatgtttttcttttaataactatctttttgtttctcttttgtttccttaactttgattccccacccctagcccaatgtctggcacataataggcattcagtaggtatttatcaaatgaatgaatcaatgaatctaaatatttcctctgttattcaaaggtggttaacatttgcttcctccaaatcagtaagttttgtatgcagtaaacattgtgaatagaaataagtaggtgaatagaaataagtagatgaatagaaataagtagatgacaattacagacaatagggaggattaacttcctaaagtcatatgttgttattttaacctaaaccaccataatattttgtgtaattgagatttggtattgtcagaactctgttggagtattgaaggtctgtgaggattagaaagtgcccagaaagtggttcacagctgatgtcccgttttttttttttttttttttttttaaacaggattatctcctgagatgtgtagaaatgaactcttgtcagagtttcaaaggaattaacgttttttggtaaaatgtgctaatgtaaagagtgagaagattagtgatacataatgaaagcaatgcattctttcacatggaaatgggaatataataaatgtcctgcaggtgattggggctgtagcaattttattgaagattaaagtttgattgacctttgttagggtgattaacccttctgaaattaaaagccagagctgaattattctgctcaatttaaatgcaaacatcgagcaggtcgtatgtcattcaaataataataagaagaaaatcttcctattttaattttcatttttgcacttctgagtggtatgctgctttagaaggaccatagctctcgcaaaagcattctggtggcagagaatatacaataacgttacagataattgggagcatataggaagagtcccaagcactactgcctgcattcgaaacatcaaaaccaccatcccaacaaaagcacggagcatgaagccaatctctgtacactgaaaatgcatgctcccaatagaaaaacaacctagggatgtcctgaaggggttaggaataaataacaatgacatctctattctagttcagtgccaaccaccgaaattgcatatcatatccatgttaaatctacatgatgtctcctggaaatgcgtgctttttggtacagttgcttatgaagcagtttctaaaagttgattatttctgatgtctggaatttcattctccatgatctctggcagtttctgaatatattcagtattttcattaagttcaaaaatgctgtaggagaagctaacgaattatttgcaatgccatttaatggtttagttttatttttctctgttaaattttctaagccttggtgaaaagttgtgtattcacatttcttcaaaaaactgtttccatttttcatatcatgttaattttgtttagttctaagtcagtgaatatttttagtcttaggtcccaccacatagtgaatgtgtctgccttttatgtatctgtgaactattaaaatgataataaaggttctcttccttccatatgtaatttatttctcttttttcatcaaagaattcactctgaatctgtcaaggtagaaaagtccaaggcattatagtgtaaaaattaagaagcctgaggtgctatagtttatttttgcacaagcttttcatgtattcttttaacatccttctgaaaggtaggcttctactccaagcctgtgaagaaagtcaaagatgaaaaacttgtgatagagtgactgagcttattcagctggcaaagtcactctggcatcctccagagagttggataataccttgaagcatagattaataatatgtttaactaagatctgtttgctgtaaggataatttcctaattcttaattgtgggacaagtgttcaaccataaattgtaaacaaatacgttgttctgtaccttgtctgataaagtgtagattatcagctttagcttcagtacattgagttgtcaaactttaaaaaattcagttgtttcatgatacttgttttcttatcaaagataattttaactaaaagataaacatgaccactaacttatatctctaaagtaagcaatattaattctttggacataatttaattatcttctctaatttagattaatcttattttacctcttaacagaactaaatgaaaataatcttcagtattaaaattggttataaatacaacattctctaaagcacaaaaagctaatgtgctgaactactgataacatccttctctacattgtcattaattattagcagtctttttattagagaaaatcatgggtttggaaggtgaaattcatattgtctcagtgtagaaaaaagtgttggtgaaagagcaaaggaaaataagattatactttgctaaatcccagatccaataatttattttgcttcagtgtgcttcgaagacattttatttctttatgttgcctttgttttctatcaatcggtttccacctaatccacccagtcccagccctgacattttctcttatagctgtgaaataacattctttgctatgaataagccaagattaatccatttgatattttatagactgcatattttagctggagcgtttctgtttaaaaagcagactgttttaaaaagtgaccaatggtgttgttttatttgttgtgcattgtttatgagtcagcaatttaatttaattttacagaaatttagagtagatgtactataagcgattttattcttctggactaaggagagatagcaagtggcagactcaaggattttctaggtttttttaaaaaaattattcatagtaaaaaagtagtcacatgaatttttcaagattatcctctttaacagacaataattctaaaataaaattatttgtttaataatggtcagtggaattacttcttgtaatttgtttaataaaatcataaaaaatgctctagaaacaataagtgtcccaatgttaactttccaacttaattgggaagattagttttctaggactagttttcaagtgagttggaaggtgacctaatatagcgtagtggtctgtggcctatttgatacaatttacgctattcgtattaaaattatcatactatctctgtgtattactttggaatcagagaacttcataaaaagatacttttaactcaaatgccttcagcattagcatttctggagccatcattgactaacctttattcagtttcaacaagcctttattaagcacctactatgtttcaggtactccccccaatccagtgaggtgagcctatgagccatgttgtataaacaagaaactcacactcagattggcaaaggttttacctgaagtcagatagctagtcagtggcacagcctggtttaggagctggtgaagcctttccttcaccaaagctgtctttgggataatcatagcattccactttgctaaaacttggagactatgagaacaggattcttgcaagatgaatttaaaccatttccacagaaaaaggaatttactaaaactcaggaactacgatgaggtaattaattctgtactgattcactctagaggaagtatgagaagagggagtttagagtgctttgagtaatacactgggtcacccatgcaatgaacattactcagtgggcttatttcatagacagaagacattttcctccccaaatattaatagtttagttcattgaaaaccaatcattaggctttttaaaaaattgtctttaaaatgcttgtgtttacctatctttcttttaaaattcataaataattatgtttaacagaattttaaagtcagaggcatctgtcctacctcatatggtttctttggtgtgagcagtttgacaacctgttgataaatgtgtctctgtattttataattcctgctcttgaaactgagtataagtctgttagatgtctatgctgtcaggaattgcccaattgtttatgacaaatgcatttaaaggaatatgtggaaaaaatatttttgataaatatcaaaaaataaatatagaagtacagtattgctgcaatgtgaggaaaaaacatgcaaaataattgaaaaaaaaactttttttctccttttcttatgagaataaaagaattaacttgagttatgcaaaaagtaaacttctgcaaaattagaccaggtggttccaaaaatttgggattgacagattcattttcacttggtgatttcatcaaccttctcattgttgtctcttttggtttgtaaactctctgaagttgacacagagaagtgtggtcagtctaaatccatctctatatttatctgcagggcctagaagagatgctgatatgtggtagagagtgaggaagtgtttgtcaacttgtactgaaagtgactattaccattaagataaaagtagggacactgagcccagtacttcattataaaggcctggtgtttacactaagaaataaacctaagcttcaaagtctgaaggaggaaaaagaagtagaaatttgtgagtgtgtatattatacacaaataatctccatcctagattattcttatatctacttcagatgctttttaaaatgatccaggtttctttactttagctttaacttatgcccataaatctccccttagccagaacttgttggtcactagttagccacttattacttcacaacaatgaaactagtttttctgaaccgattaaaatatttaatcaaaatgatcagtttggtttatgtttggagagagagagaggaaaaacaacttagagtcttcattttgaaaatgaatgaaaaagcaactaaagggcattgtgtagaatcagagaagttgaagaatatttgcaggaaaataaattgctattgtgattctaattacaaatgaaagtgttttgtagcagagaaaattaaagtgtgtaataaaatgacacatactgagagaatcttccctaagagatgctagacaagatggaagatcaagtttgaccaaaatcctttctaattatataaatactttagaattcattaaccatttgagtcctgcttgatgattaaacccttaggcagatgtgaatcaactttactatgtggaaacattgaggaaaacatttataaaaaatatgatccaatttctgaaaatacaggccaattaaagactgagatttaatttaggaattttactctgtctgcatgatgtatatattaatgatgatttctcttgtctcattctttatcttcacgagcaaaaggagatttttactcattgacatattattgaagaatctcgcttttttgcaaaattacacatttttttgcataaatgtgcctaattacctgaattcagttttgattagcagtgttaattgatgcagctgtggatggtatctgtttacccaaattaccatgtgcaaacagcaatatgtctggaagcgcatatgctaaactgaaaatactaattaggtgagacagattgttattcaagtcacatcatggagctttctaatgagagcctggatgtgtcagggtttcatgatattcagacagaaatgtctatattacatatgatttctaaatttaattcataagaacagatgggatgtcagccagggttcttctgccttattctggtattaatgtgaatattttactcaactggagatatattcatgtgtttttttgtgggaaactcattatgtgctttgacaatatgccagccctgtacatccagacacatctatttcttgatcaatatatttgaagattatatccacctaccatcccaaagatgaagatggataagccaccttgcaagcttaatcacatcagctggttaatttaatcaaatcaaataatagaaaggttagttaaacaggcagcttaactgagtaatattttatggatgttttccttttgcaccccccaaaaataataataaaggtttgatcctaggattgttaagaatcagtgagcaattcacaggactgaaaggtgaattctcattgccttcaggttgttttgaatctttaatcatttaaaaatggatagcaaaacagtgcttattttctagtgcccggttttaaagtgttaacagccttttttgtctttggtttccattacctttgtcctaatgcatgacctgctttgcttaaggtttttcttgaaagaaagcgttaatctttactttctgctgtggcactcagaactcattaatggcagtgtaagttagaggtatctgaagcttagagtacaaatcctgcacatcaggtagtgaagaaataatggacccatctttcctttcccaagaggctaaataactgtgcttaatgcataataagtctcctcttcccaaagcctgtgaaaataaggcctctttactcaaccttaagagtttaagatccctattagatattttaagatgccacgagctaaatgggggtgattttcatgatgcaaatttgaacataattatagtttggcacatttaatttaggtttaagtgagaatcataattaccaaaaattgaattatttcaattatgctaatttctatccccaaagttttgtgtaatttgggttcactaaaacaggtttagatcctgcagaattacaatggagtctcatactaaaaataaaaaatttgtgaaaatgattcacaaatgattcacagctagttacatcttaggtacagaaatgttgacatactgttaactggcccaggaaaaccggaggggctgggaatggcttaaatcaaaaatagaaaaatgggcattatgagttaactgtttgggccatttgattgccattttctacatcaatactaattttaacatattattgctatttgctgtctaatcaatgaagctaatttcagtattttaaaaataaaatttgtgtgcattacagttatgattaatagtacactgtcagaaaaaagaatactgtagtcaccttcagaattatcttgcctttgattatcacttaaaagcattaggcctttcaaaggtgcttaatgtaaaattccttaattcttggagatgaagaattggaaagtttcatttccctgtggctgaaggtagcttgcttggaaaatactccatggacagtgcaagagagttctttgttacagaaccaaagtgtatgtgtatgtaactgtgtgtgcacatacattcataaaatcgcctaaccattgaattcagacactagatttggccaaccagtttgatttgtcaggtatgtttatttctgagttcactaaggcaactgctaaataaacccaagtctgcttttacagcacagacaaaggaagaaaattccttcctaaaagtacagcaatctattctaaacaaaacgatgcctgggcactttttgctatcatgagattatctaaatattttagtaaagttttgttttgttttaaccttcatgtggagatgcgaacgtgttttgtgtaagactcttgacacacatgagcatttctacattttaactttaaaatgggaaaacaggtcagtgatgtcaaatcggaaccagggttatgaaattttatcagacatttcaatgaattgtctttaggcaaatcacccaacctcagtgtgcaaattagttaattttaagaataaatatagctatctttctgacttattaaggatttatcatttgtgcccaaggttcaacagatctgtaaatgaagtgtgtgaatcttgtctttgaactctaattggcatgtgagggaggcaggtctgactgagttaaaggctgaaggacttaatcctttgaagaaattttgatttagttttattacctctaagtattgctaatgtattctaaaattaatttgactctgactgcttggcgtatcctgatttcctttccaaaggatagattgtaggcgcattgagggaaatctatttctttgttaaccttctgtctaaccacagtcacagctttaccactgagtagtgttgtagtggtgtgcacacagtagggacacttgaagtctaagagagtgaacagtggttaccatgaataaaaactatgaccattaactccatttgtaactgtcaatcacctatatttcacgatcagtgtgttacctggcccaggggccataagcccctgaagacattttaaaaaatttaaagctcctgtttttgaaaaagatgtatatttttggttggtttattgtctgaccgaaggaactctataacatttcacaaagaatggaattcatttgaacttgttccctgaaaagtatagcacatggattaatacacacttggattaatgcaaatttcagacaaatgggacttgaattgctaagcaaagcttgtagacgggcagacctaaattcaaattttgcctttgtcatttgctagcaatgtgactaggaggcattttcctagatcttttgggccctagtttacccatttggaaagaaaagaaaataatacctatttatagtggtgttgtgaatgaactatataatgtatataaatgccttaacccaatgcctaacgtcaagtttatactcagtaaataataactataattactgcataaagtacagtagctctgtgttagaaaccaacagaggcaattagagaaggttttaaaatctggcactcattaatttacttaaacttctaagcagtaaaatttccaatcactgtgagtgtatccatagattagatagataaatagatagagagatagatagatatagatatagatatagatatagatatagatatagatagatacacaagtcctttttgtcccaggtgtatatatatatatatatgtgtgttttgtacacatatatcatttatgtaaggacaaaattaaatatctggcttactggaagtatatagtacatacacttctggctttcttattttctaacaatttctaacagttatacaacacttcatagctcaaaaataactctatacacattaccatatttgattttcacagcagcaagacaagacaagtaatattgcattcattttctataaagtacacggagatgttaagtgatttacctggtattacttcagtgaaaacaggaaagatgaaggtaggagaatatacttggaatccttttccggactgtttggaaaaacaaggtaataatactgtttttccacggaatattggcaaacaaaaatgtcttaagtgaataatactacatttaactatagggcacagaaatgagtatattaagaaatccaggtttcaaaaggtggatagaattagtttctcctcggtaaacatttattaagataccctgactcactgccttccttcaacagttaaacattctcatttccactcttattaatagggcttgtatgaaaatggagtgggcgagttagaaaagctggaaccaggaacttagatctccctcaggctcagacaaaagctcagagatctaaatatggtaaaatgtctagagatttcttaagaaattagcacatggaggcagatttaaaaaaaaagaaaaagaaaaagaaaaagaagattcttcctttcctttttataagttttatataggaaacagaaaatgacccaaggaagccattggattaaagtattttactgatttaacaattatcttaaaaataccttctgtatgtcagctattgaaaaggcactataggaacataaaacgtgcaaggcacaatgtcttccaggatcctaaataactatccttattattataataattactatatgcttattgcaacaatgatatcattaacagataaattatttgtcttttaaattctgtggatattaagaaacacattcattcatgtattccttcaacaagcatttattcctttttgcactgggtagtggaatatgaaagtgggcttggaagtcaggtagcctgagtttagatccttggttctccactaattagaggtggggacaattatatgaatgttagcttccatgtctataaaattgagttgatcataagattgatatgagaattatgatttgcaaggtactgccccttgtgcatggcatacacaagaactactctattatcattattatgcttctccactcaagggatatacaagtagttggggagtgaaataaacacacctgaagcaactagataattttaatatggcatggaaatcattgtaatctcacttggcctggactctacaggtgctgatgaatttagaaacaggaaaggacttctcgaaaaagagaaaataataccaaaaatgttttctgtacagtgtggtgtctagatctagccatgtctttgttcaatatatgcagcctgatgaacacctccactgttaatttagaaacctacaacatctgtgcaatttaaataggaccagagcccaaaccccaaaacacatagaatatgatttcctattcagtgtggttgaataggaccacatccatctctggggctttgattcatgaactacacggccctaattgacatggggttgttgccttttcagatagcacgcatggcagagtttcggtgtatttggacttgttcagggttcttacatccagaaagtccaaattagatttttgtcattagcttgtcaagcttctcttaagtccacttaatgaggtctgcagtggaatgtcttttatgttctgtggcctttatgcttagtctcagctactctcgactgtggctgagaagttaatgaagttaccacagtgttcacttgaggtctgctgcttttgaaaacacacctcgtatgtgtttgggtatttaaattctgttttctagcttttagggtttatatcctcgtggtgcattcaagtgctatggaaataagaccagatggatgtgacaaccagccattcgggaaattacatacacattacattttaaaaaaccagtgtacatatgtctatctggatgtgctcatatgctggattatttttgttgcatccaaatggttgggatttcagtgaagcagttacttagaatgtcagcacgagcattccttccaggaggaaagcagggcccgcaccaagcctttttgtcaaaaacagtcgaatgtggggacagagtaaaggccattctgcatttctctacctccttttagttttttccacagttctcatcactgcaagactttataccatagagttgttggttgtctatcatccctctagaaagtaaatgctataaggactggcgatttttctgccctgtttaatactttagtgtttggcacataatgagcgctctatatatgataatgaatacattcacaatcactgggataatgaaatcatatttaattcccttccctttgtgctgaagctggcataatatggaggttttcttttgtctcttaaatgatgtgcgtatgactatgaataatgctcctgctgctgtctaacatttatataatgtttactatatgccagacactgttctcagtactttacatctaattctgacaaacctttgaggtgggggctgctattctcccttttttatgaatggaaaatggaagcacaaatcctacctgaaagagccaggattcaaactcaccggtatgatcttctacatctcatgttgttaaaatgtggcttctggggtttgaaaataagtcatctcaggaatgtatccatcattttggtaagcaaagaaagctatcctatagccatgatctcttagttttgtgctattcttaaatatgcaattcagtttagcccagtggtgcaaagataattattcccattttactctaagaagtaggaatctgtagaggcattcacttttcctattttgtattatatctcttcagtgatttgcctacctccttgcccttctatcaaaaagaaagaagaggagactagaagactaatgctataaataaacactccaggttttgatgctagttagaatattgcattaacaagcccaaagcatattgtcaaactaaatggaaaaattggtattgggggttttatcttggcttactcatggttactcaagttcattcttactaaaacgtattgtgatggaataatcagatttagatttgaagttaagacatattatataacttttagtaacaattgtgcctgcccagttgggtttggttagcctgatagtaaaaattagtttgtaatcctcagcagagaacccacatgatagtgtaggctttgtcttaggttagtgccagaattgtaaattccttaaaaactggtgaaaatcaactctagacacataggtaatcagagagtggacagtacgttcaatgtaatggctaagtcttcagaagaatggcacaattttcaggggtgtatttgtgtactgggggaatcgagttccatagccagagatggtaccataccttcgctagaattgtaaattatgttcattacctatcaatttccttgaaacctttcctattgtcctgccacacagcaatattattttatcaactaatttctctgcaatctactccaatcagtccagatggtcaaatcaattttcttgtatctctttttctcctgaattaatcagtccaatgaaatcccattaaaaagtcacatgactttttggaggtttatataatcctgttgattcctgctatataatatgtatttgttacctaatatgatagaatatcaatttctgcccccactaacagaataagatgattcatgcaaaatgcttagcagtactaagtacagggtaaaaaattccaataaatgacatctattaataggcatctattatttgtaaacatattcaatacgttggaagagaactaaagagaatcatttttcacaagaccttttggatgtgcccatggtttttcccattctgggtcagagcaacaaaatcacatttacattatattacactcttgcacttcaggctctctctagtcaatttcctcatatttttcctttcatatactgcattatgaaggcaactggtactcaactagcaacaatcatcatcaccatcatcatcaccatgataactatatctccccaaaatagtaccaacatttatggagtagtttataatgcacctttacatatgttttcttctttccacagtccgcagtggttgacattgcgagtatagagggaacatcatggagctggtgagggacagatctaagattaagagtctgactcttagatgtccttcacaatgataaataagagatttgtgggattattaatgctgtggataattttgaatacaccctgcagacatgtcccaccctcagagaacaatttttttaaaactaatcagtcattgagcttgaccttaaggaatgtgaatattctctcctgtatctcttcttctatcaccttcagttagcatctttggaaagcactctcagtttttggcttccagttactcccaagcttttctagcaagtagaaatgcaaacagataattaggggatagggctagggatatttgcgttttcattaggactataaaatttcaagggcagaaatatggcaggttatgggattggatgaggaaaaaatcctagggatgagcaagttctagtcttatttctaacactgcaggttacctatgactccacgtaaatatgtctaacagctttagaatggaagaagagatggatagggcacactttttacaaattacttgtgtcactggatgggatgagaaatgggaatatgccagtttcttatgtaaacaacagttcatcaagtgacataaacacttcagataacaggaaggatttacctgctggtgcaattttgagtgtttagtcaccattggcacaaaaagaaagtaggaactgttaagaggatgacttaagtagagctgaaggagatacgcctcaatcattattaccatcaactattgttatttttttatggtatatcctaaatttggtaatttggttgtcattatccttgaagggcttttatctgaggtgcattgctatttttgaggacttttaatttttccctgtcactgacaatatttgaaaaatactgcttttttatggagagatctaatctttcacatctatgttttaaatcaaggaaatgggctgggtgtggtggcttacacctgtaattccaacactttgggaggccaaagtgggtggatcacttgaggtcaggagtttgagaccagcctggccaacatggtgaaaccccatctctactaaagatacaaaaattagccaggcatggtagcacacacttctaatcccagctacttgggaggctgaggcaggagaactgcttgaacctggaaggtggaggttgcagtgaaccgagatctcaccactgcactccagcctgggtgacagaacaagactccatcttgtaagaaaataataataaaaaaatcaaggaaatgttgatgccaaagtaaattttgtgactattttatggtagtggaaggtgaaaaaaaattcttaattgacaaattaagattgtatatatttatcatgtacaatatgatgttctgaaatatgtgtctatacatggggagtggttcaaggaagctaattaacatatacattatctcacatacttatcttttttgtatgtgatgagaacacttaaaatctactcttagtgatttttcaggcatacaattaactatagtcaccatattgtacagtaggtctcttggactaattccttctgtctaactgaaattttgtatcctttgcccaacatctctccaacctctcaccctctccagctcctggtaaccaccatttttctctatctttctatgagttaaacttttgtagattccacatataagtgagatcacacagtgtttgtctttctgtgcctggcttatttcacttatttcatttcacatgaaatagccaggcatagaaagattgaactggaggtcaactggaggatgacctccagttcaatctatgttgctgcaaatgacaggactttattcttttttaatcactaaataataataataatataataaaaatatgtatatataacatctacactatgtatgcgtatcacattttctttatccatccatctgttgatgaacacttaggctgattcttcatcttggctgttgtgaataatgctacaatgaacatgggaatgcagatatctctttgactctttgacatatgaattttatttcctttggacaaatacccagtagtgggattgctggattatattacagttttatgtttaatattttgaggaatcttcatactgttttccataatggctatactaatatacattctaaccaatggtgtgagaggactcccctttctacacatccaaaacaacccttgttgtcttttgtctttctgataatagccactataacaagttgaggtgatatctgattatagttttaatttgcatttgtctggcaattagtgatgttgagcctcttttcatatacctgttggccattcgtctgtcttcttttgagaaatgtctattcaggtgctttgctcaattttaaatcagattatttgttttcttgctactgagttgtttgagttctttatatattttggatattagccccttatcacatgtatagtttgcaaatactttctgccattctgtaggttttctcttcattttgttgattatttcctttgctgtgcacaagctttttagtttgatgtattctcatttgtctatttttgctcttgttgcctgtgccttggggtcacattttaaaaaaatttattacctacaccaatgtcatggagcttttcccttatgttctaatctagtagttctacattttctgttcttacatttaagtctttaacctattttgaattgatttttgtatatagtttgaaataagagcctactttcattcttctccatgtgaatgttcagtttccttgacatttcttaaagagactgttcttttctcattatgtagtcctgacacctctgtcaaaaataaattgaccataaatgggtgggtttatttctggtcactctattctattccattggtctatgcatttgtttttatgctagacctgtgcggttttgattactatagctttgtagtatattttgaagtcaagtagtgtgatgcttccagccttgttctttttgcttaagattgctttggctattcacagtcttttgtggttccatacaaattttaggatttttttctgtttctgtaaaaatgccattggaattttgatagggattgctttgaatctgtagatcatgaatattttaacaatattaattctttcaatccatgaacatgggctattttaatttcattcatcaatgtcttatagttttcagtgtgtaggtttttcacctccttggttaaatttattcctgagtattttatttatagttattataaatgggatttttaaaaatttctttttcagatagtttattattagtttatagaagtactgctaatttttatatggtaactttgtattctgcagatttactgaatttgtttattagctataacaggtttttttgtaaaatctttagggttttctataaataagatcatgtctgtaaacagggacaatttaacttcttccttccaatttggatgcagaaaacatattttgatcacataaaaaaacaaatggagaaaagtctagcaattgaatttttaaaataaataatggagattgacttgaaaaggtttattttcattttatcccttgcaatagatattttttcaagctctaacatacactaagatctgacagcagaaacttttgaaagaatgatttgagaacatcaacaaaacaaaaagatctgagagtttgcaggaagtctggccttagtatttcctactacgcaccctgggtggttttgaactctgagagagactatgaaacatatatatctgcacatcattagcattcaaacgaggttccataagaagttgaaatctccttaagggaacattggtagaacttcaagtcctttatagttttcagaaaagagtatgttttatcgtaccaaatcactggcagagagttaagaatatacattttgtataaatatgtattcacttaattcatcaaacagaatcttttcttttatagccaaaagagccattctcagagagcatatgggcaatcaaaatattctcaaagcctgaaagccaaaagtagcttttggtttatttactggggtatgtctttctaaacattctttttaaaattagcccgaaagggcaataaattaggcctctcttaggcctgagtgaataagaaagatgaggattaaaggacattcagcaaggatgccattcacatggtgtctgtctcaaggggtagacccaatgtggtaagtttaaacaggaaaaagtaaacatagaaccattactctgttcatgcagagcagtcaaaactttctcagcaacatgcttttcacaaactcaatgaggcagcacggttgtcaagaaaatatatccctgaaggtttttctgtcttagtttttcccctgttccaatgtctttactatctgtcagcagagtctgagatactgatgagaaatcataaacattaaagaaatagatgggtcaattttgatagaaatggaactgttgacatataagcaggtgttcattaatgaagggtaggttcaagaccagtgctccacagaaagagaacaaagtgaaataacccaagtttgattttcaaatacctatagaattcggtattttgtaataaatgttttatttcccgttttatatgccaagaggccacaacatacaatgtttgttaagtaattagtatcaatcaaaagtttaaagttaaaaacaagtggagaatatcaaatggtatcattggtgaagcaccctttctcagtgttctaaatattgtattgacagccgttaaaaataaatatatagcactttgggaggccaaggcagtcagatcacctgaggtcgggagttcgagaccaggctgaccaacatggagaaaccccatctctactaaaaatacaaaaattagctgggtgtgatagcacatgcctgtagtcccagctacttgggagactgaggcaggagaatcacttgaacctgggaggcggaggttgcggtgagccaagatcatgccatcgcactccagcttggccaacaagactgaaactctgtctcaaataaataaataaataaatgaataataaaaatattaaaaggactgaaataatgtccatagtgtccagatataggaatattgtatttcaacaatccaacatgaacttgctgagggaattcacctgtgtcaggtaatttaagatgtagttagcaaattctcactttcctggaatcacataaaatattcatagattcctgtcagtaattgcaaagttaaatttaaattcccattcctggctccataagataaaatatttctgtaggatctctattttctcgactttattattcttagtgcaattggaactattttgcaatcccgtgccactatgcatctagaacatagcatcatattttgtggcatctctccttcataattgtctttggagccatatattcatgcacatacatgcaaaatgcaaaagggaaagtatttggcttttctggaattgcaaatttatagagtctttataatgtcattgatccattcatccaggtgaatagagcactgactctgttccaggtagcttacatatataacctctaattgtcgcaactcagaaaagtggacaacattatcactatttcgtagaagagaacacttaactaattgtgtcaaatcaacttttctgaaattactcagattggacctttaaataaggctgactccaaagaccatattctttctacaacaccacaatatgctctcttgctatcttgagaggctctaccaatttaaatagaaaaagcattaatggcattcatggttcattgtttttaaaaaaaaaaaaaaaaaaagaccaagttctgtttcattttccactaaacctccttagtcctcttggtaattgaataaccaagccctgccttttgtgtgccatcaatgggcaatatagaaaggtagataaaggagaaaaaataaaaataaaaaagaatattccatctgtctacctggtagtggctcataggagaagcaaaagggaaatacttatttgcctgctaattatttttctgtttaaaggaggaaaggaatggcatgaggtgaaggataaatagagaatattgatgtggtaataatgatcaaaacagaacaaagaagagttgatgtgggagttatttctccattgctctggccattccactcttcgctgaataagtgtattctgtttggctttcaagctagggttgtcatgcgagaagtgtacgttaatttcatattttctcataactttcttttggggataagccttttggtttctgctgtttattatttcaaaggcatctatatgctaatatgttttatgcttattattttcatgtttgtcccttaggttatgcttcatatcacccacgagggaggatcatatctcataaaaactttcaaatttgattttgaaaattattcagaaaaatttaagccatgctatctccccacataggaacgactatgctctggagagtcctgtaatttgcagaaaatggaccaagataacatttgagttccatgctaccaaaatcctcttgagaaggacagctagctacccagaatatttaacattgtgacattgaaatgttggatgaacgattaaaatgaagaatctagtcataggttgtaagaaatcgctaaattattatgtttaatccaaagaagagaaaggaaaagctgttttcattccccccagcctctgaggtgtgttacctgcttcgattgctgtaaatattgtattttaattgtatgttatccttcctttgcatcatttctagaaagttaattttaatgatactaatgactgaagctgagtttgtgcatagaggaagaatcagataaaatagaaatctcatataataagccagcttgatgttttcttccagaacttttattacagaaatttttaaataaagtcgtaatctattttgaaagcaggttggtatttaaaaagtgaaataaaattagccaattaacctgacataaaatatttcttcaggcattgtcttttaaagaaatcaaggcttaaaaatggattccttgacatgaattcctaggattcctagtttaccttggagggcatttatcatttctcccttgattgggaattggactcctttagttccaaagcccttcaggggtacaaataaagggcatcatttcaccctctactgtgtcattccctgccctgctctgttcttaagcaaggagtcagcaacactgaggaatttgcactccaggtttaagtttgttttgtgtaccagcctcctctttactcattcctctacctttcagtagctgcacctaaatccctttctattttgttgttgttgttgctgttaaatgctttcacttttagaccacagcagtgactttattctgtaagaaatgcaacccagctacttgtatttctcctcttggttcattttagtgcctctcgagttacaagacagctttgttagtagaagagtttgctttcagaattggaagaaaggtctcctcaaaggagtcctgacaagcaaactaggctctcctccagacagaagggggtaagagtgagcctacaaaaggcaggtgaagacaggtacctggacaacatgtgctaggtcagcctaccagcatttcaacacttatggtcatcatctctctgtaaataagaactattgctggggatacattttgtgaatttgttaggataaatgattggtaaaatgttattttaccagttgaaacatgactgtatttggcacattttgttaaaataaaagacctataatggtttatgtgctaaaccctgtgacccatcttttttttatttttattctaattatttgcctgtgataataacaaaatagcgatacattttaccttttaaagttgtgtttggagaataattcattgaactaacacatttggcttaattgcagccccagctgagaagaaatggccttttcttgctcatctcagaacataattcaaagataattcaaatagaaaagaaatttatgcacagttagcctccagaatttgtgtggtgctgttgagctgtgcaacctgattaagcagcctgctaggagtgtgctactctctttttgaactaagttccatgagggcaggaaagatgtctatcaacaactcttagctcatagctctagaaggtggttgcaggttgtgggcttttagcaggtgtgttgtggtcatgcctcagtctaaatgagcagtgaactttggcttaactcaacttcagaaatgctgtgtgatcttcaacagttgacactcctggtcctgtaatgcccctggagcatgatgaatagtttgaagctttgaaataatgtagactcaaatcaaataagcctgggtttgagtcccagcatcaatacctactagttttctgaccaagtccaatctcttctaagcctctctaagcctcattcccagcatgagtaatatttaattgaaaaaaaaatcaagtttacttaagttgactgcaaggactaaatgagatgatatatttgcatagtatacacacatagtaaatgctcaactaatggtgatttttcttttctttctctttttttttttttttttttttctgagatgcagtcttgctctgtcacccaggctggagtgcagtggcatgatcttagttcactgcaacctccgcctcccgggttcaagcgattctcctgcctcagcctcccgattagctgggattacaggcatgtgccattacacccagctaattttgtattttgagtagagacagggttttgccatgttggtcatgctggtcttgaactcccgacctcaggtgatccatctgcctcagcctcccaaagtgctgggattacaggcacgagctaccgcgcccagccaatggtgactatttctattatcattatgacttttaatagtaataatacttctgggattgttattattatcattattaatcgtattaatgattatgcagaaggtccaaaatttttccctatggataatttaagtagtagaaatcaaaagatgcacgcatcagatacttttctgccaataaaacagggcctacaaaaataaacgtggacaatttcaagttttcaatgtgattcactggagacttgtatatcatcacaaagtttcagtaaacacttttaatttaaaaaaaaaagtcttaaggtaacccaaaaggtgaaaattttgaagattcacaaaatgttattactcatatctaaccaatatcaattattcaggtgagatagaaataaaaagtcaattaaaagctagatatttctaccctcgttgccaagaatctaggtgtctagctaatgatcttgctctttcccttttttggggtacttgatattatgaaatgttttgttattggctgcttatattgctggtagtagtgattatggaatacaatttaaaattattaaatattgtgaggaatggaattgatcagaatgaaggctttccataagaaaataccttgctagttgaaaagctccagtgagcttccaggacatcttcatggggctggcatgtgatatgaaagcaggcagctgggtctcagggccattgaaaagttatggtcttgctgctaaacaagagaagagtaaataggcttgtatttgtctctacagcatatggcattgcacagaaagaaaagtcagatgttaattaaacctttgcagggttggaatgggtcatcccattctgtactaaaaagtcagctttgacctttaattgcatgtcccccccaaaagacctgtaaacatatttgctaaaaggttcttattgcatccaagactcctttcaagtaaaaagaaaaatattttttctttgtatttggaagagctctaatgacaatacagcctttattgaaataatatcttgactgtatattgatacctttcatttaatgtttaccttttcctgtggatttccttctttcacaaagcctttcctccatggaaatgccgacagtaaattaacatccatgctttggtgtattttatggtgtttcattttaaatattcacacttggattaaaatccaacatcatctacgtttcatgtgtttagcatatagtagaggctaaataaatagcagttaaaagaaagtaatctcactagaattatagccacaatttcctagatttcatttccattctgtcagccctccgtgaagttggtataatttcccttcaaatgggcgagattcggaattgttcacagtcacaagtgagagaacaaaataagagagattttcatttataagattgcctttctcttatctattggtcttgcctcccagactgtctgtctgtctctggaaagcaaagtcaataaaaatgattagagttgacatctcacaaatgtacacccttaaaccatgaagcagtaatgctgtgcaggaaatatttttctgaccttttcaaattgcatccaactgtctcgggaatttctcagtgactagagataataaggttcaatcaattttaccggctggcttcaaatttagttcctctgaagctctaacttatctattctttgcatcttcgtcccagcatccattcggcacagaaacccatgcatctaatctttcttcccccttctcaggttcttgctaaaggatcacactgtggaatctacaaccatgacaactttccacttactgctcccttgaaaaacaaaatattagcacaagaagattagtggacatgttgtctttgagaagccctggttgaacttaattagcttttaaatttcatcccatcttacatctcagtttttacctatgtgatttatgcctcagtaatcttcattctgtaaaactttttcaacttaaccaaaccatgggcattctctcgaatattaaagcggcaaaaatacgtgaatttcttttatgttaaattaattttgctttttcttctgtgagtccaaatgcagcagacatactcccctagaaaggaagggagtcagccaagtgtgacgtgttaaaaggcagctgggcggcctcttcaccgtgttccctgaaggagaacagaaaacagaagctggggacacatttcttaacctcatgaaagtgttggatgtcaggaagccttgacaagaaattaaaaagcttgtcttactttttatatttagagcatctccatgttgactgtgattctggggagatatcagtgtttcctcatttgtaggacacaccaaattcaatagcattctctgctgtgttgttcccatccattgcctctgtactgacttctgcagaggagattagaatcttggctggaatttcctgtggtcagtggagcttggagcctctttctggcttggaaggcatgttcatgggcaaacagccaccaggaggaaaaagtctttttgaagttacccttttaagagtctgcattttcttgtacactaattatcaagtttgatcgtcataagatacttgactttataaaaatgagattatttcagacaaccctatttagaaaatagacttgggaaaaaggaggtgaaaagcagacattttaatatttacaacactgtatttttttttcctgaagaaactgtatattcatgccaaagttcatcttcataatatggcttgtctttttcacttaaaacaaggtgcttaacgtttttggtcaaagttaaaatagaatacaccaagttatgtttaaaaataagctgctatttcatcatttgaaattttatctgtcttgataatagaatcacagtcctgatgttcttttatgacttgggtgttgttagatggcattttgtttaggaaagatggagtattttggcagttttgcaaatcagatttacttgatatttgcaatgcaacttaatgtttttatcactagtcaaggaagagtgaagactttcaggtgcagtaattaaagctgtctgtttcttgagtggagttgcagtacacctgagaggttgttaattcagctgtgtgtatgtctgcatgtatgtgtgcagccatgtgtgaggtgtgcatactcacttaaaatcgggattggaaggcaacaactctgaaaacaaatagagtctattttctccctgtggatgccacctcttaataaattggagacttagctatacctatgaaaccctttcagaacacagaatggcttagctgattgctctaattattacacgtttagtgcctcctctttcccatttctgagatatatcgtctttgcttcagaacctggaggtaaaacaaagtccatgtttagacttcccattgcaagcataaagtgatttgaatctggtagaagaacacagtgaagtgatgctgggggtcactttgtactggggttgttttgctttgctgggtgtgcttagagtttggaagatggctgtggaatgaatcaggtagagaggcacaaagggaataggtcacctaattaacagtgccaataataataatggctgattcttactggacaactactacttaccggatgtatcacagataactcatacaacctcacttaatctttacaggagcccaataagacaggcacaactatcttcgacttatagggagaaaaagtgaagcttagagagggagattgtataaaaaaatgatttttacatggaaaggaatgaaacaatctattcgttgcaatcgttggtgtttttatttttcctcctctaccttttccttctcctttctaccctcttccttcatcacctcctcctcgttcttcttacttagcttctccttctctttatttttcttttctcaaacacagaatgaaatgtggccaggttgttaaagcactgtcccattgggtcttggtcaacaagtacagcttgttctccttcgtcatggagttgctcttagtagagctacttatttaattattttggaagtttgataagggctaagagttctggccgatggcttatttatcatcacatacttttcattaacttaaaagacgaacacaggtggcagagtatggtgattatatgctgtccctcataagctcacattcaaatctgccttctatcttttgtctgtgttaatgattgttcagggttaaaaggcagaaagaatgaattgaggatagcagatgtccaaagatatttttgtgagtaactcagtaaaacctgtttctataaaaagaatgtgttactgtatcaggatatctaggaaattaaatttttttcaaatatacagctgagtttttttttcttctatttccctcacacatcagtattacaaacataaattcctgattgctagagcaggcttgtttttgtgatgttagctcaatggagatattgatgccctgggattcaatttcactcttatagtgatgcctaatatacttcaatttgtgtctcagggaaggggcttggttatttattctgggtaaactgggctttttgtgttgccacagcatcacttagactcctgatactgaggccagcaacctgatggggcctcatttgttcccaggcgtaacagaaggaaagaaaatggattcaaatctaagcagagtagtagaatctcaaaagctctgtcaccaacactcactgcaaatatactcttcctagagggaatgttctgaaaatttggtctgcatctcacttgtgataaatatcccctttaaaaaaattcacacagaacgacacaagaaaggcagcatggttttagatgcaaatatgatttcgaggtttctctctctctctctctctctctctctctctgatatacattgggtctggggtcttttgaatatgcatgtgatctcagtttagggttcatgaatgactttgtgttttgcataaggcccttttgatttccactcctactgttatcggaaataaactcaaaattgtataaacaaacagagtaaattgttctgaaactatctgccacgcagagttcatcttcaacactttgctttctattattgccaaaggaagggaaatgacagcattggctttaaatctgtaaatttagtagtggggcaccagcctgtgcttctgtgatgtactggtaatctccacttactgtcagagctgcagcagtatttatttttccttaattggaaccccactgatatcctgtgggattccccccacccctccccttggcaaggcaatatatccatatagacctagatcataaacgccatggtctattgtaatattatagtcaggaatatcaacactgggatcaaaattaaaccaacgtccagtttctagactgcctttagatattattaggaactcaggatttttctcagtgtttatctttgaagttacagaaatgtctgcagaagctcaaattgaatatgctttatcacagtgtttcctcttctgttttaattcttcatttcattgcttctagaagtgtggggatgactgattacattgcaaactattacgcataatgaacaagtaaacaacaaacacgagtggtatgggcactctatatagaaatgttattttaaaaataccttcatcctttctaggtgaacaaatataataagatgcctggaaagccttaattttattaaagttaaattcattaaaattaagtaaatcctttttatcttaacttttggtgtcaaaacaggatttgttaccttggacatcagagagccacttcgttgtctttatttatggtttcagcatttgcttttcccatgtgctattttcatttttgtcattgaagttcatgaagacttaataattatccctctaattttccagaaaaaaaagttgatttattgaactgactgcagaaaaagaagaagaagaagaagatcaatctgacattgtaggttaatagtagggaacaaaacacgttcataattagaagagaaaaggactttccttgttcattccagtttataataaaaagcccctcgctaaagtgtcttagaaaataatgcattcagactgagtcgaattaccgcctagcagattctatttatctgtagcttaaaaagcagctgcgtttttgtaaaaagcaatgaatgtggcagtcctacttaaaggtagaagaaaaagaacaccccttgttttgtaataaggggattttcaatttaaaagagagagcaagactgttgtgtgaagtagggttattacattcactgtattctatctcacccaccaggaggctaataatgaaggggccgggaaggaggccagtgctaccagggttatctcacaacctcagatgctggataagtcgacggaggcagaatcgctttgggatgacattcagaaagcctggagtgattacttgcaagagaaaagcctacctattctttccaaggtaaacagttcatttcatctgtcagtggcatgtttcagtatacaaatatgtttatataaagatatctataaagttttccttttaaaaaatcattttaggtgcaggaatattcccctgacctgctcatccagtggtccagtaatgaattactggagacctgccttagacaaagaatgcactcggagccccaacacacctaaagccatgctttgaaggatctgccaagctcacttttaatcatgagaaagaaattacccacacggagtcagcagaaaatgagaaagtagagctcgtgctgtgaataattccagcaagtgccaaggggctagttgaggaatggcttcatgaggtgaatatctttagcttgtacttagggtttggttagcgtataatcattttctcttttaggagcaatgactatcatacatgtatttcctaactaaagagtgctcagagcatttgtcaggttgttgacagatttaatatcagtcttgcccatgttgttatttactatgactaattttacgtttgtaaatatgcaaaaatcaatttaggcggaaaggctctcctccgagccaatgactgctactagctgtatgcatttgtgtgtattgctgtgagtgcatgtccagtagtttatgtctctgtgtctgtatgtgcccttgttctgtcttctctctgttgtgaacgcaggttgggagaattagccaaccattgggttctcagatgtggtcccaggctttcatttgatttttggaacgggaaaaaaagaacgtgtcacatcatgattaatggtgaatctgaattttcaattcacatgaaaggaggaaggggaggggatatgagtcaagtgacaagactaaccttttccctttgggacgagcatgattcaaattaaacatcactttcagtgtgaaattagtttgaaggctttttttttttttttttttttttttttttgtgcctggtttaactccttggtggctgctcattcagagaggattgcttccatcccagctccgtgcccaggtctactcccagtagcccacagttcctcctcctttgtttttctaaagatcaggtccaggaaatgaatattttaccatttcaaaagcttcactcctcacaagataagattctccctgaaatgtgtgtcccaaactaatgttttaatacattaaatcaatcaatctgttaatcaataataacattcttctttttttaaagataattttgccagggaggagggagaaaggaagcaagggatccttttgaaaggcattttgagtgccctccgcttggtgccagtttttgctggctgagtgcgccacagaggaagaacagcaacaaaactcccaagttctctcctgagtctctagtttcccacataacagtcacaggattgccatgccaaccttcagcaatgttggctttcagcaagcatgtgcctcgacactttaaaactgcccttcagtactgatccaaaggatgcaggtccaaacttgtagaaagaacccgctacctgagcaaatgcaaggctgccttcccatgtatccacattcttgatgctaccatttaagcatcagcagatttgatatgtgattgactctgtttctggagtttggtggctggtggagaaagggaaagtgttgagctggctaagaaacagtgttattcttctagtgtattttcaaagggaaaatggtagggctcttgaaccccttccctaatggaaggagagatgtggtagaggagcggtgggggttgggagggtagctggtggggagagctgagccagctgggggaggaggtagaggtggagtctgggaggtagaaggtggaggcagatgagcagctgtgtttattttaaaacatatcatttaaccctcacctaaaaacaaattggagaggtttgggagtgcattaatctggacccaattagcatgtctttctccttcaaaagtgcaacctgagattaatgaatataaactagagtttcagatgcagtgcttaaatcatttgcatgttttctgcatgataattgaatttatgtatgcacttcctttcgtttaactatttccagtctcttccctgtgattcacataaaccaagatgtcatggtagtcacctctagatggaaatagcttgcctagcctttactcctaaggaggaactcaagttcttgtttcttttatttgaatttgaataatgcatttttaaaaaataaagcagagggcagtgcttaatagtctggaatgctgtttcgggagttggtagataggcacctcaagtttattttttaaagtccagataaaaccattgggatttatggtattgagttttcagtggtacagagaattgggtttcagcatggccacttataagtgttttaataataccaagagcaatgtcactttaatgcagcatgaagaatgttcttggtctttggacctgagttatttagatcactgagagatttcagtgcatagtattgtttctggcatcgttctcgcttttgtagatggggttggggatgcatctctataaaaggctgtaggtgagcagttagcacatagtatgctatacttttttatttcctttttgttatttaggtgtagagaaagcttaacgcttacatagtcaaacaggtactaagatcccgactccccacctgacccaaaatgaaaagtctaaaagccagcatgggtatgtaagaaagctttctggggaaaagttggagcaagaggcttgaaataattcctctggtttcagtttgcatcagtgatttgtctgtcttctgtctttccgtatgtgtttccaagttcaatgtcaaagtgatgagcatttctccaggaattcttcccagtgtcctttgtttttggtgaattcaatggctgaatgttgctgagtgtctcttggtcttgtttcccggtccttgtagctaagaatgtcgtggaaggataaaatcttgttaattcgtgatgtcacaattcaagtgtgcttcctgtcacttatgtgtagtttaaaatgttctttaatgtagcgtgaaatgattggttagctttgaaatggttgtgaagtcatgtgaagaaaataagttttgcatccgaccaagataaattcactctagtgctttatggctttttattcctatgtgatagtaataaagtctcatgtagggatggaagccatgaaatacattgtgaaaaatcatcaactaagaaggggccatcagtatagagaacgttagcctgtggagctgtgaatgtgatggagacaagatttagtgtatagctctgctacctgcctggtgttcctttgagtttctttatccttagatttgacagctgagaaatctaggtggattcatattcgtaatcattgattaacatgcacatttgggtttgcacatttttgtttatcatacatttttctccgttttctattaaagaacatgctctaggggaactattaatagcccaccagtcgggtaggcagcattcaatccttctatgccttctttcgccacctgttgaggtctttcttctgaaacaaagaagaaatagacaaatcagacttgccctcttggaaatgtggtccagatttctctactcccaagctccaaaaaaggtatacattggatgggctagatcaactcctcctgagagccataaatccgccaagagttgttttccatgtaagggtgtggtacaatggggaacacctgatgttggaggaaagcaggaggactttagagtggagttgcattctaatctctctgccgcttcaactatgtgacctggggcaaatgatataaactctatgagcctctttccttatctttaaaatgaagagaagtaatacctaccttgtagggctgttgtgaggattaaatgaagtaatgcatacagtgcctaacaaagtatttaacatcatattttttaaaagctcatgaaatattagtttttcttccttcccctctttctattttctctcctgttcccttttctctccctcctctgccctctccttccttcagatgttagtctaaaacagcaccttggatctaagcagcacctttgagaaagaaaagactgcttcaagaatgtctagttgcacctcctttccgtatgtggcctaaatgcctaggttggatcaatagtttaatttttttattgaactgtttaatattgactatggacttacattcacttttactgttttctgtatatttacttttgcttgaagtgttttaatattgactatttacctctgctcatttttattgattttctgtattttttcaatgaaaattat

SEQ ID NO: 382 - DNA, 35957 bp, Homo sapiens
gagctagtatacctttaattttatttcattgcaatgaatttaaatagtcacatgtggctattggtaccatattgaaccatattgaacagtgtacacacacttacacacacacatacacacagtttttgccctagtggctactatagaggtttttgatccctcctttcccaacaaacactggatttaactcaaaggtccattcttccttaggtttttgctatttccccccttttcctttaagaagccattgatggacctcattgatggaaagttctgtaagtgttgccaaggaacatcagtatatttttcctgtagctggcacctttgagggagtctggtctccaaggccatctgttttgcaagcaagggtgagacagccacattcctcatcctcagacctatgactctaccatggcgaaggcggtgaccagggagggctgggacatttgtgtcacagaaagagtccctgcattgatcatttctgagtgatgtctgagtgggggtaatacctaatgttaagagagtaaccatctgactacatcaagacttttcattttcaaagtattttatttaaataaatttttcttttgtgtgtgtttgaattttacagaaaaaaatactgacaaatactatacagcttggaccctttatatttttcttggaaaggtggctgccatttttctacctttctccctccctgctccccccaagaaaaagaaacatggaatccattgagcaatggggaaaggagcaatggggaaaggcctcctctggctgccgtccggagcctggctaaagctgctcagaagtccaggcctaggggatgtctttctcgagcctgtgctggtctaggaagcctcttctttaggaatcatttttttgtcccccgtgaacttaccctccccagatgagtcaagcagtctctggtcctgaggtcccatgggttgccagtggcagttcagggacagaggctggaaggagtgaaaatggagaggaataaagggctggggctggtctggtgcaggcagaagagggaatcagagaagcataaaacatggagaaaaagatgagaaggaagtggaaagaagagagtggatatcaacaatggccttaggctcctttcatgcacctgtttatttaacaaaacgtttagggcctatcctgcactgggactcctctagttacgccaggaaaggttgtcaggggagtctgtgatggggaaaagagaggccccattctgggtttggctcttctgagtcatcggctgtggaagtgactgagaagtgagtttctgggtgtttcatccctggggtgagagcaagtccattggattaggagacagcagggacattgtgcctggagatagaggccttgtcatggcaatgacaactgactgctgtcttaattcaaaggagcaagcagttgccatggaaaccatgttacttgtatggtcccggatcccggtgatccgccctcctagatcatatctgacactacgtctcagctgtcagcctccacctctccccagccatccattctagggggactgagaggtggagacaggaagggcagcttgtcctggtgagcagtggcagttgtggggagatgtcttccacatccctgggtttggtgcaggcagatggcaagtcattctgttatgtgaagggcacagccagaggccccatgacaaactctctatgtgacaaggggatagagaaccagagtgcttctttctctggtcaaaggggttgatgagtgggaggcctgagtgcttaggcagtttatggccatatagggtgagagggcaaatgtgactggctataaaatatatgcaggtttaaattatgattcacagggtcatctgttagaaaaccctggtgcaagggtcaccactaaatgcccaccctccacaggcctaaagtacacctggagggcaggtgagtaccaagcagcccaagtgagcaaatagaatatatctttcctttaatgcaatcttatagaatttagttttttgctactataaatatcatagtttagctacattattaattagatagcaattttgccactgtgtagaatagcttccttgggaaaatatttcaagagagctgcccagcatatttgtaaataaacttctagagcataacttgctcccaaggagtgaattgtccatctttgtaatacagtcacaatacaataaaaataccaagcagttcatcctataagtggattaactctgcttcccaacctcactctggcggggaaagccctcctcagctcactgtggatctaatttacatgtcctcacatacctcaaggcacatgtgtcacctacatgtgctctccagcattaaacacccaatttcatccattgcagcaattagtgggctcacttagaagagaagatcactcggggagaactggtgaggtattacaagcttacccttaacaacatcacatatccaacagtaaccacagttagttataagtacctactgtgtgcaaggcacttgcctgagcttcaatataaatataaataaacctctttatagcttcatcctactttcatttaaactctgttacctctgcatcccacctgtgccataccgtgcacacatcacaaccttatgacatcacttccagtgttgccttctgtgagactgcactgatgattgtctagttccttccctgctggaaactttggttatataggagatacctagctcaggtgtagcatctcctcaccctttccatctgtaaacattgcacaggtacacagttgcagtccactgacataaatgagtgggcttccataattttctagcagtcaccaccaagagctctttgttcttgcttggagaaaggcactttgctgagtggtttgcgggggtaatgtttcacagagaggtcttggatcacattaaacacctctcagtggcaatgaggacggactttgtcatgagttacaagaaaagagctttcaatgaattttgaaccatcacactttaaacatcttggcacaggtgaggggtcagaggcacagaaacttggtgtgtctgtatcaagacacacaagggtggggactgtagcaggttgctggaatgtccaattatgagtacttccagtaaaagtttatgtgtagagttagaaataggaaagcatgcatctgtaacctgagtggtttatggaatagatggtgtatgggggccttgctggttaggaaattgtatatatgtgtctgaatctggcaaggctttcccatgagacatttttgtgactgtagataatgtacttccctgcacaaagtacatagccaatgaccatttgatgagcagaatatacttgcccacgtacctgctacctgaatttgtgtgtgtgtgtgttacgtgcatgtgcacacacttgggaaccatattgagatgtatggataaatgttctttgtgctttgcatgtggggtatgccagagacaggtgggaggcatgcctgggtctgcagtaaggagcattgctattggacacatagctgccaagacagtatccaagaattgtccacgtggtccctgggactgccctccactgggacacttagtctgaggtttgttccttggttgagtagttactctgtggacatggacatagtgcattatttcaggggttcctgaaatgtctgtgtgtggtcagaaggaggcttagccccagaaaggaaacacctctgcttcctgcctaactaaacaggcagtgatggtctcttctccatctggagaagcttgggttgagcagagatccagaggtcttcttcatccttcttcttcttcttcttcttcttcttcttgttcttctctggctgctggcccctcttgcctggtgggctccagcagcaatggcaacagatgaagaggagtgtgatgatcaccaagagtggcaggcccaggaggactcccaggcagatggtgttgtagatgccttcttggtgtttggtcaagatggtgtcccagatagagctgaagaaggcactgattctctccatggtgcttggctagattagggccagagaaccctctcggcttacaagcaggtcctgggctcaaaaggatgcaaccttgaccacttgtaatttattcctcttccagctttgggtttgggcatgccactggcagcacctgaagagattaaaacagacaactgaagagaaatgcagggggactggtctacaattttaatagtgtcatagattttaggcttaggaaaggggaaggaattgaagatttccagggttcagtaaacttgtattgactcaataaacaagataaatgcatgcatgtaatcaataagcatcaactaattcttgctatgtacacacattatattgggcttaggatataaaaatgaatagtatatcaggtctggcacgtaggaagttctcagtagttgttggataaatgaatcaatgtgtgtgttcagtgttctgataaggggttgcttccctggacccttctgcaacagcagttctcaatcttttttccactgtagctcacctgacagatgttgaacacacactccccacaggacaggtctgtatgtaaccttttattaacataacttgccattttcaaagcttattgaagcttaagcacaaagtgagatgtctacttcttgctgtctgtagtagggaacctgggtctcctctgggctaagaggtcatcagtcctcatcctgccccatgcctgctttccgtgctgtcccctcatgatctcttccctgctccatgtctcctcccctccttatatcacattcctgtgcctgagaagtcctctcctcccaaggctgagagaaccaggggtgaccatttgctggctttccactttctaccttctaccttcctcttcctcattacccttctctatgttttctattccttgaccaaatactccaaagtctcctgctctctttcttctctatgggagaggagtccttgcaggctgcttagtgatggtgcttggaaaccagagtgaggttcctgggtgcctccctgttcctgttctgaactcagcatacagctggggccattctcctggttgcttgtacagagctgcccctcttccctggtcacccctccacatatatcttaaagctcagctctcaagtataaggtcttagaggctgccttccattctggaattacaggttcttgtgtacaaacaagacttcaaggacaggcatgattcaaggaaatttaagaggcctgttggtgtaagacattctccaggacccaaatattaaggagtggttgattttcaggatggacactccagagatcatcccaatgaactctctcacttaaggataaagaatctggggtccagagcagtgaggtgacatgtctgaggccatagagacccacccaggccacacaggcccacccagacccacccagacctctggacaatgggttcagcactctccgcaggctgccaggcaagcagaggaactaaggatgacaatgatgtcactttatacttgcatttcacttcatacttttctaatcattttcatctgcatttaatcttttgagtgagctgtgtctacggatgggaacactggggacctgggcctggaattcaagatcagctcaggcttcattgcatacatgtgcagccctcctgggtgatgttttctacatgatgccccagcaattgtcctcagaagtctaattccttggatagcatgctctatcaatgtctcatgatcccagtgcccatgtgcctatctaagccccagctgtcctcagtcctagtctgctggcatgtaatcccaccctctcatggcattatttacatagattttgcaagcgtacaaattggcacctactactgagccttttggtccatggagcccaaagaaatgttataggatgacaataataattgtagccaacttttagtaagcagtaattatataccaggcacttttctaggcactctattaactcattcatcttcatgacacccttatgaagtaggtactgtggttcccccatcctgcagctgaagagatggaggctcaggccacacggtgagtgagtgccagagccggtctcactcattctggagagtttggctccagatccgcaaggagtgatctgttcacaggcgttgctctgtggcctcctattcctttgtgtggaattaacccatttttggcaagcagcccaggatttacagaatcttacaatatttggctattccccagattaacttaaatgcttatcccagtctattgtaggaaagactgcaaagagatttatttctcattgttagatccttcccaaatgcatgaagatacataaaataaaaacaaagttctgcccaagtgcaggtttatagaaagcatatggctgcctgaacttaaactcaacatgcaacaaagaaaagtatcctgaggagtcatgtcctctcatccaaggctctgctcaagcccctctgaggcctgggaacagcccatgccatggatctgcccacacaccatcaagctgccaggctctctgtagagaaaagcagcctttggcatgcttctaagccccggtgatgctgtatctcaggccactcatctctcttctggattttccttctccctctgcaatgacctttgcttttacctcagtcttgagtgggtctgtgcccctgtctgttgggatctttctgctctgttgtggaaaggctttgggtgcttttctttaatttgattctactcacagctttcctgattcacgttagataacaccaccaccacaaatgttcaccaactattttgtgccaggggttatgctgttcctacagggagcagatgggtaacaggggcccctctgggttcagccagcaaggaaggagggcgagctcatggagatcaggtcagttttcatgaaggtggagccacctgggggacgaccttgaagatgcgtagtattttgacagagaaatataggtgaaaaggatgttcaaacattccaggcagagaaacttctagaacatgagcaggagaacagggggtcttctggtgagcctggagctcagggtgggagaagagaggatgagaagggacactaggaggtaggcatggccatggtagaggggccgtcatagggtttgcgtttatttggaggctttacaacaggagaatgttgtgatcagagctgcctttcaggaaaagataacaagatctgaagaactctggaaaatgtgttaagaaagttctttaaatctccttatccgtttatcaaacattcactgagcacctaatatgtttcatgcactgttgggtgttgagaattcaatagtgaatgacaaagatatggtttctgacatcgggaagcctcgtccattccaggggagttattactattgatagatcaagtcataaaagccaagtacaataagcaaattccaaactagattgcttagttggctgaagtagaagcatgcatttgaattatatgtttatctcaacatctagggccctcccacccctcccaacctttgtcttaaactcatccatcccttggcacctaaaatggcctttgaataaatagatttcttttcaagctaaagctaagtcaataattctcttctggattcctaaagggacttatttgaggctgctccccatacagccaaagagtattcattaacatttgggaagccagtctggggaaaattcgattaaaaggtattctttatattttttaatctaagaattcttttctaggcaccccccaggttacttgctgagctctgctaatctatagtgtttcattagtatttatgagtcttgcattattagcatttccagaaaacaatcaaatatctccttagtggcatgaattaaaagtgagaacttccatggaatgcaaaagaagacacacttcggcccctggaagtacactctagccttttgttagcttttgaatagcactgacaatgcttgaaaagtaattcatctatttttgtaagaccaacaataggtgccaaccaacctcatctgtctgattgtggctgtgggggtggacgagaggacagagaagaggggaaaactttctttcaatttttttgaaaccaaatattatttacctccatatcctctgtagtatctagctagggagacagaatcattcattcactctttctgtcgcaaacttctatccacccatgtatgaggtgacgatgggaaacagtgatcccagagccagaaggcctggttttgagccttgggtcaacctgcatgaccttggcaagttaaccagacctcagctacaaaatgaagctaatgatcttccctcataatgacattgtggggatcaaaatgattcaatatatttaatgcattctgtaactgtaaaatacttacacaaatataatccataaaatagtgagttatcttgaaataacaatggactaattccagtgctgggcttttcttcctccttcctcacctccaagccaatccctattgccaaagaaccatgggtccccaccgcattgaaatgaaaaggtcttcagaaataatctccctaatatggttggtctgtaggtctgtggctgttgctctagactctggcatccagaaatcagatggagagcggtcgcttggggaacatctgaaggtgcctggaggattgctgagttcataggtgaggtggaggagagcagctagccatctacaggccccagcctccctcccaggctttgggacccttggaagtgttacaggggtgggtcattccacagggaggtctgcttcaatctctgagagccaaaagctactgcaggctgtgtccagggctggccctgacactgctgttccttccggtgctctccaagaagggagcagggcgttctattctgcatcagcctctcattgttcttgttttttagacaaaataataaatgtaaagctctagaacagtgtctgtgagacagtaaatactttctggaaaggttaataataaggatcacaatggcacccaattagaatccctgagaccaactccagagtgacctccaaatggtacaaatcaccacccttcttgtagggggaggtgggaggttcagttctctatgagaaccttaagagacccctcttctgcgactgctgactcctggatttgtgtggggggccattttataactgacagttgggagcaaagacctccccttgggcctttgctcaaacagctccattgagctttctaccttgggtgcgctgatcactgtgcttgctttagctcctctgcccaggatcccaggtgacagcaggatggactgttggctacgaagagtcatttaaggagttaaaaatacagattcctgcagcctgctcctggagactctgattcagtcgggtctaggatgggcccaggaatttatgtttgtagcaagcagccagagtgtttctggacaattgtcaggtttgggaataattgaataagcaagctgagcagccgaccttcatttatgagcacaggagccatgtgctaaatgaggggaagaatcatgggtgaggagacgggggatgaagtttacctccacacacagcagcaaaatggccagccagcttggggagcctccttccacgttacttcttgctttgcgttgtcaggggatctcggccagaactgctttcctggaggtcacgttcaacgtagtaaacaatcgctgaacacccgccctgtgcattcagatcctgatcaccgcccagtctagcaagggggagaaataaaaatagaagtatagtgtgatgagttctgtggtcaagttctgtgttgggggacatgggagcagcatggcagaagcagccagcggtcctgcctggagaaggttgagggaaggcaatgaaaagaaacgaccatcatgactggtgtctgagcaggcatcgtgcagtgactaattacagagaacctactcctgctgggaactttgtacccaggacaagcaaaccagatccctgtcctttctgtgctccaagtctagtgtgggaaccaaaccaaacattcatcaaagaaccatataggcaggtgtgaaagtgtaattatggtgagtgccacgaacaagaccccacgatgctatgaaaggggaaacagggaggttaggaaggctctgatgagggatgactgagagaagatctgaatgacaaaaacagcaaacacatggctagggtgtctgaaaagttttgaaacacaaaataaacttattttaaagcatttccaagtaatatgcttgataggcttttcttcaaccctccaagaccttttcaggtgaagttctctacatttaaagaatgagttcaattgttaatacactgtaaagtgtccccccaaagtctggaaacataggcaaacaatacctgtattgtgctttttattagatgaacaaattagacccattgctgtccctgaaaaggacctgaagggacagggtagctgacagcagcagtggtggggtgagggtggatggcagggcccatgaatggcagccccacaccacaggaccttgtaagccacgtggagggctagagtttgctgtgagagccacggggttttaagcaaggaggggacataattgatgtggatttcataaagaacactctctctgacgtgtgagaggacagatgggagagggtgtagggggaggaaatgatcacagttgtccagaaagtggcagctgggccaagggtgatggtggtcggaaagggcgggatgatggcgtggctcaggtgttttccagcagatatgggtgggagaactctcaggcagagggacatgagaggaggtgtccctgggtgtgcccaactttccttcttctaaccctagtctcctatgagggctctcagtctggaatgtatatgtatattctttttttttttcctttccaaaacaggaaaatcatcagtctctacctgactcctcaccatctctcttggggggttaaaacaccttattcaaccccaggcctctccaccctgcctgtccaaaccttgccccagctctcaaaccacactgccttacaaaatccctgtggttacgataatatcacacacttcagaaaccaaggctctctggcagcgagggcacagagtggaacctcagtcagtagttattaacttggctattctggatatatattttcttgatggttctcaccttgctaacctggcatgctcaggtgccctctaatagaggtaagtactgttttgtacaaaaatggtctgatcacagtaaatgatctgcttgtagaacattacatttattacttagacccagctctaggcattctgaaataggtatctacattttccccaatttaatgaattgcttcaaataactagtcctaatacaaagtcggaagctctcttttccccccagagtatatatgatgcataactagatattcagtattaaaggaaaatagatagtattttcccccagaattgatgttataattatggttgcaattttgaacaaaagcacaaatagagcatcaatagaaaaatgattaaggcaccatggttatttaataaaatgatgctttatcatgtaaacattctggattagaagactcctgaaatgggccatctggttgattaccttactttattgatgggaaatctgggaccaaagagactgcatcttgcgggagatcacccagctggtgactaatagagccagggccagaaccaatgtcttctgaggcccaggttaccctcctgccaggtctcttccacaaactcttccacagtgctttgcaagatgcccaccatattctctttctgagcacgagtgagaccatacttctcagccccttacgtctctgtggggctatgtgactgagttccagccaaggaaacgtggctcctgaaatcttctcccgggccctccctgttctctctctgcttgctcattggctggccagatgcagagcatccaggggaggactccaagagccctggggatggcagagatgggaggtgttcctgaatgactgtgtggagcagagcacccctgctgaccacagtgaaaaatgaaatgagttagaataaacttttgttgggtgaagccactgagatttggggattttctgctacagcagttagcctatcctgcctaatacaagtgacaaaaaagctaatgttggtaatgattattaattaccattgcatatataatccctagaatgatttgcttataacaaatgtgcaatgtgttcaacaactctcctatagggcagctttggccaaagaggggtttaccttagtgcttttgagcagtggttcgggaaccagatatcctgggtctgaattctggctctcccactcactagctgtatcacattgggcaggttaacctctctctctggcgctctgttttctcatttgtagaatggcatggataataacaggatgtgagaatgaaatgagtcagtagaagtagagtgcctcagagccttgcctagcaataaaagttagtcctgattgtttgatcccaaacaaataggctggccaaagtaaacagcccttgactccttagctaatgatggttttgtttgtctttttcaaatgtgagatggttctggagtcatgactttgattatgtaggtctcctttacaaggcattttctcttttctctagttttcctgtggtagactaaattagttcattcatcattctctttcaaagcgaccatttcagaatgaaaatatggataagcaccactcaggagctgaatcataagggtttagatacacttccttcccctctctgcagggctctcccaagattgtgtggagtaggacatagaagcctccttccttcctcaccccgacgacaaactgcccttttgtcttttcctactttcccttttttccctccctcaatgtatttaatgagctcctaggatgtgtcagttccggtcctggcaccatgggtatagtcatgcataagacagacattttgtttgtgcacttattatctctcttctccaggtagaaagtatacatgttagtgcaataaaggaaataattggagtggcctctgaaaaggtgactctgaactgagatctcggggtgctaaggaccaagcgtgcacagcgctaagggcaggacctccggtagcagcaacattaagggtgagggctctgaagtgggaaagcgcatggcacatccatgagagagggcagccaagtgtggctggaccgtggtgagcatcgtaagtaaagcagggcttgagctaggggcacttgggccctgtgggtatggaaaggcacagaaaggtgccttcccctttatccccattgttacctcatttgtccaggccttcaaatggcctctagtttttccttctttcaattcgtctttctaaaatctgaatgtaacgcgcactccctgcgcaaccctcgcttggctgctcaccacctgtatgatcacacctccttagcaaggaggactggctggtaatccaactctcctattaccccagcctcaccttcctccaccacccccaccgccctagctgtttatcacataataggtgctaataaatatgggacaaataaatgaattccttcaacactcggactaagcttctctcctgggctttacctccccacccctacctcatcagctggtcctacctgctctctctctgactatgtcctgactccatccacttcccaccatttccatggccaggcctttgctgtctctcacctgggttactgcagcagcttcctaaccaatctctctggttctgctcctccctccctccggcctgttctccccaccagagccagatcatatcacccccaggccctgctcacgcctcatggcttcccgtcactagaagtatgacatctaaactagaagtatgacatctaaactctttcttacatccccaggccctgccatcgtctggcccctgcctccttctggaccttgtctggtactctcttctctcccattcactgtggcctagccgcgcctactactggaccgtccactcgctcaggaccctatttgtccctttgcctggtatggttttcctcagatcttggcgtgattgcttcacaacatttgcgtcagctcaaatacattttcatacaaatttcctcccgtgttaccttatcaggaggcctttttctaatggagtatggttatctaatgtcgcccaacccccagccaacccctatctcaccatcctgccctactggcttggtgatactcctcactttgaaatttctcagtcacttacaatgctgctgtcacgctggtttccacctttactgcctgtcttcctccattagaacataagctccatgagagcagggccctgcctgtcctattctgtttggatgcccagagtctggcatgtagctgaatgaatgaatgaatgagtgaagttaattcaagggttctaaaaaaatgagatcttgaataatcatctgtcaggcaaaccaggtcactggggagaaagagtagaagaaccaaagggcatagaaaagtgaccatcagtcacactgtggctggactttaatgataattatccacccgcagactgcactctccagccagatcttccagccacgaaaactcactggagggagaaataatgatcaagaaaaccgcctatcactgagagcaatagaaagtgggggcaggggtgagtgttttatcagctcctaaataatcacctaccttccttttgctcagttacaaagagcccattgtagctgggactttctgataacaagggattctttcctaattactatatgctctatttcaggttcagcagaaaagaaaattaaaaagctccatttcactgtgggttcaaatgagtcaatctttcagtcaatcaagtattaattaagacgtgctaggaaatatgggggaggtaaaagacatcctctcttgtctcaaggatgataccagggaaataattagagaatgatttaagaacaatgaaaagaattttaaaaagccttcatgtggactttctttgattttctattatggaaggtctggaatctccagttcctttattcttctttactcttttccctttcttctttccttccttttctctcttttcatccctaattatcttttctccagagggtccagactatacactctaagaatagttagttctcctcatgttaccctcaggattaatcatgagaaattatgtctgattccctgaaaattccagctgtactaaatgtgagtgaatacaatttctccagtctgttagcaagtcaacttcctcatatttacctcctcaaggtcaaggaaatttcctaatttttcttcttatatgccagaaaacttgtagccaagaattttgccagcctgggcaacatagcaagatcctatctctacaaaaataaaaattaaaaaaattagccaagtgtggtagcacatgcctgtagttccagctactcaggaggctgaggcaggaggattgcttgagcccgggagtttgaggttacagtgactgcaccactgcactccagtccaggtgacagggtgagactttgtctctaaaataaaaaacaaacaaaaaaacctgtctccaccactaacatggtgtggggtttggggaacattcacttaagtgctttttccatttattcttctgtaaacaaagatattgccatctttctcagagggctaggtgttttattcactgcgttacatcattttactctcagtatctggcacagggcctggtagaaagtggactggcagtaagtacttgctgaatggatgaatgaattaatgcatcgctgggcagagtaaatgagataatgtgtgtgaagcatgttgtgtaagtatatttcacacagtgggtgccttaaaattgccttgccaactgtaaagcactatatttattattatactattcacattgtgtgaaaggtgaaaacatccatttgtgaaataattattttgctctaattagagtttgatcagcttttcactgaattggtgtagaaagtgagttaaccagcccctagtgaatcagggcagccaccttagcctctcccctgccttcctgctaactttatttccattcactcccaggtgcttctccctctctcggccctcctgacctccaggatcgcatttcttaggggagccttgtgttgtccatcactatcaattttctcctcttcacttcagctagaatgctcatttgttttcttttgacagtcctcttttgatttagatacttcaggaggccaaaatctcaaaacagagggttggcaaaagtcttatcacctttcacaggaacaaggaatgatctgttgaatcaaaaagccatcatttgctgagttcttactaagtgtgcaactctgtgtgtggaatcaagggtttacagacatggtctcattcaacaactcaagagataggctttttttctatgcccatcctacagatgaggaaactgaggctatgagagatttaagtgattcgcccaaagacatggagctactcaagcgcagaaagacgtttgactctagtcctctctgagtccagagatcctactgtaaccaccattctcagaatgctgaggactttaatttctggatcttctaagatgatggggtgttcatccaactattcatctatcaacatgtaaaagcctgccacgtgcgtcacaccctgtgggtgcactcttgattacgatgccttctgtgacctcaaggagctcatgttttaataggaccaaacacgttgaagagaagtgcaatacagcatcactgataacatgtataactccatatatgctggggccccaaggcatgaaactcactggcagtctgggagctatgtccaacccacaggcacttttactttgtattatttttctgcttcctttggtttcgtatcaaattctcaatcttcagctagtcctaagatttggccacactaacctcccacatggccacaatctgctggagctttaaaagggcctgtgttctccccattccccgaccccacaccccagtccccatcctgcctgcttcacccagtcctgttcacccacctggtccctggaagcattttaagctcacctcccctggattataaactcactcaggagtaggaactatggtacatgttctctgtgctgtcatctatgtagagaagagccatgcagggggcttaaaaaatataaatgaggacaaaaggcaagcctcacatagcagctttaacctccagtttgatggactgatcctgatctgtggttaatcagacaaatgataaggatgagggatgtttgcaagaggaattaatgcatatcaaaatgcccctgggcacaatacaaacagctggcccaagggtgcaattaagcaaggagtcagaggaccctctcctagtcccagttcagttgtcctccaggcctttgaccttgggcaaaatcagttaagctttctgagccctttcctcatctgagaaatgaggttattactcatcctggatatctctcaagattactgtgaagaacagacaagacatgtggaagaacactgagcagggaaaattgcaatctcaatgcaaagtagtggtattttaggggattatattaaaaggctgaattaaagctcaaagtagaacactgagcttctcttactgatgcagtcctccaccctcctatcccccgcctttcccctagtctgtggttattaggagctacatttccaaagtggagaattcataggggaactctaataccacttacacttctattcgtcatctgtatatacatatatatatatatatacacatacatacatgatctgaccacatcctggtattagtgctaataaaacctgtagccatggttacagtgaactatcttggttatatagttctcattttcacttttcaaaatagtttggtaaaggattttggagccaatgtttgtgggtgtggtaaagtgtttaggtgaagttttgtttttggagagccagaagccgaggctctgaggtcatctgtgagttaggagcggttgagtggggcgttgccttttctgttccacaaataaagggaaacctctgcttctggccgactccaataactgatgcttaagtgttcaaatgtcatatcctcttggagggaaaaaatgttttttgaaaaagcatgagaacgaccaaacacttgtgtcattcagggtctcccacacaggtagtaattaaaagttgcataattctatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatataccgaaaggattataaatcatgctgctataaagacacatgcacatgtatgttcattgtggcactattcacaatagcaaagacttggaactaacccaaatgtccatcaatgatagactagattaagaaaatgtggcacatatataccatggaatactatgcagccataaaaaaggatgagttcatgtcctttacagggacatggatgaagctggaaaccatcattctcagcagactattgcaaggacaaaaaaccaaacacctcatgttctcactcataggtgggaattgaacaatgagaacacttggacacaggaaggggaacatcacacactggggcccatcgtggggtcaggggagggggaagggatagcattaggagatatacttaatgtaatgacgagttaatgggtgcagcacatcaacatggcacatgtatacatatgtaacaaacctgcacgttgtgcacatgtaccctagaacttaaagtataataaaaaataaaaataaaaaaataaaacttgcataattctctttaatactagagacaggaacttaagagttctgcaaactttggggcaataacagaatgactgacatatttctttttgttagtggtggtgggggagacatttacaggctggaatagctgaaaactaatgaagtggcaaaaatgtaaattatgcaactcaaaagtgatacagatatggttctattttcctttccattttgtcctttcatttaatgttaacaaaatttcggggcaattaaaagccaaaagctaccttactgcaatattaagtcttaaaatgcaaagatcaaatcatagagggagtgagcataaatattctcattccaataataactcacctctgtggaatgttcagtgtggtggacttcagatttgccaggctttggatggcagcttccaccccagagggcagtctgtgcagaggagttcatatgtctgaggataaacctttacttcctttctgcatgggcttaaatctgcattcctaatgttgcagggagtgtttttttatggttttgataaataatggttgatgaatgcagagaacatatatgagtgagctaaaatacttattgagtacacatccagtgtcaggttaagtagcatgctttttttttttttttttttttttttttttttgcttcagcaccttctttctttgatatagatgacatatgcttagcctcatcatgtgcagttttagttgcctccatgcagatattcttgtccctaggaatagccgtcatctcttccctgatgccctcagcatgcccaaacattttcctccccatccttgaaatgcccttcccaaaagagatggcaagtattgcaaattcctgaatcgggagtatgtatggaagaaactgcttaagctggggattgcaggggggtatcccatattcacccccctcgacacagggttcccttagcctcatcccctcattctttcccatccaccacctctgctccatccatgcctggagacctcaaggctttgtgggagaccctctggaaagcacttaaggccactgggaggtaggggggatggtgggagaggccagggaactcagcccttgtctctgggctctccatgatgtggcctcagggctgagctgtctgcaggccgaccaccagactttaggctttatctcccattagcagcccagatacattttttatcagaccaaccctcaaagtatcagggtcttgaagaaataacacattaggtgggaatgctttgatagagcaagacattctgaatgttagaccctgcccatgacagttagaaggcagaagatgccatagggatggcagttggcctagagcagccagagaagaaagtagatgtccttgaagtgcctaataggggtaggcagattcttctcaagaatctgtggggcctaggccccctgttctggctttgacttttacctgattttacttatttacattctcataacttgccctaggagccaaattcttggctaaagggtagtttgagtgcagaggaagctaatagattgaggaatgagaagaagttacaactcactcagtgtgtgtccttgggaaggtcactcagctgctttgagtctcagtttcttcatctccaaaatggggaacaatctagaagaatacacaagaaaatgatagcatgtactgcccctttggagggaaattgggggcagtgcaggaagggagactggcttttctctcattcctttggtaccattctgaatgactgatcacatgcatacactttctaaattaaaccaacaactggaagtgagtacctgctcacagggtccttaggtaaaagcacatagtgaatgtaatgtgtgtctgggctgttaggaactgtacaaatatttagagtcataattggtattattcccagcagttgcagggatgtggcaaaaaacaaaagtcactcctcaattctgcctggtagtcaaagtggcctgaaattcttgggaaatttgctccaatgttgggaggtcttcctgcctccaacccagaatggctggatggagaccactcctaaatcccctctacaaccaggccagccccttcacctacttgtgtagtggagctgaggctgctgctgggtaacttgaatcctccatgtgtacaaatgaccccaggtttccaagggctagcgggccatgtccactctgctgagcaagttctgacaagcacattccatccactgccaggaggcaggggggcagcaccttcagtgtgagcagaaggaatggtacctacatttgtggctgccttttcttggcctctggggctgggaagagctttgtataaaatgtgtgtgagtctcccttagttgtttactgagtccctataataaaaataatgctgcaaacatattgttctttatacatgaagaggccaatagcactaataacaattgtttgcatcaataaaatatgccatttgaaggatttttcctgtagttgcatgtggatttcatgtcaagaagcattagttaagtatttactatgtaaccgacatagtgctggaggggaaaaagaagtgtaccaactggttcttatcctaaaagagtttcttcacgaaccttagagcactgaagtcctgctctgcttagccaagtggcagggcaagtcacagagcttcatgagcctcaggatcctggtctctaagacgggaagacaatgatgataacatcaactgccctcaccattcagtgtggttgtgaaagtcaaatactaatatatatgagagttctttgtaaactgaaaatgtcctgcaaagttgaattttcaaaaataatagtaattaaatgctaaactgaaaaccagaaagtgacaaaatgcaggtactattagaaaggagagagatcaatgctggttatgttttatcagagtgggggacggggcggggggggggatatcatggaggagatagaggctgtgccagctcctgggctgtgtgtgattacatggagggctggacattctggtggggaaaagggcaagttggggtgagctacataggttggaaaagccagagcagaggtacagaggccaacaggtacagagttcgagatgggtatggcagcgaagaaggcttctaaggaagagtgggaactgaggtggcacaggaaagattagtgagatcacagggggctttgaaagcctaacatggggttggtgtaacagcctcaaggaggccctgaaagttgtgagcagaggagacctgacagcctcactctttcagtggccacattcttttacctgatcttgcttgtgatggaaagtacaccctaccagagctcgggattacgcaggattaagctcccacccatgggctcactggtaatctgccccaaccggtcaggcagagcaatcacagataccacaattaaaaaaacttttattaatagcatccgttctcccttagacaaaaatctaattataaactgaaatgaaatatcaccaaaccaatcagaaagaaatggctatttatctcttgatcccttgggaatagggggtgagggataaaaacaggatgcaatcagttctccctccttcgaactggcacccagatgggcttgggtttatttatgattggtgaaagtccaatgaatatcctacacttacaactcagtttagttttttaaaggcttctgaaaacatttcttccttcaatctactgtaatttgtagaggggagggatttcttgccctatttcacagatgaataatcttttcatagtaaaagtttgttccaaatttgttcaaaattgtaaagctggttagtggccaatggcacacagggctctagttttccacttccccagtgagatgctttctgcgctaaagttactcctaaaatgcaacaatgagggcagcaagcagtggcaaccaatccccttcgcagtttacaaagcctcccatttctcaaactctgtgaggtatggggttcccctccagctttggatccttatacaactgtagctctctctcaccccacccccatccactgctccctaccccatctcctggcctctattcaacattgttgccctggggaaaccttccttgacctcattacaggtcagagcccctgctctgtgcccttcaccatacctacattgtcaccacaacccataatctgcagtagggtaattgtttaatcattgttcttcctttctagatggaatctattcccatcatggcatcctctgcatctgggacatattttgcccttgggaaatatgtgctgaattaacaaatgaacatgtttatagatgaagaagctctgaggctcactgaaattaaatgactcatctaaggtctcatacctaataaaagatcatgtgccaattcctctatctctaaatagccagttttccttctgctctgccacactactttaggttcacacagatcatgttggtcagctggaaagagatatccaggaaaataaagtctgccagttgaaatgtcaatattttgggtttggagagctctttcagcttgggcagtatgctcaaataccaggtattcttgggtgctcctgagtagatctcttttggagactggctactttttaatctccagtgaggctgtcaggactaagaaacagagatgagagcagctgaggctcgacttccaaggaacaccagtctcaaatggacatcaagctttgttttcatggggtgccatgttgaatatcaagattacatcacttggaagtgagactacccttgttggaaagccctgattggctgtgtttctgacttcttggtgttcttgatttttaatttttaaaaaatatacagggtctcactctgtcacccaggctagtgtgcagtggcacaatcactgtaaccttgatttcttgggcgcaggcaatcctcctgcctcagcttcccaaatagctgggactacaggcatgcaccaccacatctgcctaatttattattattattactttagtagagacagggtcttcctatgttgcccaggctggtcttgaactcctggcctgaagttatcctcctgcctcagcttcccaaagtgctgagagtacaggcatgagacactgtgcttggcctctttgtgctcttcaattgatatgattttatttggtaacttctgcctgcaaagtcaactgagtagagtatgtgtgtatttgtggggggcggggggctggctcactacctcactgctattactgtaaaaagacctccctgcttttttctggagggaggaacttcctttgctggctttttcttccttcactgattctgggttgttgacaccattgtggccaaggaagccaggaacttccatttccattctctgctgtacagcagcaaattattcaattcaactcacatttgttgagtacctactatgtgcatgaagaacttctctctcttctaacgctttcccagataatgctgcctagtgagaagtagaaaacttgccagctatctgggtaaggaaatcaaaattgaacttttcttcttttgatagacactttaggaataaagtcaaggaatttacttttttgttgttggggaactggacaagcacaggcgaagtaccataaggcatgattagttcagtgtcccaagggaaattcaaacaaatgcttatggaagtagcaaggagggagacgttaattccagtgaggaatccagggcagacttcgatgagggtgtgatttgagttggcacctgcaaggtgcatagaatgtttaaaggcagcagggacgggaaagaaaggtgattccaggctgctcaagaaacccagctggctcagagaaagaatccagtcaaagtggcccgtgctccaactcagctctagaggcctccaacctcccgatgttaaggcttcaacactaaaacagcttgctccacccgaccccctctcccagggccttcttgcagccactgctttaattgccatggcattccagggaccactccagcccctgatggggatttttcaaggttctggccgtaggaggaggctgctcctgatgttctctccctccatacatcataacatgttatgacttgagtgtccggggatagggccataggcaggagtgactgatgacatattgggcttaaggacattgggggctacaatttcaaattgttttcacatttgactatgaaggcagattactgtgttaagggaacttgagtgtatagtgaattttctgcctcctccctgtccctcaccctcaccccaactacattttatctctttgtgcagcatatccttacatttgatgataattctgacttcaaactgggtgtcacaaggccctgggtaaccaaagccagttccacctggctcacgttcaaagggatccctctttccctgccccctcacccacaatcagcctgccaacatttagcacaaagtttgtggaaaccaaatgacattctatcctaagagtcaagcctagatcggtccgtggtcagaggctgcacagtggaagcccaggaggcagctgccaccagagagtggattgtgtttgatctgcagctttcagtctacgctctcacccagcttgtgtgaccctctcagatggaccagcctgggtcaaagcctggtcccaccacacactggcttctgaatatggaaagtccccttccctctctgtgccttagtttcctcaactataaaagggggataagaatagaacctctgtcgtaggattattgtgggaaccagatgagttaaatactctgtgtgatgtgggtgaaacagtgcctggcacagagcacatcttcagtgcatgttggcttcacctgtcaggcaccctgtaggcatctgagcttgtgacctctgctggggcccaatgctgaggagctcgagtatgcaaaagggaagacagtgatgaatcctgtgtgcatgatggaaagacgccactgttccattatttcagagcaagtgaggaatgctcaggcctgtaaaactgacgcaaagcgccctctaaataggtgggaaaaggaggatttgttagcccaggggccattttctggaatcatctgtagcgcggagatatcatagttgaaaatttctttccttctctaccacctcacctccctgacaatgcttgctcactgatagtacagaggctgctcctgtctgctttcccacttgacattaagctattacagagctttctcctctgggtatccccagggtctggttcagtgctggcacatattagatgtacaataaatgctttttgattaagtaattgactggttatgatctggggagatgagaaagaaccagagtgaagagtatctctgtgagggctatgctatgtccatgggccaggaagcccacattcacttctggcaccccaagctctcatacttatgcaagcttcttgtaggcccctgcagagccaggtgatgggttgggatagcagggtaggtctccagcagggtgaggggaccaggacccgggcctgggcagagcaggaaggccttgcaatgggctgagctttcacaattggggttgcagctcaaagcagcagcttatggctcaggtaagttggtcggacatctggggagccagccgaacaagggtgaagcaggactcagggattccagaatggcacagccacagcctgagcagtgggtgaagagatggccgcactagcgagcagagatcccagcacagactaatcccaggaatgggcttttctcacagctctcaatgagaggggcggggcttgcagctaggtgcttgcaggctcctgggtggtaggtggtaggtccttgagggtggaatctgtgcctgcatattgttttgtttttggaaaattccccaaagcctctagtgtagtgtcaggtacacatagaagagcttgagaactgtgtatggaaaaaaatggaagcagccagagtcatgtccgggcagcttctgccatgtaaagcaaagccgccaggcctcctaggagtcctcaaaattctctttatgcaaagaggagttgcagatgactgaccgaaagtaagtgatacaccctgacagtgcctgggagacaggagtgagaattaccaactggagagagtctagaccttccatgaagctactgcttcttgtacctgccaactgagatgaattggcaaagatactgtatagccatacgctaggagtctttgaagcaataacaaaccttaactgaaatgagaaatcagagtttaggaaagagatttcccagttcatttcttctctggggtctcacgtcacattacagggtctcctccctgggcattggccgacctcacacggtgccactggaaggcctcctgccccactccctacccttcttctccctcttcccttgtcttcttctcacatacacagtgtctgttcagagacagaggacagccaaagccattggaggccttttctcatctcctttccccatcccagggcacaactgttttgagaaagtctatgagttgaaacataggacccaggcataggagttccatgtcagtgtgacagggctgggcattccttctacagaagcacacatgtttatgaacctatgtttaataagtggcaactgtgtgccagacactgtgcactggaaatgcaatgatggaatagtgaagtcaaagagtgcctggggagggtcaaacattaccaagggccccacagggttatcaagaaaataagagacttagatttcatctcctttgaaaagtctacagcctagggccaggataagtgctctatctctgtgtccctgtcatgacacctatcatagcttttataacactgtgttataactgcctcttgacctatctgtctgccaaaatgactgcaatcccctgagaaacagaatggcttcttattcatcagtggtggcagctgcagatttcctttgcaggagctggtgaagagcacttagctcttcgtggagacctcaatttcttcttctataaaatagggatgttacaggttgaatatccctaatctgaaaatccaaaacccaaatgctccaaaatctaaaagtttttgagtgctgataggacactgaaatgcacattggattttaaattagggatgctgaactggtaattccagtataataaaaatattctaaaatctgaaaaaaaaaatctgaaatccaaaacatgtctaatcccaagtattttggataagaaatactcaacctgtagtagtacctattttgttcagttgacatgagggttaggtaagggaaaataggtaaagtgcttaatgttatccccagcacagatagagcaccataaatgttgctgttgttagctgttgcttcctactcagttataccaagaaggggctttagtttacccccaaatattttctatctcaagcatccaaataatcccgaatctctagggcaacgagaggtagtatttaatatcttttataaaagcataagatcaaatgcatcaaataagagaccagacaggaaaaggtatgccacttaatatgtgtattatcttcaagaaaggaaaatgactttataagtatgttgataaaaatgaggggaaaggaaagcagtttggcaactcctcaaaaaaggtaaaggtagaattaccatatgatccagcaattccattcctaggtttatgcccaaaagaactgaaaacaggtattcaaacaaatccttgttcacagcacactattcacaatagccacaaggtggaaacaacacagatgtcggtcaacgaataaacagataaactcttatggtatatgcacacaatggaatatgattcagccataaaaaggaatgaagtaccaatacatgctacaacatacatcaaccctgaaaacacattaagtggaaaaggccagtagcaaaaggtcacatattgtataattccattaatatgaaatatctagaataagcaactccatagaggtaggatgcagattggtggttgctggggaccgggaagagggaacaagaagaagaaattgcttaatggttatgggtttttattttggggtgatgaaaatgttttgaaactagatggaggggtgattgcacaatattctgaatgtactaaatgccactaagctattcactttaaaatggttaattttatgtaacataaatttcacctcaattaaaaaaatgcaagaggaaataacaaaatttcttgaaaactaatagatgtcacatggaaaagaatggcagagtttcccttattaattgtttgagaaatataaaatgttgtctgtgatctctttactgtgtatttattcattaattccaatgccaagtgttgaatgaccacatgcccagtagtttaagtacttttccccttttaccctcaggccctaccttgaaggaataatattttataaaccaccaaaatcttattcctggaaaatgtcagtcaggagcatccgaacttcttcctctgtggcacatgctctgtgactgtgtctcctcccttgttccagacagtgtggaggactgcagtgcctctgtctggaaatgaggtgttctttccatggccagctttgggaagctgtgctatccacccactgaaaatagtcaaaacccagctctttcctcaaagaggtcaatgatgtccttatgcaaaaccaagaaaagcacagtctttggaaatcggcaaggcacccagtaaagtactgctttcttcctgtacttgtgaaggctttggtccaagtgtcttgcagggcaagatctgagtttctaatttggaaactaggaaagctctgagcaggctgcatctggtggggtggtatgcaagtgtgttcccctttcccagtggagtttcattatggaatgatgtgggtcacccatgtaatgagatgggaagcttttatctaggccactgttatgctgtgctggcaactgctactcagcagattgtgggccttgggcaggagggaagtttcaggtcaggagtggaaggtagggagagagaaaggagggtggaagccatcagtcatttacaagaaaggggtttcatagataagctaagtctgcaggactggccttaagagtaacttattctcttttgttattgacacatctccctaacataatgttgaagaaactacatatgtttctggtaggggtgggcaggattgtatgccttaaattcttagcaccaccattcaacaagcggttactgagagcctagcatgcacactgaaaatctgtgggagccaagaaagtttggatggacgtttgtttactgtgggttccaaatcactcggaaggtcactttgaccccagcattagtttctgggtggtttcaggccagtgtgcatgagtggctgtctggaacttgcaggctacagccagggctttggtacatgataatcacatgcagaggggcttttgaaagctggcactttggcccatggggctgcagaggaatcacaggttagaaaccatgagcagatggatgcacatttaatatcttacttgagttggggaggaacaagaagctcttgactcagagtgcagcattcttttctcttatttatggtggccactgtcacatgtcatttaagttaatacacagcatatccactatactattctgttcccataacactaagctcatgggtcttccctgttcccacggcctttttcccttcccctgcccttgaccctctttccctgcccctacaccacctctgaacctgtggcccacagctcttttccctgtcaggacaatgtgaagactaaacatactatcacatgcgactatccttattgttattatttgtatgttattttcctctcttctgccaattttctttttatgacttgcctgggaaactaaaaaaaaaatgctgatgggcttttctgaagactatccagcttgaaattagggttgtatttgaggagaataaaatgtaactgaaaaacatcccatcgggagaaagctatagtcaagagcaagggcatgtctgcagtggcttctaaatacaatcatctcttcaattttgaccaagaactacagcaatggttaggttttgttttatttcttagtgacaaactccatggagcggcttgctcacaatcgtgggagcaagtctcttcccaggggtggggattgggtttggatgccgccatgtcccttgggagttgcctctgagaaagaaattttgtgtttgtgtgaggttcgttttggaacttagctgccctttcctggtctccattaaatgtccactcatgtccccagatgatgctctgttcagatggctcagactgatgtggcggaaaagctagaaacctggcctgggctctggccctggggattgtctttcaaagaatttgcactcgattttccttttgctgtccagggagggaaaaagtctatcatgctactgtctttatctcccttactgtgtctgtgacgagtctcctgaaagcccattattcacctggaacccttctcactgaatggtaagttacatatcgatattggatatgtaatttcaactaatccactggtctctagctcattcttatctctgaggtgaaacactcttcctgacaagtttgaggaaacactaaaaggattttagttaattaaggcacccaatgttgtttctcttcttgaggggtctttgggaactcctgagaaaactttaaggattgaaactgaggaaacagaagagacgagggtggtatggaggttgccttaaaagttgagaactacctgcatcccttgagggtctgcccctagtttgtcctggaggccacttggggaggattggaacttgaggtacaattttcatttcacctttccacaggcatttgaatgcctagctgtgtccttgtgtgtgagatacaaaaggtgatagagaccctggatagtattgggtattcctgggcagaggcagatggaacttggattctggtccctccattaaccagctctgtgactgggcccacacttcccctccctgaactgtagtttgctcatctgtgaagtgaaggggtggggctggctcttctcggaagtgtttttccatttgaagtctctgaatctgtggttacttcctctttttcatcaacagcttagcctctattagaactctgtttacttgaaggtttttgacgttggcataacattccaacttcatggggttggaataagtcaggattccctggttgggacagggaaaaatcacaaatatacccaagtcattgactaatgctcagattcagggccattggattaaatgggttaaaccagcaccttggtgagaattagaaaaaagcatcccctccatgtggactcagctgcaagtggggtgggtctaaggcctagcaggtggaatattggtgctttcagctccaaagactcccaggagtccttgtgcagtacacaacctgcacaagcaatagcagagcattgacttctttgggctctgaccattttagctaaggaggacaaaagaggccagagtagatgcatgtgattgatatcatggaaggagacttatcattactgccttaaaatatgtcatacaataggaaagctgcaagtctgggctgaagatgctgcccagagcttacacctacacagtccgtctaattttggtagtttcaagaggcaagattagaaataacaataaaaccccttacatttttatagagtcttacaatttatgtagcacattaaatgtactttccttttcaatttgattctgattctaaccattgccctggtgagtaataattatccccattttaaatataagggaaatgaagctttcaagaacttgttcaaggtcagctaataagcagttaagccaggaactgaacccatgtatctctagctccaagctcaaggttttttcttccatgcaggtcacacaagatcctgagccgagcactggcagccagacctaaataactactctgtaggggtctgaaattagtcagagtaggtcatccttcttgtttttatgaagtcaggactctcccacacaggggtaggtaactaaagacttggagtgtgagttctggaaaggtcttcacagatcttacaactgaactaagtattaatttttcacatggaggagtgataattaaatgcatctttactatctatgtgccatgaacccagaattctcttctttattttaggaattatcctccaaggtatcctgagaaagccttgagcgttcggagaaagtcatctggaagtcaacatatgatatgaaaatatctataggccactattgacaaatacaagactcttcagcaccaatgtggtgctaccacaggcctctttagctgccttccacctccacctatgttccagacctgtatacccaactgcttatctccatctggacatttcctgggcatattcaactttaatatgcctaaagtgttcatcactgccttctccacaatctgcttcccaagcccactccttctctagcttacatgatttttattaatggctctacaaggtaccttcccctgcctatcccactcaacaccttataatcactctctattcactcattcctcctttaccacattcacttggtcaccaagtacttctgattctacttcctaaaatccattccttttcctcagttcccactgccattgtcttagctgaggtcttaattatctctgcttcccatctctctaagccagcccccatctggccaataattctttttccaaacacaaatctgaccggatccttcctctgcttaaaaactcaaaaatggcttcctataggagggagttcacccttctcagtctagcagtgtaattcctattacacgctattccctacctgccattgactttgcataccctctttcctttgttcaaaacacactttccctaggaactcctagtcatttccaagaccctgctcatccatcacttctgtggtgtggacttcacagataattctggggaaggatctcctgccctctcccctggattagtcagtgccctgtagctactgctattacaatgtatattatcctgaactgcagtttatttctgtatctgtctcacttaccagactgaagctcctcaaaaacagaaaccatctcattatctttggactccaaggccctggtatactggcctgcacacggtaggtttggcaaatgttgaatgaatgtatggaatggatgcatctccctctttggtgaaatcaataacttagtttgttgagtgtttattattctcttgggtttagtctttagggaagaggacagaagtcatactcatttcacaggccaaatattgacaatgcatggaggccaaagaaacttttgttttacaacgcatctctttcctaaaattgtatctgggatggggacagagaggcagaatttcagacaaaaggaaagacttggtcagattttcctgtacagctgcctctccagcccagcactgggtgaagggcaggcacatcagactaagtggttgatgcaactgaaccagtttaaaggctggtaagacgcttgcagaagtctttagatagaacttgcaaaccatttgcaaaagggttaggaacaggttgcatcaatgctatgtttaagtcctgctctttgtaactcaaggctctcccattatctaacagaacttcagaatgagggttccttaaaattagcttcaggtccttatgagctgtagctgagcaaatgaaatgcaactgctttagaagggaggagcttccaagatgctccagtggtcttttccttcccttcctcgtataacgcaatcggtggcacaatcccgctaagtagcatggcatgctggctgccggtgttctgttaaattagggtgagtgcttgtctgtgcttcagtttccctttcggttaggcaggactggtcttcccactagctatcatctatagtttacttaactctattatcatatgatgaatcccgtaaagctcttcagaatgttagggaaacaggtcctattatgtcccccactctaccttcatgggtgggatggggggtctgggggtgggaccactgagagtcaaagaagttaggaagtaatctgtgtcacagcaagctccctggaaactctcagaatagcaaacaggtttcctctccgcccctggctccacgccatattttcgttttggctagttccttagctccagagaaaatctggcttcacctagaatggtttagaaacacctaagcccgcgatgctttccggagggtctcaggccttagctttctcagtaaaaaacagaatttccatgtgtccccttcaaagcgctcctaccggcagctggagtaaggtaactccaccgccgacctccgaggagttcatgtggactcagcccaggcgcagagaggaagactcctgagagtcctcgcgaaggagggaaacacaccagaactaaagttgtgaaggcgcaagaggctacttaggaataattccttgtatctctggggcaggtctcatccttctaaagacaggagtgactgggcgtcttcttccaaacagagggcgcttaaaaatgtatttttaaaaaacataacagaaagtcctgaaactcacctttcggtccgcggaagggcttcctgcaggcccagggaatctcctggttgctgccccgtctgacagcgccccgggccctggagggaggtgtgggttcctttttggttgcctctgcactcccaccccgagccaggtctggcgtgtagggccccggcgccggccaaggtcgtgggagccgcccgccccgccccgccccgccccgctccacccccgcgcgtacctgccgctgccgccgagggcagcgccctctgtgttccctgccttcctacgggccgacgcctggcatagttgaggtttcgctcca

SEQ ID NO: 383 - DNA, 1738 bp, Homo sapiens
ctcattaaacttttttaatgggtctcaaaattctgtgacaaatttttggtcaagttgtttccattaaaaagtactgattttaaaaactaataacttaaaactgccacatgcaaaaaagaaaaccaaagtggtccacaaaacattctcctttccttctgaaggttttacgatgcattgttatcattaaccagtcttttactactaaacttaaatggccaattgaaacaaacagttctgagaccgttcttccaccactgattaagagtggggtggcaggtattagggataatattcatttagccatctgagctttctgggcagagttggtgaccttgccagctccagcagccttcttgtccactgctttgatgacacccaccgcaactgtgtgtctcatatcacgaacagcaaagcgacccaaaggtggatagtctgagaagctctcagcacacatgggcttgccaggaaccatatcaacaatggcagcatcaccggacttcaagaatttagggccatcttccagctttttaccagaacggcgatcaatcttttccttcagctcagcaaacttgcatgcaatatgagccgtgtggcaatccaatacaggggcatagccagcgcttatttggcctggatggttcaggataatcacctgagcagtgaagccagctgcttccattggtgggtcatttttgctgtcaccagcaacgttgccacgacgaacatccttgacagacacattcttgacatggaagcccacactgtccccaggaagagcttcacccaaagcttcatggtgcatttcgacagattttacttctgttgtaacgttgactggagcaaaggtgaccaccataccgggtttgagaataccagtctccactcggccaacaggaacactaccaataccaccaattttgtagacatcctggagaggcaggcgcaagggcttgtcagttggacgagttggtggtaggatgcagtccagagcctcaagcagcatggttccactggcattgccatccttacgggtgactttccatcccttgaaccaaggcatgttagcacttggctccagcatgttgttaccattccaaccagaaattggcacaaatgctactgtgtcggggttgtagccaattttcttaatgtaagtgctgacttccttaacaatttcctcatatctcttctggctgtagggtggctcagtggaatccattttgttaacaccaacaattagttgtttcacacccagtgtgtaagccagaagggcatgctctcgggtctgcccattcttagagataccagcttcaaattcaccaacaccagcagcaacaatcgggacagcacagtcagcctgagatgtccctgtaatcatgtttttgatgaagtctctgtgtcctggagcatcagtgatagtcacatagtacttgctggtctcaaatttccacaaggagatatcaatggtgataccacgttcacgctcagctttcagtttatccaagacccagccatacttgaaagagccctttcccatctcagcagtctccttctcaaatttttcaatggttcttttgtcgatgctactgcatttatagatcagatggccagtagtggtggacttgcccgaatctacgtgtccaatgacgacaatgttgatatgagtcttttcctttcccattttggcttttaggggtagttttcatgacacctgtgttctggcggcaaacccgttgcg

SEQ ID NO: 384 - DNA, 18603 bp, Homo sapiens
acaaagcctgtttggtggtctcttcacacggacgcgcatgaaatttggtgccatgactcggatcgggggacctcccttgggagatcaatcccctgtcttcctgttctttgctccgtgagaaagatccacctacaacctcaggtcctcagaccgaccagcccaaggaacatctcaccaattttaaatcaggtaagtggcctcttcttactctcttctccaacctctctcactgtccctcaaccactttctcctttctactcttcaatctctcccttctcttaatttcaattcctttcattttctgggagagacaaaggagacacgttttatccgtggacccaaaactcaggcgccggtcacggactgggaaggcagccttcccttggtgtttaatcattgcaggggcgcctctctgattattcacccacgtttcaaaggtgtcagaccacgcagggacgcctgccttggtccttcacccgtagcggcaagtcccgcttttctggggaaggggcaagtaccccaaccccttctctccttgtccctaccccttctctgcttttctgggggacagggcaagtaccccaaccccttctctccttgtctctaccccttctctgtttttctgggggaggggcaagtacccctcaaccccttctccttcacccttagtggcaagtcccgcttttctagaggaggggcaagtaccccagcctcgtatctctgtgccccaatcccttatttctgtgccccaacctcttatatctctgcaccccaatcccttatttccacgccccgacctcttatctctgcaccccaatcccttatttccgtgccccgaccccttctgtacctcatcccttatttccatgctccaacctcttatctctgtgccccaaccccttttcccacttttctggaaggtaagatcccccgaaccccttccctccttttctctaggcttgcttctttcactatgggcaaacttccactctctattcctccttctactcccttggcctgtgttctcaaaaacttaaaacctcttcaactcacacctgacctaaaacctaaatgccttattttcttctgcaatgccacttgaccccaatacaaactcgacagtagttccaaatagccagaaaatggcactttgaatttttccttgctgcaagatctaaataattcttgtcgtaaaataggcaaacggtctgaggtgcctgatgtccaggcattcttttacacatcactcctttcctagtctctgtgcccagtgcaactcgtcccaaatcttccttctttccctcccgcatgtcccctcagtaccaaccccaagcgtcactgagtctttctaatcttccttttctacagacccatctgacctctcccttcctccccagactgctcctcatcatgccgagctaggtcccaattcttcctcagcctccgctcctccaccctataatctttttatcacctcccctcctcacacctggtccggcttatagtttcgttccgtgattagccctccccctcctgcccagcaatttactcttaaaaaggtggctagagctaaaggcatagtcaaggttaatgctcctttttctttatcccaaatcagatagcgtttaggctctttttcatcaaatataaaaatccagcccagttcatggcttgtttggcagcaaccctgagacactttacagccctagaccctaaaaggtcaaaaggccgtcttattctcaaaatacattttattacccgacattaataaaacattaaataaaactccaaaaattaaattccggccctcaaacctcacaacaggatttaattaacctcgccttcaaggtgtacgataatagaaaaaagttgcaattccttgcctccacggtgagacaaaccccagccacatctccagcacacaagaacttccaaatgcctgaaccgcagaggccaggcattcctccagaacctcctcccacaggagcttactacacgtgccggcaatctggccactgggccaaggaatgcccgcagcccgggattcctcctaagccgcgtcccatctgtgtgggaccccactggaaatcggactgttcaactcacctggcagccactcccagagcccctggaactctggcccaaggctctctgactgactccttcccagatcttcttggcttagcggctgaagactgacactgcccgattgccttggaagccccctaaaccatcacggatgccgagcttcgggtaactctcacagtggaaggtaagcctgtccccttaatcaatatggaggctacccactccacattaccttcttttcaagggcctgtttcccttgcctccataactgttgtgggtattgacagccaggcttctaaacctcttaaaactccccaactctggtgccaacttagacaatactcttttaagcactcctttttagttatccccacctgcccagttcccttattaggctgagacactttaattaaattatctgcttccctgactattcctggactacagctatatctcattgccgctcttcttctcattccaaagcctcctttgcgtcctcctcttgtatccccccaccttaacccacaagtataagatacctctactccctccttggcgaccaatcatgcaccccttaccatctcattaaaacctaatcacccttaccccactcaacgccaatatcccatcccgaagcacgctttaaaaagattaaagcctgttatcactcgcctgctacagcatggccttttaaagcctataaactctccttacaattcccccattttacctgtcctaaaaccagacaagccttacaagttagttcaggatctgcgccttatcaaccaaattgttttgcctatccaccctatggtgccaaacccatatactctcctattctcaatacctgcctctacaacccattattccgttctagatctcaaacatgctttctttactattcctttgcatccttaatcccagcctctcttcgctttcacttggactgaccctgacacccatcaagcccagcaaattacctaggctgtactgccacaaagcttcacagacagcccccattacttcaatcaagcccaaatttcttcctcatctgttacctatctcggcataattctcataaaaacacatgtgctctccctgccaatcgtgtccgactgatctctcaaaccccagcaccttctataaaacaacaactcctttccttcctaggcatggttagtgcagtcagaattcttacacaagagccaggaccgcaccctgtagcctttctgtccaaacaacttgaccttactgttttagcctagccctcatgtctgcgttcagcggctgctgctgctttaataattttagaggccctcaaaatcataaactatgctcaactcactctctacagttctcataacttccaaaatctattttcttcctcatacctgacgcatatactttctgctccccggctccttcagctgtactcactctttgttaagtcccacaattatcattgttcctggcccagacttcaatccggcctcccacattattcctgataccacacctgacccccatgactgtatctctctgatccacctgacattcacatttccccaaatttccttctttcctgttcctcaccctgatcacgcttgatttattgatggcggttccaccaggcctaatcgccacacaccagcaaaagcaggttatgctatagtacaagccactagcccgcctcttagaacctctcatttcctttccatcgaggaaatctatcctcaaggaaataacttctcagtgttccatctgctattctactactcctcagggattattcaggccccctcccttccctacacatcaagctcgaggatttgctcccacccaggactggcaaattagctttactcaacatgccccgagtcagataactaaaatacctcttagtctaggtagacactttcactggataggtacaggcctttcttgtagggtctgagaaggccaccgcagtcatttcttcccttctgtcagacataattcctcagtttagccttcccacctcaatacagtctgataacagaccagcctttattagtcaaatcagccaagcagcttttcaggctcttagtattcagtgaaacctttatatcccttacggtcctccgtcttcaagaaaagtagaatggactaaacggtctgttaaaaacacacctcaccaagctcagccaccaacttaaaaaggactggacaatacttttaccactttcccttctcagaattcaggcctgtcctcagaatgctacagggtacagcccatttgagctcctgtatagatgctcctttttattaggcccagtctcattccagacaccagaccaacttagactgtgccccaaaaaaacttgtcatccctgctatcttctgtctagtcatactcctattcactgttctcaactactcatacatgccctgctcttgtttacactattcttccaagccatcacagctgatatctcctggtgctatccccaaactgccactcttaactcttgaagtaaataaataatctttgctggcaggactatgctgaatctccttaggcactctctaatcagatatcctgagtcatcccaattcttagaccttttatacctgtttttctccttctgttattccatttagtttttcaattcatccaaaaccgtatctaggccatcaccaatcattctacacgacaaatgtttcttctaacaaccccacaataacaccccttaccacaagacctcccttcagcttaatctctcccactctaggttcccacgccgcccctaatcccgcttgaagcagccctcagaaacatcgcccattctctctccataccaccccccaaaaattttcaccgccccaacacttcaacactattttgttttgtttttcttattaatataagaaggcaggaatgtcaggcctctgagcccaagccaagccatcgcatcccctgtgatttgcacatatacacccagatggcctgaagtaactgaagaatcacaaaagaagtgaatatgccctgccccaccttaactgatgacattccaccacaaaagaagtgtaaatggccggtccttgcctgaagtgatgacattaccttgtgaaagtccttttcctggctcatcctggctcaaaaagcacccccactgagcaccttgcgacccccactcctgcccgccagagaacaacccccctttgactgtaattttcctttacctacccaaatcctataaaacggccccacccttatctcccttcgctgactctcttttcggactcagcctgcctgcacccaggtgattaaaagctttattgctcacacaaagcctgtttggtggtctcttcacagggacgtgcatgaaagttaggggtagaagaaaagatggattgaggttgtcctcagactttccatggtatctgagctgttttcctcttccggaattgtgtctcatatgaagttcctcttcatttgaggtataaataattcctgtgttgagtgctcttatactttggcccatttatttatcacctaccgaggagataacacatctctgtcaactctgttttctattacttttttcctgtgctcaagtaatcctcctgcttcagcctcccaagtagctgggactacaggtgcatgccactgtacctgtccttgttttccctttccttgtttcaccagttttcccatcatgttaccattttctgtagcgattgttttatctttccattctgcatgctccttttcaaagtgactttgctgctcccccatcaacaggcagagcctgtttccacatcctctgaatgtaggctagccttgggactagctttggcaaatagaatgtggcagaagtgacattttgcattttataaggcatccttaggaggtttgcagcttctgctttaggttccgaaaatggagctcctaccactatgaaaaaaagctcaggttaaactacttgaatgatgagagactatccagtagagaggtccaggctcacagccagcaccaagttctcatatgagagagtaaggccattttatgctctccagtcccaatagagctaccagatgactgctgcggcacaagtgaccccagaaaagcccataagaaaaacaacctatatgagcccagacaagccacagaatcgtgaaaaataggaaattgtgaaaagccaataaatcgacatatgatttgttatgcagcattagctaaataagacaactgatttccatcccaaagtagtcaggaaaaggaataggtaaacctatatagtcaatttgcttttcctcatatttgagggaattagtgagaaaaatcagggttctgaaaagctggggggcagagttcagagacaattctggctctgcttgtcacattcagaatctcctgtttatttcaggaggtttagatgtttctctaattaagagggagtataagccactcttctgctatgctcattcttataatacaatgtgtcattttaaacccactttggcctctctccctttgattggatgaacctaattatggtttgcttggggaaacttggcttgaggctgtggttctctaccattactgtctataaaactcagtaaaccctactgacaggtagaatcctgcccatcactctcacgacagtctgtagctcttccttataaatacacattaggtaattctgaggctagtggtctacactttgtgaaatacaattgacataaatctaacatttcagagaataataggtccagttttacctctttccatcagttgtttgtgaagttaataattgagacacagcctaagcccgaaagcaagactccatgtctacaaaagatacaaaagcaaattagccatacatagtggtgtgcacctgtagtcccagttactcaggaggctgaggtgggaggatcccttgagcccagcagtttgaggctgcagtgagccatgatcataccactgtactccagtttgggcaacagagtgagaccctgtctcaaaaaaataaagaattggaggctgggcatggtggctcttgcctgtaatcccagcactttgggaggccgaggtgggtggatcatctgaggttgggagttcgagaccagcctgaccaacatggagaaaccccatctgtactaaaaatacaaaattagccgggtgtggtggcacatgcctgtaatcccaactacttgggaggcttaggcaggagaatcgcttgaacttgggaggaggaggttgcagtgagacaagatcacaccactgcactccagcctgggcaaaaagagtgaaactgtctcaaaaaaaaaaaaaaaaagaattggggcaaaagtcgtttgggtgtgcatattgattccatacttcaaaggacgtagtagatgcatacccatgttcacagcattgttcacagtagccagggggtggagacaacccaagtggccattgacagataaatgaatacataaaatgtgggatatttatggaatattattcagccttaaaaaagaaggaagatctcacatatgctacaacatagatgaaccttgaggacattatgctaagtaaaatcagccattcacaagaaagacaatgtatgattccacttatataaggcatccaaagatctcaaatttctagaatggaaagtggaatggtgcttacgaggagctgggagaatggagagttgtttaatgggtgtagattttcacttttacaagagatctgttttctagggatctgttgcacaacaatgtgttaacaccactaaaccacataattacaagtgtttaacatggtaaattttatgttatgtgggttttttaaaaattgtggttaaccacaattttttttttttaatgaggaggaagaagaggacgtgttgacagcataaatggtaaatcctgattgtagatggagaatttacaagtttgttatgactatgtttcacagcaatactaaaaacaacaacaataaatacagttgtcactttagaaacattgttaactctatacatcagataaaattgaacataggaaactcctacagctgcagagtagcatatagttagaggccatctctaaagagttgctctccccctgctggcaagtcttggaattgttcagtttggggaaggaaccaggacagctagagagagaacgttctcagtaagatgctcttgtcattaaaatgtaggtgctttcattcatcaaaatatttcctagaaagacaccaaactcccatagctattatctgaagttattcacttttacattcttccatttatttcttttaaatattttaattgacaaatgacagattgtatatatttatggtgtacaatgtaaagtttcgatatgtgtatacattgtggaatgattaaatccaattcttccacttcttaaaatgaatgtacaacttatttgactatagctcattcattcaccaacctgtatttaactcttaatatgcattgttgtgccaaacactgggatttcaaagatgacattggtgtggacccaggtttgatatctgatagagggatatagacatgtaaatcattaaatcaaatttagtaaagagttgtaagtgtaatagaaaccatctgtgtactacagtataagaattacggcataaagaaagcagtaaagagattcagcaggagtataattaatatattggattcctgtcttttttttaaattaattatttcttttttttttttttttttgagactgagtctcgctctgttgcccaggctggagtgcagtggcacgtcgggtcactgcaaacctcccgctcctgggttcaagcgattctcctgcctcagtctcctgagtagctgggattacaggcatgaaccaccacgcccggacttcctgccctttgaatttaccaagaagaggtaattcgatcatgcatagcacacaaatatattaattgtcaaagcgcatcctctctctattcttgtgagttggatttttttttaaaaaagactttcattttgaaataattacaaattcacaggaaattgcagagatggatagtacagaggttctgtgtatcctttacctggtttccccagtgattacatcatcaaaaccaaggagttgattgacaatgataaaaagcatgtgcataattctatgtccttttaccatatgtttagatttgataagcaccacttcaatcaagatatataactatttcattaccacagggatcttccagggctaccgctttacaatactactaacctcctccctctagcatcgttaaaccctggcaactgttcatctattaaaggatgacattggcactggagatgacatctaataaagagacacagagaagtaaatcatgcaaatctaatgcagagaataaactaagcttgtaacctgtaatagcttgtagcttcaatgttatataaatgaaatcattcagtatgtgaccctttgagattggctttattccccccaattagtgcactttcctgtaatcaagccaagttgctgtgtatcaatagtttattgcttttttactgccgagttatatttctagtttggaggtacacagtttgctgaatcactcacctattgtaggacattttcagttatttccagttcttatctgttacatataacactgctatgaacaactatatgcaggttcttttatggacttaaagttgcatttctctgagttaaatgtccaggaggatgattgctaggttgattagtaagtgaatgtttatttctttttgagaaactgccaaacagtttttcagagtggccataacacttaacatcaccacccgcgatgtgtgaaacatctagtgtttccatattcttacaggcattatttttcattattgtcattatttttcattgatttgatttaataggcatgcagtgatagctcatagtgatcctaatttgcatttcacaattggattaggtgttgcatatgttttcatgtgcttatttgacatttatgtatgctttctggtgaaatacttcatcacgtcttttgccattttctaagtgaatagtttaactttttactgttgcagattgagagtgtttatgaattctagacatgactcctttatcagatatgtggtttgcaaatatttcctcttagtctgcggcttgtattttcacatctttactgggtcttctgcaggacaaacacttttaatttggatgaagtttaatttatcattttttttttcttttatgaagcatgcttttggtgtcatgtctaagaactcttcgtcaaaccccaggtcctgaaaatgtttgtctatgatttcttctaaagttttatagtttacattttactttaaaatctatgattcaaaaatttgagttaatttttatataatgtgtgagatttaggtcaaggttcacatttttacttatgaatatacaatagctgcaggaccgtatattgaaaaggctatctttcctccattgcaatgctttttgacctttgttaagactcagttcagtgtattttcttaggtgtacttctgggttctttatcctgttctattgatttatgtcactgtccctccatcagtaccatgtaacctgtttactgtgtcggcaaagtaagtcttgaaattgggtagagtgagtcttcccacttgattcatctttttcaaaattgtttttagctattctagttcctttgcctttccatatacattttatcttattttatttttgaaacaagttctcactctatcacccaggctggactgcggtggcatgatcactgttcagtgcagcctcagcctcccaggatcaggagattctcctgtctcagtctcctgagtgactgggaccacaggtgtggaccaccacacccggctaattttttttttttttttttaattcttagaaacagggtcttactccgggcgcagttccctgtaatcctagcaatttgggaggccaaggcgggcggattttctgaactcaggaattcaagaccagcctgggcaacatggtgaaaccccgtttctactaaaatacaaaaaattagtagagcatggcggcatgcacctgtagtcccagctactcgggaggctgaggcaggagaattgcttgaactcgggaggtgggaggttgcagcaagccgagatggcgccactgcactccagcctgggagacattgagactccgtctctaaacaaacaaacaaacaaacaaacaaacaaacaaacaaacaaacagggtcttcctactttgccaaggctagtcttgaactcctgggctcaagcaccctcccagcttggtctcccaaagtgttgggattacaagtaagagccactgtgcccagcaccatataaattttagaataatcttgtctttgtccttatcaacaaaatttcttgctgggattgtgctggtaattgcaataaacttatgtatcaatttggggagaactgacatcttaacagtgttgagttgtctgatccatgaccacagtatgtctctccattcatttagatttttgatttctttcattgctatttcgtagtttttggcttgtttttattagattcacactcaagaatatttttagcaattgtaaatgctactgtatctaaaattttaccttccacatttccattgctagtatgtagaaatacaattagtttttgttctaggagggtgttttggtggattccttgggacttttgtagatagacaatcatgctctctacaaaaagggacagttttatttttctctttccaatatgcataccttttatttcctttccttgctttattgcactggctagaacttctaataccatgctgaaaagcggtggtaagtggacattttcgccttgttcctgattctagcaagaacgtattgtctttcgtcgtgaagaatgatgttagctgtagggtatttttttgggaagggggggttgatattagtatgctctgtttttagaaacaaatgtaacatctgaatttgtccaccactctaaggctcaagaaactccactttatttaatttttctcaatcaagttaaatcagaatgttagttgttatgtttacgaagtttccatttttgtattaaatagtagttattttattttaatttttaataaaaaacagaaatttttattggctcacatttctggaggctgaaaagtccaatatcatggtgccagtgctaatgagggcttttgtgctatgtcatcccatagaggaaggtgaagggcaagagagggcaagtgagagaggaatgaactaaccttgtccttttataacaaaccaactccctagataatggccttgatccactcttgaaggtggagccctcctggcctaactacctctttaatggtctcacctcttaacactgttgcattagggattaagtttccaatacatgccttttgggatacacatttaaaccatagcacatgtgacgttgagcaggtgactcacaaaagagtcatgctaagtagtagttattaaaacacacacacacctagaaaaaataataaataatacaaagaaaaattttcactcctggtaaaaatttttaatacccatattagcatattcataaataactgtaaatttcaccttgttgttatcatatgaaaagtggtgatcacattaataattagcccatcaataactttaaaatatcttttgtgccttcttttgagtgttttttctttcttctcataatgaagtcctctttccttgtgaagtaagaaaagtaagtcagcaactatatttagctcttgtaattatgtttttgtataatagacaatgcaaagtcttttaaatattagagctcagtgaagtatcatccttggatatttttagtttaggaaatgttagggatatttgatgtaagtaaggagtgcccatgaactagatatgcagatgccatgggaattttgggggaatcaagatgttggcttgggtgttggagtatccattgggatctttgaacactgagaggagcatcatatggggagaaatgccttcccttgtacctcaggggtcactgaagtctgggccaatcaatgggaccttcaccagtcacgtgaaagctctcagaatgactggcgatggctgcagctgccactggggacatttctctgaactgcctagactgtcattttttaacagcttctgtcttaacaactgtagtgacaccggaggaccaagaactggatgttacagctgcttagggttaaatttgttcttgagatacaatttgtccttgagtgctacatctctttgcccagcaggtggcagtaagcgattacgagacatatggtaacaagcatcagcgtaagagactttggagtatactcagggctacttggaaggattaactcttcaacattctgcgaatctgaatttagctttcaatttagatatcaactgtaatactgttttattgggtgcctctaaaatggtgaagcggtgcatactgtttgagcgtaaacagattttacagcagagctgcttcagttgaataggggcataagacctggaggctacctactcagtgccatcttccccaaatacagcagaccattgagtctttgaagaccctgctttggctcagcttctcagtggatcaacagacctgtaattcttactagtcacctcgaattcagcatattcaaaccaagcagtggtgtgcaggggccagccttcacctacttagaagagtccattgataaattgtcagaggttttgcaagctggttaacttcacattggtagtttgaaagtatccacaatggaagcatttacaatagaagtcgtgtaattctactaacaaagatctcccctcacctccagctgtttattcaatatttattaatattacactgatctaagcacacttgctttctccctgaacaacatctcttttcctgcctatatatcccatctgatacggtttggatttgtgtccctgcccaaatctcatgtcgatttggaggaggggcctgttgggaggtacttggagcatggggtggatttcccccttgctgttctcatcatactgagtgagttctcatgagatctgatgatttaaaagtgtgtggcacttcccccttagctctctctctcatgccaccatgtgaagaggtgcttgcttccccttcaccttccgccatgactgtaagtgattaggtttgactgtgtcctcacccaaatctcatcttgaattgtagctcccataattcccacaagttgtgggagggacccagtgggagatagctgaatcatggggcggtttcctccttactgttcttgaggtagtgaataagcctcatgagatctgatgattttataaggggtttccacttttgattggctctcattctctcttgtctaccaccatgtaagatgtgttttttgccttctgccatgattgtgaggcctccccagccacatggaactctaagccaattaaacctcctttctttataaattgcccaatcttgggtatgtctttattagcagtgtgaaaacagactaatacagtaagtttcctgaggcctctcagtcatgtttcctgttaagtctgtggaactgtgagtcaattaaacctcttttcttcataaattacccagtctcaggtagttatttatagcaatgtgaaaagagactaatacaccatcaatccccaaacctctcattatctcacttcacaaagctcagtccaaactgttcttcctctgcagtgacactgaacttggccactctcccaccatcacctcttcttcccttgcctctggtttcctaaagcactttgtttctgtcacagggtaaaatactcttattttataacatgtgtttcacaagaacctggtggctagacattagcctctgtgttcctagaggggactttgaggcccgtgtctgagacttcatggtaacctcagtggctatggtagattttggcacatggtagatagatgctcattaaatggttgtggtttctgtttttaccacagaataactttccaattcttttttgttccatgatctgaccccaaccagcctattaacattaccttttaattattcatcttcatggtatttgctagatttttctcaagctgtcgcccttggtttgccccatatccacctcacatcttctctctccatctttgtgtgtactcttccctcctcatgggcggcctttcacgtttcctttagggtcttgctcaaatgccattttctctgtgaagctgttttctccttttccttctgattctgccactctaagtaatcagatctctacagtcttgcatctgtccaccaacttctaaaattctgtgaaaaggggaaactaaactcatctactgtggttaaccagaccacaaagaggaatgctggcgttcatgaagaatattctgagagccttgtcaaagtcactctgttgtccaggccaaacagaggagtgtggatgatagagatttcggatgtggcttgtgaaagggaggagggcaaggctggcagaggtggagttctgtctatttaaagtagttgtctgtttagcagtgcaccctggaggagacagggctgtctgtgctctgggccatatcaaaggtgccctcaacaccccacagttcaggtctgttagctttcctcataaaaccatgtttggagagatggcttttcagaaggaattttggcttgaaactggaagaaagcatgcctgaaaatttaattgggaagtaagggtatatcaaggggggaaaggcagcagctttgaagtggaaaatatcttgcaaagagtaaaaatagtggcttttaagtggcatatgaggaggttcggtggccagccctttcattagctgacttcctgtgccccactgggactgtcctctgagggctgattgctgcctttgatgcctctaaccagctggtgtcactactcaggccgaggatttcaggaagacaggtagcttagcaaagaggaagagaaggtttgtttcatgaaagctgatctaccaaacaccatctggcaagggattaataaccagaatatataaggagctcaaacaactctataggaaaaaatctaataatttgattaaaatacagggcaaaggatctaaatagacatttctcaaaagaagacatacagatatgggggcaagtgggggaatgcaatatagctggctagacatagcccaatagacacagccaggtggaacagctcccacagagggacccagataactggcatgcttctaacagatcctcagaggcaaggcactgagagtggatggagggaagacacagaagctgggctggaggggaagaaacctgggaacactgcctggggatactgctcactgggactgatttttggaccacaacagctccaggagaatgggtgacttgaactggcaaggagcaacctgctctctccacgggcctctggaaccccggcaagagaagatcccttgatcaccatggacactcaagttggcaagaagagctccttagagaagtcgtgggagggcaagcaagctgatgtggagccaggacgatttgatgtgggagcacctgcagtggagcacagccagggagagccatctccccaggcctgacttgctcccataggagactttagccctaggggaactgtccatcctgatctctgcagggtggtcttgtccatcagacagggctgattcgacctgagcaccccttggtctgctggcctttctggggtcccagcctggccagacctgcttgcagggcagtcttgggtgccctggaggccacgccatagcttctgtgctggcagatagtatctgactggtggagagctccagcaaggctgcccctaggccacacaccagcccatccaccccctccccacactgcagcttccctaggcccaggaaactcctcacgtgtctttgctggcacaagtctgcacaggtaggttttgccttccttgccctgccagtgcatgggagtgtagtctgcccccctgccccgtctggctgtcattgaagacagagccttggtgggcacagagcaagccagctcccccgcaacgcccacctcaacacctggcccttgtgctaacactgtgcagagaacagtggaccctgctcgcaccctgagtgatcactcctgcttgtggggcacagagaaggtgtccagacctgctcacgccagtgccctgcccccaagccaacaccacatccaacaggagcctgcacccagtcttcagcatagaggtgaaagatctctacgaggagaactatgaaacactgctcaaaataatcaaatatgatacaagcaaatggaagagcatgcaatgctcatggataggaagaatcaatatcataaaaatggccatactgcccaaagcaatttatagattcaatgctattcctattaaactaccattgatattcttcacaaaactagagaaaactattttaaagttcatatggaaccaaaaaagagcctgaatagccaaggaaatcctaagcaaaaagaacaaagctggaagcatcatgctacccaacttcaaactatactacaggactacagtaaccaaaacagcgtggtactggtacaaaaacagacacatagaccaatgaaacagaatagagaacccagaaatggttctctatttcacacacctacaactatctgatcttcgacaaacctgataaaaacaagcaatagggaaatgattctgtattcattaaatgatgctggaataactggctagccatatgctgaagattaaaactggaccccttccttatactgtacacaaaaatcaactcaaaatggatgaaagacttaaatgtaaaacccaaaactataacaacaatagaagacaacctaggcaataccatcttggatataggaacaggcaaaaatttcatgacaaagacaccaaaagcaattgaaacaaaagcaaaaattgaaaagtgggttctaaataaaactaaagagctcctgcacagcaaagaaaatacaaacagagtgaacagacaacctacagaatgacagtatctgcaaactatacatccaacaaagatctaatattcagcatctataagaaacttaaacaaatttccaaaaacaaccccattaaaaagtgggcaaagcatatgaacagacacttttcaaaagaagacatacatgcagccaacaaacatgaaaaaggctcaacaccaccaatcattagagaaatgcaaatcaaaaccacaatgagataccatctcacactagtcagaatggctgatggctgttattaaaaagtcaaaaaataacagatgctggcaaggttgtggagaaaaggcaatgcttatgcactgttggtgggagtataaattagttcaatcattgtggttgacagtgtggtgattcctcaaagatctgaaaacagaaatataattctacctagcaatgctactactgggtatatacccaaagaaaaataaattgttcaattataaagac

SEQ ID NO: 385 - DNA, 22283 bp, Homo sapiens
gactgaaacacaataagcacttttattgctcctaaagtcttcgacttggccgcagtgctgggctcagctggcctcgctcatatgtctttatagctactcttctcaagtggtggactcagtttccccacctctgaatctgggtgagccctgggactccctttggccagtagaaggtagccgaagtggctgcgtgcggatcagctggagctggctggtctaggatggcctggtttgggacccctgaactctccttctcatggtctctgcttgtccagcaggctggcctgggctttctcccgggcagaggcggaggtccgaagcaaaggagcagcacgcaggttctcttcaggtggaggaaagcagaggcgtcagctcagactatgcctttttcacataaaaaatgattttcagctgaaggcaattaagaagcagaaagtgcaggaaaagttcaggtttccctccccttttctgcctaaaggcacgatataaactctccatcactggacacaacccttgactcagaggtggtaccagaggctgctgcagacaaatcctgttgcatcagcttcctctcggatatttaccatcccatagtttaccacctttggaagcctaaaactgttgtccttggtcatcctatctctacaaatttattgtattttttaaaaatgctgtgtaagacagtgttccaagccatcactttgttacttttcattgaggcttatcctgagtgatgttggctgcctgtgttaacaaactgtttttcgccaggtacagtggctcatgcctgtaatcctagcacattgggaggccaaggcaggtggatcacctgaggtcaggagttccagcccagcctgatcgacatggtgaaaccccatctctactaaaaatacaaaaaaaattagccgggcgtggtggtgtacatctgtaatcccagctactcgggaggctgaggcaggagaatcgcttgaaactgggaggcggaggttgcagtgagccaagatggcgccactgcactccagcctgggggacaagagcaagactctgcctcaaaaaaacagaaacaaaaacattgtttttctttgtgaatctgtcttttcattaaaaagtctctcttaatctgttttgttttgctataacaataccacagatggggtcatttatttagagataggtgtcttgctctgtcactcaggctggagtgcactggcatgatcatggttcaatgtagcctcaacctcccagggtcaagcagtcctcccaactcagcctcccaagtagctaggactacaggtgcacgacaccatgccctgctaatttttttttaactttgtagagatggggtctcactatgttgcccaggctggtcttgagtgcctggtctcaagtgatcctcctgcctcagccttgcaaagtattgggattacaggcgtgagccactgaacccagcaagggtcatatataataaatagaagtgtattggcttacagttctggaggctgggaagcccaagatcaaggagccagcatctagcgagagccttcttgctgtgtcctagcatgatggaaggcatcatatggcagaagggcaaagtgagggcgagagaaagacaaagaatgaactccttcatttaaaaggcaccactctcaggataaccaactcactcctgaaataatggtggttttttttaagacagactctcgctttgttgcccaggctggagtacagtggtgcgatctcagctcactgcaatctctgcctcctgggttcaagcgattctcctgtctcagcctcccaagtagctggccttacaggcatgtgccaccacacctggctaatttttgtattttaactagaaatggtgttttaccttgttggccaggctggtctcaaactcctgacctcaagtaatccgcacacctcaacctcccaaaatgctgggattacagacatgagctaccatgcctgcgcccagaaataatgttctctacccattcacaagggcataacccgcacggcgtaatttactttccatcaagcctcacctcacaacactggggatcaaggttccaactttgggagacacaatcaaatcacagcagagccccagctgaaaacctaagacaggtggaggtaaagttttgcttccaaggcctatgcttcaaactggctcacaggaagttgcactacacttgtctacaggacaaagcaagtcacaggaccagcctggattcagaggtggagaaacagactctacttcttgatggcaggagccatggtcacacagcacagagtgtcaacacagcaaaccactaacagtggtcaatgcagtcacccccacagcaacccagagctctgtgccctgtcacagcattgggcagtccccagtgattaaaccttcctgttgggactgcactctcacagagatataagacatacgtgatcagcacaagtatgtacctacccagccctggctttactgtgcctagtcagccaggccactttctttgtcctgaaagctgacctgggttcactgtgaggcttgactgtactgcccatgcgcagagagcaaattcaggagccagtcaagcatgtcctgacaccttgggagtcaggggagaatggatgggtcatacaacaaaggacttggataccaagaggccattaattgcagccatcaataaaatttgtgacctaaacaggggcaaatgaagcttgttgggcatgctggctgggcatgagatggagtcttgctctgtcatccaggctggagtgcagtggcattatctcggctcactgcactgtccgcctcctggattcaagggattctcctgcctcagcctcctgagtagctggaattacaggtgtgcaccaccacacccggctaattttttttatttttagtagagatggggtttcaccatgttggccaggctggtctcaaactcctgacctcaagtgatccacctgcctcagccttccaaaatgctgggattacaggcatgagccaccacgcctggcttgtggttgaaatcttaacccacaatatgatggtgttgggatgtggagcctttgggaggtgattagataatgaaggtggagacctcaagaatgggattagtgacattctttaaaaggccctggagactgggtacagtggctcatgcctgtaatctcagcactttgggaggctgaggtgggcagatcacttgaggtcaggagtttgagaccaacctggccaatatggtgaaacccagtgtctacaaaaatacaaaaattagctgggcatggtggtgcatccctgtagtcccagctcctcaggaggctgaggcaggagaattgcttgaactcaggaggcagagagaggcagaggttgcagtgagccgagattgtgccactgcactccagcctgggcgacagagccagactccatctcaaaaaaaaaaaaaaaaaaaaaaaaatggccctggagagctgtctcccatcttctacgataagaggacacagctagaaggcactgtctttgaaaaagtgggccctcatcagacagcactggtggcttgatcttggacttcccagtctccagacttgtgagaagaacatttgtttataagttacccagtcttttttttttttttgagatggagtcttgctctgtcacccaggctggagtgcaatggcgtgatcttggctcactgcaacctccgcctcctgggttcaagcgattctcctgcctcagcttcccgaggagctgggattacaggtatgtgcgaccatgcctcgctaattttgtatttttagtagaggaggggcttcgccatgttggccaggctgttcttgaatgcctgacctcaggtgattcatccccctcggcctcccacagtgctgggattacaggcatgagccactgcatccagccaagttacccactcttaaggtattttgttataaccacctgaacaagaacaaagacattctctaagccatgtagtacacattcataaatctggggttttaaataccttcctcctataattgtcacgagggacagattcaagtttcatttggttgaagcttctaaacctggaaggaacctaaaatgagcttcagcttcaaggctaatgtgcctgttctccctccacgtaaagcagaaaatgccagatctcccttgccctgcttgctttgcagggaggatgtgactccacaatccaggttcccccaatctgtggccacacccaggatgaggatcagaagctagtgaccaccagcatcgctcctggtagctgatggcaacgtgagggaaactgcctcatttcacaggtaacagggtcagaagttctgttggcagccaacacagttcccagaccagctctgtgttccaatgtgacttgggttcatttatgtggctaactcaacttccctgtcctttccagaggttccatgagctcttcttttaaacatgtactgggcacttataggctctcatttcctgagctcgggactaaaccctctacacatccagcattcctttactaagcccctttgcccccagagctaggaggtgtggctcacaggcagggatcatcctctgctttcctccaaggcctggaccagaaggaccaagggaagacagttccagcccagagccatttcccttccaacctcttggcaagcctgatgagttccactccccgctgacgggcacacctgccttccaggcactgatcctgctttccccctcttgctctgccactcactgtgcctggcttgctgcccagccctccccagccttctctcctcctacctttcccacttattgcctccttccaggcttgtccagcatgataaactctggtctcagcattcacagcctcctctatctctcagctgtgtccctggtcatgactctgcttgctcttccctaaagcaattaaaataggaaaatctgacccttctcacccaggaggcaggtcctctcctatccactggagacccagagcaaaagctctctcctcccttcatcctccttctcaccatgtgatttcagacaagtcctttcacttccgagttttgccatgtgtgcctgtgtgcatatgtatgtgatgtacagacctctggagccatttcaccacagtgcctctccactcccagccagtgccagggcaccccctcagctgctgcaggatgtgtcaccagaaggagagagttaaaggggaagaaagcccttgagtaggagccaagtcatctgaacgcacaccctgtgcccagaggaggaggggcaagagttgctttccatgaagagtgcacctgatgagaaggcagctccagaggactcaaaggaaaaccaagaatcaagagagaaagaaacgtgcagtccttgcctacttggggagggggaggggtcgtaccacaaactccttggtcaatatagggacctgcttctccgtgcgccccagccccctctgcaccatgcactctcctcccgggcctagcgcctgctacaactgtggcctccactaatttcgggggtgcgaggcggtggatgatgcccaagtgaagccgttcaggcctcgtggcagcaccagatcaagggcgaggttgcgctgctcgtcctcagagtacacaggccggtagcccagcagctgcagcgcaccagcgcacagttcctgcacgcggcggatcttggcaaagggcagcgcatggcgccaggcctgggagacgttgagcgcattcctggacgaagtcttgaaggcttcgcggcgcgcaccaggtccagatccgtgggtgatgttatggatccaggcctcgagctgtggcgtgagactgagcccagtgaaggcgtagagcgcacggatttctgccagcggctcccgcgccaggtcctcgaagcgcaccaggcggtagcggccgcgcagaaagggtggcggcttgagtgtggcggcctcggcgatgcgtacgtggctacggcacacctcgcgcaccacgcgcaggccggggtcggcctccacccacgtgccgttggtgcccagcacgatgccgttgtcacgcgccagagccttggctgtctgctcccgggagcgcagcacggcccgcgggtcgcgcaccaggtgcacgatgcgtaggttgagcgcggggtcgctgagcagcgggtagagcacctgcaggttgaagaagcgcacctccttgagcaccacgtggctgtaggagcggcaggcctcccgggccagggtgaaggactgccgcgcgcacagtggcttgcacacggcctcgctgctgatggcgcctcggggaaaggcactgcaggcgggtggcgagcacagtgcacggctcacggcccactggaagaggtcggacaggttgcggcgccaaggcagataggcatcaaacacgtccatgtcgcacaggaagacggagcgcaccaggtcgcgcacagccatgtgcagcgttgcggcgctgccctgcgacagggtggtccacacgtgccacgcgggctccattaggtagaagacgtcggggtgctggttgaagagttggcccacgaaggacgagcccgagcgccacgaggacagcaccagcacatgcacgcgcgcctcgccgcctgctggggacgagggccctggccgggaaaccagaaagaggaggaggaaggtctgcgccaggaggagcgcggtcactgctgtgctggagacgcgcggcagccacatgctgactgctgggggccttagggaggagagcgcagcggttaggggctgcagcctgcacgcccatcccgtaccccactgcccagtgcccgcagggggcagattctaccaccagacccgagcatcccatgaacatgatggtctcagtggggagctctcccggaaatgtggccttaagacataactcaggatccagtctagctgagagcaaaagtacaaatgcagaatgcggtcggaaatctgtctacatgtgagtcctaccttcttaatgtgagtcctaccttcttaatgtgagtcctaccttcttagttctacctacccacattaccattgtctatttggagagggaaatatatttcaaacggaattcctgtcttttgcttaagaattcctgtaaggaaactcttttaggttgttgaactgatgggcgctctggtggatgtcacagcacggccaggctccctgaggctcttccactccgtagcctgtggtctttttccttttttaatctcccacactacactgacatacatagcctgtgatcttgaacaaaatattggatcgccccgtgactcagtttacccatctgcaaaagggagatgataccagcacataatacaggatttaagtggattattggaaaatgggaacatgtttgaatatcctggatggacaggagagacatgtagtaatgtccctaactgaagagtgcccttgctacagcgtgtgcttctgcagtgtatgatttttttttttttaaatagacaggtataacttttcttatggaaaataacttttcttattgaaaataagcaaataggcgctgggcgtggtggctcacgcctgtaatcccagcactttgggaggccgaggtgggtggatcacctgaagtcagaagttcaagaccagcttggtcaacatggtgaaacatcatgtctactaagtatacaaaaattagccgggcgtggtagcgggcacctgtaatccccagctactcaggaggctgaggcaggagaatcgcttgaacccgggaggcagaggttgtagtgagacgagatcgcgccattgcactccagcctgggcaagagcaaaacttcattccaaaaaaaaaaaaaaaaaaagaaaagaaaagaaaagaagcaaataggcaggatgcgagcctgggattcaagcctgtaatcccagcactttaggaggctgaggtgggaggataccttgaggcgaaaagtttgagaccagcctgggcaacatatggatagcctgcctgtctctacaaaaacattaaaaaaaacaaaaaaaggaaagccaggtgtggtggagtgcgcctgtggtccctgctattcgggaggctgaggtgggaggactgcttgagcccaggagtttgaggttgcagtgagctttgatcatgccactgcactccagcttgggcgatagagtgagactctgactcaaaacatacagtacaatatcaaaatgagcaaataagtccaggcacagtggctcatgcctgtaatcctagcaatttgggaggttgaggtgggcagatcacctgaagtcaggagttcgacaccaacctggccaacatggtaaaaccccatctctaccaaaaaaaatacaaaaattagctgggcatggtggtgcatgtctgtagtctcagctagttggtaggctgagacgtgaaaatcgcttgaacccgggaggcagaggttgcagtgagctgagattatgccactgcactccagcctgggcaatagagtgagactctttctcaaaaacaaaaaaatgagccaataaataaagtggacaaagaacaccaattgttgccatcaccggtagggggtgaagtgctgaaggcagcatgggctccagagggaggatgtcctggagccctgtgggtttgcaaggagaccagctgaggcggagctgggatggagccagagaagcagagaggtgagagcagaggactgtcccggccagctgaggggactcaccactgtccagggctgctgggagagctgcaacgctgatcacaaatccatgggagatgattagaggttcctcagcacctggtaaagcaggagggcgatggagtcacactctacaggggaagatagccccaaaagcgacacaacttctctgaggctcgatttccacttctgtaggatgggatgtgcaacatttaacctcttagggctgtgagatgctgctgcaaacacctatgaagagggggcctgggaaagcattccttacacacatgcccccattactgttactgtccctgtgctgagctactgtttggagaggaggaacccctccccctggggagtctccccccagaggagacacccacaggccacctactcttccaatcccagtatctcacaggccaccctctggcctccaaccaccagccctttcgtggaccttaagaatgtcacataggtcgggtatggaggttcatgctggtaatcccagcactttgggaggccaaggcaggcagatcacctgaggttgggagtttgagaccagcctgaccaacatggagaaaccctatctctcctaaaaatacaaaattagccaggcgttgtggcacatgcctgtactagggaggctgaggcaggaaaatcacttgaacctgggaagcagaggttgtggtgagccgagatcatgccactgcactccagcctgggcaacaagggggaaactccgtctcaaaacagcaacaacaacaaaaatgtcacacatgtctcacagggtggaaggaacactgagccagcttcccgcattccaaggtcccaaagtgttcttctgtttgcacctgttgcatctgcaatgatctcaaggctgggtgactttggaagggaggagcctggaagttttctccttgctcctgcatcctttgctccttgcctgcccccttcccctgtccacatcgcccactgagagaagccagggtctaacttgtgagcagatctcctctctgcccatttccctcatcaggaggcaacaggggtgggtggaggatgcccagcagctctgtcaccagccgactccagatcccacagccactctgggaaaacctggaagacagggagagtagccactcatctgctctgcacatgatcaacgctcctccagtgccagtgggctgacgatggttggcttcctgccaatggggcgccgaaagagaagggaactcattttctgacttcaatgatcacaagtgctaggtgcttcaagtccacgcgatgacttaactcaacgggccctgaggtgggcacgatgatgtcaatttttcaggtgaaagactcaaggcttggagagacagcgagaaagctgggaccccaggactcctgttcctaagcttctggcacttctgatcccaggctgtgggcttctcccacctgtgattgctccctgcagagtgcaggaccctgctgctctggcccaaacacagttgtcctggccagctcagcccttccctgggtagggaggatcttgatcccaagccaaggtatttgttacctgtgttccagggaagccagaggtcttcttaagtgactcacacactacaggaactgctatgagatcctattactgaaactcaagaactaggaaggtggttgaatcatcctacgccacagagtctccagaagaccagttcctagctgagagcattctgataggagccttacgttcagcacagtagacatttgggccaaggttttgacattaggaagaacaagtcaggcaggccctgtgataggtacttctgtcttcatgattaaatgctatcatcccaagtccctgggaggcagaaatgaccatacctctctgttttaattgaagcagtggggctcagagacatgaatatccagtaagaaggaggaagggcaggggcttaaatccaagagccagccgggtacggtaactcatgcctgtaattagggcactttgggaggctgaggcgggtgaattgcttgggcccagaagctcaagaccagcctgggcaacatggccaaaccccatctctactaaaaatacaaaaattagcccagtgcagtggcgcggacctgtagtcccaactactcaggaggctgaggtgggaggattgcttgagcctaggaggcacaggttgcagtgagcagagactgtgtgactgcactccagcctggaaaacggagaaagaccctgtctcaaaaataaataaataataaataaataaataggccgggtgtgcggtgactcacgcctgtaaacccagcacttcgggaggctgaggcgggtggatcacctaaggtcaggaatttgagactagcctgaccaacatggtgaaaccccgtctctactaaaaatataaaaatagccaggcatgatggcaggcacctgtagtcccagctactcgggaggctgaggcaggagaattgcttgaatccaggaggtggaggttgcagtgagccaagatcacaccactgcactccagcctgggtgacagagcgagactccgtctcaaaaagtaaataaataaataaacaaacaaacatacataaatacatcgaagaaccagactctcactgcagggctctgtggtgggtgtcgcagtcctgagcctttgtccagtgccctttcccatcctggaaggcctatctcccccttgaaagtcttcccttgatgaggggcacatatttattatatgtttactttttggaaaagttaacacataggtgttgtataaaattctaagccacgcatggtggctcacgcctgtaatcccagcactttgggaggctgaggcgggcagatcactagaggtcagtagatcgagaccagcctgaccaacatgacaaaaccctactaaaaatacaaaaattagccgggtgtggtggtgagtgcctgtagtcccaggtacttgggaagctgaggcaggagaatcatttgaacccgggagatggaggttgcagtgagctgagattgcgccactgtactccagcctgggcgacagagcgagactccatctcaaaaacaaaacaaacaaacaaaaaaactcaaggtaaagatgagggcattgccagctcatgtttcatatgtgaagacaggaaaagaggccacaccccctgggcagacacagccccacaccagagcacaaggccagtcaggcagaagaaagtgacgtttcctatctctcatgccctctccagccttccaacctcagaggcaattctgctttaaatttccaacaagtaattaatggtgatgatggtgatgatgatgatgaaaatgatcatattttttcaggaggagggtggaactaaaaagtacaagaggccataaagggaatagaaagttctgtttcttgttttggtacccaggaggagcaccctaagcagtggtccttcttaagtcacagaaactttttttgacattaactctttttaaaatttatttttgtcaaaacactacacatagcttgagaaaggataaaatatgcctggaggccaggcacggtggctcgtgcctgtaatcctagcactttgggaggccaaggtgggaggatctcttgagcccaggagttcaaggttgcagtgagttatatcattctactgctcaccagcttgggcaacagagtgtgaccctctttcttaaaaaaaatcaaaaacctaaaaccagagcaaaacactccagctcacagctgaagctcacagctcacagctgaagtactgagagtacatttcctttcttgttttttcttgtttcccttagttttccttggggctaattgcattagatattagaaacgttgaaagaaaaatttaaaagatgtgaaaagtagaacaaaaaacataaatgacagataaaggttggaaaatagagaagagataagatcagcaaaagattcatccaggaaagccagtgctcaggatcccgatcctggcagagctgacaatcaagttggggacactgaagacacatctggctatgtgacggtcaagggacctgatggtgtcccagtggatggcctggacatccagccgcgggagggtcatgctggtcctggctgcatccttatctcctggattccagcaaagtccccacctggcctcccttcagtccatcttgtacagttgcccccagaggtgcctacaccacacatctgatcctgtcattctccttttcagtaaccttcagctttccagccttatctcccatatcccaggcttcagatggccgggaataatcagtgttcatcaaacaagctccatctctcccaactccctcacccatgctatgagtgcgcagccctgactcccactgggaggcatttcagcctcgcctgcagccacctcctctgtgcctgtcaaggcatgccccactctgccctgcattgtactttgctttcccttcttgcctgtgagcaacccggaactttggattgtggtttttcgcaagcgaacacctgttctccggtgactagtgtgaggatcagcactgcacaggtgcactggacatgcttggttctgtccactcagtacccgtttttccttctgataacagtctctaggcttttccctggggaatcaccctcacccactcaaaagtgcatgtggctcagatggggctgatccaccactcccggctcctaagggtcatgtgtcccaagacagacccacctctatattccacacactgaccctgcccccccagcccacacagaactattggcctaggaatgggacatctgctcaactgcaattctggagttttgttgatcacaagggaagaggaaactgcctaggtttaaaatcaacaacagaagagaactcagcagagaaagttcacaggcaagctgacagcaccatctaagcatttggatccagttgtgcaaggcttacccatggacccctcagctgagggaagcattcactttctgcttaagtccttgggagatgagtttctgtcacttacacccaagagtggtgattagatagtgacagtgaaacccttggtggggtgaggtgggaagggtgcaggggcagagcttctgggggctggccctgcgttgtttctctctgacagtgctaattacatgggtgtgttcagtttgtgaaagttcaccaagctgtactttcattatatgtactctgaagaatggcatacttcaataaaaagtaaagaatcctgactgaagaagatagtaagagtcatgtcaaggaatgtcccaaacaacaaatgagtagaggacatgaacaaatacttgccattgcactcagatactctgtggtccacatccagagggaggaattccccagtagcccacatggctttctgccgagcaccttaaagtcacaggatcttctaaacatcccttaccatttcttggcctggcctgagagacctaggaaggagctatggttctgcctgatttgcaaataggaaaagcaagacattgaccaaggatggttttccatagcagggttgagctggagcccaggagtcctggctctctgggcagcactcacttccagccaagctctgcctaccctcgacacagcagctccaggccgggagtggtggctcacacctgtaataccagcattttgggaggctgaggcaggtggctcacctgaggtcaggagtttgggacaagcctgaccaacacggtgaaaccccatctctactaaaaatacaaaaatttggccaggcgtggtggctcacgcctgtaatcatagcacttgggaggctgagtagggtggatcacaaggtcaagagatcgacatcttcttggctaacacagtgaaaccctgtctctactaaaaatacaaaaaattagccgggcgtggtggcgggcacctgtagtcccagctactcaggaggctgaggtgggagaatggcgtgaatctgggaggcagagcttgcagtgagctgagatcgtgccactgcactccagcctgggtgacagacagagtgagactccgtcccccctaaaaaaaaaaaaaaaaaaaaaaagagaaaaaatacaaaaattagccaggtgtggtggtgggcacctgtaatcccagctactcgggaggcggagtcaggagaatcgctggaacccaggaggcagaggttgcagtgagctcagatcatgccactgcactctagcctggcaacagagtaacactccacctcaaaaaacaaacaaacaaacaaaaccaaaacaacaacaagacacagcagctcttcttgttaccagcctgttccagccctgttcatagaatctaagggaacaaaatgtaacactaggtatagatcccaggtttagatttctctgtttagagttggctggaggtcatccctgttcgagaatcccaaagccacctgggcacggtggctcatgtctataatcccagcactttgggaggccgaggcaggtggatcacctgaggtcaggagtttgagaccagcctggccaacatggtgaaacctcgtctctactaaaaatacaaaaattagccaccatggtggcaggtgcctatttgtaaccccagctactccagaggctgaggcaggagaattgtttgagtctgggaggtggaggttgcagtgagcagagatcatgagccattgcattccagcctgggcaacaagagcaaagccccgtcacaaggagaaaaaaaaaaaaaaaagaatcccaaaggctggaaaaaacatacccaatgaggagtcagtggccttgaggcatcaagagctacaactggggccaaactgctctagtggagccctgggcatttggaagggggaaggctaacaaggagcaaaagaaagaggaagaaagaagagagaagaaaacagaaaatgagacaaaacataaagcagggaacataaaacataaaacaggccaggtgcggtggctcatgcctgtaatcccagcactttgggaggccaaggtgggtggatcacatgaggtctgtaatgggaggctgaggcaggagaatcgcttgaacccgggaggtggaggttgcagtgagcctagatcacgccattgcactccagcctgggcaacaagagtgaaacttcgtctcaaagaaaaacaaaaccaaaaacaaaacataaaacataaagatggaaggtgagtgttcatggggggcaggaacaaggaacccctgcaaacatcatctatgagggtttcctacatgcccagtctttcccatccattttctgatttgatcctcacagcaaccctatgacatggacctgatgatcatccctattttatagatgaggaaagtgaggtgtagaaaaattaagggaggcagggcatggtgactgatgcctgtaatcacagcactttgggaggccgaggcgggcggattacctgaggtcaggagttcaagaccagcctggacaacatgacgaaaccccaactgtactaaaaatacaaaaattagctaggcgtggtggtgcatgcctgtaatcccagctactcgtgaagatgaggcagaagaatcgcttgagcccaggaggcggaggttgcagtgagccgagattgtgccactgcactccagcctgggcaacaaagcaagactctgtctcaaaaaaaaaaaaaaaaaaaaagaaaaaagaaaagggacttgcgggaagaattcacacagtggctgctgagtcagagttggaagtctagcagtgtaaccttggagctcttcgctacatagtgtcaagtggaaaacagaagtaacaaagctgacatacatatatacatttctcccatctgtgtgtgttcttagatgtgcatgtatttttcacacagttggctgggtgttaaaaatacacgaatatcaaagaacactcacagatgggagaaaacagttgcaaatcatgtctacagaatgggacttgtacccagaatataagaagagctcttacaactcaacacaaaataggcaaatatcctatttagttttttaagaataagcatatttaagaaatataagaataaataaatttaagaatgaataaagaaaaaaattaaaatgagtaaaggatttgggagaagtttctctgaagaagatacacaaatggaaagatgctcaaccaggcgcagtggcccatgcctgtaatcccagcactttgggaggccgaggtgtgtggatcacctgaggtcaggagttcgagaccagcctggccaacatggtgaaaccccgtctctactaaaaataccaaaaactagccaggcgtggtggcaggcacctgtaatcccagctactcggcggggagggagaatcgcttgaacccgggaggcagaggttgcagtgagccaaggttgtgccattgcattctagcctggggaacaagagcgagactttgcctcaaaaaaaaaaaaaaaaaaaaaaaggccgggcacagtggctcacgcctgtaatcccagcactttgggaggccaaggctggtggatcacctgaggtcgggagttcgagaccagcctgaccaacatggagaaattccgtctctactaagaatacaaaattagccaggcatggtggcgcatgcctgtaaacccagctactcgggaggctgaggcaggagaatcacttgaacctgggaggcagaggttgtggtgagccgagatcgcaccattgcactccagcctgggcaacaagagtgaaactccgtctcaaaaaaaaaggaaagatgcttaacatttttaggcagcggggaaatgcaaattaaaccacagtgacaagtcactttccatccaccaagaaggttacaatcttaaaaaggtaattataataaataatatataattacaagtgttggtgagatgacagagacgtggggatcctcataaaatggggatgtcagatggtgcatttcctgaagaaacaatttggtggtttctcgaaaggttgaatagagtgaccatatgatacagcagatccactcctgggtacacaccctagagaactgaacatacaagcccacatgaaaacctgctcatgaatttgcacagcagcattattcgtaatagccaaaaagtggagacatccctaatgtctatcagctgatgaatagataaacaaaatgtggtgtaaccacacagtagacaattatctgcaataaaaaagaataaagtactgatatatacaaagttcaatgtgaaaacactgaatatactataagccagtgaactgtacacttttaaaatataaactttgggccggacgcagtggctcacgcatgtaatcccagcactttggattaaatgggtggatcacctgaggtcaggaaggcagagtttgcagtgagctgaaatcaagccactgcactccagcttgggtgacaagagtgaaactccgtcttaaaaaaaaaaaaaaaaaaaaaaaaaatatatatatatatatatatatatatataaaatataatatacttatatataatatatataaactttaacatacatgaattctatctcaataaagccattatttaaaaaaatacaaagtatgggagatgcacactgaagtttggtgtttatttttctatggccagtttacaggtaatttttttttatttttattttttgagacggagtcttgctctgtcgcctaggctggagtgcagtggcacgatctcggcttactgcaaactctgcctcccaggttcatgccattctcctgcctcagcctcctgagtagctgggactacaggtgcccgacgccacgcctggctaattttttgtattttttagtagagaccgggtttcaccgtgttagccaggatggtctcgatctcctgacctcgtgatccgcctgcctcagtctcccaaagtgctgggattacaggcgtgagccaccgtgcccggctggtaatttattttcttattagtgctttgctgcattttccagatagtctacatcagacttttactacaatgataaaatcagaaatttctagttggttaaaggaggcttaggtggagtttgtctttgtccagctatcactgcagagagacaggtgcctgcaaaaccatctcccagctgacctgagtacccagttagccagagaagtccaggggcatgaattacccgctctgcactaaaaggtgtcagagctcccatgcacactctcaacaccaggactgtgggctgggccaggctgtggctgaagctgtgcctggcccccaagccctggccacatctgccaactctgccagtcctggtgatgcagctgcatggcatcccccagaggcagggggctgggactgcaaggcccagatgctgatggagaaaacagatctgccttcaaaatctactgggaaatgaattctaattagcctgggaaaggagcctcaagcctccctggctcagagccactgccctggggcatttcagagcagataagcagatagcaacacacaaacccttttccttggctgggagctttagggattctcacagggcacttcaaacagcacctgccttggtctaaattgtagtaccttacagctggaggccataaagtctgagggttccccacttcttctgtgcagcaacacacacagggtacggagtgggactgtgcttttagcacatttgcctgtttccctaagtattgacagagccctctcattacagagataatctggaatgttccctggtttattaaccatttattttaattaccttattttttaaaagtaaatcatacttccaaatctatgacagaaaaaggaagagactattttataggaaaataactcagggccgggcgcggtggctcacgcctgtaatcccagcactctgggaggccaagacaggcagatcaccttaggtcaggagttggagaccagcctggccaaacatggtgaaaccctgtctttactaaatacacaaaaagtagccaggtgtggtggcacgtgcttgtaatcctagctacccaggaggctgaggcaggagaatcactggagccaggagtccgaagctgcagtgagctgagatcacgccactgcactccagtctgggcgacagagagagactccatctcaaacaaaaacaaaaacaaaaaccaaaaccaaaaaacacatagtcaaatgcaacatgtggaccttgtgtggattctgatttgaaaaaaacatctgccaggagataccctagaggtaatcagatatatttcaatattgactaataggtgatagtgagaaattattattaatactattatcactacccagaacaatcttgttcatgtatttctggacccatttccccgcccaagacactagaagcagaatggtgtctgtctcattaaagacagtaggtatagagcactgaggttaagagtgtgaatcccacttgaccatttactgagcgatcttgtgcaagttacttccttctgtgcctgcttggttaaaaaaaaatctggaaggtcaggtgcggtggctcacacctgtaatcccagcactttgcgaggctgaggagggcggatcacgaggtcaggagtttgagaccagcctgaccaacatagtgaaaccccatctttactaaaaatacaaaaattagccgggcgtggtggcgggtgcctgtaatcccagctactcaggaatttgaggcaggagaatcgcttgaacctgggatgcggagaggttgcagtgagccgagattatgtcactttcactgcactccagcctcggtgacagagcgagactccgtatcaaaaaaaaaaaaaaaaatctgtaaagtgggggaaacaatataacccaactcatgggcttgattgaaagagtgagtgagtggatatttgtaaagcagaacaaagtctggcgcatagtgcacttatgagtatttgcttagcaatcttccttcctgggccacacttatattctatgaatccaagggaaagtctttgaatgaggaaaacccaaggacaatggctctaccagattcaggtgccccagtgccccagcaacagaatgtggcaggcacagacagggtccccacaagggcaaacaaaacagaagacgctggaaagtcatggctagaggcctggcttgtgttttttctgagatggagtctcgctgttgtccagactggagtgaagtaccgcaatctcagctcactgcaacctccgcctcctgggttcaagtgattcttctgcctcagcctcccaagtagctgggattacaggcactcaccaccatgcccagcttatttttgtatttttagtagagatggggtttcaccatgttggccaggctggtcttgaactcctgacctcaggtgatccacctgcctcggcctcccaaagtgctgggattacaggcgtgaaccactgcgactggccttagaagcttggcttctgaagccggattgggttcaaatcctgtctctactaccagtgaggggtgtgacttagagcaagtcactctctggctctctatactccagttgactctgtttgtagaacaaagccagaaaagttccggcctctcaggctggagaggagcccagccccagctcccggagcagcatagcaccctcagaggccctggtacttggcctactcgcttgtgggtttaagtcagccaactcctttctgctcttcaggcctcagttttcccatcctcaaaaatgggaaacttgactgccttgcctctgtgaaaaagggaggagaaaggaaagtcaacatttgctaggcacctgtcctgaggcccagagggcctgtcctgaagcccaagatgaagccgtcagaagcagtgacgcaggactccaattcccctgggtctggttccaaatcaacccgccaagctaccgtctctcaataattctatggaaaaagcccttggagagcttttgaaagtcatgtcctttgaaactcaagtatcgagacaaaaggggttctcccctcgcagtgaggattctcctgcgcagccgaagccccagcaagacacttccaaaccggcgccaacagcggcgatgccctttccacgttgctgatggaaaagccactcccagctcttcccgccaccccaggtccccggtgcaggacagaggagcgtccccagctgtgccaccagcccggcccccagccgacccgagtgtggggacatcccccgcggagaatgaagaaccaacgtaccccaaagcttggcggctctgcccgagctgcagcggcacggtgggggacgcctctctccctggactcagcaaaggctcccaaacgtcgtctcttccaaattccaccgcacagccagctctttctcttcactgggagggtccgcaggggctgacttgctccttaaggtcccaagactattaagcgacacccggtgaggccgggaaaggggctctaagaggcatggacgagagttggcggtgaccaagccactggaagctcctggagactcgaggtagaacgaatgtgggaacagggcaggagtcccagaatgggatgttgaggctgggggtgtcctggggctaccacagggaaggacccggcgcagagctccctctggaacccggcactgcggcccgcgccctctactccccgcgcgccggccggcaaccctcggcgctgcccggtgcagcccgcccgagcgcacacaat

SEQ ID NO: 386 - DNA, 5643 bp, Homo sapiens
gctaagaaattctttaattctctgactcctgaattctgtaataacttctgcctagaataaaaatggagaaagaataaggtgcaggttttggcccatagaaagcaaacaatacatgttttgagttaatttagtgttagcaacttgagagcagggaccagagccattcttttacacaaaacacaaaaatttagttcaatttttgtatatttcattgctatgtatcctgctgtcattcagtgaaattctgcttgtatttatatgctaaaaattgttggggaaaattactccttttggtagtaatcaaaaccaattcaatgtgcactatggtataatgtttaagtggaaagtagtaatctcaataatttctctgaaaatcaactccaagtttcaagcagccaaggatgaatgatggctgcactccatatattaatcaaaataatcattaaagaaaataaagaacatatatttaaaagattccatcatattgacagaacaagcatttacagcacttagcagaatatgtagttcatatattttcccttaagtgttttttcttatgggtttttaattttttaaatttattttggggatttttaatagatgatgtattcaaatgatttaaaaattaaaaccatgtaacaaggtacacacgaagaagcctttcttccaagcttgtcactatttcttccatatatccttcctttcatgcgcgtccctgtgaagagaccaccaaacaggctttgtgtgagcaacatggctgtttatttcacctgggtgcaggcgggctcagtcctaaaagagagtcagtgaagggagataagggtggggccgtttgataggatttgggtaggtaaaggaaaattacagtcaaagggggtttgttctctggcgggtaggagtgggggtcgcaaggtgctcagtgggggtgctttttgagccaggatgagccaggaaaaggactttcacaaggtaatgtcatcacttaaggcaaggaccggccatttacacttctgttgtggtggaatgtcatcagttaaggtggggcagggcatattcacttcttttgtgattcttcagttacttccggccatctggtcgtatccgtgcaagtcacaggggatgcgatggcttggcttgggctcagaggcctgacattcctgccttcttaataagaaaaataaaacaaaatagtgttgaagtgttgggacggtgaaaatttttgggggggtggtatggagagagaatggacgatgtttctcagggctgcttcaagcgggatcaggggcagtgtgggaacctagagtgggagagattaagctgaaggaagatttgtggtaaggggtgatattgttgggttgttagaagaaacatttgttgtatagaatgattggtgatggcctggatacggttttgtatgaactgaaaaactaaatggaataagaaggagaaaaacaggtataaaaggtctaagaattgggaggacctaggacatctgattagagagtgcctaaggagattcagcatagtcctgccagcaaagattatttatttacttcaagagttaagagtagcggtttggggatagcacaaggagatatcagctgtgatggcttggagaaacagtgtaaactggcagtgtaaacaagagcagggcatgtatgagtagttgagaacggagaataggagtatgactagacagaaaatagtagggatgacaagttttttttggggcacagtctaagttggtctgatgtctggaatgagactgcggcctaataaaaaggagcatctatacaggagcttaaatgggctgtaccttgtagcattccgaggacaggcctgaattctgagaagggaaagtgataaaagtattgtccagtcctttttggtggctgagcttggtgaggtgtgtttttaaaagaccttagtccattctacttttcttgaagatggaggactgtaagggatataaaggtttcactgaatactaacagcctgaaaaactgcttggctgatttgactaataaaggcttatctgttatcagactgtattgaggtgggaaggctaaactgaggaattatgtctgacagaacggaagaaatgactgcggaggccttctcagaccctgtaggaaaggcctttacttattcagtgaaagtgtctatttagactaagaggtattttagtttcctgactcgggcatgttgagtaaagctaatttgccagtcctgggtgggggcaaatccttgagcttgatgtgtagggaagggagggggcctgaataatccctgaggagtagtagaatagcagatggaacactgggaagttatttccttgaggatagatttccatgatggaaaggaaatgagaggttctgagaggcgggctagtggcttgtactatagcatagcctgcctttgctggtatgtggcgattaggcctggtggaactgccatcaataaatcaagtgtgatcagggtgaggaacaggaaagaaggaaatatggggaaatggggtgaatatcaggtggatcagagagatacaatcgtgggggtcaggtgtggtatcaggaataatgtgggaggccagattgaagtcccggccaggaacaacggtaattgtgggacttaagaaagagtgagtacagctgaaggagccggggagcagaaagtatatgcgtcaggtatgaggaagaaaatagattttggaagttatgagaaatgtagagagtgagttgagcgtagtttgtgatttttagggcctctaaaagtattaaagcagcggcagcctctgtacgcagacctgagggctaggctaaaacagtaaggtcaagttgtttggacagaaaggctacagggttcagtcctggctcttgtttaagaattctgaccgcacgaaccatgcctaggaaggaaaggagttgttgttttgtaagggattgaggtttgggagattaatcggacacgatcagcagggaaagcatgtgtgtttttaggagaattatgccgaaataggtaacagatgaggatgaaatttgggcttgactgaagtaatgggggctgtctgtgaagccttgtggcagtacagcccaggtaatttgctgagcctaatcggtgtcagggtcaatccaagtgaaagcgaaaacaggttgggatgaagggtgcaaaggaatagtaaagaaagcatgtttgagatctagaacagaataatgggtagtagagggaggtattgaggataggagagtatatgggtttggcaccatggggtggataggcaaaacaatttggttgataaagcgcagattctgaactaacttgtaaggcttgtctggttttaggacaggtaaaatggggaaatggtaaggagagtttataggctttaaaaggccatgctgtagcaggctagtgttaacaggctttaatcctttcaaagcgtgctgtgggatgggatattgccgttgagcggggtaagggtgattaggttttaatgggatggtaatgggcatgtgatcagttgccagggaaggagtagagatgtcctatacttgtgggttaaggtggggggatatgagaggaagactcgaaggaggctttgggttggggagaagggcggcaatgagatgtggctgtagtccaggaagagtcagggaagcagataatttggttaaaatatctcggcctaataagggaactgggcaggtggagataactaaaaaagagtgcataaaagcgtgttgtctaagttggcaccagagtggggggagttttaagaggtttagaagcctggctgtcaatacccacaacagttatggaggcaagggaaacagacccttgaaaagaaggtaatgtggagtgggtagcctccgtattgattaagaaggggacgggcttaccctccactgtgagttacctaaagctcggcgtccgtgatggtctacggggcttctgaggcgatcgggcagcatcagtcttcagccggtaagccaagaaggagtcagtcagagagccctgggccagagttccaggagctctgggagtggctgccaggtgagttgaacagtccgattttcagtggggtcccacacagatgggacgtggcttaggaggaatcctgggctgcgggcgttccttggcccagtggccagatttccggcatgtgtaacaagttcctgggggagaaggttctggaggaacgcctggctgctacagttcaggcgtttggaagttcttgtgtgctggagatgtggctggggtttgtctcacagtggtggcaaggaattgcaacttttttctgttattgcacaccttgaaggtgaggttaattaagtcctgttgtggggtttgagggccagattccagtttttggagttttatttaatgtcgggagcagattgggtaataaaatgtatattgagaataagacggcctttagaccttttagggcctagggctgtaaagtgtctcagggttgctgccaaacaagtcatgaactgggctggatttttatatttgatgaaaaagagcctaaacactatctgatttgggataaagaaaaaggagcattaaccttgactatgcctttagctccagccacctttttaagaataaattgctgggcaggtgggggagtgctagtcacggaatgaaactgtaagccggaacaggtgtgaggaggggaggcgataaaaagattatagggtggaggagtggaggctgaggaagaattgggacctagctcagcctgtcgaggaggggagaggtcagatgggtctgtagaaaaggaagattagaaagactcagcgacacttggggttggtactgaggggacaggcgggagggaaagaaagaagatttgggaggagttgcactgggcacagagactaggaggggactgatgtgtaaaagaatgcctggacgtcaggcacctcagaccatttgcccattttacaacaagaattatttagatcttgcaggatggaaaaattgaaagtgccgttttctggctatttggaactactgtcgagtttgtattggggtcaagcggcattgcagaagaaaataagacgcttagattttaggtcaggtgagaattgaagaggttttaagttcttaagaatacaggctaagggagaagaaggaggaatggaaggtggaagcatagtgaaggaggcaagcccagagaaaagagtagagacatggagaaggggtggggttttcttcccctccagaaaagcagagaaagagttggggcacggaaataagggattggggtgcagagataagagattggggcgtggaaataagggattggggcacagagataagaggttggggcgtggaaataagcgattggggggttcttgccccctaggaaagcgggacttgccactaagggtgaaggagaaggggttgaggggtacttgcccctgccccaggaaagcgagacttgccaccaagggtgaaggaccaagtcaggcatccctgcgtggtctgacatccttgaaacgtgagtgtataatcagagaggtgtccctgaaatgattaaacaccaagggaaggctgccttcccagtccgtgaccggcaccggagttttgggttcacggataaaacatgtctcttttgtctctaccagaaaatgaaag

SEQ ID NO: 387 - DNA, 6760 bp, Homo sapiens
gaagctctcctcgcggggcgggccggccggccgcacccccggcctggggcctccggtcgtagtaaagcgcaggcgggcggggaggcgggagcaggagcccgcggccggccagccgaagatggtggcggctactcctcctggtgagtctgcccgcccctccggcgacggagggaaacctgttgtgtgcggcccgggtctggcgggcggggcggagcggcccggggcggactggcccggggcagcgtggcggcggcggcgtggccggggcgggtctcggccgttggccgccccggcgtgtggcagccgcatctggctgccccctcgctcgcccgcgggccggcggaggggggcagggccggggcgggagggtgggagggggcggcgtgcgcgtggcggccgcgcccgggacccgcgcagaccctgcctgggccgacccgaaggcgggtgggcggacggcgaacacaatggcccctcggggagaggacgtgcgaggcccgtgccttctccggggcccggggcgcgcgcggggcgtggggtctctgggtaggaaagtttctcccgagggcgagagttaaagcgcctccagaacaaagcggcggcggcggcggcacatggggcaggccgcgggccgggagggggcgcgcccacgaggtacctgcgcgccagcgggcggcgtggcgtgggcgggagcccgcggttccccaaactttgtacgcgcgagggtgggcggaggggcgccgagatcggcgcggcctgggcgccacccccgctccgcgtgggctttgttagcccgcgtgggcagcctcggggcggggcccgcaacttccccgccgtggccctcggaggaggccgcagtcggcctcagccgcggcgtggagccgcctgcgcccggccgcttgctgggagtgtggcgcgggagggccagcccggctcggcgggagcggcgtccccgccgccatgttcctgcggggcgggctgcacgggggtgagggcgggggacatggcggcgactgcgcgccgccgccgattgttcccggcttaggcctcgggccgcgtgcgacgggcaccgcggccgcggagcccccgcccctctgggccgggctcgggggggctgggggacacaaaggaggggcggcgcgcccgcgtccccgccgcactcgggcctcggcgccgccggtcgccgcgcggctgccgccgggaaacgggttgggggggttgccgcgtccggcggggcctgactctgacccgccgccccctggcggctacgcggagaatcgcagggccgcgctcccccttgtgcgacatgtgctgccggcccgggctccatgagcgtggcgggcactttgcagtctcgggtgttcctgcccggtcttctgttcctaaactgcagcaaagggaaaaggaactgaaaaaggcaggctcgtcgttgcaatatcaccaaaagagaaaattaacggcatgccatcaggaccacagcagttggagaaacaactctttatcccggcttgcagccacgaggtcttgattgggggaggggtggtgaagaatagtctgtgggctgctttttttttttccttttactggagctgtacagtggagtcggtgattgctgctgatcataatcaagtattttaggagcttatttagacatgtatctgatagctaaggatttttcaactttattctcttacgtatttttcaactgtaaattattgggcttttaaatcctgctagtattgctcgactcttactctcacaaatggatggaattaattgctgttaggaggttggaaaatagcaaatatagatttggacggtggtagtaattttgagcaaataatgttttatcttttttttccttatttttccctattccagtcatacacgtggacctaactgcaccagtagcttttctgagaatacttgctgaaaaggaagttttctggaatgggtaagtgtattctgattttcttgaacttttcttaaaaacaaatttttcttgctattaaagttgaataaataggattggtttcttagagagtaaaagtaggtgtttctttctttagacaatgtaccttttctgaaaaactaactcattaagtacggatttgctaattttaaggtagtaaaattacagtgtaaatattcctgtacatttttggaaactggcttatgcagtttacgaaatataattttagaccctcttttaagttgggtgataaagtagatataacctgagatgatagatttaaacaggatatttacgttctgctacaattgactgataacacttgaagtgtagtctgaacagtaattttgttaatcatttcaacaagtatttgctaagtggaagccagaagaggaggaaaatgttttgccacgtggatgtgaagatttcctctaaaaggtacacatggactaaattgcctttaaatgttccaaaattagttctcatttatttgcagtctcattttgttttgttttttttctctatgtgtcaatccatttgggagaggccagccattggaagagccaccacttccagtgctagttggatggttggttatgattgccttctgtaaagaattcttaaggcataaatacgtgtctaaatggacctcatatctttgagataattaaactaattttttcttccccattagggattatgctgaatttgtatggtttatagttgttagagtttgaggtgttaattctaattatctatttcaaatttagcaggaaaaaagagaacatcaccttgtaaaactgaagattgtgaccagtcagaataatgtcaaagtgcttacagtgcaggtagtgatatgtgcatctactgcagtgaaggcacttgtagcattatggtgacagctgcctcgggaagccaagttgggctttaaagtgcagggcctgctgatgttgagtgctttttgttctaaggtgcatctagtgcagatagtgaagtagattagcatctactgccctaagtgctccttctggcataagaagttatgtattcatccaataattcaagccaagcaagtatataggtgttttaatagtttttgtttgcagtcctctgttagttttgcatagttgcactacaagaagaatgtagttgtgcaaatctatgcaaaactgatggtggcctgctatttccttcaaatgaatgatttttactaattttgtgtacttttattgtgtcgatgtagaatctgcctggtctatctgatgtgacagcttctgtagcactaaagtgcttatagtgcaggtagtgtttagttatctactgcattatgagcacttaaagtactgctagctgtagaactccagcttcggcctgtcgcccaatcaaactgtcctgttactgaacactgttctatggttagttttgcaggtttgcatccagctgtgtgatattctgctgtgcaaatccatgcaaaactgactgtggtagtgaaaagtctgtagaaaagtaagggaaactcaaacccctttctacacaggttgggatcggttgcaatgctgtgtttctgtatggtattgcacttgtcccggcctgttgagtttggtggggattgtgaccagaagattttgaaaattaaatattactgaagatttcgacttccactgttaaatgtacaagatacatgaaatattaaagaaaatgtgtaactttttgtgtaaatacatcttgtcttgttttcattcaaaaacatttcacttttggggttgcgtgtcagatttggcagtataaattctggctatattttttgttgttagatttatttggctgttaagtattgcgatatgactaaacatactgtatacctgatgatcatctgtaaagttagagtatatctttttgctttctttggagttagtgttattccaggatattttacttaatctaaaagttaatttatgttgctcatatattactcaagtatttaaatttagagagaatgccgctctgtttaaagcaatgtgtaaagatgagtttttttaagcatggaatttagggttggggtacaatttgtttctattaagcaagtaccagtttaccaatacatgagtaactgaagtgtaactgttaaatgcttgtatactagtttttctttctgattgtcagtgatttataagctataaatgaccaaggtcctcagactgcttttagcatctgcaacttaaaaaaatgggagttagaaaaagaacaaatgctaaatagagtaacagttaaatgtatgtgtacactcttcccaaatgccaagagtgcagcggtggggtgagattcagatattcatttatttctaagtctgtagttaacatttatgttccctactccctacgtaagccagactttggcaacagtgatagttgattccaggcttatttgacttaaagtcactgaagtggaaactaagaagtggcagttagtgttttacccagcatttctgccttctctcttttcttcatgtgtttttgtctctagcctatgtgtatttgtgtagaataatgtgggatacctgaataatagatttaaaaggaccaagtggtaaaattgggcccaagctgaagtacaggcaaacttgatgtttgaaagataagttttgagaaatgtcattgtattttggagtaaaagaggctatcttagtaataagaaataaacttccataacactaggttagaccacccaataaatctagaaatcagcttttaaaaatattgtctgaagtctaacaaaagttttcacctctaatgtgttctttaagaaatttaaggaacttagccttggattcctgaatagaaaggtaagaattctatcattctggagttgatgaaaacataaattttcaggatgtgaaatgaacagtgatttataaaatggaaatcaaattgtacattagcagagttcttaagctttttgaattgaaggagacctaataattgtgtctttttggttatttagtgacaaacgtggctttcaaactatgcttaaaaagttccggctggacacggtggctcacacctataatcctagcacttggggaggctgaggcagacggattacctgaggtcaggagttcgagaccaacctggccgacatggtgaaacgctgtctctactaaaaatataaaaaattagccgggtgcagtggcgtgcacctgtaatcccagctactctggaggctgaggcaggagaatcacctgaacctgggaggtggaggtttcagtgagctgagatcctgccactgcactccagcctgggcgcaagaccaagacttaaacgcaaaaaaaaaaaaaaaaaaaaaaaaaaagtttcataatacagcatggtctggtagtttgcaaaatggtgtgcttttggggagatacactagcaatttttttaaaaactggaacagtgtgataggaagcctgctggatgatttcttaaatattctaaaatgtaagtcaaatatgttttaataacaaagacttaaatggcttttctccctagagactgaaactagtattcattgtgttcagaacttaattgggcttgaactgagatttaaatctaataaacaagttaataaatgtgtatgttttgttgtgggtttggtagtgatctgtggttctatagggtttaataggaattgcttttgatttgtttctggctttagaatgtgaggcaaattttacattcttggttctattaagattttcttaggcatgctaacatgccaacaaaaagccatgtaagtattgtataaaaagattcacattgttaatttagccattttgaaattcagatgagtgagcaagttgataatggcctcatctctgacctgagaaaaaacaactttgacccttgttcttaaaatgctttaaccttgaagttgcttgagacttaagaggtcatgttgctttaggtttaataaatagccttaactatttggaggggaaaaaatgggtcaacttttttttttttttttggcgtttgcatgtacaactttctatttttagcctatatttggaaagaaagcacttaacattttaggaattctttttaaagctgcttgcaaagtgttggtgattttactgaaaacttttgagatcttcattttacaggcagacctgtctaactacaagccagacttgggttttctcctgtagtttgaagacacactgactcctgacaaaatgcagcctgcaacttcctggagaacaactcagtgtcacattaaagtttattatgtatttaatgatacactgtttaattgacagttttgcatagtttgtctaactttagagaattaagagcctctcaactgagcagtaaaggtaaggagagctcaatctgcacagagccagtttttagtgtttgatggaaataagatcatcatgcccacttgagacttcagattattctttagcttagtggttgtatgagttacatcttattaaagtcgaaattaatgtagttttctgccttgataacatttcatatgtggtattagttttaaagggtcattaggaaaatgcacatattccatgaattttaagacccatagaaaagttgaagaatgcttaattttcttatccagtaatgtaaacacagagacagaacattgagatgtgcctagttctgtatttacagtttggtctggctgtttgagttctagcgcatttaatgttaataaataaaatactgcattttaaagctgttaagaaattgtccagaacgagaatattgaaataaaaacttcaaggttatt

SEQ ID NO: 388 - DNA, 5821 bp, Homo sapiens
ttcaagagaagaaatgtttattatctcacaatttctttgggtcagaaatacaggtgtggtttagctgaatgctttctggctgaaggtgtttcaggacgttacagtcatgccaccagctggggctgccaactcatctgaaggctcaacacagggggaccggagtccaagctccctcacatggtcaccagcaggattcagttcctcgaaggctgtcatttagaggcctccctccgtccctccttacaggtccttctcacagggcacttcgtgacatggcagctgactttctggggaccatccaagtgagaaagagcccttagaaagaagtgacagtctttatataacctaatctcagaagtgacaactcatcccttctacaaggttctattattcaaaattgcatctgtaaatccagctcactcaagggaaagggattactaggagataggggtcactgggggccattctagaggctccctgtcacagcatccaagctgagacctacagaatgacaggagttcaccaggcagggaggcaggagggagttgggggacggcaggtgcagtgaaccatggttgtaactcagtatggctgcacagagagcactgcctgagggtgagcagtgctgtggagaggccagcagggcccagaacttgtaccatcttttaacccaggtttgtaagggtggactttatcctgcaagcatgaagatcctaaagcttgaggctaacggttaagatttggctttagaaagattacactgctggcccagctcagtggctcacgcctgtaatcccagcattttgggaggctgaggtgggcggatcacctgaggtcaggagttcgagaccagcctggccaacatggtgaaaccctggttctcctaaaaatacaaaaaaattagctgggcatggtggtgggtgcttgtaatcccagctatgcgggaggctgaggcaggagaatcgcctgaacccgggaggtggaggaggttgcagtgagccaagatggcaccgctgcactccagcctgggtgacagagtgagactgtatctgaaagaaaggaaagggaaaaaaaagaaagaaaaaaaaaagaaaagaaaagaaggaaggttatcactgctgtggggagaatggattgaagagagtaaaagagcagaggaaggccagctggcgggtgcggcaggtggggggattgaactgaggtgctggagaggctgaatggctggcagcagcgctgctgcagagctggcgtccctgggtgtaggaactgactgcttatgtccgtcttcctcctctggaacataagctcaatgaggacagggattcttgtttgtagtctctggtatccccagcgtttaggacagtggcactagatgaatgactaggacaccccaaggtttctggcttgagtaactgggtggagctattctctaagctgtgaggcacagagggcaaacatggacagaaacttaatatttgagaaatactgagtttgaggtgctttgtaggccatctgagaataaatgcctcgtaggcagttgacatgcggggatctggaaagcctcttaaagaaatggtgagagatggagacttgaaaatccaagcacctagacgcccgtgatgggagtagttaacatggccctgggaccctttcccagagtttctaggacaccttacgcagcaacagtgcttgctttgaaagatagtaaaggaagaaagtcttgccaattgtcattcacaaaagaaagtcaaaaatatgttgccagagaggacaggagaaagccaggaatcacgggaagccagaagagagcttcgagtactatgagaacagcacagtaggttaggtaaggactgaaaggaggccggtgagttgaagcccactgtgggtggggaggaaggagaaaaggaatgttttccagaaatgcaaagcattacttaatatttattttattttatttttttgagatggagtctggctctgttgcccaggctggagtgcagtggcacgatctctgctcactgcaacctctgcctcccgggttcaagtgattctcctgcctcagcctccagagtagctgggattacaggcgcccaccaacatggctggctaatttttgtatttttagtagagatggggtttcaccgtattagccaggctggtctcgaactcctgaccttgtgatccacctgcctcagcctcccaaagtgctgggattacaggcgtgagccaccatacccggcctattttatattatatttattttattttatattttttgctctgttgctcaggccgaagtgcagtggtacaatcatggctcactacagcctccacctcctgattctcaagcaatcctcccaccccagcctcccagagtgctgagattacaggtgtgagccaccacacctggcctccattacttaaaaatgttttaaaggctggacacagtggctcacgcctctaatcccagcactttgggaggctgaggcaggaggatcacctgcagtcaggagtttgagagcagcctggccagcatggtgaaaccccgtctctactaaaaaatacaaaaattagctgggcgtggtggtgggtgcctgtaaacccagctacttgggaggctgagtctggagaattgtttgaacctgggaggcagaggttgcaatgagtggagatcatgccattgcactccagcctgggcaacagagtgaaactccgcctcaaaaaaaaaaaaaattaaaactgtcacttccaaacaccattaaaaaacaaagtgcctgattcggccgtacatgtactaaaattggaacactggaacggtaacagagaagattagcatggctcctgcacaaagatgacacgcaaattcatcaagcattccttttttttttttttttggagacagtgtttcactcctatcaccaaggctggactacagtggcgtgatctcagctcactgcaacctccacctcccgggctcaatggattcttctgcctcagcctctggagtagctgggactataggcatgcaccactgtgcccggctaatttttgtatttttggtagagacggggtttcactatgttacccaggctggtttcaaactactgagctcaagcgatccacccgcctcagtctcctaaagtgctgggattacaggcgcgagccactgtgcccagcctcatactttttatattcattttgaaaaaaaccaaacatacaaaatatagataagcatttagatcacaagttccccaaactggtctttgtagcagcaatttaggaatcacctgggtggtttttaaaaatacatattctgccgggcacggtggctcactttgggaggccgaggcgggcggatcatgaggtcaggagatcgagaccatcctggccaacacggtgaaaccccatctctactaaaaatacaaaaaaattagccgggcatggtggcgggcgcctgtaatcccagctactcgggagactgaggcaggagaatgtcatgaatccaggaggcagagcttgcagtgagcggagatcgagccactgcactccagcctgggcgacaagtgagactctgtctcaaaaaaacaaaacaaaacaaaaaaaaaccagattctgggtttgccccaattccataaaattaacctctcaagggtgaagcaggagaaactattttttaatgtgccaagtgactttgaagtgtgacaagctttttaaacattttatttggagttttctgcttttattatttttaattgacacataataattgtatatatttatgcggtaccatgtgagattttgatataggcatacaatgtgtaatgatctaatcagggtaattaacatatccatcacctcaaagagttttgacatcactcatttaaacctctaagaaatacttttcagctgggcgcagtagctcacgcctgtaaccccagcactttgggaggccgaggcgggtggatcacctgaggtcaggagttcgaaaccagcctgaccaacatggagaaaccccatctctactaaaaatacaaaattagccaggcatggtggcacatgcctgtaagcccagctactcgaaaggctgaggcaggagaatcacttgaacccgggaggcagaggttgcggtgagccgagattgcgccattgcactccagcctgggcaacaagagcaaaactccttggccgggtgcggtggctcacgcctgtaatcccagcactttgggagaccgaggcgggcggatcacctgaggtcaggagttcgagaccagcctgaccaacacggtgaaaccccatctctactaaaaatacaaaattagccggtcatggtggcacatgcctgtaatcccagctacttgggaggctgaggcaggaaaattgcttgaacccgggaggcggaggttgcagtgagctgagatcgcaccactgcactctagcctgggtgacagagcgagactccatctcaaaaacaaaacaaaacagaaaacaagagcaaaactccgtctcaaaaaaaaaaaaagaaatactcatttttctttgactttaagcccttttagaataaataaagcggtacaaaatattcatagattactaaactgttagaagccaattgttaaatttaagactttaatagggaacttaaagcaatcaagaaaataaactctccacaaagttttaaaaaacaactataaaatacatcctgtaggccgggtacagtggctcaatcccagcactttgggagaccgaggcaggcggatcacctgaggtcaggagttcgagaccagcttgaccaatatggagaaatcccttctctactaaaaatacaaaattagccaggtgtggtggcgcatgcctgtaatcccagctactcgggaagctgaggcaggagaatcacttgaacccaggagatggaggttgcggtgagctgagattgtaccactgcattccagcctgggcaacaagagcgaaattctgtctcaaaaaaaaaaaaaaaaaatcctgtaggtttgttatcaagaaaatgctgatgactataattaggattataaatttagttgagagtgagagctagattagtaaataaaattgtctataaacatttgtaaatcagtcatcctcctgggtacggtttgtaaaagaacccagtgcttaagtgaagagcagggacagctcctggctctggatgggggagaagtcttccttgtttcatagtcaaggaaagctcccagctgaccatcaccctcttctcttggaaaacgccacacctaccttcttgccattcctagagcgattttccagcctgagtggtatgactgcttccatttcctcgccactcttgtttgtccctggcagttcactttgattctcaaaagtccattaaaaccccttccaggtcctccgggatccctggccatgtaagctctgccaccaacagcagcctttctagtacaaagtctctagagctttccacagcctctggcttggtctctccctctccaggctggccacaggcccccagggacctatctgccatctcttggaaatatctttctaaattccccactccccctcctgcctttccacgactttgagttgcaatagtttgcccagttccccttttccttgtagtctttaaagataagtccacaggtttttcatttgtttataagatttactctccatcaggaaatgaaaataaacatagggaagctgataagtcacagctccccacccccagccgttgttccggggaagcctctctagcaaggctcagatgtttccatcttaaggttaaatcacaccaaacaatagaagccctttg

SEQ ID NO: 389 - DNA, 1505 bp, Homo sapiens
aatcccagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcattgtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaggagacggtgcgcaaagccatggaagctgtggctgcccagggcaaggccaagaagtgaaggccggcggggaagatactgtccccaggagcaccctccctgcccatcttgtccctctgcccctcccacctgcacatgtcacactgaccacatctgtagacatcttgagttgtagctgcagatggggaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataaataatacaaaacaataacccttctggggtttcttgtggcggttgaaatagtcccacatgtggtcatcagaaaataagccattcctcataccaatataggatcagctccttgacctctga
